United States Patent 6,812,339 (POLYMORPHISMS IN KNOWN GENES ASSOCIATED WITH HUMAN DISEASE, METHODS OF DETECTION AND USES THEREOF) - sequence listing, part 61

SEQ ID NO: 15896 - DNA, 76472 bp, Human
  misc_feature (1)...(76472): n = A,T,C or G
acataactgaactcaatctccagccttcctcttcttctcagaggttgagctggctcaaaagtctcaactctgtagtcacatggttggtcttttggtggtcagtctcccattttcaagataacaaggcccaccataagtgacctcattagcataacaaagacacttctatcattcaggaaattccaagggctttggaagctccaagccaggaacccaggacaaagaccaaattttaaaaaataaaacatactgtattttagagttaggattttttaaaaggtcaattcagatgacatttatggctattcataaaaatctgtcttctggttgtgaaaataatatttacatattattctgtttcttactctgcaacaaaaattacagttgctatctcacattctgtaactaatatttattttgtatttaggtattcccagttccaagatgaatacagtttagatgaagtgatggcatctaaagaagtttttgattttttgactatcttacaatgttggtaagaaaaatatattttaacatttaatgagggaagtaactgctgcccttcctgccacccccctgtggttaaaccttaggctctgcatctgggcggagctttcacagaactcctcccagtgccgtccccactctgggtcacttcactagagtaccctacttcttactcctgcctggagacagactgtctcttctcttggaaaatgatgtgttttacttcttcttgcaggacttctacctactttggtgattgcaattgtatttattcattaaactgtggcttgggggccagtggagcccaaagcattttgttttccctgctatgtacttctactacaggaaattctactctataatagtagctatgagtaaaagtaaaacaaggaaaaattcatagctctaatgatgataacagttgtttcttgcaaagtgcttgacagtatctgtctcctagaaaattgagtgagtactgcttagctcctgcctgtgtcctagttaacacctggctgtgccctgtagatacaggctgggatggaaagaaataagtcgggtcagcttttatttgttgtgatatgagggtctgcccatttagaaagtctaactgaactcccagaagacttcttgtgtttgctaccttccatcacagtttgctgtaagaaaaagatctgtttaagatctcgagagtcttaactaaagcagatggttttgtattcccaagctatcttttcccagtttccaaaaggatttcaggactgagttatttggagatagcaaagttggagctggggcggtctgtagtagaatctttattgtattaggataggaataaccttttggacttactcctcagaagatgccttatgcatctccagaggcaaattggtaattctttgcaataagaactttttggggctgggcgtggtagctcacgcctgtaatcccagcacattggaaggccgaggcgggcggatcacctgaggttgggagttcgagaccaacctgaccaacatggagaaactccgtctctactaaaaatacaaaattagccaggcgtggtagcgcatgcctgtaatctcagctactcaggaggctgaggcagaagaatcacttgaaccggggaggaggaggttgcagttgcaatgagccaagataacaccattatactccagcctaggcaacaagagcgaaactccatctcaaaaaaaaaaaaaagaactttttgggactcttagattccaagtagtgattgacaacatttaagttcttgatagaggttcagtcctcaggtgggaagcatgtgtgatttacaactgtagatatcacaaagaagacaatccactgaccagcaagcatatttggcctttcctttcacatagaagtaactcctagtctgaaatcctccgatcaggtgctactgggtgtggagaattatttttacttcctcttagtcccacttcagatggtgctgcagcagcaattttggccagtgaagcatttgtacagaagtatggcctgcaatccaaagctgtggaaattttggcacaagaaatgatgactgatttgccaagctcgtttgaagaaaaaagcattattaaaatggtatgtctgagattctatttgttatttttatttttaagatggagtctcatgattcttgtgatggagccatgcattattatataataacttttaattaactagacatgctatttgtcattattttaagttgactatgcctagaactccaatcttacagagttaagggaaaaatgattgttttgttttgttgttctttcttttcttttctttctttcaacagggtcttactctgtcactcaggctgcagtgcagtagtgcgatctcagcttactatagcttccacatcccaggctcaatcaatcctcccacttcagcctcccaagtggctgggactacaggcacatgccacgactgccggctaatgtttgtattttttgtagagacacagttttgccatgtttcccaggctggtcttgaattcctggctcaagtgatccacctgcctcagccttccaaaatgctgggattacaggcgtgaatcaccacacactgccacaaagatgattttaatgaactttcttgaccctcagcactttaaaaattctgaataaagattgagtacaaaatggaaaaagtaaaaaagatgaaaattcagacctagagttagttgaatatttgaagacatacacacaatacacaaaattgcatgctaaattatagtttacaaatgattttacaacaacactgtgaactggaaaatgtttttgtaactgcccaagatcacagttaggttgtggcagaggtggaatttatatttaggtttcctggttatagtacatttttcattataccacagttttatttctttttctttttctctttgagacaggatcttgctttgttgcccaggctggagcgtggtggtgcgatcatagctcactgcaacctctgcctcctagtctcaagcaatcctcccacttcagcctctcgagaaagtgggactacaggcatgtgccaccacatctggctaagtttttgtattttttttttttttgtaaagacacgattttgccatgttacccaggctggtcttgaactcctggactcaagcgattcacctgcctcggcctcccaaagtgccaaagtgctgggattacaggcatgagccaccacgcctggcctcaccgttttattccttgaagaaaagttattttattatttgaggagaaaaacatgttaagaacatggactttggaaaaatggtttgaatcctagatgatcttctaaaagaagattgtgtcattttatatagaaattctcccatatttttcagtgtatctgactcataatgatctggtaataaatgtcttcaacttgtttatcacaactatacattgtagtttgacagaagttttgtaacttagcacaagatatgctctgaggaattctaggtcctttttatatattttatttaaaaattctgtcattttttagtacaaaattgaatatgtacatccttctcctagatgttattttatttagactttctgtgtaatatagaatcaattgactgaccctccttccctccctccctcccttccttcctccctttctttccctttccctttcctctctttctttcttttcttcttttcttcttctcttctttttttgtttcttttttgagacaggatcttgctctttcatccaggctggaattcagtggggtgatcctggttccctgcagccttgacctcctgtgctcaaacgatcctcccagctcagcctcccaagtatctgggaccacaggcacatactaccacgccaggctaatttttaaattatttgtagagacaggatcttccattgttgcccaggctggtctcaaactcctgggctcaagcgatcctcctgcctcagcttcccaaagtgcttggattataggcatgagccaatgcacctgggcaaaaatttaatatatgtggtcaattatcagttgttaaggttatgcatctattaatctcttaaaatacttgtttaaaaggcccagttttggtgccctttatttatatatggttttggttttaggttggctttgatatgagtaaagaagctgcaagaaaatgctatgagaaatctggcctgacaccaaatgatattgacgtaatagaacttcacgattgcttttctaccaacgaactccttacttatgaagcactgggactctgtccagaaggtaacatctttgaatagggcagattaattcagtaaatttcactgagaaaacttcactttgaccgttagataaaagaattcactattcacttttcccttaacgttggctctgccacactgtgggaaatgaatgtaagctgttttggtagtggacgttttagaacttgtggtattaggcagtaccaacactaagatgatggagtgtccagataatttgtattatgattatattatttgtctggaaggctcttttatctgaccaaaatagctactccatctttcttatgcttattctttgcatgagattttattcatttgctttcaacctatttatgttaatttatttaaagtgtatctcttataggcagcatgtaagcaataatttttttttgttttttcgtttttctgagacggagactctctctgtagcccaggctggagtgcagtggtgcaatctcagctcaatgcaacctccacctcctgggttcaagtgattctcctgcctcagcctcctgtgtagccgggattacaggcacctgccaacacgcccggctaatttttgtatttttagtagagacagggtttcaccatgttggccaggctcatctcaaactcctgacctcaggtgatccacccacctaggcttcctaaagtgctggaattataggcgtgagccactgcgcccagccgtgataatgtattttttaaaatctactttgttgatttctgccttttaactggagtgtcgaaacctgtgctgataatgacagccactagctatactttagtctttgaaatgtagctagtccaaattgacgtgtgctgtaagtgtgaagtacacatggagttttggagacttaatattgaaaaatagaatgtaaagtatttcattaataatttttttttttttttgagacagagtctcgctttgtcacccaggctggagtgcaatggtgtgatctcggctcattgcaacttctgcctcctgggttcaagcagttcttgtgcctcagcctcccgagtattacaggtgtgcatgctaccatgcccagctaatttttgtaattttagtagagacagggtttcaccatgttgcgcgggctgttctcaaactcctggcttcaagtgatccacccgcctcagcctcccaaagtgctggggttgcaagcatgagccacctggctcactgataatttctttatgttgattacatgttgaatgaaaatattttatatatatataaaatgtatatattaaataaaatatatactagaaaatttaaaagtattgtgtgggcattatatttctgttagacaatatttatttagataattaatgtaattattgatacagtaggatttaggttggtcatttaattatctgttttctatttgtcccctgtaatttttgttcctctgtgcccctcctcttgacttcttttgcattatttaaatatttttagtatgccatttcaacttatcgattgtttttttcaccatatctctttgttttttcttctttgtttatcccagtggttgctatagagcatggtttatcaaccttggcactattgacatttgagctctatcattcttgtgatacagcttgtgcatggtaggatattcagcaatatccctgcctcttacctactaaatgccagtagcaccaccccccacagttgtaacaaccataaaatgtcttcaaatattgtcaaatgtcttctggggggtaaaatctctcccagttggcagggcgcggtggctcaggcctataatcccagcactttgggaggccaaggcgggcagataacgaggtcaggagatcgagaccatcctggctaacacggtgaaaccccctctctactaaaaatacaaaaaattagccgggcatggtgttgggcacctgtagtcccaactacttgggaggctgaggcaggagaatggcgtgaacctgggaggcggagcttgcagggagctgatatcataccactgcactccagcctgggtgacagagcgagactccatctcaaaaaaacaaaaaaacaaaaaactcttccagttgagaaccactgcgataagaattatagtatgcctccttaagcgtctcctttgagttaatattgtaccacttcacataaaatgtagaagccttgcaaccatataggtccattcactgactcccctttgccgtacactgtcccttatgttataattgtcatatgtgttatatctatttacattgaaaaccccaatatataatattataagttttgctttcaacagtcatacacttagatgtctgttatatgtcatgggtaaaaatgtcacacataattttaaagatactaagagggaaaaagtattttatacttatccagatatttatcattttttgttgctcttcattcttgaacacccaagtttttctctgtaatcattttctttagcctaaggaactttttgtagcattttttataaagcagatcttttggagatgaattctcttagttttccttcaactgaaaatgtctttgcttaaccttaattcctaaaggaactctgggctgattatagaattctaggttgacaggtcttttagcacttaaaacatgttgtttcagtcttctgaccgccatagtttctaacgaggagtcatggtcattcaaattgttgtttctctgtatgtgatgggccatttttctctagctattctcaagatttttagcagtttgattgtgtaatgtctaggcatggttttcttttaatttattctctgttgtgttttctgagtttcttaagtctgaaaatgcaaaacttttaccaaatttggcaagttttcagccattatttctttaaatgtatgttctgtcccaattttttcctcctcttcttctggacttccaatgatgcatatattagacctttggatattgtcccataggtccctgaaactgttcactttgaatccccttttctctctgttcttcacatttgataatttatgttgatatatctttaaattcactgactcttccttcatgttctttctactcatgaaccattctaatgagttttctatttcaaatattgtattttcagttctaaaatttccatttggttcattttatagtttctatttctctgctgagagcttacatctttttgttcatttctagtgggctttctttaccttgtagttctaacagctgttttaaagtctttaataattccataatctgggctttcttgggttttgcatctgttgattgtcttttaccttgagagtattggttacattttctgattctttgtatagcaaacaattttggattgtatcctggacagggtgaatgtcctattatatagatcctttggagaatgttgatgtttttgttttagcaagcatttaagccagtatgttctgacaataagttctgtcttgccttctgagggtggtggttaaagtctttgctcagctctctaaatgtatgcctacgtcagagtaagcctgagacttgtacaggtctatacacagaattaggggatcctcttctctggctctctccactatagacttcttcccttactctccagcctgcagagatttcttttcctagttcctttggttaggaagatggggtttctgttagagttttagctacctttgctgtttctgctgccatgctgttccagggctgtgctcaaccttggggcaaagctgttgagagagagagagcctaaaaagaaaaaaagacaaccaggacctcacccttatgcagtggcttctccaagttttgacttgctctataatccccctgcttttatttacttttcagagtcctcaggcagttttttttatttttatttttatatccagtgttttcagttgtaatcaatgcaagagataaactgtagtgaacatattctgcctaatatggaacttaatctaaaagttaaatattttatgtagatacagatataaaatgattactttcttttttttttttttctttgagatggagtttctctcttgttgcccaggctggagtgcagtggcgctatctcagctcaccacaacctccgctacctgggttcaagtgattctcctgcctcagcctcccgagtagctgggattgcaggcatgcgccaccatgcccagctaattttgtatttttagtagagacggggtttcaccatgttggccaggctggtctcgaactcctgacctcaggtgatctgcccgccttggcctcccaaagtgctgggattataggtgtgagccaccacacccagcttttcttctttttttttttttccgagacagttttgctcttgctgcccaggctggagtacaatggtgagatctcagctcactgcaacctccccttctcaggttcaggcgattctcctgcctcagcctcccgagtagctgggattacaggggtacaccaccacgcccggctaatttttgcatattttttagtagagacgggatttcaccatgttggtcaggctggtctcgaactcctgacctcaggtgatccacccaccccagcctcccaaagtgctgggattacaggtgtgagccaccaggcctggccaaaatgattactttcaaacttatactccttgcttgaactgcttctccaacctctagactcaagaatccagctgcctactttttaggggtttctttggatgtctcataagcatctcaaacctaagtccaaaattgagctatggatatttttcaaactttctcctccctcagtcttccccatcctcctgttgcttaaactggaaaccatcaggcttgaattcttttctctctctcacaatcatcattaaatctatctctaagtcctgttggctatggactctaccttcaaaataaatccagaatatgaccacatctcaccacttttgtcactgccagcctagtgcagaacagcatcgtttctcatttatattattgttggagtcttatggctggtcccgtgcttctgccttgtctctccagactgaagctagaatgtgcagcaaatcagttcattaattcattcaaaacccagtagtttctcaactcactcagacgaacaagccaaatatgatctgtcctccttactccccactcccatctctgacttcctctgcttttctctgaatcttctactctgctgcagccacattggcttccttcttcaagcactggaagctcgctcctgtttcagggcctttgttccaaacatacatgatttgctctctcactcccttcaggtctttgactaatgtccttctcagtggaagccttctccgatcactttgtttgaaatataaaccactcacctccatcttccttgtctcaatgtgtcctataccctttccctgctttcttttttcccttggcatttatcaccactttacatatttctttacttattttatatattgtctgtcttttcctcacccctctccccacataacttaaactccatgatagtagggattttcgtttggttcactattgtatccataagttcctagtttagtttttggtacagaacaggtataataattgttttccaaaagcgtatgcatttgttttcctatctatgctaggggagagcgttcatttacagtactttaatctctgaatatttttagttgatgagttcaagataacttccctttggaatcttttaatactttacaagattgtatatattataggaaaagtgtagtgaattattcacttttaggggttagcttgtgtttagtttgctattacttgctacagaaacaatatttagcagtttgtaagtagcaatagtagatagatttatctcttatgactagagcctcagagcaatttccaaggtagaaacataccaaaaaataaaagagagaatgccttagccaatggttttatctataacctagatttaaagccaaattagaagtgtcagtcatctaaaatcctgtgattagtgtatttcattttaccaacagaggaacttttgtttttgaaggcaatataatatattagctgagaacacaggctgtggagccaggctccctgagtattaatcctagatctcttgctgttgccttggttgatttcttaatatctctgtctgttttctcatctaggaaatgagaatgatagcacctacttcataggattgaatattaaattttataaatagtcatcactcagtatctgtggggttttttttctaagacctcccacagataccaaaatccatggaagctgcttatataaaatggcataatttttgcatataacctatgcacaccctcctgtatattttaaataatctctagattacgtataataactacatatcacttcattcacatggattcaatgtagtactcagcacatacaaattgaagttttgctttttgtaatttttttcttctgtatatatatatatatatatatttttttttttttttttttgagacagagttttgctcttgtcgcccaggggtgcaccaccatgcctggctaatttttgtatttttagtagagatggggtttcaccatgttggccaggctggtctcgaactcctgacctcaggtgatctacctgcctcggcctcccaaagttctgggattacaggcatcagccatggtgccctgcctcttctgaatatttttgatttgtggatggttgaatccatgatgtggaacccatggatgctgactatatatacagaaaataattagaacaagagctgacccagagtgagtgctcaaagctattagctacctttgacagcattgccaccatcattactatcattatttggagcgtccacatcttattactttatcgtaaatagatgtggaagacaattttatacaatacatccatttttatttacttcttaagcatctggaagaatgaccaaatgaccaggaaattgacaggaacattgaagccaccaagcatgtgaagtaattttttctttaaccttacttttgtggctcaacagtgttttcagacatttctcttcattttatgaaagtgccttttttctcctgtttttccatatttattaaaaatacttatatagtatatagcagtacagatgaaaatagaaaagaacacattttggcaaaattatgcatttttaaagctgacagttattttagttatagcattatatccatttcagttctattctcctagttctctgaatctctaccatatttagagcaattttggaagtcagagagctctaaggaactaataggagcttttgtttcatacaggaaatgttctgaaaatgtaagtatttattacttttaaaagtgcttatgtcaaattattgttagtttgaactgttaagaaatatttgctccaagaaattcttggctatatggaaatcttataaaagcatatcatttgttctattgttactattaatatttgtgaatactattttttcttctataggacaaggtgcaacgctggttgatagaggagataatacatatggaggaaagtgggtcataaatcctagtggtggactgatttcaaagggacacccactaggcgctacaggtaatgctacatacagatttcatacattttaaaatcattttttccttaagtgtgaatgagttagtctttcatttgaatgaaagattatattctctgaacttggtagctggtgctttaaatgattgtttagcttcaatatttttgatgttccattaagtagagcacacttaaataatcttcattaattgatgagaatttgaattaattaaaactaaattcaggatgtttccaaatagagatcttactagacctgctaaataagaatcatttgaaatgagcatgttatttatatgtagttgtatacatggttgacattgcatggaaattattttctcttgagacaactggactagaatttataaagtaagaattttactatggctctgctgttgactggctggccgtgtgaaactatttttatcagtcaatcactttaacttttaattccttaattataaaatgacaaacttgtacaatgtggtttctgtttttttaaataaaaaattaagcccaaacctcaccatgcaattccttttttctttctttcttttctttttttttttttttgagatggagtctcgctctgttgcccaggctggaaagaagtggcacaatttcggctcattgcagcccctgcctcccgggttcaagccattctcctgccttagcctcctgagtagctgggactacaggcttgtgccaccatgcccagctaatttttgtatttttttttttagtagagatggagtttcaccatgttggccaggctggtcttgaactcctgacctcaagtgatccacctgcctcagcctcccagagtgctgggattaccggcatgggccacacacggccacaacatgcatttttaatatatcacagtctaccttcaaatagtgttatgccattttgtatataacgtaagatttttacagctgcctatctatttaccttctcctatcttttgtgttattgtttccatacacttattcctaagtatattataaccctcacaatatactattattattgttgctttaaacaatctaatatctttcaaagaaatctaagaattatggggatgatcagtgatgttatgggaagtggcaaaataacaacatccaaaaatcctgtcctttataaaagttcggagaactctggcaaaaattgtcaagatcaactttttccataactttaaaaattaaccagatttacaacaatctgttgggagtggaggtggggggtgcttaaaacaacaacaaagaacataatctctgtgagagcaacgagctttgtggcattttcacctgccttaacacctccctctttctgcagctccactgtagccttgaaaacctacagcttgcagtcatggtgaaaattagcagcctagctggcactgagcaagtcagaacagagttggagctctttcaaagccccttccttagagaactgtcattatatgacctgtctgacagtgtcctggtaaaccccacttgaaagctttgtctttatttcacctcactgaaaactcacccagtgcaaagagtattttccctagaggcaattgtcgagaaaaatcagccacaactgttcaacaaagtagctacctcaggtgccaattggggtaaacaacaaaataaccaaaaaaaaggaaaagttggggagtaggatgtccatagggggctttgaaaagatctgatatgttcctgagaatctagaagcctaatggcgtatataaggtcagagttgtgtgcatgctcaggaaagacctgagaaggtcctaagctcacctctggctaaacttggggctctgcacaagcaaaaggcaaaggctaaggtagaattgtaaactgcctggctgagtaccacattatgcaggtagaggtccagtaaagaccaggagactttttagttcagtcatttaaggacatctctgtccagtcagtagctgagggaagagaaaattcagtggccatgtgggacaaagattacagactttatagaattagcttggaaaagtcactaaataaacaaccacaacaataaacagcaacaacaacaacaacaaactgggaaagaggaggatttgatttttagagaagctacattatttaaaatgtccagttttcaacaaaaaaaaagaaagacatgcagataaacaataaagggtgacctatgtacctaggaaaaaaagcagtcaatagagactatccctgaggaagccaaaacattggacttactagacaaagactttaactagctattttaaatatattaaaggaaaccatatataaagaactaaaggaaagtatgagaacaatgtttctccaggtagagaatattaataaatagaaattataaaaaagacaaccaggcacggtgggtcaggagatcaagaccatcctggctaacgcagtgaaacaccgtctctactaaaaatacaaaaagttagccaggcgtggtggcgggcgcctgcagtcccagctacttgggaggctgaggcaggagaatggcgtgaacccgggaggcggagcttgcagtgagccgagatcatgccactgcactccagcctggacgacagagtgagactccgtctcaaaaaaaaaaaaaaaaaaaaaaaaaaattaaaggtataggtggagaagaagaaccatttaagaataatgagagggaatgctcagttagccaaggaaggagagtgtttcaaaagtaagagattaggccacaaaagttagatagataaagaatgaaaagtgtccttcagatttggctgttacaaagtcgttggcaatcttggagcaattttgaagaagtgttttgcatggaagcagatgagattcagaaagaattataagtgagaaagtggcaataatagtgcaggtacacttttagaaatagtggctatgaatggaaagtgatatatatgtaagggatgtacctgaattataggtacgtgttctgtatgaatgaagtcttgggtttgaacctagcctcttcactctctttagtatgtagcttagccagttaatcctagtttcttatctataaaatgggaatatagtacctaccttataaggctgttctgtggattaagtgaggaaatatatgtatgtaaagtatatagtagagtcccccaaaaagagtaggaacacaataacttccagaattcccttcccaactacaaaagggagccatgatggatctgcttaactggttcttgtttgtttgtttgccagtaataaacctcttgttttttttttcttttttcttttttttttccttgaaacggagtcttgctttgtcgcccaggctggagcgcagtagcgcgatcttggctcactgcaacctccgcctcccaggttcaagcgattcttctgcctcagcctcccaagtagccgggattatgggcatgtgccaccacgcccagctaatttttgtatttttagtggagacagggtttcaccaggttggtcaggctggtcttgaactcctgaccttgtgatctgcctgcctcggcctcccaaagtgctgggattacaggcatgaaccaccacgcccagcccaaacctcttgtttttatcacagtatgaaaaataatttttaaccatttttggaaaagaatgttctttaatttggtttttttttttgtgataacagatcaattttaattctagtacctgaagctatacaagggtatgctctataaacttcatgggactgttgtacacacttgataaagtgacaactgtgcaataccacttagcatctcaaaatcaggaacatactattgaattgcttaaacacaatccacagaattaaaaacaaaatcagatgccatccacagttatactaattatccattaaaagcttacacttaatacttgaaataacaatcaatatctagcagggaatactgaaagtgatttcagagtctcatcctgttgtactctattgggaaggtttcttgagtagttatgtgactggccaaagatgggtacaaccaagaccagaccagcaagtaaaagttctaccacagtttctgtagtttccacttgtttttctttgtcagttaaaagtgaacagtgagaattaaatacttatctttacatatacacaaggtatgctatgaaagcatatctgcttacaaacatataaaaatacttgttaactagtttgataagaaaataatgtataaaagtatatagcaaaaacattaatcatctctgaccctggaaagatcaattccatattttatattacaaacaaaaacagttttagttttttgaatcccttacccagaaatacttgaaaaggaagacagaagaaattattcctttttacccttagcgtggctgtgaaaaagagttaaattaaaaaaccaagtacactgaaatatctaagtcctaaatgagtccaaatatttgaccacgtagaatattaccatcttcaagagtaggagcagtaacacaggcttttatgagcagtttttaatccataaatacaataggcatttggtattttggccaccagaaaacaaaagttgtagtataagtaaaggtctgagatggttcacttttgtagattcaattcagtgtatttaaggttaacaaaggctgacattgaaatgtttaaagataggcaaaaattcacattaaaaaaaccctatatttctatttagagtaacagtaggcagtgtgattccaaaagttaaaaattatttcacaacctgtagcttcagcttggcaaacagcttagattccaaaactgattcatctctattaaaatgtaagcacttaaaaaaagagcatgtctgtgtatatagacatatattttaaaggaatcagataatctttgaagcagccttagtgtttcctttaagtttgtctggaaatgaccattgtattagcttcacagaaaggactagccagcttcttggtctaaggctaacatggtgatcatttgtctaaggctagaaaggtaccaacaagatgtaaactgaggagaggaagagaagatgagggcttttcctggcagttggtagctaaaactgaagggattctagaaaatgacacaatggcagcctttcttgtctttttctttccgtgttggttctggtgaaggaggacattcctgctcttgaaatttcctgataacccggacaagttcatggaaagcttgatctacattcatcctaatctttgctgatgcctccatgtatgttaccttaagttgccgtgctaactgccgtccttcttcctgtgttacctgtctttgatgatccagatctgctttattaccaattaaaatcattgggaactcatcacgatcctttactctgagaatctgtctttgaaacttatagatttcttcaaaactgcctctatctgtgactgaaaagaccaacaggaagccctcgccagtcctcatatactgttctctcatggctccaagctcttcttgtcctgctgtatccaaaatatctagccgggctgctctgtcatctatcacacactgctttgtgtaagaatcttcattggttggatcataatccgttacaaaataggactcccaacttaggaaacaaaacatttgtaatatgattgaagactcctgcatgcctcctcaataatattcccctctctcctcccccagcaccaagaggtaatcaatatcctgaatttggtatctgtcattctcatgcatttatacaacattagtaatcatatgatagtattcctaagctatgttttggagaggacaccactgcaaatcttcagccctatactagcttttatcggtagccatcaattgcagttttaatagaaatacaaatacatcaagtgtctgttctttaatttgtaaagaaaatttgttttctagcgtgacaccctcaaggtaccgtatctgtatgtaaatgttgtgcccaatgctacacagacattattttaaaactattttctgcctttggtaaatagactaaactgttttctttattcctcaaaagaattagatcatacttcagtgttgattttgttgctaatgggacatggagatgtctggatgataataaatattcctgtggtatggtcactgaagcctttaagagttatgctgtagtttgtgtgtaaagaagtgacttaaatcctcctttcagacagcttccttacgcatataggaaacctctgtttcattaggagatgaatatgatatttcattttagttgttcttgttgacatacaacttttttctcttctgaaatagcatgtttttattataatttgcttgattgccattattagatatttttgtcatgccatccactgaaatactcagaaatcatgctttatagtaacaatataatttttcatatctatatttgttattaaaatttagatctaatttttatacaataaaatgcacagttctgcctctcagaaccttcctgctgccacatttgcaccttgctgctctagcctctggggtgcattccatcctttcagcctgcaactagcagagaaaaaaagttacatattttcttgccccatgcataccttgaggcgagcaaaaaaattaaaataaattttaaccatgagggaaatcgtgcacatccaggcctgtcagtgtggcaaccggatgggtgccaagtgctgggatgtgatcagtgatgaacgtgaaatcgaccccaccagcacctaacatggggacagcgacctgcagctggactgtgtctccatgtactacagtgaagccatagatggcaaatatgttccttgtgctaacctggtggatctagaacctgggaccatggactctgctagctcaggcccttttggccaggtgcttaaaccagacaactttgtttttggtcaatctggggcaggcaacaactgggccaaaggccactacatagagggggccaagctggttgattcagttgtagatgtggtgcaggaggagtaagagagctgtgactgcctgcagggcttgcagctgacccactcaatgggctctggaatgggtactctctttatcagcaagatccgagaagagtgccctgattgcatcatgaacaccctcagtgtggtgcctccacccaaagtgtctgacaccgtggtcgagccctacaacatcaccctctccatccatcagtcggtagagaacactgatgagacctactgcattgacaatgaggccctctatgacatctgctcccgcactttgaagctgaccacaccaaactatggggacttgaaccaccttgtctcagccaccacaagcagtgttaccacctgtctccacttccctggccagctcaatgctgacctccgcaagttggcagtcaaactggtgcccttaccacatctccactacttcatggctggctttgccctctcaccagctgtggaagctagcagcatcgagctttcacagtgcccaaactcatcaggtaggatttcaatgccaagaacataatgagacccctgccacagcttatatctcaccgtggctgctgtctttgtggatggatgtccatgagcagttgctcaacgtgcagaaccagaacagcagctactttgtggagtggatccccaacaacatcaagacagctgtctgtgacatcccacctcatggcttcaagatggcggtcaccttaatcggcagcagcacggccatccaggagctcttcaggtgcatcttggagcagttcactgccatgttcccctggaaggccttcctccactggtacacagctgagggcatggatgagacgagagttcaacaaggctgagagcaacatgaacgacctcgtctctgagtatcagcagtaccaggatgccaccacagaagaggaggaggattttggtgaggaggctgaagaggaggcctaaggcagagcccccatcgcctcaggcttctcagttcccttagccatcttactcacctgccccttttctctacctcagaatttgtgtttgctgcctgaaacacaaatctagatctagaacagtgcttagcacgtagtaggcactcaataagtatttgtctgttgaatgtttcctttctctttccactctgggaagcctaggtttctgccactctgggtgaccctgtatttccttctggtgcccatcccttccatctgtccagttaatatttcctcctttttaaaatctccaagaagctgggtctcatccagatctcatttagaaccaactgggttttgaaagcccatgtggataatggccaccatcctaagcccaaagcgaaagatggtagaaggtggcaggtagaagtcactgcaaggaaggggatgggattttccatcctaaaagttttggagagggaaatccaggctattaaagtcataatttccaggtatttctattttccatttctcagcttcaagagaggtgttagcagtattttctccattttcagtctccctccaagctctgccctttggagaggtctgccccactctgtcaagtggaatctttccctctctggctctacctctctcatatattgaattcctccctttcccctgattagagaaggggatcaaggggggaaagagatcagccttggtccctaggcctccagaaatgccctcctaatctccaccttttcttaacccccaaaaaggattaacatccctgactttatgtgggatagtatatactgccacatcagtgtttgagtcattccccagagggaaggggaaccctcctccatcttttttgcaacatctcctatcttccttttgctgttgcttttttcccacttacacttggttttgttctatcctacactacagatttctattttgaacttgctgccttttttcatattgaaaatgtgacattgctccaagagccaaaaataaatgtgaattggaaaaaaaaatgcacagttctcacaaaaatgtgtacactgatgtttacagcagcattattcataatagtcaaaagctggaaacaagccagatgtctatcatcaactgatgagcaaaatgtggtatatttatttttatttttttagatttttttccagacagtctcactctgtccccgaggttagagtgcagtgatgcgatcttggctcattgcaacttctgcctccctggttcaagtgattctcctgcctcagcctcctgagtatgtgggattacaggcacctgccaccatgcccagctaatttttgtatttttagtagagacagggtttcattatgttggccaggctggtctcaaactcctgacctcaaatgatccaccctcctcggccttccagatgtgagccactgtgtccggccaaaatgtggtatatttatactatggaatattttttggccatgaaaggaatgaggtaccgaaatatgctacaatatagatgaaccttgaaaacatttttaaattccatttttatgacatgtccagaataggcaaatccatagagacagaaaatagattagtggttgcttaggactagggaacacaggagagagataactgaagggtatgtgtggagtttctttttgagatgatgaaaatgtcctaaaattgattgtggtgctagttgcacaactctgtgaatacactaaaaaccactgaattatatactttaaatcgataattgtttttgaaaattatatacatccaggtagcaaccagccaaaaccagatcaaaaacattttcattacccccaaaagttctagcctgtctatttccagtcaatcctctggcctccctgaaacatttctctctcactctccaccaccaccaggctgagatgtttgacttctctcgtgatagattagttttgctgatcctagaacttcatataaatggaatcatacagcacatgtatgtattcttttgtgtttggcttctttcactcagcagattataaaattaatacaagtttttctttttatcagtagttcttttttattgccaagtagtattctattgttgaaatatatcagtttgcttatccattgtcctgtggatggatatttgaattgtttcctgtttagggctgcatgaataaaattgctatgaatgtttgtatacaagtctatttggagacatatatttttatttatcttgggttgataacctggagcaaaatttctgggtcataggacagatctatatgagtaactgtcaaaaaggccaggtgcagtagctcacgcctgtaatcccagcactttgggaggctgaggtgggaggattgcttgaagccaggaatttgagaccggcctgggcagcaaagcaagactttgtctctacaaaatattaaaaaattaactgggagcaatagcatgcacctgtagtctcagctacccaagaggccgaggtagggggattgcttgagcccaggagtttgagaccggcctgggcaacatggtgaaaccccatctctacaaaaaatacaaaaattagtcaggcgtggtggcgcacgtctgtggtcccagctacctgtgtctgtccatacttttgcaggtatatccataggataaatttcaaacagtggaatcattgtgtcaaagggtagtatacatttaaaaatcagtgcagattgccaaattttcttcagaaaagattgttatcggcgtatatttccaacagcagagtatgagactgcctcttttccttcagtcttgttaatattggattttttcctcaaatgttaaaaattttgccagtcttgacaggtcatctgtttttcttccctgggtactgaacaggtaacctaaaacaccccaggaagatagaatttactcaatttttaaatattcaaagagagactcgcattcaaagagatacctcaggaaatctgcagtatcctttgataaccctttctaacatttgagtctacactgttggtaaatttttccttttatcattaatctttgagatattatgtctagtgatggtatagcattttttgggaaaaaaattatgaatcttgatgacttgagtggtagtctgaatagggatgaggaattattgaaaagtaaatgtttccttgctacatattgaggatttggatatacttcgaggaaatctggcacatggccattagctgtaatgtgccccaagacagaattcagacttattgaatttatatcacaatgacagttatgagtagcttaaacattttttctctagttacttggataacaaactgcaatagaattctaagagattcagaaaatggtcaagcgaagttccaaaatatgttaagactagtgatgagggtgtaagattctcttctgtaaatggtgttaatttaattgtaaggcagtgctactttggttgggaactcagtattggggaattagctttaaaaattaaagcttcatgatactggtttctgattttgtttagatctggatgaaagtttctacctgccataacagtatcaatagtaaaagaaaattgtagttttcagcatttgaattgagtattcttttgttcattgttagtttaaaaacattaattccttttagatttccattcaggaaaattacattaaacttgaactttttttgattactttgcagtgatcgtatgacaaaaaacacattagtgttcaggtaataatgtcatattttattccagttttcaaagtgcttttacatatactatccaacacttactgaacacttgtttttttttttttttttttgagacagagtcttactctgttgcccaggctggagtacagtggcatgatctcagctcattgcaacctctgcctcccaggttcaagtgattcttctgcctcaacctccggagtagctgggattacagggacctgtcaccatgcccggctaatttttgtatttttagtagagctggggtttcactatgttggccaggctggcctcgaactactgacctcaagtgatccaccttccaaagtgctgggattacaggcgtgagctgtcacacccggcctggtcacttgttttaaatgaataaatgttggacatggtggctcatgcccataatcccagcactttgtgaggccaaggcaggaggatagcttgaagccaggagtttgagaccagcctgggcaacaaagcgagaccctagtttctaccaaaaaaaaaaaaaaaaaagaaagaataagtaaaatttggctttagtttattcttagctatctctactttttaaaaaatccatattaatgtctgtaatctactgaaaggacatgaaagtgcctttgagataaagctcttgacaaaggattattgattgctttgaagctagaagtgggtttttttagtttggccttttgtcgtagttcagcctggccttttaggccttttagaaaggcctctgtgcctttccataggcttcaacctagtgttaggtcctgatcttctgttattcagtcaacatcagttcagtagtgacttattgtgcacccacctcatcattaggtactgtagggctgtgaaatacgaggtctactcatagaccaattcggagcctcctgaagcttttaaaagtatatgttcttgcctgagtgtggtggcttatgcctgtaatcccagcattttgggaggctgaggcgggcagatcgcttgagctcaggagttcgagaccaacctgggcaagatggtgaaaccctgtctctacaaaatgcaaaaattagccgggcctgatggtgcatacctgtagtcccagctactcgggagcctgaggtgggagggtagcttgagcccagtaggcagaggttgcagtgagctgagatcatgccactacactccaacctgtgtggtagagccagactttgtctccaaaaaaagaaaaaaattatatatatatattacatatgttctctctctctatatgtatgttcctgtcctacccttagacattttcttgggtctgggttggtcctaaacaatttatatttttttaaagttccgccagagcttctcatgcatagccagatttgagggctagggttaggatatacaaggtaactactagtctcaggaagtgtataagaggcagataatacaagaacacaaatacttatatatttaaataagtaattataatacaaggcagaatgtgctgtagaagaagtacaaagcagaagtatgaagaggagaaaaagggaaaggaggatggcagggtcatgaagatttgctaaatcccatcacatgcctggtgttttgccagcatttctatctacttgagttttggggaaggagatgcacaaagaggaagcatgtttaaaccaaactgtttgcttttaccaaacaggtttaattccttcttgcctatacaaactctacctttgttattttctcaataataatacactgttctaagtatacttcatgtacaagtgcattcaattttcatatcgatttttctcttttacaaaagaagaaaatagaggcatggagagtttaaatgatttgcatgaagtcatcaagctagagagtggcaaagctaagattcaaacacaggctatgtattcctagcgtccagggtcttaaccattatactgttcttcagtgtcctttcctcactggaaacgcccatcttcaagtgctctctcaaatgctatccaccttatgaagcttttcctgtttcactgattctttccatagattgaattaatctttcccttttctgaactcctatactttctcagtacttttcttttgacatttatgctcatagtatatattatcattatttataggctttaaaaaaatcttccctatttaggccgggtgcggtggctcatgcctgtaatcccagcactttgggaggccaagatgggtggatcatgaggtcaggagatcgagaccatcctggctaacatggtgaaaccccgtctctactaaaaattcaaaaaattagctgggtgtggtggcaggcgcctgtagtcccagctactcaggaggctgaggcaggagaatggcgtgagcctgggaggcggcggagcttgcagtgagccgagatcacgccactgcactccagcctgggtgacagagtgagactccgtctcaaaaaaaaaaaaaacaaagaaagaaaaaagaaaaaaatatcttccctatttaagagcctatgaagtcaggattcatatttcatttgtctctctaccttgaacagtgtgcaatacattgcatatttaaagggatagttgaatatattattgctcctttaacatctagaacgtggcatggagcaaagggaatacatttgtttaatgtgggaagaattaggatcattaggaagaattcattggaagttatattttggccggatacaagagaactttctaacatggcttctcaaaaatggaataggttgcctcctgagagcatgcatttacctgtcagagaggctgtgcacaaaaaatacatgtaacaacttgataggaatgttgtaaggagaattttgcccatctgttgggccttagatttgatgaattcatagatccttttcaattctattataagatgctctgatctcctgtgcgaagtaattatttctttttctgcattcacatagttcttgatgtttctaatgacacgtatattattattctatcctgtgatttttgtttacatgtttcagtacttttaaaggcattataaacttcttaggtcttaagaatttgggtgaaaatgatgtgagaagaagtggaattttaaccaagggaccgagcattttcaaatcaaaccatggcttatctcgtctactctgtaagaggttgccaaaataaatcctaggacgatgactggtaaggcctaaatccaatataaactcttaaaaagccagcaagtcagtaagagctaattagcttttcaccaaaatttcttttttacctttcatcatatcctccaggccacccatccttgtttccattgcccagagttttgcatttttaccactgcaatgtgaggagaggtaaattttatcattaaactctatctgtgccaggacaaatggagcccaggagatggtgtctactctagatacctgttgctagctagagataactaggagaaagccctgaatttctgtttctatttcttttctttttttatttttgaaaccaggatttcgctctgttgctctggctggagtgcagtggcatgatcatggctcattgtagcctcgatttcttgggctcaaatgattctactatctcagtctcccaagtagttgggactgcaggcacgcaccttcatacctggctaattttttacatttttggtagagacgggctttcgccatgttgcttaggctggtctcgaactcctgggataaagcaatctgcccatgttggctttccaaagtgctgagattataggcatgagccatcatgccttctttttctttttttgagatagagtcttcctctgttgcccaggctgaagtgcagtgcaaacatggtgcaaacatgcttactgcagtctctacttcctgggctcaagtgatcctcccgcctcagtctcccaagtagctgggaccacaggtgcacaccatcatgcccagctaattttattttattttttcttttgtagagatggggtctccctatgcttcccaggctggtctcaaactcctgggctcaagtggtcctctctccttggcctccccaaaagctgggattacaggcgtgagtcaccacacccagcccctttttctttcttcacaatttcacggatagaaaattcattgttactgtagatcttagcaacctcagcatgccatttttttcccttaaagttgggaacttccaccttttcatttaaaggaagcacttgtatgcacatctgaatcgccacttcactcctcttgcgctttggggccatcattaagtaaactaaggatgacttgaacacgagcagtacccatcacagtacccatcacagtcattctaataacaaagatagctactaactgactaacgggtgggtgggatgtaccacttggatatgctgggcaaagggatgattcacatcccaggtggggtggagctgaatggtgcgagattttatcatgctactcagaacagcatgcaacttaaaacttatgaattgtttatttctggcattttctattcaatatttttagactgtaatcgactgagggtaactgaaactgtggaaagtgaaaccatggatgtgagggcactactgtattttacttttttttgaaatatattttacatgtgatagataattttgtcaggcctctgagcccaagctaagccatcatatcccctgtgacctgcacgtatacatccagatggcctgaagcaactgaagatccacaaaagaagtgaaaatagtcagttcctgccttaactgatgacatgccaccattgtgatctgttcctgccccactctaactgatcaattgactttgtgacaatacatcctccccacccttgcgataatgtattttgtgatattcaccgcccttgtgaatgtactttgtagggtataccctccctgcctttaagaaggttccaagatggccaaataggagcagctccagtctacagctcccagcgtgagtgacgcagaagatgggtgatttctgcatttccaactgaggtaccaggttcatctcactggggcttgtcggacagtgggtgcagtccacggagtatgagctgaagcagggcagggcattgcctcacccgggaagtgcaagaggttggggaattccctttcctagccaagggaagccgtgacagatggtacctggaaaattgggacactcccaccctaatactgcgcttttccaatggtcttagcaaatggcacaccaggagattatatcccatgcctggcttggagggtcccacacccatggagcctcgcttgctgctagcacagcagtctgagattaaactgcaaggtgacagcgaggcttggggaggggcatccgcctttgctgaggcttgagtaggtaaacaaagtggctgggaagcttgaactgggtggagcccatcgcagctcaacgaggcccgcctgcctctgtagactccacttcttggggcagggcatagctgaacaaaaggcagcagaaacttctgcagacttaaacgtccctgtctgacagctttgaagagagtaatggttctcccagcatggagtttgagatctgagaatgaacagattgccttaagtgggtccctgacccccgagtagcctaactgggagacacctcccagtaggggctgaccaacacctcatacagccgggtgtccctctgagatgaagcatccaagggaaggatcaggcagcaacatttgctgttctgcaatatttggtgttctgcagtctccgctggtgatacccaggcaaacagggtctggagtggacctccagcaaactccaacagacctgcagctgagggtcctgactgttagaaggaaaattaacaaacagaaaggacattcacaccaaaaccccatctgtacgtcaccatcatcaaagaccaaaggtagataaatccacaaagatgaggagaaactagagcagaaaagctgaaaattctaaaaatcagagtgcctcttccctccaaaggagcacagctcctcaccagcaatggaacaaatttggacgcagagtgactttgatgagttgagagaagaaggcttcagatgatcggtaataacaaacttctctgagctaaaggaggatgttcaaacccatcgcaaagaagctaaaaaccttgaaaaaaagattagacgaatggctaattagaataaacagcatagagaagaccttaaatgacctgatggagctgaaaaccatggcacaagaactatgtgacacatgccaaagcttcagtagccgatttgatcaagtggaagaaagggtatcagtgattgaagatcaaatgaatgaaatgaagtgagaagagaagttcagagaaaaaagaataaaaagaaatgaacaaagcctccaagaaatatgggactatgtgaaaagaccaaatctacgtctgactggtgtacctgaaagtgagggggagaatggaaccaagttggaaaacactcttcaggatattatccaggagaacttccccaacctagcaaggcaggccaacattcaaattcaggaaatacatagaacgccacaaagatactcctcgagaagagcaactccaagacacgtaattgtcagattcactaaagttgaaatgaaggaaaaaatattaagggcagccacagagaaaggtcgggttacccacaaagggaagcccaacagactaacagcggatctctcggcagaaactctacaagccagaagagagtgggggccaatattcaacattcttaaagaaaagaattttcaacccaaaatttcatatccagccaaactaagcttcataagtgaaggagaaataaaatcctttacacacaggcaaatgctgagagattttgtcaccaccaggcctgccttacaagagctcctgaaggaagtactaaacatggaaaggaacaactggtaccagccactgaaaaaacatgccaaattgtaaagatcattgatgctaggaagaaactgcatcaactaatgagcaaaataaccagctaacatcataatgaccaggatcaaattcacacataacaatattaaccttaaatgtaaatgggctaaatgctccaattaaaagacacagactggcaaattggataaagagtcaagacccatcagtgtgctgtattcaggagacccatctcacgtgcagagacacacataggctcaaaataaagggatggaggaagatctaccaagcaaatggaaaacaaaaaaaagcaggggttgcaatcctagtctctgataaaacagactttaaaccgacaaagatcaaaagagacaaagaaggccattacataatgataaaagggatcaattcaacaaggaagagataactatcctaaatatatattcacccaatacaggagcacccggattcataaagcaagtccttagagacctacaaagagaattagactcccacacaataataatgggagactttaataccccactgtcaacattagatcaacgagagagaaagttaacaaggatatccaggacttgaactcagctctgcaccaagtggccttaatagacatctacagaactctccaccccaaatcaacagaatatatattcttctcagcaccacatcacacttattccaaaattgaccatgtagttggaagtaaagcactcctcagcaaatgtaaaagaacagaaattataacaaactgtctctcagaccatagtgcaatcaaactagaactcaggattaagaaactcactcaaaaccgctcaactacatggaaactgaacagcctgctcctgaatgactactgggtacataatgaaatgaaggaagaaataaagatgttctttgaagccaatgagaacaaagacacaacataccagaatctctgggaaacatttaaagcagtgtgtagagggaaatttatagcactaaatgtacacaaggagaaagcaggaaagatctaaaattgacaccctaacatcacaattaaaagaactagaggaagcaagagcaaacacattcaaaagctagcagaaggcaagaaataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaactcccattcacaattgcttcaagggaataaaatacctaggaatccaacttacaagggatgtgaaggaccccttcaaggagaactacaaaccactgctcaacgaaataaaagaggacacaaacaaatggaagaacattccatgctcatgggtaggaagaatgaatatcgtgaaaatggccgtactgcccaaggtaatttatagattcagtgccatccccatcaagttaccaatgaccttcttcacagaattggaaaaaactactttaaagttaatatgaaaccaaaaaagaggccgcattgccaagacaatcctaagccaaaagaacaaagctggaggcatcacgctacctgacttcaaactatactacaaggctacagtaaccaaaacagcatggtactggtatcaaaacagagatatagaccaatggaacagaacagagccctcagaaataataccacacatctacaaccatctgatctttgacaaacctgacaaaaacaagaaatgggggaaggattccctatttagtaaacggtgctgggaaaactggctagccatatgtagaaagctgaaactggatcccttccttacaccttatacaaaaattaattcaagatggattaaagacttaaatgttagacctaaaaccataaaaaccctagaagaaaacctaggcaataccattcaggccataggcatgggcaaggacttcatgactaaaacaccaaaagcaatggcaacaaaagccaaaattgacaaatgggatctaattaaactgaagagcttctgcacagcaaaagaaactaccatcagagtacacaggcaacctacagaatgggagaaaatttttgcaacctacctatctgagaaagggctaatatccagaatctacaaagaacttaaacaaatttacaagaaaaaatcaaacaaccccatcaaaaagcgggagaaggatatgaacagacactcctcaaaagaagatatttatgcagccaacagacacatgaaaaaatgctcatcatcactggccatcagagaaatgcaaatcaaaaccacaatgagataccatctcacaccagttagaatggtgatcattaaaaagtcaggaaacaacaggtgctggagaggatgtggagaactaggaacacttttacactgttggtgggactgtaaactagttcaaccattgtggaagacagtgtggcaattcctcagggatctagaactagaaatagcatttgacccagccatcccattactgggtatatacccaaaggattataaatcatgctgctataaagacacatgcacacgtatgtttattgtggcactattcacaatagcaaagacttggaaccaacccaaatgtccatcaatgatatagtggattaagaaaatgtggcacatatacaccacggaatactatgcagccataaaaaaggatgagttcatgtcctttgtagggacatggatgaagctggaaaccatcattctgagcaaactgtcggaaggacagaaaaccaaacaccacatgttctcactcataggtgggaattgaacaatgagaacacttggacacatggtggggaacatcacacactggggtctgtcgttgggtgggggaagggggaagggatagcattaggagatatacctaatataaatgacgagttaatgggtgcagcacaccaacatggcacatgtatatatatgtaacaaagctgcacattgtgcacatggaccctagaacttaaagtataacaataaaaaaaggtactttgtagtattctccctgcccttgagaatgtactttgtgagattcaccccctgcccacaaaaaattgctcctaactccaccatctctcccaaaacctataagaactaatgataatcccaccaccttttgctgactcctttttcagactcagcccgcctgcacccaggtgaaataaacagccttgttgctcacacaaagcctgttgggtggtctcttcacatggacgtgcgtgacaaattttatatcttttggagagaaaaactgctctattataaatatacattcttcagtgtatgctgagtctatgaaaactttttgctgtttgaagctcaacaagccttttcttcctcaaaaattcaggctctgatagtagaaaaccatgctttttaatgttgtttttggaaaagcatttaaatgtctaatttgaaactaaagccggattatgactttattgtacttggctgtcttgatagtataggaaggtttatacgttcaaggagaaggaggaaaagacctcagagaataactcaaaatgttatctcctatagcttttccattctgtgtctattcatagcacttaacgtccttatctttgttagcactttgcatttacattacactgtgaatcctctgttatctttaacatttggtagagtgtttgatacatgttcgaatggtttatttttagaagcaaccagattgtatacccttatgtatgtagctgagtcctaggtcagttactttcatgtaaaaaggttgaccaacatcttgttaggaaatgtttgcagcaagatgatgttttgtaaccagttggttggaagtacaggtggcttggacttgcatttggcatctgaagtatgaacagcctggtgggactcagccctcaacccatgggatctgacactatctccaggtaaatagtgttagaattgaaatgaattacagaatacctcatcggtatctgtaaaagaatcgatttgctatttgggggaagccctcacctttccgacatctagtcacagaagtgtgctgtgagtatgttgagtagaaaggaaaaacagcttgctttttctatttacatctagcttttaatttacatcaccgttagggcttagaaaacaatacaccaaaataaaagcctcagaagcaaaaatttttctctggccttctcctggcctcctgtctctcagtcccattctccccaccaaggccagccgtagaaactagaatccctcttcctcaaggcagatcatgaaagccataaccccttttccccaaagccagtcataaaacctagaatactactataacttcccttcacctttctgtgtaaaaactagccataaagaaattatctgacctatcttgtttgactgggggtcataagacccccattccagaaagggacctgccccacgcccagaaggaaggaatgcgtgctcagagaggccaagaagaacctagatggacaggcctggctgggtttccccactcagtctattagcattagatcatatgctttttgtccaatcatatttctatagggctgttccatactttgttgaacttaagcataaaatggacaacttcccctgtatctttgggtctttattctgaatgctcctatgtatacatgttaaataaatttgtataccctttctctaattaatctgacttttacaagttgatttttcaggaaaccttcagagggccaaggagcatttgctccctttgcccctctctacgtaaccattccccagttacttcacttctagattatctagtttttcactgttataacagtatgatgaacagatagctttgtgtgtaaaactttccctacatttgattatttccatggaatggttttgaaggcattttaaagactcttcataactttgtacattgctttccaaaaaggttgtcctggtttaaactttgaccagttctgtatagaggtggctatcttgccatagtttcccctgcattgattattcccatttttacatattcttaccaatttgattggtgtaaaatggtatctatttgatttttatcaatggtgagattgagtattttctcaaatagttgtaaattgcatctgttcttttgtgaagacaactagcagcgtatctaagaccagtttgaatattttttgtcttttttgtcttacatattcatttataaaggcagatttccagtaaaactgattgcccccaagtttgggtataatagagtcatttcactttgaccttcctcattaatttctaaattgttcacaattcaaaaagttattaccagttgtggagctacctttttttttttttttttttttttgagacagggtctccccctataatcttgccctgctggagtgcagtggcatgattataactcactgcagccttgacttcctgggctcaggccatcctccttcctcagcctcttgagtagctagggctacagacatgttgtccccatgcctggctgatttaaaaaaattttatttttaggccgggtgcggtggctcatgcctgtaatcccagcacttggggaggccaaggtgggcagatcacgaggtcaggagttcaagaccagcctggcgaatatagtgaaaccccgtctctactaaaaaaaaaaaaaaaaaaaaaaaaatagctgggagtggtggcgcatgcctggagtcccagctacttgggaggctgaggcaggagaatcgctggaacctgggaggtggaggttgcagtgagccaagatcgtgccactgcactctatcctgggcaacagagcaagactctgtctcaaacataataaataaaataaatttatttttagtagagatgaggtcttgctatgttgtccacactgggagctacctatttttaaatagtgtttaagatacatggtctgtaaatatatagacactgcttagaaatgaaaagcagcagttaaatttcttggggaagttggggtttatacaggaaattgtcacaggtactcaggaattggaagttgtggctggggatgtgtatggaagaataggcactgtaagtagtagacctgcagaccagtctgccctgatagaacattctttttttttttttttttttttttttttttttgagacggagtcttgctctgtcgcccaggctggagtgcagtggcccgatctcagctcactgcaagctctgcctcccgggttcacgccattctcctgcctcagcctccctagtagctgggactagaggcgcctgccaccacgcccggctaattttttttttttttttgtatttttagtagagacggggtttcaccgtgttagccaggatggtcttgatctcctgacctcgtgatctgccctcctcggcctcccaaagtgctgggattacaggcgtgagccaccgcgcccggccctgatagaacattcttaacccagctctccttcaatagctggtccgatagaaaggcaaacaaatatacatctggagtcatgggttctaaccttacctctgaaattagcctgctttgtaaccattcacagattaacctttctgtttctcagtgtttacatcagtaagttcctttcagctctaaacatctttgattttattattcaggggacagaatgttatccttttgaatccagaacctttcttgtgaatatctgtgaataggtctggaaaacaactcattgttgttgggaactacttggaggaaaataataggaaaaatttcccataccagctaaacttttagggaatgtgaacttccaaatccttgtttattttcttttaatacattaaaaatggtaaaattaaattatttttatgccattttccctggactagagaattgtagattcggtgttttctctttcaacatgccagaaaacgacaggttaagttgaaagagtgcaggaaagaaatttagagagaaaataactagctgcaaaacccttcggtgttttaagagaagttactatttacacaaacgtggcctcggcttaatcaaatgctttaatttaaagtcacaaacatcccttttctggcttgagaaagctggtggaagcagctcagtgctctgtgttcgatttgttaggtcttgctcagtgtgcagaactctgctggcagctgagaggggaagccggaaagaggcaagttcctggtgcaaaggtggctctgcagcataatttaggcattggaggagctgtggttgtaacactctacaagatgggttttccggaagccgccaggtgagtgacattcagagttttgtgtgtcagttaatccttctgacttttcacagttgatgatgttttacatgtaaaaatttcttattttattgtcttagtatttaaggaaaagtatctcattacattgttttaagaacatggctttaaaagtggccatcaggttttaaatttaaccaactttaggtgaattctgttgaaaaaggacccaggatagtcacgagagtactgaactagaagcctgagctagctgggtatgggtctcggccctagcaacctaagttatttaggcaggtctcctcatggccttccaggcttctgaggtggtttagggagtcactaaatgtgctgattggatctttgcaaatttgtatttccgagtccagctaataagccctcgttgatgctagaattctttttgtctcttgctgactttcttcctctccttcaactgcccatgctcctcaatttgcaggcactttctttcgcatcccactcaggatccctcaactcccttgcttatctctcaaagaaatgttcctccccagaggaaaaaagcgcccctcctgtcaaaggctcagctttccttgttccatgcttttgtttccagtcactttctgtaacttggttatctttccattgactcctttccctctgtcagcatacatgttcaggtcttcccttagatctctttttctccttgccttaattgttgttgttcatgatgagccttttatgttgagccacctttatttttccaagccggaatacctcacagtctaatttttacctcaccactgaggtcagtgtcaggtaaggccaccaggatctaaatgaaattgaataactttgtctttattttccctatttactctctttaacccggctgtagcttttgacattaattggctcccttttttcttttgaaattcttggtaattatttaatcatttattcacacttttttgtttctccaacaaaggatatgagacacacttctttttttttattattatactttaagttgtagggttcatgtgcacaacctgcaggtttgttgcatatgtatacatggagacacacttcttttattgagtctatgttattcttctgtaagctcttggatctcttctcttgtcctctcctctttctctgcccagaatataatttctgttgtaaaacttataatttaaagcccgtctcaaataccatctctttttgaatatccacagcactttgtatgtttttgggtactatctagttggtttggttgcactgtatccggtttttaattccctttattatatgaaatccttgaggcctaagactgtgacttacatctcttgttcctggagtctctcatatgtttattgaatgggagtaaaaagtattgaatcttaagtttttgtggggtttttttcttttttgagacagagtcttgtatggtcctctaaatatatggggaaggcaacatacttttttcaaaatgctgtagaagctcagaggaagaaattattatgaagaaagtaaatttgaactgagatgactaggattgcccaacagaagtataggggaagggcattccaagtctgtacaataggtatagaaatttgaaaatacaaggaggtttgacaagtggttgtgctgtgtgggtacagagtagattattttgtgtgtgcctgggtagagggacaaagtgggattatggttttgaaatgattcagatgcaatgctcaggagtttggaatttatcctatagaatatggaaagatattctttagcaaaagatcatgtgactatattacacattaggtagatcagtctgacattactttgagctggtggtggagagaccagaggccaggaatgcttaggaagctgttgtaggagtgtggaggagaaatgtttagtgttgcaacacaggctgtgaacaatgaagaggagaggtcacatttaagggctgtgaacaactacatttaattcacaattaaactttaatttagaccagttttgaacatgaatatcaactttgtattataacatcctattcattttacgtaagagaggagcttttgtgctacagactgagaataggtatgtattctatattctgttaaataaaacccccttttaaagcccaactttgttttgtatttctttttttaaaattaaggtataatttacatacagtaaaattcattctttgtattatatttccacaagttttgataaacatacagtcgtattactaccaccataatcaaaatataaaatagttttattgcccaaaaatgttccttgtgcacccatgtagtcaacccttctccttctcttctagcctctggcaaccactgatctgttttccacccatgtagtactcctttttgcagagtgtcatgtgaatggaatcaaaaagcctttgagtctggcttctttcacttagtattacacattttaaaattcatccacgttattgtgtgtatcagtaatttgtccccttttattgctcaataatattccattgtatggaagtgttagttgcttacccattctttggttgaggcatatttggattattcccattttctttttaatggaaaactaagttagcttgaaagtttaacccagtgggtactatttgaagatcctaagtcatataagaagttaaattagaagtaaaaattgtttctatataatgattacaactgtatgcatgcctataaataaagacaacaagaagcaatacagaaaaatggatagagaaaaattgttggagtagtagcattgcaggtgattaacttgttcgtattttcttttttcttttcttttttgagacagagtttggctcttgtcacccaggctgcagtgcaatggcacaatctcggctcactgcaacctccgcctcccaggtgcaagtgattctcttgcctcagcctcccaagtagctgggattacaggtgctcactaccacgcccggcttatttttctatttgtagtaaagacagggtttcaccatgttggccaggctggtcttgaactcctgacctcaggtaatccacctgcctctgcctcccaaagtgctgagattacaggcatggaccattgcgcctggcctgaatttctttttcaattagaacctgttaggtagttacaaacaaacaggaaaaaattctaagaataatacaaggaactcccttataccttctacctagatttaccaattgttgacattttgcccatttgctttatcatttttcctctacatatatttatatctgtatacattttttcttaactatctgagagaaaggtggagttgttatgcttctttatccctaaatatttcagtgtgtaattgtagaaacaatgatattcttttgcttaaccacagtagttataaaactcaagaaacttaacagggttgggcgtggtatctcatgcctgtaatcccagcactttgggaggctgaggcgagtggatggcttgcggtcaggagtttgagaccagcctggacaacatggcgaaaccccctctctactaaaaatcaaaaattagccaggcgtggtagcacatgcctgtagtcccagctactcaggaggctgtggcatgagaatcgcttgagcctgggaggcagaggttggggtgagctgagatcatgccactgaactccagcctgggcaacagagcaagactctgtttcaaaaaaaaaaaaagaaaaaagaaagacatggatacaatactatgaactcattcaaataacatagtcacagttcaacaactgtcccaataatatatttataaaatatactctaaactttattttttctccctgtcaggagaaatccctaaaaatgcatttagctgtcatgtctctttagtttcctttaatgtgaaatgatccctcagactttctttgtatttcttgaccatgatttttttgaagagtgcaagtatattctttaatagtagaatgcttctcagtttgcaattgcctaatgtttccccaaattagattcagattatacattttttgcagcatgaaattatgttgtgtccttctaggtgcatcatatctggaggtgcatgaggttgtttaacccatattggtgttgttagctttaatcacttaatgtggcatctaccatgttttcctctgaaaagttgctgttcttttctttgtaattaataagtaatttgtagcaagatgctttgagatgataccattttttctatacttattaactggcattattctgtaaagaagagctttcccttgtcttccatttcaaaatttattcatatatttatatatgtatgcatacaaactcatgaattcttattgtattcactgggttatagtaaagtggtatcaattattttgattttcaaaatgcccctgatttggccagtgggaacctgatcaagttgattcatttttccctatgattccttttagtagttccttactttctggcgcaagaagatattccaggctcgtcctgtgctttccatgcctcagccctaggatcagtcatttctctgagtcctggttccttttagtagagaatggtatatggaaaccacaaatggctgttagctgtgtgcttgttattattacttctaggccttttcagcaagcgcagtagcacacacaagcattactttagttttgttttaagacagatatttaaggaatgcacgcaataatcttaatgtgatgtatatctgtttccatactcatgtagccaccagtttgttagcagttagaatgaggaatttataaaactagttaaatgtcacttgtatgtgacaactttttaaattttatagactagagttaccggagacagatttttgtttttttgagacagagtctccctctgtcatctaggctggagcgcagtagcacattctcagctcactgcaacttccacctcctgggttcatgcaattcttgtgcctaagcctcctgagtagctgggattacaggtgcatgccaccatgcctggctaatttttgtatttttagtagagacggagttttgccatgttgtccaggctggtcttgaactcctgaactcaagtgatctgcctgcctcggcctcccaaagtgctgggattacagacatgagccaccatgccatgccatcagagacagttttgatcagtgggaagagtaccttaatcaactttttgatcacactactggctttgagcatattaatttagccttttccttatttagaaaatactgaaaatatgtactttagggatcagaaaataacaaattaaaaatatctgccacacattgtagttgctcaataaacttttggttttttatttcccagtgcattttcctttcttctttcctatttctctagttgtgtcactggttaaaggtcaaaaatagttttatcttagtttaatttaattcaattttatagagacagggttttgctatgttgcccaggctggtctcagactcctggagtcaagcagtctgcccacctcagcctccagtagtgctgggattacaggtgtgagccactgtgcccagcctgaaaatggttttatttattaattataaatattacttaggggtataggaaaaaaatgaacttaaatttttagtacagtatggggaacatatccaactcattgaagcctacagcttggccaaagaggatcttatcatatctcccaccatacctctatgaggtttctttgtttgtcttccaactctcaactctgtgggctgtatttctatgtgtgatggacccatgtgcctgctctgaggtcatggggagtagctgattacaaatgaacttgatattccctgaaacttacgcgtactgtacgaccgtctccagtcagaacaaactgattactggttaaattttcgttttagggatgaaggtttgattacaatgcaggactttataatcttcccaaacactaagaataacagcaaccacttttttttttagacagagtctcactctgtcatccaggctggattgcagtggtgttatcttgggttactgcagcctcgacctccccaggctcagataatcttcccacctcagcctcctgagtagtttggaccacaggcacacaccgtcatgcccagctaatttttgtattttttttgtagaggtagggtttcaccatgtcgcccaggttggtcttgaactcttgggctcaagtgatccacctgccttggcctcccaaagtgctgagatgacaggcatgagccaccatgcctggccgtcaaccactttttttttttttttttgagatggagtcttgctctgtcgcccaggctggagtgcagttgcgcaatcttggctcactgcagcctttgcctcccgggttcaagcaattctcctgcctcagcctcttgagtagctgggactacaggcacgcaccaccaggcctagctggctaatttttgtatttttagtagagatggggtttcccatgttggccaggctagtcttgaactcctgacctcaagtaatcctcccaccttggcctcccaaagtgctgggattacaggcatgagccaccgagctcgggctttttctttccttttctttttctttctttttttttttttttttgggacagagtcttgccttgtcacccaggctggagtgcagcagtatgatctcatctcactacaatctctgcctcctgggttcaagcgattcttgtgcctcagactcccgagtagctgggactacagtcataggccaccaggcccagctaatttttgtatttttagaagagacggtgttttgccattttttccaggctggtcttgaactcctggcctcatgtgatccacctgccttggactcccaaagtgctgggattacaggcatgagccaccatgcccggcctcatcaaccattttttaaaaattatttcagataactttattaagacctaattcacatgcccacaattcacgcattttaagtgtacgttcagtggtttttagcatatcacaaagttgtgcagtcattactgcaattaatcttagaacgttttcgtcacctcaagagaaagtgtgtacccattagtaatccctccttcttgcagtctctggcaaacactaacctactttctgtctctatggatttgcctgttatggacgttgtatgtaaatgaaatcatacattgtatggcctttggtgactggcttctttcatttagcataatgttgtcaagattcatccatgttgtggcatatatcagtacttgattcctttatatggctgaaggttcccatttctccacattctgtcattacttcttgttacctatctttttagtgttagccatcctagtggttgtgtagtggtatttcattgttctttgcatttccctgatggctattgatgatcagcatcttttcatgtttattggctatatgcatatcttctttggagaaaagcctattcagatcctttggcatttgaaaactggggtctttgtattttaattattgagttgtgagagctctttcacaatcactttttgagggcctggtatgtgccaggaccacactaggcgtttcacatgtacttctttgtttaatcctcataaaagtcccacacattaggtatttctgtttatagatgagattgatgatcagagttaaaataacttatctaaggagagagagccttgagtggtaggaatcaaggttctagctgagtgcggtgcttctgttttcctggctactctgtgctctcagtctttgacattgttgtagcagagcctgttttaggccttagaatgaaaattttcaagaatcatggagggaattcatatgctgagtaggttatttgctggtttttatcttcaagtttcctttcaatgtttatatactagatttattccaggaaacatatataaaccaaattaaaaaaataaaaccaattggaatttagtttctgataaaagaactttttatgtaaagaaatcatgaggaacatccttttgtgaatgtgaatactctctgagtttaagttgatatattcagttttcttagagcagggcacatatataaattttaaggaatgaggggttttcagaaaacattgataaaactttacatattaacttttaatctggatgaaaagttggttcatcactaacttcatgagcttttcaaaacaagcaagataaaagacacacctgtgacctttgggaacatgcaagatgtggcaagtttggaaaagggcacaatgatgattaaaagtaactgaaaaattggaccaatgaaatgaaattggcttgtggagaactagctgtggctacttgattttaggtcacatattcagacttttgaccaagacgatatactgtaccatagataattctgctctgaatggaacaggaaggaattaggagttaggcaagggagaattcagggtaacttcagttccattcagtcactattcactaaatgcttatgatttgctgggaactggcaatacagagattttttttaaagaaaaggtatggtatctgctcttaagccgttgacatttagtagggtttcacagaaaagtagtttcctgaaagggctgggtctcgaagggagaaatggagtttgctaagatggaggtattctggacccagggagcagcagtggcaaaggcatagaagtgtgaggtggcattctgtgcaacgaggactgcacagagtctgcttgctggagatgaggttccattccctgttcatatattaatatgattcctctagtaggctctcttttcaatttagactctccacacccttcctttcaccctcactctctgctgattactttgccttatactttgttgagaaatagaagccattaaacccaaacttcctcaacttccatccaagacctacagacccactacacgagaattacacccatctgatcctctttcttcgcttgagtctcctcgtcctgtcacaggccacaagatttttctccttccatctcctttttccaggttccttaccatcatcaggcatacctgttctgatttgttcatcttaaaatgaaacccagcctttttgaaaatcctgacatgctgcaagatggatgatccttgagaacattatgccaagtgatatgtcagtcacaaaaagacaaatactatatgattccacttagaatcatagtacctagaggtacctagagtattcaaaattatagagacagaaagtagaatggtggttgccaggggttggaagcaggggggagtgaggagttactctttaatgggtagagtttcagttttgcaagatgaaaagagttatggagatgaaaggtgatgatggttgcacaacattatgactgtatttaatactactaaactgaacacttaaatatggttaggatggtaaattttatgtgtattttaacataataaaaaattggaaaataaaatattttttaaaagttataggactctcatatgcccacatccagaaggaaatgctacatttctttctttctttttttttctttttttttttgagatggagtcttgctctgttgcccaggctggagtgcagtggcatgatctctgctcactgcaacctttgtctcctgggttcaagcgaattctcctgcctcagactcccgagtagctgagtttacaggcgcacaccacaatgcccggctaatttttgtatttttagtagagacggggtttcactatgttggccaggctggtctcgaactcctgacctcaggtgatccacctgcctcggcgtcccaaagtgctgggattacaggtgtgagctaccacgcctgcccagaaatgctacatttctttaagagattagtgaaaataaagatgtcatctttatcccccccaccaaaaaaatcccacaactcttccttgataccaccacattcctctccagagaccacctcattttactgttccactaagactaatgtctcaaaagagccacgctgtgtctatttccctcttctattcactcttcaattcactataatctgacttccaccctccactgaaaactgcttttgtcaaggtcaggtcatctgtactctccatgtgcacatctagtggatacttgaccttgtggcagcatttgacagtttgcccctccctcctggaatcttgctcccggctcctatgacaccatgctggttttcctcttgcatcactggctgctgctttcccttctgtccctgactctgagtaatggaggtctaaagggcattgtgctggactctcttgtttctctataattctgttacagtccctgcccagggatttaaatgctttcactatgctgatgatttctccattttatctctagctggccctctccactgagctccagactctcatatccatggctttcttgttttataaaatagtatacttactgtgccttaaacagaacttggatcccctctattcccactacattcctccttgtcctcgtaatggcctctccatcacccagttattcaggccaaatgcctggataatccttgccctttcctctttgtatctccctcacccccacagcaaggcttgtggattctatttctattttgaatctattcccactctctatctactggcagactgcctctgtagtccaggccaccatcacctcctatctggattattccaacagcctcctaactagtgcccactcctcttgctcctctctccatcgtcattcgttcagcacactgttgtaagaataatcacaaatcaaacaatttcacttccatgttatcatttctatggatttccaaattccctactttggcctgcctgcatcatcatttggcctgcctagttctccaatttcatttcatgtcactctccccacacctactgtattatagagactctggtcttatttgactttcttttaacatactcctttctccctcaggatctttgcagtttcctctttgaatggctagctccttttcttcctttaataaggtcttagaggtcattccttgactgtccttcctaaagtaggttccttttttttaaatttaaaattattttttattgatgcataactgatgtacatagtctcagggtacaagtactaatttaatacattcatgtaatttgtgaaaatcaaatcagtatacttgggatatccatcaccttaaatatttgtcttttctttattctaggaacatttgaattattctcttttgattattctctttttgctatttagaaatgtaaatgtatagtaaactatagtcaccctactcctgtttcaaagtacttggtacagtttgcagttattttgtgtttacttctttttctcctccactggaagaatataaactaagtgagtgcaaggactgggtctgatctgttcactatcatatccccagtgttttgaaatgtcttgcttggcatgtagcaagaagtcattaaatatttatgaaacgaggccaggcacagtggctcacatctgtaatctcagcaccttgggaggccaatgtgggaggatcgattgagcccaggagtttgagaccagcctgggcaacataacaaggcccctgtctctacaaaaaatttgaaaaattagctgggcatggtggcatgcgcctatagtcccagcttacttgggaggctgaggcaagattgcctgagaccaggagttcgaggttacagtaagctgtgacaggaccactgcaccccagcctgggcgacagagtccctgtgggaaagagagagagaaaaagtatgtaaataatagaaggaaaagggaaagaggaaggagaaatggatttgaggactgcagggagacatacatgagaggagaggggtagaaaaagacagatgcttattgatctactgctgcactttttgtttttttttgacaggttctcataaatcacccaggtggggtgcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaggccaatttttgtgttttttatagagacggggtttcaacatgttgcccaggctggtctcgaactcctgagctcaagcgatctgtccgccttggcctcccaaagtgtaggattacaggtgtgagccactgtgcctggctaactatattatttatttttttgtttctaaattgtctcctccactaggatgtaagattcatgagggtagcttctttggtttactgtattttcaagaaaaacttctagctcctaatgagctgattatgtgttgaaaaaatgagaagaagagcttaattgtttctttgtttatgacggagtttcgctcttgttgcccagcatggagtgcaatggtgccatctcggctcactgcaacctccgcctcctaggttcaagcgattctcctacctcagcctcctgagttgctgggattacaggcatgcgccatcatgcccagctaatttttgtatttttagtagatacggggtttctccatggtggccaggctggtctcgaactcccgactacaggtgatccactcgcctcggcctcccaaagtgcagggactataggcattgagccatcgcgcccggccaagcttaattattttatatgcttactaaagatttcctttggataagatttgcaacatctctgttcttagggtttttgaaaattttgaaaattactattttataaatgttgaaaaacctagtacctatgtgactccatgaattgaaacagtttcttttccccagttcttttagaactcatcaaattgaagctgttccaaccagctctgcaagtgatggatttaaggcaaatcttgtttttaaggagattgagaagaaacttgaagaggtaagatttatgtaaaatattgccaggaaggaccttgaggctagaggaagcagacacaggtttcaggtgttgccacgaggtggtacaattgaaaatttatatcatgttgtcaagtattgagtgtagttagatttctgagtgtctattaaggcttccttgtaattctaaaaggaatgcatttcagaaatgtatgaatctccagatttgagctaaagaactataataaatactgttaaaattgtcactcttttctaggtcctctttgtcagagggtcattcagtcatgggcaaagttcaaatataaagggattctaatttattttgctgtaatttcctttgaattaaaacggtcttacttaaaatcatttcaaagaataatatttaaaatgagccttttttgtatatatatcaaaattctttgtaaaaagaaattgtgttttgatttcttaaagtagttaaaaaatttttttgttttaaaaatgatgttaatttaaaaaatactatacagaaatatatgtttatgaatagtataaattttatactatacttttgttttaaccttttaaacaaaagtttaaaatctccccaaattctgccactcagagtttactgaaatgttaacagtggttaacattctttcagacatctttctctgtgtatattaacttacagttttaacctagggtcaaaaaaacctattgttttttgttttgttttgttctgagacagtgtcttgctctgtcacccaggctggagtgcagtggtatgatcttgggtcactgcaaccttcacctcccgggttcaagtgattcttgttcctctgcctcctgagtagctgggattacaggcacccaccaccacgccaggctaatttttgtatttttagtagagacagggtttcaccatgttggtcaggctggtcttgaactcctgacctcaagtgatccacccgccttggcctcccaaagtgctaggattacaggggtgagccaccgtgcccaccacaacacctgttgttttttattatactatatatgcggatctatttttatatacaataattagttcttgataggtaataatcatactaaggcaatctaaaaataactctccagaaagaaagttattctcttcacgcaaaattgatatttatttcattgttttaaacttagaagaatcttgggatctctttctgtttttttttttttttgaaacagagtctcactttgtcgcccagaatggagtgcagtggcatgatcacggctcactgcagccttgagcccctgggctcaagtgatcctttcaccttggccccccaaagtgttgggattacaggcgtgagcctctgcctggatgtatttcattatggattttagatctgagaccgtataaggcatggttacagccataatcacaatgcaaattacacatctattaaggtgatcaaagtgggctggaataaatagaatgtttaaactgtatttcactcacgttagagccatggtgtgaaaggcaaacattgtgcttatctcataacccttattgtaggccagaggactacttaatatctgagatgattgcactgtggatgggaatacaggtgatataactgatgtgtcttgtgaaagaacccagtattcccaggactttcattataatctacaaccgtcctgagggagagcagggccaggcattggcctagaagctgcagacctgtcctgcaaccatcttgggatgcatccacatggggctacctgttttataacctatgtttttcttttgacattatgttccatggccataaatctaaatctttaccccctgtttttttttttgaaacaaagtctcgctctgtcacccaggctggagtgcagtggcgcgatcttggctcactgcaacctccacctcccgggttcaagcgattctcgtgcctcagcctcccgagtagctggcattacaggcacgtgccaccacacccagctaatttttgtatttttagtagagatggggtttcaccatatttgccagggtggtctcttatctcctgacctcgtcatcttcccaccttggcctcccaaagtgctgggattacaggcatgagccatcgtgcccggccgtttaccctcatttttaatacatagtatgtattcatatgtatttgtcaaaatttaagtagcttcctgtgatgaatatcaggttgtatttaacattttcaagtaaaacagtgctgtaataaatttcctgttgcactcatatttaagtatttaagctatgatcaatttaatataaataaaggaggaaaattgttgggtggttggctacgtgcattttgtatgctgatacatattgccaaactacccaccagaaagagagtactaacttacaaacattaccaattcatgagagtgactattttttccttttaaaacatttatttatttttatttttgtaaagatggggtcttgctatgttggagactaactatttttacttcacacctctgatactatgttggctggtttttaaaaaaatctctgggctgggcacagtggcacacccctgtaatcccagcattatggaaggctgaggcgggtggatcacttgatgtcaggagttcaagaccaacctggccaacatagcaaaaccctgtctctactaaaaatataaaaattagccaggcatgatggcgcagtcccagatagctgtagtcccagctactagagaggctgaggcaggagaatcgcttgaacctggaaggcggaggttgcagtgagccaagatcacgccactgtactccagcctgggtgacagagcgagactccacctcaaaaaaattaaaaaaaaaaaaaaaaaaaaaggctttgccaacctagtaggaaaaaatatctcattgtttcttgaacttctttcattacaagtgttcctataaaatgaagttgcactctataaagtctcggcttaaaagttttggtttttaaaaatgctgccaatatattcctgcagaggaacacataggatagtggcgtctgacaagttgcttcatttatttcaaccctattccatctaaaaaaaaaatcaactaaattaatgtagagattatctactatgaagtatgagatatggcagtatatcagtcattgaatacttcattactgggatttacaaattagtgtggtttttattttacagtattcttttagctttgcaaatgtatgcctcttgctccattttaattcttttctctataacctccctaccaaccttgttcccttgtttctttctccttcccacgattgtcagtttcctaagtgtttgcagcactagaaagtaaaagtcttggaatcttttgtcaattcatgcattttctgcattagcaaaggcagcctggcaaaagattttatttccacttttgtctttgttagcaattctccattgcccttctttgaattctgtcttaattttttgtccctattaagtttgccacaggacctactccttaaccttttgcctactcagaaagaagtacttttcttcaagcaaggaggcactcagaactttctcagtactaatgatctccaatttcacaactgtattttattttccctttaaactctttctcctcatcagtttccttaccctctctcactcccacttcaattgaaaatgttttattgtcgaagggatgtgattttataagaggatcagttgtttctgaaaagtagcagcaagtgcagattattctctatctattttaaggaggtgggaggagaagtagtaaggttataggaatttctcttcaagtatgcaggtagaatttctaaatgtttgctggtgttttcctgctgtaacttgttggtgtctgcacatagctgtattcctgaggcactgtgcaagcagatggcatggatgcacctggaaatagtcattcatgggccactggctctagagaaagctttcctctcaggtggcctagcacactattaaccccctctcctatattatttctacagaaccttgagagataaaagattttaaggaatgtgaagaagactttgaactttcttcattttatggtgccagatacagctctgctgtcatcggctaaagtttagaaatgttgatgtgacctacagtttcagtgtggtatggtcaaatggaagtagcattgaatttgggattaaagcaacctgggattgagttctggttgtactacccactagccatatgtccctgcctctcagggaacacagagtttagtgggaagagagacatggaaaaatatttccagaaaaaagcaacatgggtttatgtgcagagggccatcaaaatatctggtggagatagagactccttcccaaaagagttagcatgtgagctgagatttgaatgatgaggtcaggggtgggagtagaggctaggaagaagtgagtgtcctgggatggggtatgagtaagggcatggaggcatacaagcacttggcacgtaagttcatggaattcaacatgttcatggaattcagagatgaagaggaagagaaagtggctggagataagaacagacaaatatccttcggatcatgaagactctaggataatatgtaaagacagacttcatcctgttggctgtggggagccactaagaagttcaagcctgagagtgtcagatggatatgttagtgttagatggactacttggcagcagtatagaggagaagcattcttaatctttataagcctcaattgctttttctgcttaatgagctaatactaatgtctgcccaactatttgtatggttttgtgaagattaaagaaattatatatacaaaatatatttaatacaaaagtattaaaaacttgaagggccctcaaaatattagtattgttagtagtttttttctacagttaacttaaaataatttaagtgagctcttttaagggaagccaacataagagaatttctttttcacttaaaagaaaaacctgacagtcattttggtttcttggtttaagtagaaaatattggtagttaatttcaggatactcacatgtaagagatgctgccatgactattcagataagtagtccctgactaaatattttaggactacttattaaaactaaacattttaggactacttattaatccttaatattttaggataaaacaaaatatttagtcctaagacccatgtctaagattccaggtggctctcagggaatgtacctatatgtaagaaaaaggttgacataccgggcacagtggctcacgcctgtaatcccagcactttggaaggccgaggtgggtggatcacttgaggccaggagttcaagaccagcctggccaacatggtgaaaccccatctctaccaaaaatacaaaaaaattagctgtgtgtggtagcgtgtgcctgtaatcccagctacttgggaggctgaggcaggagaatcacttgaaccgaggaggcagacgttgcagtgagctgagattgcaccacagcactccagcctgggagacagagcaaaactccatttccaaaaaaaaaaaaaaaaaaaaggttgacacacccagtaggatgactaaaataaaaaagacaataacaattgtttgtgaggatgtggagaaattggaaaccctcattaattgctggtagcattgtgacatgatnnnnnnnnnnnnnnnnnnnnccaacccacaggagagagagagacgcgagaccgcaacacccaccaaacccgaaagccccagcgcagaagcaaccacctcacacccagcagctcaggggtttcagtcagctaagattgcaccacagcacaccagcctggtaggcagagcaaaaccccacctcaaaaaaaaaaaaaaaaaaaaaggatgacacacccagtaggatgactaaaataaaaaagacaataacaattgtttgtgaggatgtggagaaattggaaaccctcattaattgctggtagcattgtgacatgatgtagccactttgggagtgccttaaaaaattaaacatcaccttatgacccagcaattacacttctagatatgtaaccaaaagaaattaggagcctatgttcacatgaaaacttgtacacaaatgtctatagcagtattattcataataggaaaaaatgaaaacaaccatcagctgctgaatacataaacaaaacatgttacatccatacaatggaatattatttagctgtagaaaggattgaaggaggccgggcatggtggctcatgcctgtaatcccagcactttgggaggccgaggtgggtggatcactcgaggtcaggagtttgagaccagccaggccaacatggtaaaaccccatctctactaaaaacaccaaaatttttagtacttttttttggcacgtggtggtgcgcgcctgtagtctcagctacttaggaggcagaggcaggagaatcacttgaacccgggaggaggaggttgcagtgagttgaaacatgccactgcactccagcctgggtgacagagtgactccatttaaaaaaaaaaaagattgaaagactgatcgatgtatgcatcaatgtggataaaccttgaaaacgtcatgcttaagtgaaagaagcagtcacaaatatatgatttcatttatatgaaatgtccagaataagcaaatctatagagacaggaagtagatttgtggttgccggggactgaggggtggaggagacagggaatgactgctaatgggtatgagtttcttttggggttaatgagaatgctctaaaattagatagtggttttggttgtacaaccttgaatatactaaaacaaccactgaattgaatattttaaaagagtgaattttataggatataaattatatctcaatgctgttgtaaaacaaaacacaacaaaaagaaatagtgaacttaggccaggctctctgcatacttagaaacagaggttagtatctaatgtcagtttatgtaaattcctcaggggcagtaattatttgagtatttcaggtacttatcagagtgcctgaacattgtaaacacttaagtctttcttaaaataattaatattatgaggccaggcacggtggctcacgcctgtaatctcagcactttgggaggccgaggcaggcggatcatgaggtcaggagattgagaccatcttggctaacacggtgaaaccccgtctctactaaaaatacaaaaaattagccaggtgtggtggcgggcacctgtagtcccagctacttgggaggctgaggcaggagaatggcatgaacctgggaggcggagcttgcagtaagctgagatcacgccactgcactcccagcctgggtgacagagtgagactctgtctcaaagaaaaaaaaaaaaattaatatgataccaaaaggaagaattttgtgtataaattattgcagatatgtaaggctgaaataaagaagataggaaataaaagctattagaaattaaagagaactcaacaggttgccagttccaaaataaacattaaaagattagtatattttctatatatttgcaataacctggccataaaatttaatgcaaagatgtgctattaacaaaaacaatataaaatacctaagaataaacttatcaagaaatgtacagaagtctatgttggcaaaaaaaagacaacattttcccaaaggacattaaagaaaaggtgaagatttactatattcgtggatgggaagacttaatattgtgaagatactacctctctcctaaacagatctatatattttatgtaaccccatccaactccaacaacattttgggagaagaactaagtgattataaagtacatataaaggaaaatgtgtccaaaaaaaaatccaaaatagccaagaatatttggaagagaagaattataattgagatttgctgtgtcagagtaaagtgtattataaagctataatattggcacagaaatagctagatcatagaataaaacaacaacaacaagatgctaacattcattgagtactctgtgtgttgtgggtatttacataattctcttacagctctgtgagggtagttactgttttattcccatttaacagataagataaccgagattcatacaaaaatgcaaaaaattagccgggcgtggtagcgggcgcctgtagtcccagctactcgggaggctgaggcaggagaatggcgtgaacccgggaggcggagcttgcagtgagccgagatcaggccactgcactccagcctgggcgacagagcgagactccgtctcaaaaaaaaaaaaaaaaaaaaagaaaactgagattcagaaagtaacttggctaacttgttgataacaatcaacaggatattggttaaataaatatggtatacttttacaattaaagactatatgtgaccatttaaaattatgtagaatattattagtgacacagtaattaggataattatattaaacaaaaaaagtagattataaaacaatatgatcccatttaagatatatatataaaagctttatatataacatatatatactatattttatttaatcaataccctgttaattgttattcaggctcgtgctaacttctggctcttaaaacaatgctgtgaataacattctcatatctaaatatttttacagagcctcatttatttaagggtaaatccctagaattaaactttgctaattaagaacaccaaatctaggaatcaaaataggtttgaattcttgctcttccttgtacttctacaaacctagccaagttattagaccttcttgaatatatatataataatatatatgtagcatatataaatcttatatatatatatcttaagtgggatcatattgttttgtaatctactttttctgtttaatataattaaacagatcccatttaagatacatatatatataatcttttctgtttaatataattaaacagattccatttaaaagatatatatcttaaatgagatcatattttgtaatctactttttctgtttacagaaagattttcttgtttttggtacaaaacccattttttttctctgcatatatatgtaccaaaaatgattttctttgagtgataaagttatgaatgattttggccgtgtgcagtagctcacacctgtaatcctagcattttgggaggctgaggcagtggatcacttgaggtcaggagttcgagaccagcctggccaacatagtgaaaccccgtctctactaaaaatacaaaaaattagcatggtggcgtgtgctgtagtcccagctactcagaaggctgaggcaagagaatcgctcgaacccaggaggcagaggttgcagtgaggcaagatcatgctactgcactccagcctgggtgagagagcaagactctgtctcaaaaaataataataataataaatgatgaatgatttatattttcttcttcttgcttactgatattttctaatttttccacagtgaaataaatgttccttctctaaaaattttttttcaataaaattattaggttgctcttgtttcttttaaacaaggtgtgtgagtttgttgtcctccttttgttattcaccctgccagctggcttagctgctcctctgtgctcctgcagtcccctgtgtttcccttgatcgcagcgtattgtcatagtgatcatagcgtattgacattacttacttttctgactcctatctctatatccttggtgcctgtaacaatatttggctcaataaatgcttcaggaaggaaaggctgggaatgaagggaaaaaaaagaggacgggagggagaagggaaacccccttgcagagatataggtctgagttttttttctgtatttaggccagcttctttccctgatgtccaaaagcaagtggtggatggtatattactcctataattctttatactgatagagaaaatgagttgaacaacaacaaaaaaggccttgatttcagaaccacttgtctttaagttctgattgcaaggaaccaaaaatatacataaggctagctgtggtggctaacccctgtatcccagcactttgagaggctgaggcaggaggattgcttgagcccaggagtttgagaccagcctgggcaacatagggagatcctgtctctacatacacacacacacacacacacacacacacacacacacacacacacacacacagatccagatcctgtctctatacacacacacacacacacacacacacacacacacacattcaattaaccagttgtggtggcacatgcttgtagtcccaactacttgggggaggctgaagtataaggattgcttgagcactggagatcgaccctgcagtgagccctgattgtgccactgcactccagcctgggtgacagagtgagaccttgtctcaaaaaaaaagaaaaaaaacctatatgtgtatatatatataatttatatgtgtttatatatataccatttatacgcttatatatatatgtcatttatatatgtgtgtgtacacacacacacacggagaagggcaggttgggatctctacattaaagatgccagagtgaatctttcccaacttattgaaacatacgagggctattttggcagaaaatgctgccctgtccctccttcccttccaccagttgtatctaaaaagccctttttgttcttttttgagacaaggtcttgctttgttgcccaggctggagtgcagtggcatgatcatagctcaccataacctcaaactcctgggctcaagtgatcctcccatttcagcctcctgagtaggtgggaccacaggcatgcaccaccatgcctggctaatttttttatttttagtagagaccaggtctcactatgttgcccaggctggcctccaactcttgggctcaagtgatccccccacctctgcctcccaaagtgctgagattacaggaatgagccaccatggctggcttaaaaagccatttttaataaaagacttggcagatgtgggagttgttgcctgcttgcctttcagacttttctgggtaaaagatcataagggaccttggggaccgctccctggcccgtatactcatatcatgtatctatttaaacatgaatttgcttgaggagaaagccagagaaatggacttaatgtaaccccagtgttatttttctttccaggaaggggaacagtttgtgaagaaaatcggtggtatttttgccttcaaggtgaaagatggccctgggggtaaagaggccacctgggtggtggatgtgaagaatggcaaaggatcagtgcttcctaactcaggttagtttgggaatgacttcattctaggagcactgacgagtttacgaaggctgtcagctgggaaaatgggggtctgctttactgttcccaaaaaggactggcttttaatgttaaagaaccagtaaattccagggaacaggaacaggtcaaagccacctcctcccaaggatttggaggctccatcacagagttgccaatcttaggctttggaattaggcaaacttgggttggagtcccatccatgccattcacataatgtgaccttgaacaagttatttaactttctgagactcagttttctcttctgtaaatgggcttaataaatggccccttttcataaggttggtatgaagattaagaggattctttcttaattaaccgtaaggcacacggtccagtgcatggctggtggccttggaagacctgtccatactcacaatcgccagttattcttatccaaatcttttttgaccccactctagtcagcttttgtcctcatcactatccccagactgttcctgtcaagatcaccagtgactaccacattgctaaattcagtggtaaattcccagccctcatgatattacacttacacgttttccttacctactgactgttcctccttggcctctcttgatggtttctttttgtcttcaaatttctaagcattggagtgttccaaggctcagttctatttgccttaattccttggggatcttaactagtcccatgctttgaaacagtttctacactgatgactttgtctttagtatggacccagccactgaactacaaggtatacatccagctgcttaactgacaagtttacttggacacctaataggtatcgcaaagctaacgtgtgaaactgaactacagatatttcttctcccctctaagtatgtactcctcctgctgttgcaattggtaaattgctcctgtgtcctactggttccttggtctaaaagccttgaagtcatctttggccactttttttctcttatactccacagtttaacccatcaacacatcttgtcctcctctgtaaccaccaccaccctggtctaagccagcatcattgttttatccggtctccccgattctgttcttgcccactactctgcacacctgccagagtgatcattgaaaaacttgtcgaattgttaccttcctctgctcaaaagcatccaatagctttgtctcactgcaggtaaagttcttaaaattgcactgtatgatctggcctcagttttcactgtcttactatgtatgtccttgctcacttggctccagtaacactgacttttttgctgttgcatgaatgtgggattctcttggttgggggctttctgctctctgttccctgtccggaattaccttctcccagatatccttgtggcctgttccctcctttcctttggatctttgctcaaatttcaccttctcagtgagccactccctaaccaccctttttaaaatcttaaccccacggtgaaaccccatctctactaaaaatacaaaaaaattagccaggcgtagtggcgggcacgtgtagccccagctactcaggaggctgaggcaggagaatggtgtgaacccaggaggcggagcttgcagtgagccaagatcacgccactgcactccagcctgggcgacagagcgagactccgtctaaaaaaaaacaaaaatcttacccccattactattccctattgcctttttctgccttatttttctccatagcacttattaccatctcatataccatgtaatattttacttattttcttattgtccatctctctcacttgaattgtaagttccttgaagacagagctttttgtctgaggtacactgctgcattcccagtgcttagaatgtacccgagacatggaaggccttcaaaaatgaataatttaaaaatggacaacagaatgaatggcatcgagtaagcattcagtaagtggtagctgtactgtactgttatgcttctcttgttggagagagcctagggtaatttagaaacactgtggattgggaccagctctttggagggcttaaaatgccatgataggggctgggcacggtggctcacgcctgtaatcctagcactttgggaggccgaggcgggcggattacgagatcaggagttcgagaccagcatggccaacatggtgaaaccctgtctctactaaaaatacaaaaaattagctgggtgtgtggtgcgtgcctgtaatcccagctacttgggaggctgaggcaggaaaattgcttgaacccaggaggcggaggttgcagtgagccgagatggcaccattgcactccagcctgggcggcagagcaagactctgtcttgagaaaaaaaaaaaaaatgacatgataggaactttgaaagtcgttttgtatataactagtataccaaagcttttaaatatacattagagcttcctaagtagaaaagtgaagtcagagctgtgttttagaggatgaagctggtacattagacctgatgaattgaaaggggtgagagatcagaaacagagagagccatcaggaggatagatgttgccactgtctaagtgagcggagaggatgaccagccttagtgtaggcagtgggaaaagtaagtgttctgagagtagatgccagagatactggaggtgaaggtaatgggacctgggaattgtatagaagaagcgtgtctatcaaagatggtgaaatttcgttactggcacatttttgagggaggtcctgtaggaaaggatgacatcgggagcacaggtggaagcaaggttacctctagtaagaaggggtggatggaaacttctttctctgcaagggtagttaaatattcaggggcattttgagaggagaggaggttggcaagctcctggaatagagtgtagagcttggagtccggagaaaaagtgaagagcactgttaacgtgcacggttgaataagggattgatgagagatgaatgaaagaaaaattgagcagtagttagggcatccgtctagtgtgggcagcatggctttgttgtggaagtttcctgaattatacagagtccctttttttccttccaaaatgaatgggaaaaaaatggccatagctttgcattctatgagctgccactctaaggtggtgtacaaagaaaagctaaaggctttatctggattccagcttttagaaatagaacttcaggaattatagtagtgatcttttttttttttaatgactgaaggttaatggttacttttatatttagatatgcccatactgatattaaggttgttttttttttaatttctccttttcctcctattttgttgttggttgatagcgttggtttgtcatcaaagatcaaatgctgatggaaagctgttgaatgattttggaaaagctgtgttccctccagatacgttcttgccatgttcttcccacattaggtgctgtaccccagaccccaagggatcttaccctggggaaggatagtttctgctgaaactgacacttattggcagccaagagtggtgttgaaatacagacttaccaagaaaagccatcactggaaattgccagctccttttacatcaaccaacaaatggctatttgttagagattagctacattaaagcattaataacctgtcctagtttgaaccggcatcttaaggagaattgctagttcatttggcatgtacataatgttagggggtttgtttattgttaacaaagtaagatttacttaaatgtattttgtaagagcttggtaatgattactgagatgattatattatggatttttagattttgtgcattttccatcatctctttttgcttcctgggtgccttttagtatcttctccatgagttctgcctttccctcatctcctttgaaacgactcatatagcatatctccaggaggccatctttgattaatctaacataacatattattccttcattcctttattctgacccttcagcaccttgagttctcaactctgtccctttatgggcagcatgatacagaaagcttcagggtctcctatccccaaggtaaactagaaagagcatagccaaaagaaacagccaaacctgggttcagatctaggctctgtcactcagagggtatataccttccctgagagtccaatggtcttatctaaatatgatgagaataatttctatccatagaactgttgtggggattaaatgagataaggaagatagagcacctagtgtagtaagtgctcagtaaatcattgtttcctccccagaccatatgttaaacattaattttgcttagacacataggtttgtctcagcccctcaaaagggctttgaaaacttggaaaccatctgggattcatcaaatgctatgaatcagtgaaggtgcagttaaaactgagctgttgaatgtttacatacttcctaaaacaaaaggaagctgtagagcataggaattgggagtatgagctttggcaacaggaatctgcattcagatgtagctcagctacttactagctatgtggtcttgggcaagttatttggtccctctgacccttataggattgttataaagatcagatgagaccagatatgttgaagtgttcagcatagtgagagctcaataaatgctgatattatagcagcagcagtagcagattttacttcctgaagccccctttcaatgaccgagagtcctttcttggactgttaggaccaggtccaactatctcagtttgttttttacctcgtgctctttgatgttatatatctgcaatagaactggattttctaggctgtaaatttgtttattttttaaggatttagaccttttttcgagtattaagagaagattttctcagcagctaagttaggatgaccattgaatctcagtctttttaggggcgatccctgagttgtaagacacataataaaacctttttttctatcttgtttcagtgatttaatactataggcatactatgctttaacagtttattccatctctttttttttttgagatggagtctcactcttgtcacccaggttggagtgcaatggcacgaacttggctcactgcaacctctgctcctgggttcaagcgattctcctgcctcagcctgccgagtagctggaattacaggcacctgccaccatgctcggctaatttttgtatttttagtagagatggggtttcaccatgttggccaggctagtcttgaactcctgacctcaggtgatccgcccacctcagcctcccaaagtgttgggattacaggtgtgagccagcgcacccggcttctattccgtctcttttattaaggcacagattatctgattagctattatgacataatttgatcatcttttgaaattcacataatctattaatttattcaacaagtatttattgatttcctatgtgtcaagtactcttcaaggacctgtgcatatagcagtgatcaacactgacaagggctctgcccccttgaagttttcattctattggacaaatacagacagaaaacacatacacatataagtagtttcagatcagtgcactgtgaataaaatgtgacttcattttagggagaggccagctttaatttgagctaattcttaatgagaggaggagccaactgttagaatcctattgttatattaattgattgcctaaaacgttgactgctgaaaatgttgatttcttggtgaatttttccttttgcacttgaaacctctcatttggacaaggtagacatggctgatttagcaatgagatattagtctttgttgtccagtcttttttccactattttactttgataataaaattaatattttaaaagctttgtattattaaaattgcatacacttgattttaaaaaattagaaaagatagacaaacgaaacgaagaactaccctaccaaaattccactgtccaggttaggagttggcaaattatggcctgcagaccaaatctagcccatcacctgtttttttgttttgcgttttgtaaaatttttgttgaagtctagcctgtagtaaagggcgtaattccagagtgtaccacgtgatgaatgtttacaaatgagtacacctccaaggtcaagacacagaatgttgccagtactccagaagcctccctcctgcccccctgctatcactattcactcccaaaaggaaccattatttcaaatcctatcaccatagcttgattttatttattttagaaattcatacaaatggaaccatagaacaataacatttactcttttttaggtctggcttttttttgttcaacagcataagattcattcatatggttgcgtgtggcaatagtttgtgtttactaggcgaataccccagaatttattccttgtgcatttgatgtatctttgcattgtttcaatctgggagcctgatgaataaagttgttatgaatattcttatagatgtcttttagtggacatttccatcgtacttacttctactggacacgcacccagggctaggtgataaagtgcaggttttgggtatggatgtactattttacatttccttccatattacatgagagttttagttcctccacatttttgacagtacttggtacttgccaggtttttttaaaaatcaggttaattgatgtacaattaacaataaacaataaaatcaaccctttttagatgtataattctgtgaatttagacaaatgcatacagttgtgtaactatcaccagaaatcaagatacagacagtttccattaccccagaaagtgtcctcatgtccctctatagtcagccccctcaggcccttttagccactagtttgatttctctccctgtagttttgctttccttaggaagtcatacacatgaaatgatacagtatgtagctttttgagcctccttctttcactgaaatttattcatgctgttgcatggatcatgaagtattttattcttttttgctgctgaatggttaccccttcaccagttgatgcacatttgggttttttccagcttttggcaagtatgaatcttaaagccactataagcattcacatacaggtttttgtgtggacgtaagttttcatttttcttcggtaaatacctaggaataggattgctagttcatatagtatgtgtatgtttagctttatgtgaaacttccagactgttttctgaaagtggctgcatcattttacagtctttctggtattatgttgacctttcatttgtttcccatcctcactaacactgggtattgtctttttttttttttttttaaatttcagccatttgttctagtaggtatgtggcactcatcatgattttaatgtgaattttctgatgattaatgaagtgaagcactgtttcatgtgtttcttggccatttggagatcttcttttatataatgcctacatgtgtcatttgctcatttttatattggatcgtctaaccttttctagttgagcagtaggagttcttttttttatcttttcctgtaatccactgtaccttagaaaggagttcttcatatagtctgtatatgagttgtttgtcagagatatatgagttgcaaatatcttctcctccctctgtctgccacctgtttaaaataattttattggaacatagccaacatttgtttatatattatctatgactgcttttgcactacaggggcagaattgggtagttgtgatagagacctactgacctgcaaagcctaaaatatttagtgtctgatctgttacagaaagtttgttaacccttgatctagagaaccgtattcattttctattactgcataacaaattgccacaaatttagtagcttaaaacaatgcccacatttattagcccacagtttccatggataagtaggctgaggacagcttagctgggtcctctgcatagagtcacacaaggctacagttaagcttttggccagggctgggctctcatctggaggcttcaatggggaaggatccatgtccaagttcattcaggttgctggcagaattcatttccctgtggccttgggaatgatagcttccctcttttactggctataggccagagctggccctcagctcctaacggccagttccctgccacgtggccctctccataggaagtccacaacatagcagtgagctcattcagagccagcaggagagcaagaatgagtctgctagcaaggtagaatcatttaatgtaacaaaatgacaagagtgacatctcattatctttgccatattctgttagctagaagcaagtcacaggttctactcacactggaaggaaggggatgtacaccaggagggtcaccttagagtctgtcacagttactattagtaatatattggtgtcttaagtttacagatgtttttctatgtttatatagttgaattctgttttaagcaaaaatggcatcatacagtttcttttgtaactggcttatataataatatcatgaataatgtaacatgaacattttttcatgtcagtaaatccagatccatatcatttcttattgtggcttgtatcatacctcactatttgaatataccataatttatttaatcaattccgtcttgttaaatatcaggattgcttgtggtttatgtcacattttaccaggctgccatagaagtatatgtgagtgcccatttccccacactgcctcagtgctggttataattctgttgcagtcagtggctcttgacaaaaatgtatatgtgaaactgaacacctcctattctccttccttctcctgtgtatctgttttagataagaaggctgactgcacaatcacaatggctgactcagacttcctggctttaatgactggtaaaatgaatcctcagtcggtaagtatgatggagcttatatcctgctagtaggtaggtctttcagccctttctactccatctcctgactcagactctaaagtgcaaagtggtcagactcacaaaactcagtgttccccaaacagttgacagacgtctgtggagcaagctgtgtgccacacactgtcttgtgtgctggaagtgcccagaagagtaagaaagttcccacgctcagggcatccacagatgtgtaaaagagtcagtgcagccagagatccaaggtgccacacctggcttgtggtcaggggaggatgaaggcaggagcagccatatctctctgggccatcagggagagcaccacagaggaagcagctcttgagcttagtacccaggcggaaagtaggagtgttccaggaggagggaggggtggcatgaacaaaggcctgaccttttacattccatttatttgcccatgctcttctttttgcctgacctgtccttacctgacaaatgacttgtctttcaaaattagctcagatattatctccaaggacctctttccaagttgctggggagctgtaaccagtccctctcctgagccacgtactggactgccagcttagtgcctgttgtgttatgttagtcataatatgcctctctctcttccctgttaggctgtgagtgtctcaaagcatcaaagcacatcttatttgtctttatgtttccagaatttagcacagtatctgatgtttttaggtattctgtaaacaactgttggactaaattgcatttgtctaaagtgtgtttatgccttgtatagattttcctagtccccaaattgtcaagggtcctcttaggctcttcagctgcagtgttgaatggacttgatatagtgagctttctgtcaacttgatatatactgagctttccattaataaaaaagaaactaagacgtttctttccaatgtaacttaattttttctgttgtctcagtctggtttgttttaggttttattcctgtggttctctggtaatttccaagattggataaaacaactaaatctcactcccacttgcttttttaaaatgctttttctacgtaaccaagcacattttagttgatgccatgacaagtgagaaatttgcatctgtgatgtttcagctgaatacacaccattggcactgacatttccactgagcctgctccagaaatctggacagaacagaggccaccagtataggagctggctgtcatcctccttcccacccactgcacatgccatgcacagctttggcaggctgttcagacttcacacatcagctgccttcattctctcaatttatctttgtactgcccattttgggggcaaggtgtcagcttattttccttcagcacctgttaacacccaaaggaattaaagataaaaatagcagacctttctattaatgtgctaatggacttcccttatgctcagaggatttccagaggatttgactggaaatcgttaaatgcagtggaaattctaatttcagtgtttggctccagcagcaagcgtacatgaagaacacctaggggccagattaaaatcatctttatgtatggactctctgaagggtgaagattcatgttttctctattgttagtaaataaaaagtgattttctttgttaacttacaaaggagaaaggtggcgagtttctcctgtactactggtccgtatttttaaatgatgtttgttcaatatattgtgttctgagacacctgacctttaaggcatcagacagaaggctttgtgccatatagaaaggaaatatttagtttgtccagacagaggaaggggaaaaaaaggaattagtcacccttaccaggaggtacagaaaaaaacagagctccttacattcccatggatgatgtagaagagctcctagcttcttaatgtactgttaaaaacctaggactaccagaagctttttttttaaatctagcccttccttattttaagcattcagttaaaatactgagatcatggcagggaaattatgctacgttcccaattttgctgtttctcttaagttttcctgggattttgttacatggtaaatttagcaaacatcatgtgatctaatcccaggcagttgttaaatggaacaaattgtggctctgcacttcagattggtttgatttttcttgttgagccaaagagtaacacaagcacctcattctcagcaggctctgtgccctctgtagggataagtcctttatcattggtggcatttcattcacatgcatgttggattgaatcccaagagtttctgtgttttttgtgtatgctttttctctcagcagcctgctaaaaatttcagttcatatttcccacctacatggaatgttttaaaacataatcagtgtagtatgaacccactttgaggaggacaggtgaaaacaggctcaatttctatgagaaatttgggaaagctgctcctttctgctgatctgcaaaaagtgtggcctttacaaattcttccttttgaagaatgtggttccaaatctattccagaaagccaagtttcatattttagagaaagtcatgtgacctggataaataaatgatctcagggctagatagtgtagaaacatcagcaatcttaaaacaaaaaaacaccaagtaatgaattttctttcttcttcacaggccttctttcaaggcaaattgaaaatcactggcaacatgggtctcgctatgaagttacaaaatcttcagcttcagccaggcaacgctaagctctgaagaactccctttggctacttttgaaaatcaagatgagatatatagatatatatccatacattttattgtcagaatttagactgaaactacacattggcaaatagcgtgggatagatttgtttcttaatgggtgtgaccaatcctgtttttcctatgctctgggtgaatagagcctgatggtatactactgctttgcggaattgcatacaactgtgcattacaaagttaatatggtaattatggtctggggtaaaattgagtttcagaataaaattaggaacagtaaaatccaaagaactatgtaaacaaaaaagcttttgttttgcttacaaagtatatttaaggattattctgctgaagattcagtttaagagttttccttgggagaactaagtaagaaacacaatgccaacagctggccagtaattagtgttgtgcacttcatgtcattaatcaatttctcaatagttcttaaaattagtgagattaaaaatctaaaaattttgcatttcatgctatcagaaacagtattttcttcccaaatcaaaataaaagaaatatgatcagagcttgaacacaggcttatttttaaaataaaaatatttttaacatgggtttccttattgaaaaatcagtgtattagtcataaaacaccatcattaagaataattgaacaataaagtttgctttcagatgcagttttcaaattataatctcatttcaatttataacgttctcagtcctttgttataattttcctttttcatgtaagtttaattatctgcatttatcttttttcctagtttttctaatactaatgttatttcttaaaattcagtgagatataggataaaataatgctttgagaagaatgtttaatagaaaattaaaataactttttctggcctctcttgtttttactgtgtatgttcttgctcagggctctctagataatgcagaataaagagaaacgttgggggatttataaactgaatgttatctggacataatcactagtttttgattggggaggcagtgtggtataatagaaagagcacttgactgggagccaagagacttgcttctcttaggcagataactgcctgcctggacctgtttgctaaactattaggagatttaagtagatgatcccaaaggtcccttctgctcagaatcctgtgagtttcctcagagcacagtagaatggtttgggaattacccaggccccacctttctgttgtttactcattacttcacccataggtggtcagaggtagacaaccagctggtatcatttgtttaggtgtttggagcccttgctgatatagtcaggactatggatcagatctcctaagaccatttagctttgcatgttttgtgaccagcagaacagcatttggtgatagggcaagaggatacattaagccaatagaagttgatcccaagttccataaaatgaattcagaacacagacctacttcctaatcatagtagcttcttactctgagaagaaaaagacttcaagaaaagagtttcaacaaaatgtctgatttctctgtagtttggatttgctgcatcattctttcctcacttgtcccagataacaagagatacctgaaataggctttaggatgaacctcaaaaactaaaaggaaaaacaaaaactggttcttacagtaggattatattcatatatgatgtaatttgtgtgcatgatagaaaagtacttagtgataaaatagtttgatttttttcccccttctggtattatagtttggaggaaggagattaagttttaatttgagttaaaactgccattactagttgtgctagttgaagagatcaagtcttagttgcccgattgataaagtggagatactaatatcggcttcctaggattatgagaagctggagagataacatgtaaagtacctatagcagttgctagtttagggtagtcattcagtaaatgtgagttcccttgctcttctcaccattagcagcaccacttgctcctgtgatatatgataatgatgtttgtagtgttatgtcccacttttggagtctttcgtttgttcatttaacgagtatttattgagtgcctaccatgtacagagcactatatagaaggcataatctcactggagatactagtcagctctttttctcaaggtgcttacattctaatgggtgagacagtcagtcaaagagacaattattattgactatgaagtgcccagcaggaaatggttagggtgctctgataagcagtcatagcgagggaccttgataaagtagttaaaagagatgtctttgaggaagtaatttttaagctgagatctgaaggttaagaaggagcaaaccatgcaaagaacattgcatgaaagggtggaaacaggcttgatttgttccaaaaattgcaagggggccagtgtgagtggaatagtgagcaggaaggataggcccgagataagatcggatagatacacagaagctagttttattgggatttgttcattacggtaaggctttttttgtatttcattctt

SEQ ID NO: 15897 - DNA, 58821 bp, Human
tgtggcacactaaatggtgctataagaacatttgctagagtgagttgaaattctcctgttgaagaccgtaggaacagtggaaagaatggctgtagtctggtaggcaggtagtggtaggctcagcctgtgggagagaggagtcagtggtggctatagggcacgtcctgggaatgggagtcatggagctgtggtagaaagcaagactcacctatatcatggcacagctaaaggccaggtctgggctgggtgtggtggctcatgcctgcagtcccaacacgttaggaggccaagatgggaggattgtttgagcccaggagttgatcaaaacccaaatccaaatacctacttagcatattttctcttctgggaagtaactaaccacctgattatttggaaaatgaggcatttgttggagttgaaggtgtagcaagaaacttttggttttaagagtcaaagtcagaggaaaaaaaactctcagacttgtattcatccccaccccccaccccaagctactgcaaagagcaggggctttggaagattggtttgttgaaatgaagttcctttgacaaaggtacctgggcccatttctctcattctaaaaaggacaagactgatacccagagacggcaaggtcacagagctgattaaattgggatcagaatcttctcagtcaggagctctgtccatggcttcagagcctgtgccccagtcccctctccccacctctcccctatgccccacttggcccgtcctcttcatcctctgcccctgtctcctatgtcaggaagaggaagcccctgtgtgcaccccaccctttacctcccaccctcactgcagactgcacttcccattccctgctgcctgctgcctgactgctcctaatgagattacagatctctggtgaaatagacgagggttaattccccctggctttacagggcagggcaggccaggccacaagaaatagcaaaaagacacctattctccaaagcactaagtgtgataatgaccctaagagtccgttcccctgttcagcacaccagggttcacactgcgtttccaaataccctctgggtggaattttgtaccagccctaacaaagtagatgctgttatcatctctattttacagatggagaaactgaggcacagtgagatgaaatgcttgtctgaggtcacacagctagtaagtggcagagctgggacccgaatgtgggtctcttgggctctgtcatctttaaaaaataataggcccagagagcctgcagggtgcccagcaccaggcttgaaacagccctgaagcatctacgtcccatttcccggtgagtggcacagcccacctttgaactcaggtcccctggactcgaatctacattccccacaatactgccaagcacccttgaacctatctgcctgttcatgtggtggaaacagactggcctagccctgacttctgacctctgtgaccatggccaagggactggcttctggggtctcagcctccctttctgaaaaatgaaggtgggaaccctgggatctttgggacaattccctatgattggcatagctaaggcagccagcacaggcctggcccgcagcacatgcacccacccacctcagtttctttatctgtaaaatggtgatattaatagtacttatttcttgggattggtgttaggattaaatatgccagtacatgtaacactcttctagaatggcacctggtgcatagtaaatgcttaattaatgttgagggaaactgatatcttactgtcttgtttttgattctttctggaaggaagcaggggtaaagatcaaaccaaccaagcaaatgttcctcttgttccttccagtacctggtccactcaactgtttaagaggaacgcttggctttgaggcctgaactcccagaccacgtggtctgctctaatttcccaggccctaatctgctcccagctcctaatgatgcagctggtaataggattgtggcttccctctaaggcggccacacgggcatggccgtggggctggcgactggtgtttagcaactccgaccacctgcctgctgaggggctagagccctcagcccagaccctgtgcccccggccgggctctcatgcgtggaatggtgctgtgccccttgccagcaggccaggctcaccatggtgccgcatgccatcttggcacgggggagggacgtgtgcaggcggaatggactcctcatcctgtctgtgctgtctgtcatcgtgggctgcctcctcggcttcttcttgaggacccggcgcctctcaccacaggtcagccacccagagcatctcgggacccctgtccaggaggggcgtgtgggcctgagggatctggggtcccgttctagcatcacagctccctggtgccatgacagtgtgtgaatccctctgcctctctgggtcctggttttctcatctgtaacatgggtgtgataaacactttgcaggactagagggaagaaccagtgatgtggctggggagtgattacaaacccagcaccatcaggtgaggagaggcgagggtgcctcatgacgacaaacacagggccaagagctgtggcggggaaagaggggggtcttgtgtgagttcaaacaggcaccagagaacacctcctaaaggctgctcaaatgacaagagatccaggaagggtgctctaggcagaggtgacagcagatgccaggtgcagcggccggagcgcagaggccagcaggcccataggtcccatcgccacacgtgggcttgcggcaaccatgagatgcttttgggcagaagagcgacaggccagtttggagcttgggagacccctcaggtgctgagtggagagggggtgattctggggcaggcagggggccgagaaggggcagcctgggggagatgcggcagtgcagacaaaagggacagacgtgagaactgttttcaaaagggggagcttcaggatgtgggggccgattggatgtgggctgggggacaggaaggggagccaggccccgggtttccagcctgtgtaactgccatgaagaagctgcgtttcctgggaaagagcccctttccctgtcagcccccatctcctacaggagagggagggacattcccatggtgttaaggacaaaatcattctgccactagttaaactggtaaggaaggctctattcaggactattgtggtaggggggtagttatcaagacctcctggggagagagatgggacccaaccacaaatacaacaaagatggctggagatttatagccagcgagcagagggagggggtcggggacagaaaatgactacaggagacatcagggtagggggattcttgttgaaggcaggccagggtgatcagacattgatctgggatgaggaatttgatccagtatcaggatgctggagggtgagggatcctcactaaactgacttggcaggacttttgctacagctggactatgcaggctgaagacaaggcccaaggacaaagcccagtggaaaagagggctcagaggagcctgtctaaagtgtggtcaaggagagaggctttgtcaatgggctcctggaagagtccctattcccagaaagtcctcttcccgcagctcactaatgtctaatgccatctctacaactggggtcaggcattagactttgtcttccattaaaaggaaaacacccactcctggagaactgagccacgactatagtgaccctgttaagcctcgagcagttatttaggaagaagcatggactctggaggcagagaaaccctgaactttgactctgctagcaaatggctaggcaatatcctctctcctccctgggcctcagtttccttgtctgtaaaatgggatgtggggcagtatatgtctactagaattattatgaggaataaaccaaggattcatcaatgcccagcatacagtaggtgcttactacgtgttacttccccctccctcccttatgtacctgttaaagtcctatctacatcaggaaccatctcatcatccatagctgatgaaagtaactgtaaccccgctgctggctgcctggcttcagagctggttatatgggtgtctctttctcccaccaagctgcatattgctgaacaacatatgggtttgtttttttttttaaccaaaacgtgagcctagccctgtgtcaggcacagagagaacgctcaactatctgctgcattaaactggcaatggaacaaaaaaatctgcaatctgttctctttaattttcctcagcaacaaaaatatatctcctgcaggaagattattttgtgaaaacaaattggaatgcctattattaaaagccaaactcatctggggcctactttgccaaagctgcctttcccatctgtttggaaatgcaaatgtattccggtctggattaacctgccagataaattgaaggaaggatgtagaggcttagaacaattatttggcagaaactggctttctcagcatcttactttgaaatctgggatttctctgtttgatctctttgcctgtgactcagaaactaaacacttcttgttttgtaagcttatgcaacaggcaaaaatcataaacaatatggaaaatggtagaatgttctatttgtgaaaaagaacttttatccttgataaaatcacaggattttatcttggtgtatgagtgtctcatttaaaaatactgagcattttgagacttccagttaaaccatggtgaatcacaggtgtatccatttttttccctccttcctagaattccactaacattttagtaatgggatttttaaaaggtaaaaccaccaagaataaagagaatataaaaggagacagttgagaaaaagaaatagagaggctacaacaaattagataatatggaggtgggtggagctgatgacctcgttcacagaaagctggaatcttagtctgtggaagttgataccaagtcagtttgtcttgcagactccagaacgtaacagagcaagatgctgcactaggcagggtgaggctggggttgaaagcctgggcatggtttggagttttgtaaccagagcagttagacccctagggaccttccaattcagttgggggactcatccacccatctccacccactgcctgccccaaggaaccagagaagctggacttgagggtattgggccacccctgtgtgtgttggggagagggccatgctgaggcacctacttcaaactaattaacagacatccttgtctgagtggggtccccagcacggtttcagatcgctgtcagctgagcttaggcaccatgtcattcctcagccaaaggcaggaagagacttctctcactgaggcctcagagaaaagatctctaaattctgctataaaggagactcctctaccatcccacccagccccagtgaaaaagccagatcagcacctgtcaccctgccctgagggccgtcagttgacaaaccctactcatacatgcagaagtttagcgcttcaaacttacatacgagcagaaagccacgccaccagaaatgtgaggaggctcctaatgtgaaacagagtaaacgaagagaaaagggggtctctaatgagagaaacaaagagaaaagtgggtctctagtgaagcagagacaaggcggggaggagaaggaagctttgtaaatctcctcttaagctttctggagctgcgagtgaagatatagttaccgtacaacagaggggatgtgaaaagaaggaacaatcagagaacaagaaagaatctggggaaattaaaaatagaagaactaagataaaaatgtgagtagctgcccaacacatagaaaggataaatactcgaagtgttggagaccctgaataccctgatttgaacattacacagtgtatttaacaatataccaactgtatcccataaatatgtacaaatattatatattaatataaaaactttggctaggcctggtggctcatgcctgtaatcctagcactttgggaggccaaggcgggtggattgcctgaccccaggcattcagggccagcctgggcaacatggtgtgagaccccatctccaaaaaaaaaaaaaaaaattaatgtcaataactgggataaagttgtagaaatctcccagaaactagaacaaaaataaatgaaaatagaaaaagaaaatataagaaaattagaatgttcaatgtccagctacctaatgacacttttagagacagctaacagaagaaaaatagaggagaaacagtttgcagagaatctaagcagtttctcagaagtgaaaggcaagcatagcactgtcaattttgtttacaaaagaaagaaaaccccatactatggcccatcaccatgaaattaccaaaaagtggagataaactgatgatctttggatggttctggtggaataaaaccaacctcatctaaggaacaggaaatcagaatggctttgaacatcttaagcaaactggaagctagaagacaagggagaaacaccttctaaacctgaggggaaattatttccaacgaagtatctcacacatggccaggctaatatcagaggtaaaggtagaataaaggcatttttactcatgtaaggactcagaaaagtttatctcccatccactctttctcagaaagctaccaaaggagatgtttcagcaaaacaaggaagtaaaccaagaggacaaaggatcccagaaacagggggccctctaaaggacaagtcccagaatgacaaccaagaaggaaaccatgacaagcactgggcctagagagcagtcagtccaaactggagcaggaaggtggaaagctcacagaccaaggccccaggcaggataaaagagaactgatgtgcttgagagagcagaaaatactattgttaggtagtttagtagacatgttaaaatgtttggaagaaattagtgggtgattcccagaaaacaagacaaataaaaatcagtcaattaactttaggctacaagcaaggagacatggttgtagtacattacttggctcaatggtaaacactgtttggcgatcaaaacattgtaaatcttgatttactaaaaaattgatataaatataatgctgaaataggtggagagaaagggagtaagaactaactcctcatcaatcatggcagggaaattgatagatgtcaaaatgatgaatcaagaaatagcattatgaccatattatctagaaatagtgatactatgggaaacagctagaagaactgagcatgttcactactgggaagttgcaagatagggatagagagaggtgaggcaagagctgcctttttatcagtagagcaccttttttttttttttttttttttggagatagcgtctccctctgttgcccaggctggagtgcagtggtgcgatcttagctcactgcaatccccgcctcctgggttcaagcgaatcttgtgcttcagcctcctgagtagctgggactacaggcgtgcaccaccatgcccagctaatttttgtatttttagtagagacggggttttgccatgttggctgggctggtctcgaactcttaacctcaagtgatccacctaccttggcctcccaaagtgctgggattacaggcataagccaccgagcctggctattagagcacttttaacttaaagaatatatacatgtgggtgccagtgcagtggctcacacctataatcccagcactttgggaggcctagctgggaggactgtttgagtccaggagtttgagactagtctgggcaacatagtgagacactgtctctacaaaaaatacaaaaattagctgggcttggtggcatacatctgtggtctcagctactcgggagcctgaggtgtgaagattacttgagcccaggaggtggaggttgcagtgagctgaaatcatgccactgccctcctgcctgggtaacagaatgagaccttgtctcaaaaaaaaaaaaaaatatatatatatataatatatatatgtttttatatattatatatgtttttatatattatatatgtttatatattatatatgtttatatattatatatgtttatatattatatatgtttatatattatatatgtttatatattatatatgtttatatatattatatatgtttatataaatatatggactaaagttaattaaaaatatattgttggcagggcatggtggctcacgcctgtaatccaagcactttgggaggccgaggcgggcggatcaacaaggtcaggagattaagaccatcctggcaaacatggtgaaaccccatctctactaaaatacacaaatttagccgggcatagtggcgcgcacctgtagtcccagctacttgggagggtgaggcagggggattggttgaacctgggaggcggaggttgcagtgagccgagatggcaccactgcactgcactccagcctggtgacagagcaagactctgtctaaaaaatatatatatataatatataattatatatattattttatatatatatatatagagagagagagagtcatgatgggcatatttctttaaaaagcagattttctggtgcattggaaatgttagcagtcctggtcctgtgctgcggttaacattgggtgggtctgtcacctcccttttgcggttcagcttcctcatctatcacatgagtgggctgggctagaagatctcaagagtcccctcatagcaccaacatttgatgatttggagatttttaaagcatcagatcatcaaccgagtatgtttggctttggttaaaaaaaaatagttgcaagtacaacaattcaacttggatgatgtttgaaagtccatttgcctgcctcgcccacaacctcaccctctgaagaaagtggccccatgccagggttgccagaagtagcagaactgaattaagttaaaaaattttataaacagcacacccagttaaactggagtttcagataaacagcattttttttttttagtataagaatgaactatatgttgttatctgaaagtctgatttaactgggcttagcagcccttctgcttcagttgtcaggtcctggtcacgtgactgttacttgcgagacagcttattgggcaaggagttggcgccttagtcagagatccgtggacaggctggagccagcggcctaggaaggggtcaggcgtaagaactctgccaaagggggctgtttctaccgcgtggtgttgcacccattcaatctgatcctctctctctcagcattttcgaggagaagcactagagaatggacccaaaacagatggagaaactgactcgcaaggcggccatggtctgcttaggagtgggtctcctcaccagctaggctgggaacttctcaggacaggaaccctgcctagttcatgttggggtacccactgtgatgcgtggcacgatgcgggttgaatgaatgcatgaacagtactcggctctgtcctctggtcacctgccatctgctacacgagagagattttattccatggctaggcagatgcgtggtgcagatggaggagagctgttattttcaggattaccaaacattggctgtcatccaggcgctgtgctaagtgcttgcgtgcattctcccgtttaagccccccaatgaccctgtgaggcagagcagtccccccttatccgccatttcgctttctgtgatttcagttaccgatggtctgaaaatgggtgagaacagtactggaagatattttaagagagaccacattcacataacttttattacagtatattctaatcgctccatttgattattagttactgttaatctcttactgtgtctaatttatgaattacattttatcgtaggtatgtacatataggaaaaaaacaacgtccacagggttcagtctctgtggtttcaggcatccactggcggtctcggaacctgtccgctgagaataagtagggactactgtagttattaccctcatgttacagatgagaaaaacacaaaactcagagtggtcacagaagatgcttaaggccacacagcttgtgggggattggtggaggcggggtgtttaccaggattggaacccagttctgtggctccaaagccagttctttctccatggtctctgctgccatgtgctagacaggggagtcagatgggatagtgcttcaaagactgtgaagaacggaaccactgtgcagtctgcatctcttgctataaccccagttcttactgtgttttcaggaaattagttacttccagttccctggagagctcctgatgaggatgctgaagatgatgatcctgccactggtggtctccaggtgagagcgggggtttgaccaggtggtccggaaccaggagggtagaggatggcttctgttgctgccctgctcctgctgtgggtggctggagagcaaccacaggccctgggatgagtgtgaccgtggggcctttatgggcagtgccgtgggctgccggcttctgagtcattcagtggccccagttgttggttccatccagtagaatttttagtggatagaacaggtgatttggaatcaacggatatgacccgactccaagatagctcaaggccagggagttgagggttggcttcccagaggaggggctgttcatggtaatgcagcaaggcctggggaaaagagaactaactctgaggatactccagtgatcacagcctggcttggctgtgtaaccttggacatattacctcacctctctacgcctcagtttcctcatctgtaaaatgggaataacaacacctacttcgaagggttgtcatgaagactatatgcttgtgtatgctgagcactcaggaggttgggacttggggacaagggcgggatggtgcgagatgaatttggagggtgagctcttgcccaatcatgaacgaccttgaacaccaggctgaagaattcagaccttacccagtagggtgcgggccatggaaatcatgggagatcacttggtccctttcactgatgtgctaggtgaacttgagcaaccctatccctgtccaggtcttgagtattccagatgtataatgagtggctgctccaggtggtgtctaagagccttttgctctgaggccatgagaaatcttcatcttccaggactcctctgcagagaggaaagaggatgagcctctgcatgcgttctgcctcccagcctccctgctgctgagcagtgagccagctccttggacctcccccctttgtgaagtggagataatccccaggccaagggcgctttgtattttctgcacagaggcctttgcaagcagcatttaaatctctcaggactcagccttcaaggctctgctgaaatgctacctccctcaggaagccttccctgactcctcaactcactctagtgactgtctcctctttctgcatctttggagtcattcactgagcctgtgaatctgtcagggtcagcagtcctctgtgttgctgaatctgtacgacacgtccagttcttccacacggcctctccacagccatgggtgcagctgattactcttgccctcatgaaatgcccttccctatggactcacactcttctaactttttgcctgctttctgcccctccatcttggtctctctccttctactcaacctccaaatgttcagcttctccagccttttctcatctaatttcatagctttaacataccacctacaagcccaatgcccccagatggagatctccccagacctctcctgtgagctccatacttcattaaccaactgcctatttgacatctccacttggatgtttcacaaacgtttcaagttttgttttgtttgagataggatcttgccctgtcgcccaggctagagtgcagtggcacaatctcagctcactgcagcctcggcttcctgggttcaagtgatcctcctacctcagccccccaagtagctgggaccacaggcacacaccaccacacctaattattttttgtattttttgtagaggcggggtctcaccatgttgcccaggctggtctcaaactcctgagctccagcaatccacctgcctcagcctcccaaagtgcgggaattataggcatgagccaccgtgcccagccacacttcaagtttaatgtcaccaacttgaagttccacccagaaaactgcctccttttcctgttttcttcttgtccgcaaatggcagctccatcacccaggtcttccatcgggcctgtcattggctatcctctttctctcaaccccacagccccatccacagttccagtggattctgcctactcagtcgaagaatggagcttcctccccaccctacaggcccgggcactctcttctcacgtccagactccaccgccacctcactggtctcctcgcctcacttcttgtccccgtcccatctattccacccagtggccagaaggatcttgagaaaagcagattgggccctgcccctcatttaccttcaacagcttccatgacatgtagaatcaacctgcagaccgttaacctggtctaggaggccctgcatgatctgcctcgcccaccccacctcatcccatgtcacatactccagtcccaccagcctcaagttccctaagcagaccaagcccttaccatctcagggcctccacacgtgctgttccttcctctggaacatgcttccccaacatcttacatctcttcttcttcctctttttttccatctcaacttgcacatcatcttcttaggaaggccctccccaccaaccccttcatgccaccctggctctcccttactgtaccctgttccctcccggccacagcacatatcatatgttgtcattctatatgcattcacttgttaactggtttctttatccactgggctgtaagctttgcaaagttaacgaggctactctgcctagattcaactctgtgttgtcagcacctagccaagtgccaggcatatagtaggtgctcattaatactggtcaagtgaattaattaatggatcctgcaatcatgcattgtgctttctggacacttggccctgtgctgggtgctgcagacacagagatgatggagagactgtcctgtggtgttcacagactgctggggagactgacaggaaaatagacaatcacagaacagctaaataagtgcactggtggaggaagccaggacccttggcaggcagttctgtctgccctttcctgctgactgtcctaactgcctgggcattgcccctctctcagaacagaggcaccttagaggccattgtatggaccctggtgtcacacagcctggccttgctatgtattagctgtgtggccttggacaagtcactcaaaacaaaaaaatcctgttcagaagtcagaggccagggtcctcgacctgcctccaccacaagcgatcatgtgatctgaggtgaggcccccaaccctgggcttctttacccagcaacgaaggcccgtccagctctccaccttctggctctcaaatgcctggtctccctccaccagactcagtgttctcttggctggaaatgcatgtgatattaagttgagaaaagccaggacgtgttcatacatttcatttgtttattatagagtttggactggtgcagagcaaccgtgtcactaagaaatggaaccgctttaacattttcctatgaagggaaaattaaaccttcaggggggagatatgacgcatttctgagtcctaaaacccctcgttcctgaactctccctcctttggcctcaaactggcctattatccatcctggccaggagtccatccacactgtcccctgagctcttgctcctggccagcccagggctgggtgtccctgcctttgaggaacagccactctggtgtgaggttgttactcagggcagagcaaaatcaccagagctgctttgaaaaattcagatgtcaggcctgaccctgagctgactgagctagaaccccaaagggtccaagcagaggtttgctttcagagctccgaaagtattctgaggattttaaacctcttgattgtcctggggtcagaccttctggctccacagcttaggagcccagcaggaggctgtggtgctcccatccccaggggctccaagctgtgacccaggaaggcaagggttttctgcagtgtgtcctggctacagggcagtagcgggggagtggggggatgggggcagggggttacctttgggctcaccagcttccagttccaaccatctgcaggtctgggcctcgaagcctggctcccatgacatctgttcccacctcctctccaggacaaacagccaccctttccccatgccaagccctggaaccaggctggtcacccactagtcccacagcatgccacaagggtctatctccacactcctgctcctgcccagcccctgccatgcacgccctcttttaattcttttaatttaaagtctcactctgtattcaagacctagctcaaggttctgtgtgggaagtccttccacctccccatttgttggtaaaatggatgatgatctgtctccaatgctgacgctgtgtgtgacctgcatgagctgagtgtcgttagctcagtgacctcacggtcgcagctggcatgccacacaatgggggacaggcatcttttagtccagtagtgacatctatgtgagcaaaccaactagtatccctattcggaagagccactcatctcactgaacaagaaagccactgtcaaggggtcgggccagcggcatggccccctccgtgggcagggtcgtgtgcatctttgtttttttctgagatcccaggaggggatcaggtcattgacccccttgtctttcacactgacctctgcctggtactcagcgtgacagattcgttcagaagttggagatctaaacaacaagcaaagggaggtggtgaggtgtaaagaagtgtgggtgactgcaagggtggacgtgagggctgaaaggcccctgggctgccatggaggggtcacaggcacaccttgctctggagaaaggaggcccagtgggagggcagtggggccagcggggttggagctgagttcagtcactcttcccataatctggcatcttccagatgtgggctcttttttttctagaatttctccaacccagcccctggcccaagtccctcctcagacatgtgtgcttcagtccagctgagtgcagcccacgcttgaccagtggtggcttcatctgtcacaatgtggcgggggagcaggaagcatgggcgggggtggttgaaatctgcaaaggctacagggcaggaacagggctttggagtcaccctctagatgtgcaaatgtaaacaagccttttagcatctgagcctcagtgtccttatctataaagtgggaagaatacctccttcacgaggttattacgaaaagtaagtaagagaatgtacgtgaagacccagcatggctcctggtacgttatggatgtcccatgtttttcttttttctttttttttttcttttttgagacatagtctcactctgtcacccaggctggagtgcagtggcatgatctcagctcactgcaatctccacctcccgggttcaagcaattctcctgcctcagcctcccaagtagctgggattacaggcacccgccaccatgaccagcaaatttttgaattcttagtagagacggggtttcaccatgttggccaggctggtctcgaactcctgacctcaggtgatccgcccaccttggcctcccaaagtgctaggattacatgcgtgagccaccatgcctggcagatgtcccatgtttttctaacttattaaagcatcaccaggctcctcagatgtgtcatgaatgctcccccagcccgtggccacctctgtcactgctctcagcaggaagccccttggatggcctcttccatcttcatggttctaattagcacctgcagctcacctgtcccctgccctggaaagccacccttgactgaggcacacccgggtgctccctcaacactggtacagaccatgcagcatgccctgcttcacctgagtcgtgcacacctgcacatccacagggcctccgcaggggccctggccaggtcctgcccacttctccatgatgcactcacctggcacccagagccattccttgcgccatgacagtcagagcctccttatctgtcatgaattcctattcttttttgtttttaattgagacagggtcttactctgtccctcaggctggagtgcagtggcatgaccacagctcactgtaactttcaactccagggctcaatcgatcctcccgacttagcctcccaattagctgggactacaggcacacgccaccatgcccagctaattttttaaattttgggtagacatggggctctcactatgttgccaaggctggccttgaattcctgggctcgaggcatcctcctgccttggcctctcaaagtgctgggattacaggtgtgagtcaccgcaccctgcccaattcctattcttactgcctcttgcttttctatgcccttcactcctacaaccaagcagccttcatcagcttcccattcacaccagcattccttgcttcaagtagtgccttcagttatctcctggttctctgtgtgtgtgtctgtgtgtattcgttatcattgccgtgtaacaaattatcacaaacttagtgacataaacacacttcatggttgcctcagtccctgggccagcagtctgggcgggcttggctgagtcctctgctcagagtcttaggctgcaatccaggtgtccgctgggctctgttctcatccggaggcccaaccagggagaatccgcctccatgctccctcaggcatggacagaagtgattccccatggctgctgcctgagggcccagcattgacagctgtgcagtggagccactcaggttctagaggctgcctgcagctccccacccagctgtctccacaggcagctcacagcatagcactgtaggtcatcaaggccagcaggaagcccggttctcaccagtcttctgagtcaaagtcttctaccacataaccacagggagacatcccaccaccttgttgtgttctcatagaagtcacaggcactgccacactgcgggaggaggatataccagggcttgggtcatcggggtggcctgagggcctgtccacctccttctctctcctggaaccttccttctctcttcctctgtccccagagcagctggatgtctttcagaagtcacttctgctcacctctctccctggagccggcttgggttgagtggagccactgctcagcttctgtccaagtagttcatcaagaactttcttctgtataaggactgctcccttactgtaaaaataattctgaagaatataactctccccctttcatctgatttctcactgccccatacagggcctgctactgcctgtgcctgatcaatacattttcaatgaataagaagcagcagagggcagcggcagcagagttcagggaaagtctcaccaccagcatttgtatgggccctggaggacagttaggagctgaactttaaagatgttttcatattttaaaaaattagataaagccctggcaacatagtgagaccccatctctacaaaaaaaaaaaaaaaaaaaaaaacttttaaaattagccaggcatgatggtgggcacctgtagtcctggctacttgggaggctgaggtgggaggatcgcttgagcccagaaggttgagcctgcagtgagccatgttcatgccattgcactccagcctgggcaacaaagcaagaccttatctcataaaaaaaaaattagataagcaaattacaaacattttggataacagagaagaaaccatcctctcactccacattgctaattctgccactgtgatttcttctctacaaggtttgttcttattcttactggtgaattcaccagatgtgaggtgaggtccttggctgatgggatcagaagcccaactgtctgggccccagagctggttgggcctgtcccccgatgctagcaaggggcaatcaaatatgccacatactgatttattcattcccagagatcaagacacttgccagcaaggacagtcatatgcaggctctggccagagcctctctgtgggcttaccatgcagggaacccactggtgaaatctgcttgctggtgggtacatttagttatttaactgtataacccggcgtaactccaggtttgcggttttcagtttatttcagccctcccaccacccccgccttatagtggagtcccatcatatgtgcatttaacttaagtgaattcaattacatgtgctctgaaaaagggagaaaatcatttaaatgagacaggagactcctccttccaagggctcttccccaggtgagggccacgagagaggagggcctgaattgcctccaccagcctctgtgcccaggcacctcctgaacagtgagcacctccctgaagccagagagtttctagggcctgcagaggggtgggtgttttagatcacggcctctgagtgtatgctgatgctctcatctggtgtttgcttaaagaaacagcaacccactccaaggctggaagggaaactgtcttgaatgaacttacacaaaactatacctcctggactctatgggcaacttaagagattttcaaaggcaaaattaattacactttgtttttgctttactgacttgaaactgaatacactgaatatggtcctactcccctgtactagcaggaagcccagtgtgtccctctggaggcctccaccccgtggccacagtcagcttatttcattcagtggaagcttctggtgtaaacagagctggaacatggggtcctgccaccagccctgctgctctggttccctccacggggtggccctgtggaacgcaggtcccgcacgctctggtggaagtctgcacactgccccttgcaggtgcacaacgctgctcaggccacagggatgcctccagacccctaggtccccccgaagtgctcaataattgttcctaaagcagcctcagtcatgtcctgagatcagctccccgggagttgagccccaattcccttttccctcctactgggttcattttggaggccttgaatgccaggccatctcggctgggggactctagcgtaccctggtgctaacttcaaatcacagggaactggggctcaggtcttagtctttttcctctcagaaggccctgatcctctggtgcaaatgggcacagttttccataactctgcagatctcaagttctcaaggaggaggcattcatcaagccacaacagctcctcccttcccctgacagtgctgccttctcatccgacatttgctgctcaaaagattctttgcaaaataaaattgcctgcaggggaacttgctctgtccacccaggaacagagacgccttggacaaaaattagaaaattctgcctcacattacattagtataggaacgaatcatctggacgggacctgcattggggcccccctcccatggttttgccctcctcagccgtcttccgtgtgctgccacagttcactaacgccatgccaattatatctttatttagaaaagtcaagccttcagggcctgggagccttactttcccattctccccccagcaggccacttgtcactaccccaatcctttttgctttcaacttacagtataacccaaaaagtatcttccacaaaaataaatctgtagcctgcttgctttggttttcccccaatgtgatgtcataagaatttccacgctgcaccttcaccttggtgatcctgttttactcacccactcgggaggcacagagtttgcaaagtcttttgcctgtcacaaggcacttgggaggctgctagactcttgagggagctgccctgcctcgggactgtggtctcacctcgagttcaccctcttagcctcagccataaaataggcacaatgctgtctgctaatttacaaagcaggtcccggcaggtgctctgtgtgtgtgtttgtgtgcccatgtgtgtttgtgtgtgtggcccattatggccccattccactgaggctagactttgcacctcaccttgggaggtcaactgagccttgttttcacacatccccagacaagcttgacacaaggaattaggggtaagtcagaccagcatctggatccagctagagcctccaattctccacttgctttttgccaaacccttctctcccctcattcttcagtttcttaaaccaggcgtccttcaggggaaactgaatccatgtgtttgtgattcactagggctgcgcatggtagagtgttctgtgagctccacaacatagcaaagacagccaagcgtgggtgtgggtttgtctgtgaagctgtgttgtgtgtgtgtgtgtgtgtgtgtgtgtgttgtattgtgtatgtattgttttccttcctatttcttgtaaggactttaaactgatttttcttagaatcaggaaatcatgtttggccagagaaactcaacaatcccttctccccttcctgaggaactctagtttggcagaaaattcccaaacacccacattctaacttattggaaatgggcctgggccaagcagccgtcaaagtctggtttgggagccagtgtgcagggggctgcccagactccccaggacaggccgtgagcaggaggaggcagaggagcgggtggccagagggccaaaccggtacagcctgtgcttcggatgctgccctccgagtcagggggtagccacagtttggcgagctccactgaaccttctggtgtgagccctgggacctgcctttggccctcctgcccagtcagatgatttgccttactcatcaagaggggaaacgtggcccgctgtgggctgcgggtggggtcagacctccagcctggtgactccgaaaaactcccaggctttatcctgcaccacagacttccatgctctcgctcccttccagttagagaattcctacttggccttcgaggctccatccagctgtgccctcctctgggaggcccagcccgatgcccggagggctggccctgctctggcgctcagtcacagctacccccacccccgggttggtgttgctctgctgctggtctccccacccgctggccagagcaccaggaagaacacagacccacctcattcccttctgagccccacagcacccagtgcaaatgttcaacaccgggcagggtgggcacatatctcagagcctgggaaggtgggtgaggttttgaaaactgtgctgccgcccttctctgtggagaaccgctgcactggagagaggcccacaggatggccccgcctgagccctgtgcggggcagactccaggggccctgctggtgcagggaggggaggcaggagacctgagttcccctgactcctcatgatctttgccacatgggcaaggaaggggtgggggattcagttcacgtggagttggaaactggacctggccctgactgccttagggaatgcagccttcttggtggagaatggttgagaatggccggcagtctgacagtgagctctgagggctgcagctgtggctcctccagcttttgcttttgatccagttcaagcttgtcattctcacaggtcccagtggagcgccctcttggcacccaggcctgggaaggagggaccttcagagggcagcagggcatgccagggtagcagcacccaccgcccacactctgagccccacactctctcccaccttccctccatggaaatcaaggtggaggccaagaggtttggtccatgtggctccagagggctggctgggcccagtgtggcccaatgctcttccccggaggcggatttcattgtgacaccaggaaggacttcctaataagcatcacgagctcatagtggaggggctgactcagaaggtagtgagtgctctgtcctctgagatatgcaagcagaggtggtggaggaatttctgcccttgggagggtgtgctgagacgagatggcccagactttagctgagtgggagtctgggcatgctgccttaggcctcaggaggagtcggcttgagtgtggggctttggcagagccgtctgggaagcatgacttggagctggcgctaatgggcatggcactggctgtcagctgttgggcctgccttctgctcaggggaaaagaagagtaagccatgatgctcagatggactgaagggacccctcttgcccgcagacccccgaagcctccttcctgcggcctgtctggtagacttcctgcagctgcatcccagggccagctggggagagcctctgtggctaggtcagccgaggccagagcccaaggacttggctgcagggcttggggctcctcactgtccctcaggtcctcccactgccaggaggttgtgactggatgctgtcatgccagcagactagggcttgaacccacttattgtgtgactttagcaagttgcttgcacacctccagtgactgggaggtcaccacttctcaaggtagttcctgccagagcaggacagctctgccagaaagttattcctggtgctgagctgagagccctagggcttttcccatcatccccagcattcccaggtctgctcccctccagaccacacagcacctgccccccagccccccagctgctccccgcaaccaggcacgtgcctctatcacctgctgcctacccagctgccctctacaggacacacacaccccgccccgtccctttctcaatgagtcaaagcaggtctgcagcagcctccaccagcccccgggcttctgaagccacaggcggggggcccaccagccctttggcagccccgcgtcccaggtgactcaccagctggcagcaaacaaagcccaaagtcccctccccacgtgtgcagccacggctcagcctccccctcccaccccggtgtttgtgcactccaagctgtggaagccaagtgcggcccaacacatgtctgtgttcaggctcattgtgtcagaattgactgctggggtctgcttggattcccaactccctcatccagcacattagctattcctcccagcttcctgtcctctacaaatctgctccacatgctgtcgggggccttggccaagccattgattaaaatgaccagaaaggagagggccgaaagcagagtcctgaagctgatctctagacaccctctctactgcccaggacattcagctccttgtcccttcaccaagcccccatctcttcccagatttctggtgccaactgtctcgatgtcacacagacacacaacaccgtgggcattcccctaagcccatccggggaccaaggctggtactggtgatctgttctcaggaaaccttcaatggctgctcagtcacctgggcacacaagtcgtccttttcacgtctgatctagaatgtcaccctggttcagcatcacacacatcagcaaccctgcacccaggcctgtgccagaccttgggttttaaggacctagagccaaactagacttagccttgccttggaggagttccagtctgctgggacaggtggtcacagacagacagtgaagacagaggaaattataacaattgaaatgcagtgcgtacttatcacatgccatgtaccactccaacccaagatttggcctcacagcaaaccggcatcatccccactcatcctcagtggaaactgaggcacacccaggcccagtcacatgcccaagggctcgcagtgagtgagggatgcttacgggagcttcctcgccttgcctagggccagggcagccttcagagggcggtggtgcctgagtggagacttcagagctgagcagcatccacaggacaggaaaggagaagaaggcggggactgggctcccggcactccgtgccagcccgtcctgtgccaggcgctgggtcaggccctggggattcgggttgagcccactagcagggtgctccgtaacaaactgggaagcacagggtgccctggggaagtgggtgagatggctgcagtcagggaaggcttcccagaggcagtgatgtctaagctgacccagggttggggacattgggccagggttggggaagggatggtggatggagagttccaggcgggaggaacatccagtgcaaaggtacttccaggagcagagtggacgaggaggagagcggcccagccccaggggacgcagggcagggaaggagctgggatggttgcggagggcaatggggagtcaccccaaactgggggaggggcatccggcagctgggcagcctgcaggctctcttggctctctctgtagggaggtgcgactacaacttcgacttcgtgggggcgtggtttctaatccctcacctttgtaaccagcgcttggcaaatggcagagctgccctgcacctcccagtgtgagatggggtcaggagtcccacctcaggggttggtgcgagaaccaggggagggtcagtcagcagcctttttctccttccaccgggagcctggcagtctttgcctcccttcccccacccctgcaagtggagcaattaccagattgagacaggctgggccttcccactgcctctgcgggttaatgtctctaatcactgcaatctcttgatacacaatccctgggctctgagtggtggccagatggcttaggagggagttccagcctccagactcccagaggctcttccctggggccctcaaacaccgcaggtgctcccaggagcacccagccaagcgtggtgtgggagagaggtggttgcctattctcccctcaccataaatcacagagccagaaggaatgtttgaagtcatcctcatggaacctcccactctatctggaagcctccatctagcatctcaacaggtggccatccaggatccacctggatgcctccaacaatgggaagctcaccaccacaaatctgaggctcattaccaagggcaggctgtgaactccgagattgaactaaaatggctttacatgggctggatcacattaaaatcatagtcagctgggctgggtggctcacacctgtaatcccagcactttgggaggtgaagacaggaggatcatttgggctcaggagttccagaccagattgggcatcatcaagatacccccatctctactaaaaatttttaaaaattagccaggcatggtgtcgagtgcctgtagtcccagctacttgggaggctgatgtgagagaatcatttgagcctaggaggtcaaggctgcagtgagccatgatcgtgccactgagccccagcctgggcaacagagtgaaaccctgtttcaaagaattaataaaaaataaaatcatagcccaaaccagatcttttcccccaccaccagagttaaaccaggtttgtgccacagacaggcactgtgggagtgggaaccccacaaggttctgaatcagaaatccctgttccaatcttgacattatggttcaccaactggagggcctggccagttgcctccatctccctgtgctccattttccccatctgtaactcagaactattgtattgggctgtccaatacaacagccacgagtcagaggaggcctctgagacccaaaatgcaggcagtgcaactgaggaactgaacttttatttaatttaatttaaaatttaaaacctgaagcaatataaatttttttttgaaacggagtttcactcttgttgctcaggatggagtgcaatggcgtggcctcagctcactgcaacctctgcctcccaggttcaagcgattctcctgcctcagcctcccaagaagctaggattacaggcatgcgccaccacacctggctaattttgtatttttagtagagatggggcttcaccgtgttggtcaggctggtctcgaactcctgacctcaggtgatccacctgtctcagcctcccaaagtgctgggattataggcatgagccaccgtgcctggcctaaaaatttttatattgatgacatattgaaatgataatatttgggataaactaggttaaataaagtattaaacttaatttcaccaaaaaactaatttcacctgtttctttttactttttaatgtgaccactagaaaattctaaattacaaatgtggctcgcagtggaactccacagtgcttcactcagaaggttaaggatccactgggctgggtgttcaggtgtctggggaacagtaaagtcccagagagatgatggcttctgaggctgctgggtcctccaggaggtgtcatctccatcacacaagaagacgggctcaatctagaaagaatagagaatgtgaaggactattcgaaacaaaacaaaaattacttataacacccaaagataataattacatttcctatagagtttgcttgtttccgtgcccgtccacgcgacctggtctcccaccaccactgggcaccagctgcaagttctcagaaaagtcacctttaacagcttgaccttgaagcctgggaccttgaggagcctcagcagggaggaatccctcaaaaagccaaagggcagggccttacacctcctttctgtgcctgtgagctctgagtggaagccacgacctctgcatgcccagctcccattcttcttggcctccgccctcacctgcggtggccctggcactccgggggaggctggcctgcgctgccagctgtcaccagcagttcccgcggctgctcacctctcccttccgccatttgtgggaagggagggaggctccagcacagaacgacttgggtcccaggattctctccatttcgtccatgggtgctctcctgtccagagctgatgggggccccagggtggggtcagggatccctcttgctctgtctaaaacctacactccctcccacatctcaatctgtccctgagttggcgccacccccgtgttaggcctcttcgtccccggtggggggccttctgaggggcctttatcctttcctgaaatccagtcctcacctgcaccccactccacacaatccctcagacacatctatgtgcctagactgcaaatctggagggagtccaccatcccaggaggttccagggctcactgcagagatgcaaacaatctggtaacttgcttttccacttagcattgatttaggaacacccttccagggacacgatcactccggatggctgctataccgtccctttctatctaatctgcattggtgagttcttaggtcaggtttttgatcttacaagtactacttcagtgaccctcccagtacaccatgtgtactttgatcttctcaaatggaaggaatttttcgttctcccttctagacatccagcaaattctgctgcctgagttgtgctgaagtgccacaaggccaccctactcctgagctcagcctatcttctctatcccttctatcaccaatctgtcactaaccctcagatattacctgagctcgggccacatcgaacagcacggtgtctcacactttccagcctcccttctgccttccactgtctcactgctgcgcatgtctgccccatctccaaatcctctcccatttccaagagccaggtcaaatgccacctcctccagggagcccttcctgactttcctagctcgaagtgattcccccttctctgaacaaagacagcatttccttgtccccgcttcccttgcggttctgatgctcccacatagtccaggggccatttgagtgcacttgtggcccagtgtcctttccttctccctccccattccctggcagattaggaactccttgaggtcagggacaggttctgatttcttcctgtgggcacagggcatggcacggagtgggcatgtgcgaaaggtttgaacgcacgtgaatgaaggaggacaggcctgggtctggccctgagttctggcccagccgggcactgctgtcctgtgtgacctcaggcagggcctgctctcgggtacatggcttccctgtggcctgaggcggctggaccccactgcggggggttctgtcatggtgggaggactgtttggccctgggttgacgcaccggccctgcgtgggataatctctcttggatgatgattgcagggcagccccccatttcctctggctgcacaatcccattatgagcccttcaggatttatgtctaagacccaccctaagcccatcactaacatatggcatcctggcagatgaggatgagcagagattgtaaacactcattcattcattcactcactccttcactcagcagtctgctaccaaactgcggacccagcattcaatcagaacctggcccaaccctggaggtgcttccagtaaagagtccgcagtccagtgaggtgggggcagggacagtgggaggcacagggactgtggagccagagaaggaggcttcactcagcctggtggtcagagacggcttcctgcaagaggggatgctcaaagtgtgtcttaccagaagagtaagccattgcgccagcgagcaggcagggcagggccctcacaggcggtggctcccgctgggggagggggccggtgttcacgctcagcctggggctggatgctgctgcatggaatctaatgataagaggagcgtggctggggattatctgctcttgtttacatgattaaaaccagacaaatacttctttatctgaaagaatgaaagggctttggggaaaaatccttttgtcaacaaagcaaagcacaagcatttccttaattaatctcacttcaccccacaccccccaccgtcccacaccccccacaacggctgcaagaagcgttgctctagggctccagggctccagggctccaggacgccagtactctggggctgacctgcactggtaggcagaaagcccaggccagggtggctaggggtggggaggagccgagaggagagagacccacagccctctcaacacagccccctgtgacaaggagcctgggcccaggcacaaacccaagatgtccccattttacagatggagatcctgaggcccaaagatggggaagtgacttgcttgcctgaggccacacagccagttggcagagctgggactaggacctgggtcaccagcccccagcccagcgctctcactcactcctcattagctcgtccaggagcccgcaggaaccgcctgcagtgccgtcctctcgggacccacagggaagtcagactcatccctcctctcacaaacagacaggcagcgtcctgatggagcagccaggggctgtgggggtcctagaatgggctcctcactctgggggagaggcaggtagatctcagaggtagaccaagcttggtcctgcctggctgggcaggggtcaggagagtgaaggaagcttctgagaggacaccaagcatgggaaacttgaggcaacaaagtaaagcacacgcatttccttaattaatctctcactcccccaacagtgtccccaccatcccacagccaccctggcctgggctctctgcctagcagtgcagaggtctcaaggcacagatgtgtgtggcctgcgccccggggcgtgggggagagggcagagcagaaagagaggctggaaggagcacaggactggattgttggaagaatggggttccctggagcactgtgaggcagctggacatggccaggaggggctgagtgagcgctgagtgccagccaggccctggcctccccaccacagcccctgaccccctcgccctcccagcttgatgtccggacttgcctccctggatgccaagacctctagccgcctgggcgtcctcaccgtggcgtactacctgtggaccaccttcatggctgtcatcgtgggcatcttcatggtctccatcatccacccaggcagcgcggcccagaaggagaccacggagcagagtgggaagcccatcatgagctcagccgatgccctgttggacctcatccggtaactattgccacccacaccccgcttgggaacgccaggcccgagcctgccctgccaggtcccccagaggccaggacggggtgtggagatgggggtgatcacggagtccatgatcaccctggtgggttgagctctgggctgcccgctgggctcatgctgcatcgtctgccccaccaggctagaagcaccttgcagcctggacggggtctgcccctctctgcctgtggatgggcgcagagcagacatctgtgagcatttgctgatgcccagccggtagggtgggaggctggctgttattggcccctccctttgtttattggtcctctttttacagatgaggaaatggggctcaaaaaggtgccgtgacttttccagagtcaccggtaggtaggtagtggagacaggattcaacctagtcctgtctgactccaaggacaatgccctttgccctgtggtgccaccccctagcaatggcagtgccacatcctagccacagcagtgcagctaaccttgcttctcagacctaggctccctctccagggaagcactgcagacccagcggcacagccaccttccactccctttccccgggtcccctgcaggtcacccctgctcctctccttcgtgcattcgctccctcaccagtgccagttctgtgccaggccctggaccaggggactcagagccagcccttgccctggaggagtggtcagacccacgagcagacagggacaacatgggggcctggggctgcaatggggaagctggggctgccggtgagagcaggaagccactgcccttctaagggaggggaagatggggaggcagggagggcaggcctgggggtgatagctgtgcgaaggtcctgagctgcagggaaccgtctggggggagaaggcatagcaccatcagtgtgacacagcagaaggggtgagaggcaggcagaaacccctgctggagaattcaggtggggaccggcctcaaagtgcaccgtgaaccaggccaaaagctaagttgcatcctaaagaccacagaaaatgagttttatacagagaagcggcatgatccaattcagaaggttcaatctgaccagggatcagagttgcaggggaggtaggaggggaaggcagagccagggacagggccaagtggtggccctggggatggggaagggggcagatggcagggctgctcaggagggatccttagcaggaggtgggtgagtaggaggtgaggtgtgctgatcacccagcatgaagatttctggcccacgcatccaagtggatggtggtgtggtcaccaagcgatggatggtctggagcaggtgcaggcatcctggggtaggtgtcaactgatggttggccagtggatgagaatctcatgggggagtctaagctggagacggaggtttggaaatcgccagggagaggtgttaggtgctaccctagtggcagaggggctcttgcaggacaggtggtgagagagcagggattgggatggagcctgggaagccccacccaggaatggtgtgctgggctccacaggctaccccactaagcccgctcagggaacaccttctagtacctctcacttcctggtcaatttcagatctaagaagtctaggcctaacattaaaactccaaactcctgcagtttaaactaagcctgtcttagccttttggatctgactcagactgggaaagctgcagtgggaagagggtcgtggtgagtttgtttctctttcctgctctgcctgctccctggtgagaggtgagggagtgggctaggaagggctgcccagactgggagaggggtgagctggagcaggtgctccctcgttgtgtctctccaggactacttctatgggttctctggagcccctcttctctctcgcatctctcacctgctgtcccctggactcaggcaatttattccatctggctacttacaacatcccctagaccagggctctggttgactcctctgctggggtcacctcacccctctgggtgaccctgttgggtcatgtctggcccatgggaagcatacatatccctattggaagtgctggcctttcccagggcctttggacatgagtcaggcaccagcccctacattcctcaaattctaagagactcaagccaaggtctctgaatagttctcttggcttaaggttgtggagaagcattcctttcctcccccgtggggatagatgcccatacacaggctcccacccactgtctaaagaaactctcgttccctgtatcagctagttactgctgcataacaaaccaacccaacatttatcagcttaaaacaacagccacaagtctataggtcagctggaaagttctgctggtttggactgagctcactcacatgtctgcaggcagctggtggctcaactggggaacagttggtctaggggagtctggctgagatgattcagctatactctgtgatctttgtactccagcaggccagcctagatttgtttcatggtggcgacaggattccaggagagagctagcccaggcattttttttaataacaaaggtagaggagcaagagaggaaatcaaaacatgcaaatgtttctcaagcctctgctttcagcaagtccactaataccctcttggccaaagcaagtcaggtggccaagcccagactcagggtgggaagggaccacaatgttacaagggaaatggagtctacaaaccgaggccatcaatgcaatcagtctaccactcccttcatttctccaggaagatcttcagcttctcttttaccctttagagtgtgtgatgaactaaggatcatcaaatatttgccatgctgttcctatcgcgtggctgtcacctatagggtctggagccagaaagagatccaggcagggtctgttctgtgtttgcttacttggctggcaagacttcatccaataccagggctttgaacaccttctggactctggcacttccgaatttagtctccagcctggaaaactctcacctgagttccagattctcacataaagtgtctagaggtatctcaaaattaacaggcccaagctcaactcttgatttctccataaatctgcccttttctcgccctgcccatcttggtctgacatctctcattctctcataccctgcagccagttcctcagcaaattctgtgagctctaccttgaaaaccaaatcccaagccatggcccttccacctcccctgccactcccgccattgccgcccactccagtgtctggcctggcctccgcttcctctctgcttcctgtcctctgttctcagcactgcagccagaggcatccttttcaaaacctgctctcaacccagcacatggcaacaaagtcgtagcctgcaccgcagcttacaggcacttgctgacacacatcagactctgacctccgccccaactctccctttccctgccctggctccagccccacccgcctcgttgtccttcctgtctgggtgtcattgcctcctctctgggtggccctccctgcagaaagcatgcagctccttccctcactccatttacatctctcctgggtgtcgcctctcctgagacctcccaggctctgcctctctgttgtcttctcttgagtcacttctcctcatagcctttcttactacccaacatgatcatatctacgtgtttcttttcctcccacatccactggaatgtaatatgccctgtgaagcctggctctttaacctccgttccctgctgtatcctggagcctaggacagcacctggcaccgagtgggtgcgcagagtttgctgaatgcacacgtggggtttaaggtcatcagtggcgttggggtctgatccccaggaggaactggaatggtccagggagaatgtgcccagcaagcaggtgcagaggcctaggacgggccttggctcacggccgcactgtgggctttgcacagcaaacagagcaggggcaagcagagaggcaggaggagaactaggagagtgaacatcctaaagacgaggaaagaggaacttcaagaaacctcatttgtaagatctgttatttctaggatctggtaactgtgattcatggtttcttgggtcttatgattcagaacggcttctccacatggtggaaggaggtatcggtgctgcctccttcaccactgcctgcccttactcaggggctgcggggctccagatcagaaacacgtgccacagtcaaatgttccagagtgtttcctgctcttgggttgcttttcacgtggtgaaaactgatcctgctgcttagagccgcaccccccacgccccagccctaccccacccgctctcaacccagaggcaagttgttctgcaaagctgggtgttgggcctcgctctcaccgtttcttggtcagagagcggggctacagggagagaacacaggcgtcctgggacaggaaaccagaacctaggagacctgtggcctcatctccactctgataataataagttactgtgtggccctgggcaggccagttcccctctccaggcctcagtttccccagtgattttcaagatcccgtctagctctgtggttctgaaacacaaaggcctatgagccagtgaggaggctgcagggcatgaaccaaagcttctggaggtgggttctgggagatgaggttgggagggctgggcagagcccaaccttgaagacaggaggcccaggttgaggggctggctgttaggctttgggaatgggaagctggtgggtttgggaaggatggattagagcagggtggagtggacagaaggtgagcagaggcatggatggggtgccctgggaggagcacagtcacttcctttccattcagctccgctgtattcagctgctgctctgggtgaagacattgtgctgggagctgggaagcaagtacaaatgcccctcacgcccccaccccagggctgcccaccatcttaggacagacggacaagtgggtgcactgacagccactcctgatgctctgagaggctgtgaaggagatggggacactggcagtgagggaccaggggcctcctgacccttgccctggcccagaacaggtgcctaccaggtgctgaagactgaacaaaaacactgatgaccaggaagagaactgagaaccagggcaagtgggacaaatggaaagtgggagcccactgcgtggggacataaggcacaccacaggggcaaagatctgcatccttgtctcaaagatgactccagaggaacacaacaggccatgtccctggatgaccctccaagacaggaattcattttccagggctccggggggccgctccagaaggctggcgcctgctcacagtgcagcacgcaaaacagaaacccaagcagagcactaatcaggtctggccccttctcttttttttcgaatcttattaaaacaccacagagattaagtaatgactgggctctatttatagctcccaactaccctctcagggattggaggaagcttccaggagctgtgcttgggaaggaacaattcccacctttagggcttggtttggggacatgttattaggggtgggtttggaagcatctcggtgagaatttgcaagtagcaggtgaagaggggagctgagaggtggactctggctctgcctagaaaacgtgcagggaggcacagggcagagtgtgtgggtatttgataggcatggctattaacgtccccaggcacgttctgtgttttatgtagctgccaccaggagcacggacctcatgggacaagcagaaaagtcttcccgtgaaggctcaaagccaaaagaaaatgtacatttccccatttaataatcaaaggtataattcttgattaaaatctgcaggataaattcattggttattagtatgagcacacacgagtcaggacttgcttttggctgccagatcagcagaggcttaagtaaggtaaggtttgcatttgttcctgaagaacagtccagaagtgggaggtgggcagctggcagtcaccagggtcccaggccctgccctcctgtgtgccgtgccatgcttagcacctggctttcatctgagtctcatggtccatgaaggttgctcaagctctagctattatccccatgttccaggcagaaagaagaaagttggaggaacggaccaaagggtcctggctgaatgggcacctccttaagagttttccaggaatcaccacccaacgacttccactcacctctcgatggccaccccattagcaagagaatcagagcttgatggcaggtcccatttggtccccacaacataataggacttctattaaggaaggacgggagaatggagactgcataggcaactagctgtccctgccaaggcccacatttaaaatgattgtaattgtaaaggaagttgtaaagaaatgtctatataggtataagttccatttggcttcttacgagcttccaaatgttctccgtgtgtgtaaactgagtcttgaaagaggggaagagggttaccgaggacaagagtgagtgggaggcgacccaggtggaggcagtgtgagtgtggggcggcaggttggaggaagagcaggcatgcaacggaagcctcttaccagatgctcacctcagagttggcatttctcacaagacacactcctagaaggggactgtgaagacaaagatacaaatgcttttagagaaaggttgctgccaggaccatgtgagggtgcccatctcaccaaacctcccacattgtgcactgtcatttgaaaaatactttgtcagtttgacaggtggaaatatcttgaatttgttgatgaaactaaacattttaaaaagcatttttggccactgacttttcttcttttgtaacacgaattgcctggtagtatctttccatcgttttcctgtcgggtttttgtggtctattggtttacgcagcaaatatttactgagtgcttggtatgtgccgggaactcttcccggggctggagacacaacagtgaacaaacacagagcttccgccctccagggagctgatattctgatgagaggagatagtgaaggtagaaaccaggccaagatttgtaaaagctcttagtagatttaggatggtagtgcttggtcacgcagtctctccagctcgtcacttgctttgtggttttatttgtattgcaatctgtcttagagagcttctcaagcattcagctttccattttagcatagttttaggtttacggaaaagttgtagacagtacagagagatcccacacacccttcacctggcctcccctgatgttagcggtttacataactagggtacgttagtcaaaactgagaaattaaattggtacaacactattaactaagttacggatctcgtttggattccatcagtttttccacgaatgtcctttttctctgttgcaggatccaatccaggatgctatgttgcgcttagggatttctttattttcatgtagtaaaatctattgatttattgctcattttgttcttagagagtcatttcctatactgagacatgataagatctcaacctatatttcttctagctttttatggtttctttgccttttttttttttttttttttttttttagtcagagtctcactctgtccccaggctggagtgcagtggtgcgatctcagctccctgcaacctccgcctcccgggttcaagcaattctgcagcctcagcctcctgagtagctgggactacaggcgagcaccaccacactcagctaatttttgtattttttagtagagacggggtttcgccatgttggccaggctggtctcaaactcctgacctcaggtgatgtgcccaccttggcctcccaaagtgctgggattacaggcatgaactactgtgcccagctggtttcatttttcaaagacttatttatttctttaaaccttttggaatttattttggtgtaagcatctaacatctattttttccaaaccgttggtcagctgcacagcattctataatgaatccttcgtttcctcactgatttgtgaaacaacttttatcaagtacgaaacacttagaggtgctagtttctgtttctaggctacagcttacatggacttttccatcgactgctgtgtcagtatcacagtttgacagttacttttttttttttttttgagacggtgtcttgctctgccgcccaggctggggtgcagtggcgcgatctcggctcactgcaagctccgccgggttcacgccattctcctgcctcagcctcctgagtagctgggactacaggcacccgccaccgtgcccagctaattttttgtatttttagtagagacggggtttcaccgtggactcgatctccgacctcgtgatccgcccgccttggcctcccaaagtgctgggattacaggcgtgagccaccgttttttatctagtaggaaagactcctccacctttagctttataataaaatatgttactaagaataatgagcccacctatgtgcgaggtcccgtgttaggccccacagataggacatgaacaaccaagtcccacctgcaaggcggccactatatgggggaggcagacaggtgagccagtgaccgcacggtggtgtggcggagcagcagcgacctacacacagaagggccgcagggtctcgtggggcagtcagggagggctggacagaggaagaggtgcttgatctgtggtagatttgagtagttcaccagaccaagaggcaggcagggcattccgggcagagggaacagtgtagacaaatgcctggctctggaaagtatgtggcacagtctgggggcggcaggtgctggcgctgtggagtgtccatgatgtagtgggtgagactgcagaggaggctggcctgaggaaggcccgaccaccaaaggagatgtccagatgaccccaaggccacaacccccagggccctcctgtcctgggctctggaatttttcaattgctgattctcttcctaggaacatgttcccagccaacctagtagaagccacattcaaacaggtgagtgagtctctgggcagtggaggggagggaaggggcagcaggcaggagggcaggcagcagggctagtggcatggctgggaagtgacaggtgtgctggccagtcacgctgtctcctggaggtgggatgctagaggggagggtacgctggggaacctagatccttagagacccccatggccacatccctgtcctgggttccagttttcatgatgaaaaagtgtgggggtggagagaagccttcactgagtgcctgctctgcttccacatacaccatctcgcccatccacacagtaactcggcactgaggtaggatgagccccacttcctgaagaggaaactgaggctccgaggagtcaatgatttgcccaaggttataccactagtaaatgacaaagccagtaggtaaacccaggcctatcttcttagcctgttttctctttctttttaaagtaatcatttttcccctaacaagaataataatgatgttcactgtagaaaattaggaaaataccaaacaatataaagtagaaaacaaaaatcatctctagttctagtacatagtccctggtagcagaggatatatttctggtcttttttcttctgcttatttttaaataatattataatcatagtgcatatacagttttcatcttgctttttttcacttccattatatcctgagcattttccccggttatgaaatatttcttaaaagtacaatgtttagtggtactacaatggcctgtgataaggctgggctgtaatttatttcccactccccctttcagtgttcccttaggttgttttcaaagtttttccttcgtcgaaattgtggtgaatgtccttgtgctcagtctttgcctgccctttgaataatttccaattctttttccctttctaaactgtcagctggttggttgacttaatccagcaagggtttcctgaacccctttcctgggctgggccctgtgttgagcctggggacacaaaggaagtggctgaggtatagagaggaggcttctgaatagggagctgtgaaagctttggcatatcgccgcgtctctcctgacatccatgaaataagccagattgtgaaggggactgaatgctaggctagggagtttctattgtaattgggaatcattgagggtgtgagagataaagagaaagaatgttgctctactctgtaactctctggaatgccctttctcttttggcaaactcctacccatccttcaggactcaagtcaaatgtccccttctttgtgaagctaactctttcagccaattagtcactccctccgcaaggcagaaatcatgtcaggttcatttgtgtatctccagcaaccagcacagagtgttcaacgtgatgatgacgatgatggtagcagtaatgcttccatggggcttaacatgtaccaggaactgttgtaagcactttatatacatcgtctcatttcatttcatgcagtagatgctatcacggtcccattttacagaggaggaaaaggaagcagagacttcaggtctcatatgtttcctgagtggttggccttatcgatgcagtgatgtttgaggggagaggaggctccctttttgggctcccagtacctgagggatgatggggtgagacccatgaatgctctgggggcagagagggaaaggtacgtggctcaggaaggtcattttcttgtgcatgggcttcatctcattaacaaggcttggggcaggctatgcttcttcaaaaagaaggtccaagtttccacctggtgggcagcagggccagcaggccaccaggtggatggatactggatgattgggaggggacagatgggtggataaagggttacttgggtggataaggggctgggcaggcagttaagagggacccagatggggtgatgaggtatagaagtaagaagaggaatgaaggcaggaggcagcgtggctgggtggtgtggtggtagaggaaggagttgcagctttctttgggtaaaatatcgatagcaatccctgctctgcctgcctcacagggttactgtcaatcaaataggataggaatggatacaaatgtgccttcaagatgctattattgttgtcgttaatattagtaacaacccttggccctgacttctctctgggtggggtgtcacccaccagtaccgcaccaagaccaccccagttgtcaagtcccccaaggtggcaccagaggaggcccctcctcggcggatcctcatctacggggtccaggaggagaatggctcccatgtgcagaacttcgccctggacctgaccccgccgcccgaggtcgtttacaagtcagagccgggcaccagcgatggcatgaatgtgctgggcatcgtcttcttctctgccaccatgggtatgtgctgcccacctgcccagcagtgccgtggagccgggcccccagcccctcccagcagcctgctcctccacctcttactgaggtctggggagaatgctggagaggtttactgtgaaaaactggaaatattcaccacacctgtttatttaaatccttcgcctccccaccccaccccaggggcttccccctggcacctccccctcaggcccgtctgggccatttcttaggcccgcagctggcatccctgccacacccttccctttgctgccctcctctgggatgccaggcccctcacctatgcaagccccttggaggcccgcaccttggtttttaaattttgtgttatttttcttaaagatgggtcccaaattatacaagcttcagaccccacaaagcctgtggaaatgtcctgcctgccatccccgactcctccactgggttttcttgtcaaggaaaagacctcaccaacctcgttcatgcaaaaactctaggggtgactttctacctcgtcctctgccttggcccccacctttgcatccggtcgggtctgcccccaaagtcccctccaagccgtgcgtttccttctaccccgcgtcactgcccgggtcaaggccgtgtggtctctcgcctggttcctgtgaaagctgcctagaaaacttccacggctgtccctgctggtgtgtccagctcaggaggtcacaagtctgaccgtgctctgcccattgcccctggaaaggggccgaacccctagtgccggctgaaaagccccgtgagactggcccgtgtgctcctctccgcacaaccctcagcccggctgctcttgccactccccctccacgtttgtcatcttcagggtgctccccacaagtgccatgccctcaggagagtcctccgcagactaggccgagtgccccgagctacactgcctggttactctgtgagcactagactcgattgcaaggatatcattgcttgctgtctgcacagccatgaccagccccatacaggctgacgggcttgtctccatccaccccagagcccaccgctgccgtggctacagcaggcactcagcagacctggtagggagatgggtggacggctgggtgacaatgggtaatggagctcttctcatctgggccaaaacgccaggtgtgcagaggggccggggcctcggtgacccaagtgtgtgaaacgaaaatgtctgaaagtgcctctcggcacatctgacaagcagtccccaaactcagcctttctcagggctgggaacataagagaagggcatctactggcagaacaaaagaaccggagacccttggactcaactcgctgagcgttcgctgcgcatgtgtaactgtccgtgcatctgtgaacatttgtgtgagtgtactgaggcagggcgtatgagggtaccgaggcagggcgtgtgagtgtactgaggtgggacatgtgagtgtaccaagacaaagagtgtgagtgtaccgaggcgggcgtgtgagtgtactgagtgtgcgtgtgagtgtaccgaggcggtgtgtaagtgtaccaaggtagggtgtgtgagtgtaccgaggcagggtgtgtgagtgtactgagacggggtgtatgagtgtactgacactgtgtgagtgtaccaagctggtgtgagtgtaccgagacatggtttgtgagtgtaccaagatgaggagtgtgagtgtaccgaggcaaggtgtgtgagtgtactgaggtggggtgtgtgagtgtactgaggcgggttgtgtgagtgtaccgagtaggcatgggtgtaccgaggcagggtgagtgagtgtgacgagtcagggtgagtgtactgaggcagggtgtgtgagtgtaccgaggtggtgtgtgtgggtgtttcgaggtggtgtgagtgtaccgttgtgagatgtgtgagtgtcctgaggcagtgtgagtgtaacaaggcagtgtgtgtgagtgtaatggggcagtgtgtgtgagtgtaccaaagcggggtgtgcgagtgtaccgaggaggggtgtgtgagtgtaccgaggtggggtgtgcgagtgtaccgaggtggggtgtgcgagtgtaccgaggtggggtgtgtgagtgtaccgaggcagtgcgtgtgggtatgtgagtgtaccaaggcagtgtgagagtaccaagacgatttgtgtgagtgttccgaggcagggtgtgtaagtgtactgaggcggggtgtgtgagtgtactgcggcagtgtgtgtgagtgtaacgaggtggtgtgtgtgagtgtaccaaggtggtgtgtgtgagtgtaccgaggcgggttttgtgaatgtaccaaggtggggtgtgtgagtggacaaaggcagggtatctgagtggactgaggtggtgtgtgtgagtggaccaaggtgcggtgtgggagtgtaccggtgcagggtgtgtgagtggactgaggtggggtgtgtgaatgtattgaggcagtctgagtgtaccaaggcaaagtgtgtgagtgtactgaggcggggtatggcagtgtaccgaggtgatgtgagtgtactgaggcgggtgtgtgagcgtactgaagcaaagtgtgtgagtataccaaggcagtgtgtgagtgtaccaaggcaatgtgtgtgagtgtaccgaggtggtatgtatgagtgtacacaggcaaggcatgtgagtgtaccgaggcaagtcgtgtgagtgtaccgaggaaaggtgtgtgagtgtaccgagacgggttgtgtgagtgtaccgaggcaggttgtgtgagtgtactgaggtggtatgtgtatgtgtattgaggcagtgtgtgtgagtataccaaggttgggtgtgcgagtgtaccgaggtggtgtgtgtgaatgtaccgaggcagcgtttgtgagtgcaccaaggcagtgtgtatgagtggaccgaggtgggacgtgtgagtgtactgaaacaagacgtgtgagtgtactgaggcggggtgtgtgagtgtaccgaggtggggcgtgtgagtgtactgagttgggttgtgtgagtgtactgaggcggggtgtgtatgtgtactgaggcggtgtgtgtgagtgtaccaaggttgggtgtgcaagtgtaccgaggcggtgcgtgtgagtgtagcgaggcaggttgtatgagtgtaccaaggtggggtgtgtgagtataccaaggtggggtgtgtgaatgtactgaggtggtgtgtgtgggtgtatgtggatgtgtgagtgttctgaggcggggtgtatgagtgtgtcgaggtggtgtatgtgaaggtatcaaggtgggggtgtgtgagtgtacagagaggcaaggtgtgtgtgtaccaaggtggtgtgagtgtaccaagacaaggtgtgtgagtgtactcagatggagtgtgtgagtgtactgagatggtgtgagtataacgaggtggtgtggtgtgtgaatgtacagaggcatggtttctgagtgtactgagttggggtgtgtgaatgtaccaaggcaatgcgagtgtaccaaggtggtatgtgtgagtgtactgaggcagggtgtgtgagtgtaccaaggtggggtgtgtaagtgtaccgagatggtgtgtgtgtgtactgagacagggtgtgtgccaaggtaaggtgtgtgtgtaacaaggaggggtgtgagtgtaccgaggtggtgtgtgtgagtgtaccgaggcagtgtgagtgtactgaggcaaggtgtgtgagtgtactcagacggggtgtgtgagtgtaccaaggtggtgtgagtatactgaggcaatgggtatgagtgtactgaggtggtatgtgtcagtgtaccgaggcaaagtgagggtattgtggtggggtgtgtgagtgtaccaaggtggtgtgagtgagtgtactgaggcggttgagtgtactgaggcgaggtgtgtgagtgtaccgaggcaggttgtgtgagtataccgaggcgggctgtgtgagcatactgaggtggtgtgtgtcagtctatcaaggcagggtatgtgtgtgtaccgaggcggtatgtgaggtactgaggcagtgtgagcgtaccgaggtggtgtgtgtcagtctatcaaggcggggtatgtgtgtgtaccgagacggtatgtgaggtactgaggcagtgtgagtgtaccgaggaggggtgtgtgagtgtaccaaggtggagtgattatactgaggcagtgtgagtgtaccgaggcggtgtgtgagtgtactgaggcggtgtgtatgagtgtaccaaggcaggttatgtgagtgtaccaagactctgtgagtgtaccgaggcggcgtgtgtctgtaccgagatggtatgtgtgagcctaccgaggcggtatgtgtgcatgtaccgaggcggggtgtgtgagtgtacagaggtgggttgtgagtgtacagaggcagggtgtgagtgttttgaggcagtgtaagtgtaatgagaggtggtgtgtgagtgcgaggcaggatgagtgtactgaggcagggtatgtgagtgtaccaaggcagtgtgagtgtaatgaggtggagtgagtgtactacggtggtgtgggtgtaccgaggcagtgtgagtgtaatgaggcagagtgtgtaagtgtaccaaggcggtgtgagtgtaccaaggcagggtgtgtgagtgtactgaagcaggttgtgtgactgtaccgaagaaagttgtgtgagtgtactgaggcaatgtgagtgtatcgaggcggtatgtgtgagtgtaccgaggccagttatgtgagtgtactgaggtggtatgagtgtactcaggcagagtgagtgtaccgaggtggtgtgtgtgaacgtactgaggtggtatgtgtgagtgtactgaggcggtgtgtatgtgtgtaccgaggcagggtgtgtgagtatgctgaggtggatggtgtgagtgtactgaggcagggcatatgagtgttctgaggcagtttgagtgtaacaagggtgatgtgtgaatgcattgaggcagggtgagtgtaccaaggcagggtgtgtgagtgtactgaggcggtgtgagtgtaacaaggtggagtgtgtgagtgtaccaaggtggtgtgaccgtatgtgtgtaccaaggtggggtgtgtgagtgtagcaaggcgggttttggtacgagtggagtgtgtgtgtgtaccgagacagggtgtgtgagcctaccaaggcagtgtgagtgtaccgaggcagggtgagtatactgaggcggggcatgtgagtgtaccaaggtggggcatgtttgtgtattgaggcagtgcatgtgagtgtacagaggcggggtgtgtgagtttaccaagacgtggtgtgtgtactgaggtgtgagtgtaccgaggcaaagtgagtgtaccaaggtagggtgtgtgagtgtaccaaggcaaaatgtgtgagtgtacggaggcagggtatgtgagtgtaccgaggcagggtttgtgagtgtaccgaggtggtgtgagtgtaccgagttgtggtgtgtgagtgtaccgaggtggggtgagtataccaaggtgggggtgtgtgagtgtattgaagcaagggtgtgtgagtgtaccgatgcagtatttgtgatagtaccaaggtgggttgtgtgaatgtactgaggcggagtgtgtgagtgtactgaggcggtgtgtgtgagtgtactgaggtgctgtgtgtgagtgtaccaaggcactgtgtgtgactgtaccaaggcaggtggtgtgggtgtactgtggtgggttgtgtgagtgtactgaggcagagcgagtgtactgaggtgggatgtgtgagtgcttggaggcagggtttgtgagtgtaccgaggcgaggtgtttgagtgtaccgaggcagtatgtgtgagtgtgccaaggtggtgtgcgtgattgtaccaaggcgggttttgtgattgtaccaaggcagggtgtgtgagtgtaccgaggtggggtgtgtgagtgtactgaggcaggttctgagtgtgccaaggcactgtgtgtgagtgtaccgaggtggtgtgtgtgattgtaccaaggtgggttgtgtgagtgttccgaggcagtgtgtgtgagtgtaccgagggggtgtgtgtgagtacacggaggcaggttgtgtgagtgcaccaaggcagtgtgtgagggtaccgaggtgggttgtgtgagtgtaccaaggcggggtgtgtgagtgtaccgagaaaaaatgagtgtaccgaggcagggtgcgtgagtgtactgaggcagggtgtgtgaatgttctgaggtggtatctgtgagtgtactgaggtggggcatgtgagtctaccaaggcggggcgtgtaggtgtactgaggcgggttctgtgagtgtgccgaggcagtgtgtgtgagcgtactgaggcagtgcgtgtgattgtaccgaggcaggttgagtgcaccaagacagtgtgtgtgagggtaccaaggtgggttgtgtgagtgtactgaggcggggtgtgtgagtgtaccgaggcaggttatgtgagtgtaccgaggtggtgtatgtgagtgtactgagggggtgtgtgtgagtgtaccgaggcaggtcgtgtgagtgtatcgaggcaaagtgagcgtactgaggcagggtgtgtgagtgttctgaggtggtatctgtgagtgtattgaggcagggtgtgtcaatgttctgaggcagtatctgtgagtgtaccaaggctgggtgtgtgaatgtatcaaggcggggtatgtgagtgtaccaaggcactgtgtgtgagtgtattgaggcggtgtgtgtgtgtactgaggcagtgtgtgtggatgtgtgagtgtaccgaagtggtatgtgtactgaagtggtgtgtaagtttaccaaggcagggtgtgtgagtgtatcgaagtggagtgtgtgagtgtactgaggcatggggtgtgagtgtactgagctggggtttatgtgcgtgtgagtgtaccgaggtggagtgtgtgagtgtgctaaggtggggtgtgtaattgtaatgaagcaaggtgtgtgagtgtaccgaggcagggtgtgtgagtgtaccgaggcgaggcgtgtgagtgtacctaggcgggatgtgtgagtgtaccaaggtggtgtgagtgtactgagacagggtgtgtgagtgtaccaagatggggtgagtttaccgagacagtgtgagtgtaccgagtcggtgtgtgtgagtgtacagatgcatggtttgagtgtaccaaggcagggtgtgtgagtgtatcgaggctaggcgcgtgaaagtaacaacgtggggcatgtgggtgtaccgaggtggtgtgtgtgagtgtaccaaggcggggtgaatgtactgaggtggggtgtgtgagtgtaatgaggtgggggggtgtgagcataccaaggcagtgtgagtgtaccgaggcagttgagtgtaccgaggcgagttgtgtgagtgtactgaggtggagtgagtgtactgaggcggggtgtgtgtgtaccaaggtggtgtgtgtgaatgcaccgaggtggtgtgactgtaccaaggcagtttgtgtgagtgtaccgaggcgggttgtgtgagtgtaccgaggcgatgtgaatgtaccaaggtggtgtgagtgtactgaggtggtgtgtgtgagtgtaccgaggcagtgtgtgtgagtgtaccaagtcggggtgaatgtaccgaggtggggtgtgtgagtgtaacaaggtggagtgagtgtaccgaggcagttgagtgtaccgaggcaagttgtgtgtgtgtaccgaggcagggtgtgtgagtgtattgagctggggtgtgtgagtgtacctaggcaggttgtgtgagtgtactgaggcgggtttaagtgtaccaaggcagtgtgtgtgtaacgaggcggggtgtgtgagtgtatcgaggcagggtgagtgtaccaaggcgagttgagtgtaccgaggcggtgtgagtgtaacgaggcagagtgtgtgagtgtaccgaggcggtgtgaatgtactgaggcaaggtgtgtgagtgtaccaaggcggggtgtgtgagtgtaccaaggcagggtgtgtgagtgtaccaaggcagggtgtggcttactgtgtatgctcatgcctttatgtgcccacatctgccagtgcctgtgtctgtgtgcacgtgcatctctgtgtccctgcatcagtgtgtgcctggcctctccgtgcctgtgtctgtgtgcacctgtgtccctgtgttcccccatcagcatgcgcctggcttacctgtgcctgtgtctatgtgcacctgcgtctgtgtgtgctcatgcctgcgtgtgcccacatctgcctgtgctcatgtctgggtgcagctgcattcctgtgtccccgcatcagcgtgtgcctggtctttccgtgcctgtgtctgtgtgcacctgcttctgtgtgtgcctgtgcctgtcagtgtccacatctgccggtgcctgtgcctgttggtgcagataccagtgtctgcccgcgtgtgtgagtgagcacactagcacagcggctccgagcagggctttctttggttccctcaacccagcctcctttccccaccccatccctgggatgtggctggtgctaaggtcctgctggccctgccgtgagggagcccccgtgccacactagggttccatgcacactggctcccagcagccagtcctcggatgcccctgggaaaatccaaatgggcctgaggaggggcaggaagcccgtgcgtggtggtggtggagcccggggagggcggagccggcaggggagtctgggtctgcatcagccaggcggcaggaagacaggcgggcggggtaggcccagggtcacctccaactccagcctctcctgcccaccctggcagggccctcacctcactccgtcaccacggggtagctgctccatggactgtgtggctcaggcttctcaggacagggaaagagcccttctctggtgtcccacaggccagggtttgaatcccaccctgcctccctagctgagccccagcaccatgacagtgggcctcatgagggcagctgtagagagtgctctgctccccacgtcggtctcaccaggaggtagggcagccactcagtccctgtttcaggactggcctgacagagctcaccccacggagccgttcccacaccaccctttcctggtgtgtgcgagctggggaggaaggcctagaatgccgggggaggcgccaggagcatcaggaaaggccctagtcctcactcaccattgaccactgtgcgtctaacatgctccagctaaggagatgcagttcttgctctcgctgagctaacctcgcagaggagacgggaaaaaacccagacagttatgttgtaataggccctaagaggtgagatattgaagaataaatgggagtttgcaaaggggatcggggatggcttccaagctgtttggagagcgggcagccagtgcctggggcactgcgtaaacggcttgcgcaaaggccctgaggcagtgaagagctggactccctccttccagaaacttaaagaaggccagtggtgccagggcacagtgagatgggcaggagcaggagggagaggcaggcagggcccactcgagtggggctgaggcatcgagctgggtgaggcagcggggagcttgtcatggcctaagcgcacagcgaagccaggggtgcacttggcagggagcacttttatcctgaggaggtgacattggctgctgcgtggaggaaggtgagagaggaggaagcgtgagagcactgtgggatcggtagtagagtggaggaggagagagggagagagagagtggggggagtggggggagtgctggagcatcaaggctgctgggaagccagccatgctgagacccatgtgggcctgtgggtctgtccctgctttaccacagcactgtgtccctgacccgcaggcatcatgctgggccgcatgggtgacagcggggcccccctggtcagcttctgccagtgcctcaatgagtcggtcatgaagatcgtggcggtggctgtgtggtaagcctcctcatttacccacctcaccccggccagccctgggtggatggagggaagacaagaccccaccctcttctcccgtaaagtgagcagaaagctgtgcccaggctcagccctgggccggggcctccggagctacatgtgtttccatgggtcccccagccccagccaggcctggctccggccctgggcctgccccttccagcctggtctaagagctctgcccggctctgctgctctcctgggctcagtttctccatcacatggagccttatcagctcagcttttggagaaaggaaagctggcggtaaggactagcccacagttcagagtcctcggcccacagttcagagtccaggagctcagtggggaacgcagagggagggctgcccaggcgcactgtgtagactctggcgttgttgggcctgaaatgggggcctcctgaaggcaggtcgggggaaggagtggcagaggttgtctggagctggggcggtggaagtaacggtatgaaggacgccatgtgctgagcctgggccgggcaccttggcacagtctcgctctgtcctcgcaggagccccaggaagctcagggggaaggccgcgcagcgatgcggggctggggccggggtgtgtctgcctgcctggttcctgagcctggctgccccgccgcccccaggtatttccccttcggcattgtgttcctcattgcgggtaagatcctggagatggacgaccccagggccgtcggcaagaagctgggcttctactcagtcaccgtggtgtgcgggctggtgctccacgggctctttatcctgcccctgctctacttcttcatcaccaagaagaatcccatcgtcttcatccgtggcatcctgcaggctctgctcatcgcgctggccacctcctccaggtagccccggggacgggcaggacggtggggagctgggaggggctgagccctgtccgtctgtccagccatcattggttcatagccacagaaccaccaaaacgccagtgtggcccacctcacaaatgcggggacggctggtgctggggtaacaagactgacgtgggggacttttggcctttgtcgaggcctctccttcccccacggccccagtcctcaagctcactgagtccgcatgggggcggcctcgacgcgccagggcagacagcacagtagagtcagtgggaaatcacattggcaacgcactgctgctgccttttgccccacaaggtgcttctcctggagtcgggccctgtgttgctctaggagctcggcctgtccactgccgctgggatgtcctggctgggtgccctgtcacaaccttggcagtgtccctagacctcagggacttgagccatggctctgtcactcactcgctgtgcctgggcattgctttcctcatgcacagactgggggagactccagcttccagctcacagggttgcagtggaggtcgagcccctccttgccaggctgggccaggtgaaccagcacttggccttaaggatcccaaacctcagcccagtgcagagacctcaggaatttagagttgtgcaaaccatgtcgttggtggagggggcaggaaggaagtggtcccttatggagcatctagtgctgtgaaggcagtttggctctccccatggcaagtgtctgagctccacattaagggagtcgcaggaacttaagccacatctttctggcactgaaggcctcactcttccctctagccctcacttgggtctcagtttttccatctgtaaaatgccctgcaggcctctgtacccagcagtcatatgacacccacccctggcagcagatgcacctcctgcaggattcaggagcagaccccagtgaagaaaagcccaggagccattgccaggaacaccctcccgcagatagggggtcagagggcaggacaaagccccaaacatgccagctcccatgccaggggccaagccagccagagccagcagccccctggccatctcctgccagcaggaaccgcagcctcaagcccagcaggtctggagctcctgagaggctctggcgagtagaaccggccttccaggcagaggcccgggggagaggaagacacaggggccacaccggcctgttttagtcccagcactgccactgggaactctcatgacaaacatagtaataataatagtcatggtcaccattgactgagtgggtacaatgggccaggtgctgtccaagcccgtagtcgtttaatcctcctagtagctctgtgacccaggtctttttgggacaaagatgctgaggcacagggttcaggaacttgccaggaccacttgacaggaggctggaatctaagcccagacagcctggcccagggccctgctgctcagacctccatatccctcggcacagcagtgtgacatgggtcagccccgccctctgggcgtcagcttcctcatctgtaaaatgcacccaaacacctccctcataggaagaaccaagtgagagcactgcagtgcccgcggtccttacctcctgccggagcagcgctgcagaggcacaaacactcctggcggggtggctgcctggggaggggtgagcttcccgacagaggccccagccatcctggaggagggtgctgggcagacaccggcccctctaaccgtagctcagccacactgcccatcaccttcaagtgcctgctggagaacaaccacatcgaccggcgcatcgctcgcttcgtgctgcccgtgggtgccaccatcaacatggacggcactgcgctctacgaggctgtggccgccatcttcatcgcccaggtcaacaactacgagctggactttggccagatcatcaccatcaggtgcaccctgacactgcacctgggtggatggggcgggggctgggggccttggggattcccaggctcccagacttgaggggtatctgaagcgagcgagcctgggctcggagcacagcaggcagagggccagggctgggagctccgagcctggaggacagcccgggagggagggcattgctggtggccacagggcgagcggaggccagggacaggactcaggaccttggagaggccgcccgtgtggcaggagccaacgaaggggtgctgggatgcggctgaggctgacggaggcctcacagcccagccaagcacacaggtctgaccctggaggccaggccccagaggcaggcaggcagagccatgtggtggtcagtcagagtccctgggcagccccatagcaatatagcttcctggaacccacagaggcacagctccagacacaggtgtttgcacagttcccagggattctcctgaggccaggaatgggggtccatggggctgcaggactgtgaggagggacttgaccccgagagctccctggtgtggcattcctacccaccccccgcaccaaatggctgtcccagaggccctgacactcaacctcttccttggagccagaccctgacaatgcaccctgcccctcctgctgctcctcttccccttcccaccccctgcagtatcacagccactgcagccagcattggggcagctggcatcccccaggccggcctcgtcaccatggtcatcgtgctcacctccgtgggactgcccaccgatgacatcaccctcatcattgccgttgactgggctctgtgagtggactttgcctctagctctagccctctgggaggggctgacttcagggtcagcagggatcagggtgagcggctgagtcccttccccagggtagaaggctggggactgccccgcttggcactgtgggagtgccctactcattagcacaggcctggctgcataatttgtggggtccagtgttcaaaaatgaaaatgtggaacccagtccaaaaactgtaaaggccaggcatgatgactcacgcctatatgtcccagaactttgagaggccatggcaggagcattccttgagcccaggaattccagagcccagcctgggcaacacagtaaaatccccatctctactaaaaattagaaaagaaaaaattagctgggactggtgacatgtgcctgtaatctcagctattcaggtggctgaggcacgagaattacctgaacctgggagatggaggtttcagtaagccgagatggcgccactgcactccagcctgagtgacagagcaagactctgtctcaaaaaacaaacaaacaaacaaacaaacaaaaaacaaacctataaagaatttcaagacagaaacagcagaggattaaaccaaacctaacccttctaagcatggggacctgtggaacccacagctgcatgccaagaagctgcttcaatgatgccaaagggtgggcttgggaggagccaggaagccatctggctgcaggctttgcatgacagctggtcaccggccgtgctgtactgtgctgggttgagcactgccctcttccagctccccttcaagtgcccaccactcacccccaaccttggctcaccagggaccgtttccgcaccatgattaacgtgctgggtgatgcgctggcagcggggatcatggcccatatatgtcggaaggattttgcccgggacacaggcaccgaggtgagagcagtgagatccagaggctgccaggagggtggagccacgcagggtgggcagggcaccagatcttccaccaaccagctcggcagcctccagccaatccctccctccatgcctctgggcctcggtctcctcatccgttacagaatgactgattcctctaacatctatttattgagcacccgctgtggctggcgctgatatagacacaggaggaacagtagaacaagatatgataaaattccccgccctcgtgtcgggatggtctgtccagtttagccaacatgtgagcatttgtaggtctgtgcaggctgtgtgggcttcaggctccttctacaggcaaatggagaaggctgtccccacatcatggggaagaagctgaggtcaggcaggggatccaccaattccccagatggaccctgtggattaagtcccctcctctactaagccagctccagtgggaggcaggacgcttgggaacaggagcccagggaggccgtgacctgccgaggtcacacagcgtgtctgcaggaaaatccatcttgtggttcctagccctgagctcattctgccccactggccctcagtcctccctcgtatctaaccttggtccctcctgctgctacaaagacctgtttcccttcaccagaaactgctgccctgcgagaccaagccagtgagcctccaggagatcgtggcagcccagcagaatggctgtgtgaagagtgtagccgaggcctccgagctcaccctgggccccacctgcccccaccacgtccccgttcaagtggagcaggatgaggagctgcccgctgcgagtctgaaccactgcaccatccagatcagcgagctggagaccaatgtctgagcctgcggagctgcaggggcaggcgaggcctccaggggcagggtcctgaggcaggaactcgactctccaaccctcctgagcagccggcaggggccaggatcacacattcttctcacccttgagaggctggaattaaccccgcttgacggaaaatgtatttcagagaagggaaaggctgcatgggggagccccatctagggagtgatgggcccggcattgcctgaggccccgctgtgacagtttccccggtgtgagcccggtgagggcggcaggcaggggttatccggccccactttctggatgacagacttgaggctctgagagctgaaaacacttgtccaaggtctcacgttaaggtcaagacactaactcaaatctttcaagccccgcctctcctcttggaggacagggcagcctgcagctgtgtccaggcccaggccccaccccataacaggtggcctcagccacacagttctccccaaggggagcagcccagggccaagccccgctgccttccccaggccacagtgcgtccagtctcctgtcctgccacgtgtcttttgcaaagctccttggatgtggagacagatgtctttactagagctgaaaggcccccttgacacatccaggccaacctcccatggaataggtaggcaagccaggactccgggaaggaggtgcagccaggatgctctggtggagctgccgatggggccctggtgtcagaactccccaaaggcctgtgcgtccaagtggagtcaggttttctattcctttctgtgtttgcaaattcagtgttaactaaataaaggtattttgtttttcacttcttgtgggcttcaacaccttatgctagccagcaaatatgatattagctactgggctaattaatacaggcggccagagtgcagacgggcctgtctgggcagccaggatatgggcgggcctatgcaggtggccagaatctaacaggcttgtccatttggctggagtgtagacaggtctgtctaggctgccagtgtgtggacaggcctgtatgggcagccagagtgcagagaagcctgtcctggtggctgcagtaaggacagtcctatctgagctgtcacatgcagaagacagagtataagctagcctacccaggagcctgtctcaataaccacagggcagctgggcatcgtccagtgtggacagacctctctgccatggtctaggctctgctctgcaggcagggccttgagatcagtccccaaagaagaaacagatttccttcccagtctggctccccgtggtgaatgctttgctttagacaggggcgtgcccagggacatttccagatggtctccctcattctcacaccccaggctgcctccaggaggcctgcagggcacacagaagggccctggcaacacagcctgttccagatatgccttggggagaagatacagctctggggtctggaggggcttgcaccatgatgcccttgaagacactaaggcccagggaggggacaggcctcccccaggtcactcagcgtcaagagggcacctgctcccactgccccattcctgaactccttccaccctcctcccaggggtggagtgtgaggagtctgggaagagcacgaccccaggacacctcctcccactgcagggctgggggctgcaggcctccacgagagcatccttccttccctgaggcctcctcacctgggagaggtcagatgtcatgcaatcggtcatcccaccttcatgcagacaagcttagcagccccttctaggtgtcacatctctaagaccccttgagcaatcgagtctgtcccagcacaaggcaggagtctgctctttagtggacttggcaggagcatccttacacacctccagcagcagggaggtcaccacttcccgagcatctcaacccacagtggggcagctctgcccatcagaggctcttcttagctcagagctgggtaccacctcccggtggcagctctcccactggggtgggaagcacactgggtgcatctgttagctctttcctggaaaggtctgcggagacctgggcccccaagtcggctctgctccagctcccaggcctgcctccagtcccctgctctcctctagaaccca

SEQ ID NO: 15898 - DNA, 98701 bp, Human
tgggggctgtgaggagctcactgggagccctgaagacaaagtgggggcacggggtgagatgagagggttgtcagccagagaaacagctttcctggacccagcatgggggtggggcgaaaagtcacaacacttatattgaatatttagtaccagttaacttaggtttctatacatgatgcattacttgattaggtaagtgtaaatttacttggttcctgctaaaatacatagtatcctcaagtggaaattaaaacacaagaacaagccacaggtctcccgcatgctgattatatttgctaagtgttttgtgacttggacacacgtgtctgcattatcagctagcttaaattcggtagtcataccaaagaatacgtagtacaatgctgtttaaagaagagatttattttattatttaacttttaaagtctctaatatgccttctaagaagggttctggctcagaaaattgcagaagaaaatcgagtagagaactagaattacagaaacctaagaaatacttttactgagctttcttcacacaagaaaatgcacggaaatgaattatacatggataccaatttgtgatttttaaaaatttgtaattttttaaattaagataaaaattagtttatttttttgaatacttttttgttttgttttacctcaccctttactaagctgttagcttggtctgttgcgcttactgctatatcctcagcatctagtacagttcctgacacatatatgcacttaataagtatttgtcaaatgaatattattgagtaaataagatgaaggtcaattcagaaattcagcactatcaggctatatacataatacagactattataaaaaactagaatggagcagttccttttaacgacggagaaatgtcagtaacatactttgagcacaatatagctaatttcacaactggtctttaaatataacatacctataatcaatttaatgtttttctttgttaccagagttgttcaaaacgtgcgttttacctatcaaagctcaactaaatgaggtttaagaaatctgcacatttgaatgtacttaattttaaaagattctggttttggattaactctggatttcaccctatgggaaattttgtaaatatttccaacttaaaaaaaaactgtgaagccccagcgctaagagtaaacgatgcattggaatttcaacaggatttctgtaactctgaaataatctttagcatttcttcttccccccatcccctcagtgtaggagcattccagtccaagtttctgggagatcgctatcgaatcttatgacactggggtgagaagttttgccgggttgaaatgagggggtcactttaataatctggaattccggagactttatgtcaagtcttaaaaattcgagcctgtggaaggctgcgctgtcaagagaccggagttgcgagcgtctgggtgacgtccgtcctcctggaaggtgggatccgggtggcaggtccctgggcggcgactccggccgggctcatagcgtcgcgcccgccccgctcatcggccctacccagcgtccctcccagaccgacgaccgcctgggaagcctcgagctcccagcccgctgcacagcccggctccgctccacagtcccccactgccaccggccggggcgacaccgggcgagctggcgagacccggctccaggaccgaatcgcgccgacacttgacggcgctccccgcccctccctgccgccgtctccgcccccgtccggtcgcattccggcgcccgccgccgccgccgccaccgccgccgatctgggaggcttgtccctcgccgcccaccgtagccccggcgctcggccggtcgccgtttccaagatggccgcggcgcgcacggctcctgcggcggggtagaggcggaggcggagtcgagtcactcccgcacttcggggctccggtgccccgcgccaggctgcagcttactgcccgccgcggccatgcggggctccgtgcacggatgagagaagccgctgccgcgctggtccctcctcccgcctttgccgtcacgcctgccgccgccatggaggagccgccgccaccgccgccgccgccaccaccgccaccggaacccgagaccgagtcagaacccgagtgctgcttggcggcgaggtgagtgtggcggccgcagtcggtcgctcgcagaaagcggggcgggtcctggcccgaactcggtcgggcccgagggcctctgcttcccgccaggttgggagggaagcatccagtctctgcaggctggggcgggaggggcgcggtgcatccctgggtcccaggggaccgcgtctgagtctgtccggcgactcctcccggggttgcagctccgcagggttccgctcgagcgtgttgccggctccccttcccttgtagactcccccagctcaccctcaacgttgcgggggctgggagcagagtgcggctgcctcccctgccgctagcttcggaagagtggcctcactgaagtgcctctcatcattactgaacgaaagtggtccctcccctctgccctcattcgagtaaaagagacattcggaaatcgagtgcgtactggctatttccccgcgttctcctcctcctctccttttgcccgctccagagaatgcctgtcatctcttccgtgagaaattgcacttagactatgcagacagatacgttgctttcctgttctgagggccccttactgtcctttagtgctagtattgtgcagattgttgctcacacgtgcacaaaagtaaggattcatttgtctaaaactttgctactgcaggaagctctaaggtggaacttcggtaaccaaagcatttgttgctttttcttccatactctattaacttatttttatgtctttattttttttttaattgagagaacaaactcaccataactgagaatttccctctttttacgtgcctatgtttgtatgttcaaatgtcctcttactccctgtcctttgcatcccagagtaaacttgcaaactgctgccccctgtcccctgtaatgaaaatacctcggcagctcctcttggcatcttatggtcttgctctttagttctaggaataaggcagtaaagtgtcctctttttcctgcttaaagaaaattcacacctgtaactgtagttagaactgaacacaggagccatattcttgcttgtcatcattcagttggcccaaacaaatttgttttatttttataagctgtgaagaaattagttgcctcttttaattctgagatagttctgggtacttctaaggaacaacttctctgaataatggtacagggtgtaatgagaattcctttggttccttttgaatacatctagtatttttagaaattttgtcagaaagtttattataaatttgttaacggatcagttttcgagcaattttgatacctttttctttaaaattaatagtgaacacttaacggttaaaataggccattgtctttatttctattaacccatttaatcttttcaacaactctatgaggtaggtcctgttatactctctttttgacagatgaggaaactgaggcacacaggttaagtatcttgtccagggtttcacagctggtaatgaagaaaggtctggctgcacagcccatgtctttaaccaccatgaagaattcattatccaaatgggcggatcagaaattagaattctgtataaccctactccggaaagaaatggacatgagcattcttaggtaaaagcgagaagggcagagaaatgaaaatgtgctgcaaaaatgactgctgcttcagtggtaaaaaaaaaaaaaaacttgacttttcagtcaggcttctgtctgtgttataataaaaataggtcaggataatgggtttcatccaactgtaagtgaacagcagtgtacggaacaagaagatctgacaaatatttttcttagcaacattgcagttaattttacaatagaaaaatctgtaaaacagattacttgacaaagctgttgttttctcttttttatgtcctcgttgtcaccacctgctcttcaatacatagaactgacctctgacagaattactgtagatctttggtaaaagatgtagggggtctatccagttgttcatttgaacttttttttttaaccattttagaggagctcagtgtacgtgttcaaaatgtgtgaaatgccacctcttttttttttttacaattttcttttttattttattttcaatagtttttggggtacaggtgttttttggttacatggataagttctgtagtggtgatttctaagattttggtgcacctgtcacccaagcaatgtacactgtaccaaatatgtagtctattcctcaccccgctctgagccttcccccgagtctccaaagtccattatatcattcttacgcctttgcatcctcctagcttagctctcacttataagtgaatacgatgtttggttttccattcctgagtgacttcacttagagtaatggcctccagctccatccaagttgctgcagttgccattatttcgttgtttcatggctgagtagtagtccatggtgtatatatgccacattttctttatccactcattggttgatgggcatttaggttggttccatatttttgcagttgtgaattgcgaattgctgctataaacgtgtgtacatgtgtctttttcatatgattagttgttttcctttgggtagatactcagtagtgggattgctggatcaaatggtagttctacttttagtttttaggtttttttagttttttttgagacagaatctttctctgttgcccaggctggagtgcagtggcgtgatctcagctcgctgcaacctctgcctcccgagttcgagcaattctcctgcctcagcctcccgggtagctgggattataggtgcctgccaccaggtccagctcatttttgtatttttagtagagacaaggtttcaccaagttggtcaggctggtcttgaactcctgacctcgtgatccgcccatcttggcctcccaaagtgttgggattacaggcgtgagccactgcgcctggccagttttttaaggaatctccatattgttttccacagtagttgtactagtttacattcccaccagcagtgtataagagttcccttctcaccacatccatgccattgtctatttttttaattattatttttaaattatggccattcttgcaggagtaaggtggtatctcattgtggttttaatttgcatttccctgataattagtgatgttgagcattttttcttatgtttgttgaaaatgtgtgaaatgccaccttttaatacattggaaaccaataatgtgataatttatgctaccaggttaactggttttgccacagactagaataaaactctgtttgccatctttgtcacatactttatgtctgtgtgtcattgattaggaaggttgtgttaatgcacaggccttttgtagaattcaggcctgtacatgttggcctccaaagctgtgcagcaagtgtgccatcgtggcaggtgcagccagcccagcacatctgcctagtgtgtgctttcctcctgacccaagagtgttatgcagtgacccagcaacacaaaacaggcagagaggtcatagtactctattccagttttattgcttgctgtcagttgtggatacttttgtccttatttttgataaagaattcatgataaggatagctgttgttattgttagtgattaaattttgaaataaacattgcttatcatttctttttcaagcttctggggcagttttaggaggatcctgaggtgactaggagagctattaaaactaatttggaacaatttacctttgtgacttattggatctgtacacctaaaacacagaataaattggatattaaggctgatataatgctcttgtttactataacctttcatttaaaatatttatattaaaaatagcctcattgttctcattgtccttatgagtacatgctgcataaatttaacaattaactttttttaaaaaatgaattatttactttatatatttattgtaaattcatttgaaaaactggatttcctactaaaaaactagttgaatgtcgtcactcctaggcaatttgctctgcctctcggcttgaatgtccaccttgagcctgtgtgtttcagtcttgaccttgtatgtcaactgttctccctggcaaagtcagcctcctgtggtgctccagactgttggtgtagcatcagtgatggtcatgcctttacaccactgtaacagtagatgccattggcgggggtggcgttaggcagagaggagtcaccaaacagcagtgatggcagaaacttcatgttttcaactggggacttgtcacttaggaggactttgtagttccctttaattttctgtcattgttagaggccactctgtttccttcatgtatgctctcatggtgtcctgcaaatcttgttctgagctctgctgaaatacggggatataaaggtcttgcctgctcactggatacatttgttgtaataacttcctgttatttaataattcctcattcctcatgactatgattttactcatagcattctattgtctcagccttgtcatttgaccaggtagtatgtatgctgtttgaagactctttaacgttgcctatcagtaggctactggtagtagtttctttaaagagaaaatggaaaacgtgagagaaggagattagctgaagactccgtaggtcttcataagctggcactcccttggcacgataatcaaggcccagacactcactgtgcttggcttctcaggcacagatactcagctttgtctgtacacctggttagtcagtgtattctcttgcttgtagaaagccaaagtataattaagagattgattagtaagcatgatattagcaagggaaatgagttgaatgatcccggtgactcatgttagcagaccagtgaggtgggcttgcatccctagcaggtgcacccctgcttctgaatgagaggcagtgtgatccagacttactcttaggtttttattttctaggcatcacacaggctgcttttttcccttgtgtcacaaactttcctaaattgtttgggttatagtatgtttgttttaatcttcagtctttataacaaaccttgcttttcctgctttaatttgggagtatattttatccttctcactttaagatttctttttttaaacctcagtggtacggtacatttttactaatggtgagtctcagaggatcaccttattgtctccatcccccacccagtattctccccataatctctgtcccaccacccctcgccaagaatcctttagcatagtttctcagaacaatgtggcaaagatgtcagtggttggtgctttcataaaattctttttgaatattgtgttcaaaaaggatcatgatggtatctggcttttctggatttaagtcataaaattaaattttaaaaaatcagaaccacatcagaattctatccagttattaaaaactgtttttaaatagtgtttagtgacatgtgaagatgctcatgatacaactccttttggggtggtacctgagtagctcttcttaagaagattctcaagtatttctgatgtatacatactcaccgctgtgttcagcaagaacaaacagactatgaaacagaatttgcagaagatgggagccaaaatttgaggtagtttttcatctcatacacatatttgtccaccggctgtgtctgccctacttcactgtcttccttctaccttatttgggggaattcctctcttgactcaaactacatggtacatattggagctgccctcttcttacagatgccaggccataggcatgacacttgacccagtccaggccaattaggattctttcctgggatttttcaaattggagctgggagagagaaacgcgcattttactgaagtataggctgagaattcatgagcctagagctagcttcctgaagctcctacagaggacctggtctcagagagtgatgttaatccccagagaaaagcagagaggctgaaagaggtctatggccagttgcctttaaaataaataaataaataaaaataaataaagagatggcagtctctgtatgttacccaggctggattcaaacttctggtctcaaagaattcttttgccttggcctcccaagtaggtggtactacaggtgcgcaccaccacactgtcagccagttgcccttttgtgctagatttgtccctatttttctcctgatttgatgtgagctaatctctatttgtgcttaaactattaatttgagttaaacttcttaaaaccctaatactcagtgtgatcgcattttaaaaagtatgtgcatagaaaaaagatataaaaaatacatactaatttttcctaaaactttttatgatgaacgtgttacacattttattttaaaataaaaagctaatcagagagcctaaattcttaactagctcatttataattttaagtttctttacgttgaattgttactaaaattgaaattgatgagagtccatgtgatataaagagaatattgttgccaaattttaaatgattttatttatttttggtatctgagctggcttatctgagctggctgtagcaagctgcttttaaaaaactatttacttcagcttgggtaatagagtatgtagattagaaacaactccaacagtaacaaaacaaacacaggacttacattagggtggtcttttacattaatagaaatatttaaaatctagaactgtgttctcaacatgtatattgtgtttaaatgctttccccattttaagcggtgtacttgaaatgtctatattttaaaagatacattattccactggcagtgagtatggtaggtgcatttttagacccctgcagatctcacactgtgtaatcgagtgcctttgcctttaaatatttattcactagcaggcaacatgaagttttgtttttgaattacaagaacgttcatgttttgcaatttgcagacctacctcagcagtattggtttcatgggtcatatggatgccacgtgtttataaattagcagggaaagctattaagaatatattaggcagtctatcaaaagcatttcatacatggatttcatttcagacaaaataagccttctgtggagaaaagtagatactaagctttaaagctgatcagatttgatgttttcagtggaagcttttttgtgtgtgagcaggctatttgaagatactgctgaaatgtagaactttctgaatagggcttgttagaggacagctagtttagagttgtcaaattaatagaaattgtcaacctttttagtgtttcagtggggaacttttggacgatagtacatttattttatttaaaatcctaaagtctttttatatgggaacataaaaatgtagatataacttggttttctcacacaatttttggagttagttagttgtatctgttaagtatttagttcttactcagataaggatttaaacatttgctaatacaagttcttacagatggtaggacgcttagtgttcatttcatccaacttcctagccattgcttatagaattacaagagttgagctcttataagatcatttgggctgtgcgtctcgttttagagatgagaaaaatggcctagaggggctgcagctttcccagctgacagcttaggctccagatctgcaagcccttcttcccttaccctcgcatcgccatgtgctcccctggtcaaggtccaaagccaaggtgttctccagccacctgccatacatagcccagcttaagcccatgtgcacagttacttggcaaccgtgaaatgctgtattttctggatgaattggactcaacaggatcaaacgagatgaaagatttgtttttagaaaaaaatgcaaatagaaaatatgaaatcctcttaaaactcatcatccacaacgtttttcccccgtgaaacttttatttcttgctcgcagaataaagaagagccaatgctcagaaattttcagatacgttgttattttcaggcgtcggtctgtacatcaagaagacagtaagattctaacttctggtctgtagtagtggttttgaaactgtgtttatggtcgtgacctacagtaagaaatatattttatgacagtgtgtgtgtgccttataaccaaaagaaaacaattttgaaacagtatttgaccttgcaatatatgatactcaaataattcttattctgttctattaaaaattgttcatcataacctactaaattgattttattacccacaaataggttgtgaccctcagttttaaaagcatagctctacccaaaataaaatggatgctgttatactttgtaccttgtcccttgagactgagtcaggagaacaagtacactatttgtctactaaatgatcaaatggaattttgaagaagctcggcaatacttacttcttgaagacagcattgttacccgaaggcaagagtaagaatgtatctatgcttgtctctcaaggttgttctcttggctgcttatccttaaactacaagaattgtaaagatcagtttaaaatctaggattaattttagagtaaaattgggattggcattatgtgaataatttaggtaatttgttgatctttctctgaaacagtaacctgtgtttaaaatttttcacatagagcagtccttaagaaaagaaaggaactcattttcccctgatatatatacacacatatatgtgtacaccatatatacacacacatacacacacatatatgtgtacacccatctgtatacacacatatgtgtacacccatatatacacacatgtgtacacccatatatacacacatgtgtatgcacacatacacatgtgtacgcacatatacacatgtgtacacatacatatatgtatattatactatacatatatgtacacacacatatatagtgtataatatgcatatatatgcacacatagtgcatattatatataatatacacatatgtatataatatatattatatattataatatacacatatgtatataatatatattatatattataatatacacatatgtatataatatatattatatattataatatacacatatgtatataatatataatatatattatatacacatatataatacaagtgtatataagtatatatgtatatacatatatatgtgtacacatatataagaaatccaaatccaaatactgaaaaatttacaaaaaatatttacaaaaatatttttatcaagttattaattataggtggaatcatgtatgtctcaagctatgtgttataaatgttatcaaataattcaaacaatatatttcacatctatatattctgtatatgcatgatatatatgtcatatgtaatctatgttagggtacagcagtttcactttaggtcttaagcattgcttactttagggtccaccttgacatttcccccgcttccccccagaatagatgagatccttctgttatgtgtcctcagagcccctgcagtttgccaccatttgtaattatatatttgtgtacatatttgtttattatgtttgccttcagtaaactccatgagggctggggcatcgtctgttgttttgcttacttttattgcctaattcctggctcgttgcctaacagcaggttctttgctgacacttgtatgaaggaggcagagcataggttttggtagtagataggctttgaatgttaccttttgattgctagcagtaggattgtggggaagtaatttagcctctctcagtctgtttccgcatttgaaaggcaaaaataataacatcttcctaggttgttattaagattaagtaattcctgttctatagtaagtgctcagtattagctgttttattacatttctctttcttcctctttttgggcttaaggtaaaagaggcaaatcctatagtgattttcttaaaaagccaccaaatatgcattgaggctggatacttttaaaaatagctgcaataatctccattcaagaaacatttcccccccgacgtctgcagaagccatagaaataagaaaaaggtttttttttttttttttttttggatctagcttttccagattctctctcttactttagttgtggtttattctgcatattattcctacaggtgtttggaattctggctggcccttggatcatcataaatcatgctgctaaattaagaactgtaacgctactgattgtgattgtttaggttaataggcacagctgtctttttctgtggaaattctttttagttcatttaacttgtgtctttataacttggattaattttcttttcattttttaaatgttatacactgtaagaggaatagttttcaaattgatctagccactgcctaagaaaaatgaatgaaatcttttcacgtaataaaactagattgatctagctactgcctgagaaaagtgagtgaaatcttctcgcttaataaaagtaacttaatcagttagaaattttcctgattataaaggtaacctgtatctattatggaaaactatgaatcatataaagaagaaaatgaccaattctaattctgccatctaaaaatagttttggctttttttttttttttttttttgagatggagtctcgctctgtcacccaggctggagtgcagtggtgcagtcttgggtcactgcaagctccgcctcctgggttcatgccattctcctgcctcagcctcctgagtagctgggactacaggcgcctgccaccatgcccggctaattttttgtatttttagtggagatggagtttcaccatgttagccatgatggtctcgatcttctgaccttgtgatccacccgcctcagcctcccaaagtgctgggattacaggcgtgagctcccgcacccggccggcatatttcttttctgtgtattttttttatacagtttatttttacaagctgccatatcatgagcattttcctatgacagacaatggcaaactgtattcctctagatgtatatcccataatttaatagtttgaatttgataacatgatataacatatggtttgtgacatatgattccacttacaattagtgacttgatacaaatatttttgtgaatttttcactattttggattgtttctttaggatagcttcctaggtcataagatatttagagttttaaggcttttgagaggtgttgctatgtttctttctagaaaggtattaagttattcataccagtgtgaaagacaaaatgcactggataattttatttacaaaagcatattctcctaaattgtaatgaggtatagatcgcttaagaggaaagggctccttatatattcagaaaataaaacattaataacagcaacaatattctcaacagaatccacggtcatccttgattagttcattcagtcctgtgtaattctttttccacttgatctttagttagcagtctcatgaatttatcttcttcttgattagagttctagaaatcctgagtcagtccactggtatcttctcaaagttgtttaaacattacatcagaagactgtactgcaaggtacctggcatagtccttttccttgggtcccaagacagctcttctttgttgaagacaggcactgtggcctgtagctgattgtaagtgctgtcagggaagcagcaaggtagaacgaaaacctatctgtaaatgacaaaataacttaaagtggctgtggttaacttattactataattttcaaaagtgaaagatccaatgagatttcattataagaataaagcaattaataaggatatttggttgtttctttgttgtacaagacaagattaaagtcattccaaaatttttttaaacaaaatattcatataaacataaggattctattttcaagaaagagtggctattccatttttataaattagatggaatatccactctttcttgaaaatgagttaatctttactgggaaataaaagtatataaatataattactgagaaaaagaagtttagatataacatatgatagttctgatatatgccaacaatataccaagcatatagttaaaatataccaagaatatcagagaaagagattctgtaagtccggaatatgtcctgaacatctatctgtgcttattaatgaaacatcataggtaagtaatgtgaatatccagttgaaaaccactggcctggaagatactagattcaaattaagttgggaccaagtcaacatttaaaaacaaaactgaaattatgacccataatgctgtgttgtctaatatcgaacaaagtagcaccaggactctgataaatagcagtgtatcattgtcagtgagagcactgacaattttctgttaacttctatagcaagcagagtctgaaatatttacaacattttacctatacacatttaacctagagaaggctaagcatttcttctgacttgacaactcatcaataacaacatgacagataaacctaattattttctagcacttctttttttaaaaggtgaaagaacaaatctttgtgattgtttcggggaccaccatctgggaaatctcaaagacagttttaggtgcaaatgatatttatgatttgattttggtaaggtaaaatattaaaagttgccaggagatttgaaaacttcaattaagataggatcgtgggttaccaagaaataatagatgactttatatttaacccaagtgacaataaatattttgaaagtaaacataagtggtaacatgatcgtcaagaaactttcctgaaggagaaacttgttccttaaataatcaaggacataataagttggcagaaaccataggttttcatagtaaaacagagaatcttgctgtttgtgcagataatgtagaaaagtaaagaataacttttacagtctattaagagcaaaccagtaatctgataaacatttgacgttgaaacagagaaaacacgattttagttttgtatcagtataacatttgatactaaaggtctttttaaaaaccttatttaaaaccaccaaacttatccagtcttgaccatgacaaataaaattccctttccatgaaccttctacaactttctgtattcaaaatgaacacattcattaatggactcaagacacaaaagtatataaactttttttttttttttttgagacagggtctcactctgttgtccaggctggggtgcggtggtaccatcatggctcactgcagcctcgacctcctgggctcaagtgatcctcccacctcagcctccccagtagatggaactataggcacatgccaccatgcgtggctagttttttaagttttttgtagaaatggggtttctccacgttgcccaggctggtctcgaactcctgggctcaagcaatctgcctgcctcggtctcgcaaagtgctgggattagaggtgtgagccattgtgcccagctttagacttaaattgtgtttaataatcagtgttttagtactcaggaatggtgtaggtatctaatgaatacccattgattaagtcaatttagtatcagaagttttaaattacctagagaccttggaaattatcttcaagctgatgtgattattgaaataaagtttgtcagataatgattaaatttgtttaaatacaaatttaccttttttagaatcttaagcattaagtagtagtaatgttagcttatttgattaataaacatgtataagtttaggaagaacattacaagtagaataaaaatctgtgcgtatatttaacacactgataagtcagagaagacatagctgtttttttatttttgttttttgagacagagtcttgctctgtcgcccaggttagagtgcagtggtgcaatcttggctcactgcaacctctgcctccgaggttcaagcaattctcctgcctcagcctcccgagtagctgggattacaggtgcccgccaccgtgcctggctaatttttgtatttttaatagaaacggggttttgccatcttggccaggctggtttcgaattcctgacctcatgatccccccaccttggcctcccaaagtgctgggattacaggtttgagccactgtgcccgaccaacatggctgttttattaaaccaacaatataaactagtatcagttactaaaggtttacctaaattgtgtgaatttgaattctgaaactgtttctgagttagtttccatgatccatgtcttcttttttctcacattgaattaaaggtgcaatttccttgacttctgagcattttaggactattcaatttatagaaggacagctggcctttcgtatctgtgggttctgcatctgtggattcaaccaactgcagattgaaaatattcagaaaaaaaattgcttctgtgctgaacacgtacagacttttttattcttgttattattccctaaataattcagtgtaacaatcatatacatagtaattatgttgtattaggtattataactaatctagaaataaagtatatggaaggatgtgcataggttatatgcagatatcgtcattttatatcagacagttgagcatcccagattttgtttttccaagggaggtcctagaatcaatccctcgtagatactgaaggatggctgtacttatctgcgagccagtcagaattgagctctctcctttaagggattttataacctatttgagaatatcatctaaaggtaggaacatatacagaatatacactcacataatgagaggtataggcctttcatagttacaaacagacacagaacacaaagagaaagcctatatattcaattttaaaattttagtcatggatcaagcatacgcaaatgtaacattctccagtcccgagatctgcttcttggtggtcatgaaattcctaactgatttgagctcaaagtagacaaatagaaaaaaataatcaggttctctgtcatctttcctaacagaaaaaatatccctattataacccattaatttgtttatggagattgacaaactgtaaaatcaaaagtaaccagcaacagaaataaagcaaatctcagagtaaaaatcagttccttactgtgctgcagatgagcaaggtccaaagcgcaggaccaggaattgtactcattgttgtgtccccaggtcacagaccagaaacaaggcacaggggaacccagaggtcttgttacttgggtggagtcaacagggatctgaaggcaaggtcttcatcctgcttgagtcctggcatcaaaacaaaggaaaaatacagtggacagttaagtagacgattttattcgggatattgcagtggggaaaaacattcactattgaggaatgtcttgaagaggagggagaaacttagggttttataaaacgtgggaattactgaggaagatagagggagggctaattttacaatatgcaaggacatggtggtcctttgaggttagccatttcttggaacacagaacgtggatttcctatccattgctctcttaaggagcacagggctcagataaagttaaacagttgtgtcaagtgatgggtgtgtaagtgcccaactcattctgtcctttataacatagaatattttcatttgtattaaatagtttgaagtaattaattttaaatacccagacatgatcctgtatagcctctgaaaatctgtaaaggtttttctcctttttaaaaaaattgctttggttcatatttggtgcttctgctctttaataggctttgtttctagtaaggtcatgcttatttaacttatagatattgagcttttagagagtaatgtttcatcaaacataaaaggctgtcaattgtaatatgcaacataaattttatatgtcactaaggaaaaactgcaatgaagcaatgacacagtgctttttttatatcagttgtagggtacggtgaaatatcagagatgttaaaattagggaaaaacgtgtgttttaaaatcagtgaagtatggccttgactcttgcttctaattaaactttttatgtgataaatatggtaaggcatagctattgtcttctataaaattctggtaaacccataaagagtagaaagaaggtagaaaggcagaaagtgggatagagtggaaagtgggatgcagtgatgatatttattatataatatttgatataacttcagtctaccagtaggaacctttgttgggtagcaattgcatactcattttcactgggtgttttctgatatttctcttctaggaagctgtgatcttaatttaaccagtcttttgtcggactcttaggatgtttctgtttcttttactgttatgaatgaggttaaaagcattgtttttagcttaatctttatgtctagtcaagatgttttattagagtaaaatcctggaaatataattactataccaaagtgtgtgtgtgtgtaaatatatgtaaaattataatccattttattctttacagaattttacataccgagttttacgtataatgggagctgtataagcgttgacataatgtggtaatagatgaaacaggagctggcagttgaccaattatgtaggaccttgtagtttcccctctactttgtgtttaaatttttgtatgatatttattgttgtataatttaacaaagacatacttgtgtatattacatgtgtagcttgataaattgttcaaaagcaaatacagcgttataaagtttacctaagtgaagaaataaaatgtgagcagcatcctagaaaatctcttcctacttcttgcacacactaccctttctttcctcattatcctgacatttactgatattttacatctactactttcactcagcatggtgcttgtgaggttcatctatgttgttttggttgatggtggttctttcattcttgctactgtaaaatacttgttactgcaaaatgtgtaacattttgctcaatgggtataatgtttatacccattgtataaatgtatcatggcatattcatttttttaaaccatctgaacctttttttttttttttgagacggaatctcactctgtcaccaggctggagtgcagtggcacgatctcggcttaccacaacctccgccttgcaggttcaagagattctcctgcttcagcatccctagtagctgggactacaggtgcgcgccaccacgcccagctaatttgtgtatttttagtagagacggggtttcacacctgttggccaggatggtctccatctcttgacctcgtcatccacccgcctcggcctcccaaagtgctgggattacaggtgtgagtcaccgtggccgcctgaaccatttttaagggtacagttcagtagcgttgttaagtacatttatttacactattgatgcaaccaatttccagagctctttttatcttgcaaaactgaaactctatacccattaaataacaactccccatctaccccggtaaacactgtgttacagtttcatgaatttaactactctagatatctcatgtaagtggaatcagagcatttgtctttttctgattggcttatttcacttggtgtaattttcttaaggttcatccatgttacggggtgtcagagctttcttcctttttaagactgaataatattccattgtgtgtacatatcacacttcatttatccattcatccattgatgaacattttggttgcttttatcttttggaatatgtgcatttaaaaaaaaatctttgaaaggctcttgagaatatttgtgccaatttccaccaggaatatatgagtttattcttgacattacaataataatttttaagtctttgctagtttgataaattaaaaagctcctgagaacacatggacacagggaggggaacaacacttactggggcctgtcgggggaaggaggtggcggggaagagcactagggaatagagctaatgcatgctgggcttaatacctaggtgatggattgataggtgcagcagaccaccatggcacatgtttacctgtgtaacaaacctgcacgtcctgcacatgtaccctgggacttaaaaaaaataaaaaagaaaaagctcttagttttaaattcttgcattttaaatcgtgaggttgaatgctgttttatgtcactcagctatttacatttctccctattgtgttttaaaaattattcatgtatcctcttgactgtactacttgagagtagtaactattatcataggtattccatttatccccgaagtgcctggtactatatgtaccacatgagatgcccaggatgtttggtaaataaatcagtaactttctttgttgatgtgttagaacctcataaaattgtatgcttatcatattttttggtttgttacaacttttttaaaagtatttcttaaatagttacataataaataatctcaagtaatatttgttagaaattatccaattatccctattttaggctaataaaagtgtttatttttaataaacatttcttggttcaaaactataggtatatgttttgtttctttcaaatgttttttaaaagttcacttaaaaatcatgttattccattaaattttgttttcctacttagtccaagtttattgcacaattgcctactctttatttttgtttaatcggagcagataagcttgactgtgactaaacctaggttgagaatcattactaatcactttgctatatttactatgactaacccctgttaaatactcaaacactaatagtttatttaagaagtttaaagaagaatttatcctgctacatgcagatgtctgatagaacctacttgtaggttgcaattttatgcaatttttgtattcacaactctggaaattttgagttaaggttaattaattgaaggctgtgagattatatttattgtgtatagctttgggtgtgcttttttttgatgtcttttattcctctgagtgttagaagcgtgtgatccttagagcaccgtaaggcagtcactgaagaaagaactgtaccacctctggtgcttttgctttagacacttcattggtgtgtaattcttgaagttcttgtaaggagagtggataaatgaagagaacaacagaaagaagggtgggaaggagttagggactacaaagaaagagaaggtggagagaaaacaaggtgctgtgttacttcaaatgacattcattgtcctaataggcccatgagagggaagtctaatgaagaatttgaaagtaaaatgcttttaaggaaagtttctctggtagagtaaacccaaataactcctttaatgcagaggttcctaaacaggcattgaagttatcaacctccatgcaggtaaattgataaaatgagtatggtgactttttttctataaagttaaattaatttttcaggattctgttttttgggaaacagcggagacagtagattttaggtattttcagtgtctgagtgaaatggtggcagtctcgtattggttgcctttcaacccccctcccttcttcacacacttaattttaggtatgtcttgaacaaaaataaataatttagaaactgtttctttatacttaattatctgaaaaagtaggatgtcagaagtaagtgagggaaaatacttctggaaatgccagaaaccgtcatgaaagttcaacgccagaactgagcttttattttgcaaaagaagcccttagaggtttacttggctctttgaatatctgagtcttgtttaacagagaaccaaaggaggagtatgtgtgtattgaggaacagttactaaaaagggagagcagttagccagactgggtgaatgaaatagtaaagcttaactgtactgactagttaagtcagtagtagctcactgctgcagtccatcctacccatctggtttattcctttcctgacagactcattcatatgttaagtgctggctgtgtatcaggcagtgctagtgctggggcatggggccccagcagtgaatgaaattggtatggtctctgcctagtgactgagtcctttaagaaccttgattaggctcagagagctttttgagttggcaatctccccaccctcagatttagctgaaattagggtggccacgcatttcgagtccacatttgtgaagaggccttaacttgcctccctacaccaatttgccactcagcaatagctaagtgtgaggctgctttaagcttgaaatccaggcccaatagtcctgctgaaccccttgcctctgagaatttagagtcttaattcactgaacatcttcctagttgttgaacattctgtgttctttctcagctccattcctttgtatgggtcggttcctatgcgtcagttgccctttcctctcttttcttttggaatcatttcaagtggtgtttctcttgggaatattcccgtactccccagccagataatctttttattatataaatcataatataaagcatgccctgccttcagagaatttataagctaattggaaaagatgtaaggtaatagaaattataattcatggtctggtgcagaactgtaataaatttacatctataatctacctatatgctatcatataagtggcataacttgttgctttatataattattacaacgaacttataaaatacatatgcattttcagataagggaggtgagcctttaagagacgtattagtgcagaataccgggaatctggtctcaaatccatatttgttactctattttatatgttgtttccttagacatacatgagaaaagacgttgtgaaagatttaaatagtagtttattacagcagtaagagagatcacaggaatgattaattgccaagtaaactacacaggggtgggaggaggtcctttaggctgaggtaggaatgatatctaaatgtattgtgagcatttggcgtgttaataaaaatattataacatcatttaaaaatggtcccatcatatttcattttatgagcataccatagagctggaagttactaccagtttcttcttctagacaacactgcagtgaacctctcggtacataccacaagcttttctggctgctctcaaaagaatttcctgaaagtagaatttgaaaggattttgaacacttttaaaggttttaatatcacaataatttcctctggaaagattgtacaaatgtatataggtcatattagtgcttaccttactgtattctttctagcttccagtgttactaaaaactgtttgctaatttcctaggccagagagagccatcttgttttaatttgggtggcgggacagttttcatgtttcattgctatataaatttgttttgtgaattgtcttttcattttgtttgctcattttcttgttggtattttgcagcttttcttcatgagccttttctaaatttaggacagttatcctcagtttaacttttaatatggcttaggtaaattttttgtacatatatagaagacttaagcattcttatagttaaatctttccctttaagttttctttcatttctttaatgctagaaaccccaacacatgaaattaagggaaataatttcagattcattttctaggaaaataattgatgcagggcaggcaagcccaaaagtgaggtttagcccatgagggttcttggctttgcccaggaaagaattcaggggcacactagaggtagaagaaaacagctttattgaagaggcaacgttacatctctagtggtgttaagctccgtggctgctgctgcagggcagggctgccccgtaggccaagagtagcagctcagggcagttctgcagtcatatttatacctgttttcaattacatgtaaattaaggggcagtttatgcagaaatttctagggaaggggtagtaactgctgggtcattgccgtggaaaggggcagtaactcctgggtgttgtcatgtcagtggtaaactgattggcacactggtgggcgtgtcttatggaaagcagattctgccccatcactgttttagctagtcctcagtttggtctggtgtctgaaccctgcctctggagtccagtcccgccttcattgtaaactctaaaagagcttataatgtaggttttatgtattttgtatatcacatagtaggcactgaataattgactggtggtggaatgaattgtcattaacatgacttttgtaataaccttgctggttcttggcacctcttcctttatgcaaaatgctctcattttttgagaattaatgaactaataaaagacaaaggagcgccctttccttttaggcttcttatgcaagatttctaccccttttgtaccactgggtattatatcttatgtacctggttaaactttcttcctgggaatggtatttgaatgagagttaatgtagaacctgtcataaaatccttatttccccttgttttaatgtaagtaggtttgctttcctttcaaatcctgctagtttgttagtgctttttcaaattaatttttcagaatttgagaaataggtgattattaaaatgagttaatttggtcatgcagagagctgttccatatagtttccaaatttagtgctagtcacaatttcctctagaaataacaagtgagatagtccctttttttatatgaggatgctgaaatcctgtactaaccttaaagcacatatatttgaattctggactaccaaaaaacattgtgtctctaggatatcagaaagtgttctcattggaattggaattcacatggagaggaagagaactataacagtagggctcttgcctttacttatattttagatagctttgttgagatacaattcatatgtcatccacccatttaaagtgtccaaatcaatggttttagtatattcacagatatatgcaaccattaccacagtcaattttcaaacattttaatcaccttgaaaagaaaccctgcaccatgtagccattaccaaccccctgcccggtccccaaccctcccactgctgagtaactgctaatttactttctgtctctgtatattttcctattctgaacattttatataaattggatcatataatatgtgggtttttttgtgactggcttctttcacttagcgtaagattttcaagttttgtcatagtataaattatagtgcattcatttatatggtgtcaacagtattctctttaatgtgtatctttgtccatttgtattgctgtaaacttttgccagggacatggatggagctggaggccattatcctcagcaaactaacacaggaacggaaaaccaaacaccacattttcaatgagagctgaacaatgagaacacatggacacatgggggggaaacagcacacactggggcctgttgatggtggggggagggagagcatcagaaagaacagctcattgatgctggacttactacctaggtgatgggtcgatctgtgcagcaaaccaccatggcacacgtttacctatgtaataaacctgcacatcctgcacacgtatcctggaacttaaaatgaaagttgaagtggccaccatcaccaccaccaccaacagaagaatactcgaggctgggtaatttataaagaaaagaggtttacttagatcacggttcgtcaggctgtacaagaagcatggtgtcaacatctgcttccggtgagggcctcaggaagcttccactcaaggtagaaggagaaggggagccagcgtgtgcagatcatgtggcacggaggaagcaagaggtggtgcggggcggggggaaggtgccaggctcgttttaacaaccagctcctagggtagcgcttgctagcactcatagagagaattcactcattactatgaggctggcaccaagtcattcatcaggggtctgcctccatgacaccagactcctcccattagtacccacctccaacattggggataaaatttcatcatgaggtttgggcgccagatacccaaactatagcagtgggagtactacattttgtttttccactccagcagttgatggacactggattgttttcaccttttggttattataaataatactgctatataaattcatgtataatgatttctccatatctttgtcaacgcgttgtctgacgttttaattataaccatcctagtggatataaagtgctgtctgattatagttttgatttgcatttttccagtggtggtgattatcttttcaggtgctcattgaccatttgtatatcttttttggaagattgtttcactatttttttgtctttttaaaattgaattttaagagttctttgtatattctttatataagtctcttattagatacatgatttgcaaatattttctcccatttttgtgggctgtcttttttactttcttgattgtgtcttttgcataaaagtttctaattttgatgcagttggtttatctgttttgtcttttgttgttcgtgcttttgtatcatatctaagacctcattgacaaatatgagatcctatagctttaccccagttttctcttacacattctggttgttgttacattttgatcttctattcattttgaattaattttcacatatggtgtgaattaagggtccaacttcattccttttcttatagctggttgtcctagcaccgtttgttaaaaagactgtccttttcccattgaatatttttggcaccccagttgaaaatccattgaccctagacatacgagtttatagctggactctctcagttctgttccactgatcccgtgtgtctgtccttatgccattatcacactcttaattacctttgcttagttttgaaattgggaaggtgagtcctccagcattactcttttccaggattgttttggttgcctttatctttaaacgccttgtattcttgcacttggaatagtgcttagcacataatagctttttgtaaatatttattgcatggatggtttaaagtactcaatgcatgcagtttgaatggtgaattaatgtctttaaatagaatttcctagctgtgtctgtttttcagcattttgtaacatatcccagtcccttgttatttctatgttaataaaagttactagtaatgatatatatctcgggagtataatgctttactaaaggtcttgtgtgcactgaaaaaagaattttagaagcgaaaaaagaacaacaaaggccttagtttaaccaacattatattaaattataaggaaatgtttaggttctatacagttaaaattattcttggtagaggagggatacatttgtataattaaatgtaggttttcggaaattgagtgtttcctgtcttaattagtatattagaatttttatttcgatgatcctagctaagtcaaaacaatttggtggcatacttgtttctgttaatgatatttccccctcagtaatagggatgagggtgatagaactactaactgtttttctgacaagcacgtaaggaactgccaagagtgttatttatttggtcttctggtaccatctgtagttgagaagtatgtcactttctatttatttggatattttaaatagtattaggtttgtaaaagcctaagttttagagtttttatatgcctaaaaattaggtccacaaaaaatctttgtgatcttttgtaagttatagaaacaggcccaaagaggttaaattttcacaaaataaatgggttgaatttgactatctgtaagtgttttagcctccaaaatgaggtgatttttgcctttttatgtaaagtaaacataaacatatacatatttttgaacaaaatttcctttctcctttgcttcctaaagacactgctgtgtgatcctattatataatacttagctacatcatgtaatcagtcactttgaaggttgaaggtcaagtactggttttcccaaatgtgtgatgaagctgattgtgcgttatgttattataaccctaaaaatacacagaacagtttttttagattaaaaaatataaatatgctgggttttagtgattacaataaactcttcttacgctatttggaatagacttgagtatagagtgactgtttcagatattagacagcaggctgtacatgatagtaatccctgaggcaagggaaacaaataaggccaggcttttgattaccctggcttttgcctggaaacctattccagactgtgttgcggggaagaataccaggcaaagcagagtgaacttgctgagtggaggaagcagattggagtttgaggaggctgaggcagttggaagttgaggttggagttctggagaggaaggagtgatctagaaaaagagctccagaaaatttatataaggccttcttgagtcgttgatgagtagattgtgtggaatagaaactctgcaaataaggcaaagagctgttgaggagctgtgagctgtgaaaagtttgcagagcccacacagggctgggaggcacttgagtaccagttggttgaagtggaaagtctttgttgcgttggacatttgggacattcagtaaagacttggaaggatcacagcttagtagtgaggttaggctgtttctagaggaaaagcttctatggaattgactttaaccaagcttgaaaacaaatcttaaaaggataaaaaggaatttgagataatttaatagcctacaaaaaaaccctcaaagtttaatcctctttaaaggaagacagtaaaatccaggtaacaacaacagaaaatgtataatatccaacatctaatcaaaatatgtcaataagcaagaaaatatgacctataaccaggagaaaaattagtcaatagtaacaatcctagaagtgtaacagatgatggaagtaccaggagttgctaaaatagtatgattataattaggctcaagtatttaaatgaaaacatgaatattagagaaaaaagatgtaaaaaagatccaaatggaacttctgaaaatgaaaaatacgttacgtgaaatgatagatatgctgggtgggatatcaacagattagacactgcagaaaaacatcagtgaatttagggatatagcagtagaaactatgcaaaatgcaatgcagagagaacaaagactggaaaagtgtaccagaataccagtgacatgtggaatagtgtcaggcggttagcgtgtgtattgagttttaggagaaaagaaagaggagaaccgaaaaaatttttttaagaagtagtggttgtaaatgtttcaaatttgataaatgctgtcaaccatagattcaaaaagttcagtgagtttaaagtagggtcaacacagaagaaaccctgtcactggaagatcactgcttaaatctcttgttcctctatagtttttacctttgttgcctgtcttaaaaatagttttgttcttgtagtggtttttttccttctacttttacatctctggtgttacattttggaaacattcttcctttctctcatttaccacagtttcttccatgtttgcttaacatctctttctttctatttttgagacggagtctctctcgcccaggctggagtgcagtggcgcgagctcagctcactgcaacctccgcctcccagttcaagcaattctcctgcgtcagtctcccgagtagctggaattacaggcgtgtgctaccacacccagctaatttttgtatttttctagtagagacagggtttcaccatgttggcttggccggtcttgaactcctgacctcaagtgatccacccgcattggccttccttagtgttgggattacaggcgtgagctgtggaccacgcccagcctttctttcagaaggcttttttattgtgtttagtcgtaaccttgattatgaaccatttaaggagttttctaattattcttattaactgttactagataaaatgttaatttatgttaaccatttaaaaaaaatttttttaaactcaaatttgtccgaataattaaccatttttgtagggtatatggaggccagtatcactccaaacatgaaacagcagtgtgtcataaaaggtggaaaattattttattcactgcatcttttgacacttatatgattttgtaaaaaagtcagttttgaataaatcctatgtatgtgggtgggtagaggtgtctctgtccctggctagtacaacaggaactttgtagtttgagcattggctttgaattagttatgcatctgacacttatatcctttaggtgttgaatacatgtcactgtgagatatttctaaaagagaaacttgctaaatgtgtgataaatactaggtcaatgcttcttacccttttttgtgtcataaactgcatttgagaacctaatgaaaactatggacttttctttgtttgtttgtttgtttgtttgtttgtttgagacagagtctcgctctgtcacccaggctggactgcagtgtctccctgcccacatgtgtgcacttttctaagtaaagagtcctgggccgggcacagtggctcacgcctgtaatcccagcactttgggaggccgaggtgggcagatcacaaggttaggagattgagaccatcctggccaacatggtgaaactccgtttctactaaaaatacaaatattagctgggcgtggtagtgcgcgcctgtagtcccagcaactcgggaggctgaggcaggagaattacttgaacccggggagtggaggctgtggtgagccgagatcgcaccactgcactccagcctgggtgacagagtgagactctgtctaaaaaaaaaaaaaaaaaacaagaaagagaaaaatgcatgcatgcacataatgaaaatttacattcaagttcagggaattcttagttttcatggttgaaatataaagtaataatggctttgatgccacagctatttttaaaatattccctatgttttgtacatgttgtatttaatgatacactgttagacatttcttttctaaaactatatgtggtatttatattgggaatacacagggcctttaagccccacatttccagtaaattccacattgaccttatgtgttcaaccacaattaccaattacgttctccttagtgaggaaagctttaaagttaaaaataggaggttttattttttcttctaaaattttttagactcatttaaatttttctcagtttacatagcttttaattaagaaagttatagttttcatgagacaaacctgtgtgtatctttgattacatctttgatgttgggtcatgttttattacctcttagatagcaacttgccatttgtaaggtttttataattccaaaaggcattgttcctctcaagtgaacaattcttttccctctgttagctaccaacaggtcacttggtcttgattgctggagtgtagacagaagctgttggggataagacataacgtagtctgttcctgctcctgcctgctgcttctgggactcggattcactccgcctgccccaccctgggttgtcatgggctcctttcactctcagatgagccctgctctctcctgtctcagatcctctgcacatgctgtaccttctgtcttagcagccccccactttctgcctcctttttctgtgcaatttcttcggaacttttatgtgtcagttgaaatgctccttcttcagagaagccttctttgttaccatcttcctagttctccaggttaggtcctatctgctggtgggctttgtcccagcactttgttccctgtaatcttcctccatagcataattcataagtatacttgaaatacacttgtgtatgtaattctgtgctaactctccagttctctgtagattgaaagctccatgagggcaggaacagtaatgtgttttttcctctactcctagcacacctcttgtctggtggggtcattgttgaatgaaataaagacatgactgtgatttcccttgaggtgctaatagtgtaatttgacacacaatgtggtatgaaacagataatgtgtattttcacctgtaagtaaatcaatcaaattattagaataaagacccaagaaaacaaaaaaaaacaaaagtgaataaaagaaaatggtgtacatttaacacatttatatcttctttgtctcatcccttatagaatcctgttttcaatgaaaaagaaaaaagaagagttgttgttaattcaaaattaccgttccctagtttgaaaggctgttttctatttcaacacacgcacaccggcacacacccaggctcatgtgaaaggaacggagactcaagcctgatctgatgaggctgtgttagaagtgctgcacattgaccttcctggaacgcagagtgtaatccctgcatttggtacggaagataaatagctatctgaaggagacgatttcagttagaccttttatttgacatatacagataaataaaccaggcagaatccccactttttctctcatttaacttgtagccaagctaggtctccctggagctgaatttagatgcagtatcttatccagagtaatacctttatttatagctgaggaaatttaggatggttaaaaagcttcaccaaagatgtgagtcctagagcggaccagagaactggctctctgaactgccagtccatactttctcctggtctctctctcatgctatgctctctctccacctggagggactttgtcccacaggagaagtgatccttatcagtgtgagctacaagtgaatggtctgctgaagatgggagggccttgggccttagagttagatcaggactccagttatggcccagacacttgcaagatgagccatccttttccctactctggggcccaggaattatgctagtacctgtaggaatccttgggtacctcgcatgtaacagagcacctcccatcatcaataagaattgacctcctgtgcaaaggatccttccctaaaatggttctataaggttctggtaaagatgaaatgagactgtatgatatcgagcatagtacttaccaagcatggtaagtactccgtgcctaacggtagcaattatactgttacagtgaaaattcttcataacttaatgggtaacaaattacagagctgattgaaaacataaacaagtataaatgttttattcccatttaacataattttattgttttttgaccattgtcttaattttgagtcttcgttcatctgtctttttccagctttatatgaaaaggtagcactggagtttaactagtacagagtttttcaatcttccaccatctgtgtaacaccttataatttttgctgtatccttgtaccacctatcctattattttcctttttttaaaatttattctctttttaggcagtctattttagaaggaaactttatcatgatagtaaacatggaaaacctaaataattttgccataaatagaaaataattgtaacaataaatgactgtaagcacattatacatgtgcctccagaagtcttttaaataccacattatgaaaaacattgcatgtggtcttccatcatgctaacctaaagccgttaatcagtatgtttaggttatgcttcttcactcagcctcctggaggaggaatgctaacttctccatgaggatggaagagcagaatttgccgttaaaataggaagaaaagacatgatttatggcagttgatcagactctgtttatggcactggtgcatggatcagatgctgctatgatgattgttacaataaatatttccaagccctgtttcagactctctggtcagaatttcttgtggaagatactgaaatctgtatttttaacaggaaggtcaaaaattctgatgcacataccagttttggcagtcactgttttaaatggcattttttcagcctatcattttgaagttgtttacaaccacaattaccagtgtatctgtaaagaattgcttaattttataattttacatttttaagtttagttttggctcttagtcttttatacctgtacagtaacatcacaattattaagcagtcatgaaactattcaatgtaatataattaagtcttaaataaacttttaattttggaatagcttaatttaaattttctctcttttatttttttaagagacagagtctcactcagttgcccagactggagtacagtggtatgatcatggctcactgcagcctcgaaattttgggttcaagcgattctcttgcttcaccctcctgagtagccgggactacaggtgtgcagcaccaaacctggctaattcttttgtttttttgcagagatttgtgtctcacgatattgcccgggctggtgtcaaactgctggcttccagtgatcctcccgcctctgcctcctagagtgttgggattatagatgcgagccgccacacccagcccctagagtagttttagatttagagacagttgcaaagatagtacatagaattcccctataccctatgctcagtttccccttttattaaattttatataacttcatatatttgtcacgactaatgaaccaatattgacactttgttgttaactaaactcagaactttattcagatttcatttgttttccccacatgttctttttctgttcccagatcccatccagggaccacattagttgtgtctccttagcctcgttggctgttaacagtttctcacactttgtttttgatgactttgacagttttgagaagtaatgattaggtattctgtagaaagtcccgcaacttgggtttgtcaggtgtttttgtcttagtttgaggttacgggtttttaggaggaataccacagagattaagtgaccttgtcatcatatcatatcaggggcacgtgctgtcaacatggcttaccactgatatgttaagcttgatcgcctgtttgttgtcaggttaccccattgcaatgttacttttttttccacctttctgtcaccaaagtgtagcccacgcttaaggggtggagagttcaactccacctccttgagaggaaagtatgtaaattatttggatttttattttctgtacaggagatacgtatgtatgtatgtatgtacctgcctgtctgtcagactgtctgcctatctgtccatccatccatccacccacccacccagccatccatccatccatccacccatccatccatccacccacccacccagtagttatcaatatgggctcatggttgtaatccagtgttacctcatttgttttgttgctcagagtgtcccaccttcggccaaatgggagttctttgagttggctcctgtgtctctgtaacatacctggcagttctgtttttgaatattcctcacttgctggtgatgcaggatgctcagctcaggcttatactgcaacttccttgccctagtcccacaatcagccatttctccaaaattctcttattggagagtggtattgggaaccaagatctagtccctggatgaacgagctctttctgtgccgtcaaagcaaaggtgagagatttttgtgcccaggttgtcctgatttgccttccctactctagtgtccgttttccgtcaccaaatactttgggagaatatgtcatatgctcatatttccttgttttatcctcccagcagttggaactaatgttttgaatgtgtgatgtgtgtcataggccatatttacagttaactaattttgtaatccaaattttaagaaaaagtaacttcagctaaggagatccaggcagctcatctgtcccctacagagatggttcttcagttgcttgatttctaagaatgccaatgatatagaatgttttttccacaagtaaatttaatttagaataaggagattttaaaaaatgttcttatttgcgagaagagtgggtagaagatcgtaattcattcttgagtgaattaacctttaattaaagttttaaacgtttttcttgtttctctgtaaactcttttatgttttgtctttggcataagcccctttgtttgtttttcctcccagctttgacagttttttatcttccaaattttcctgtcttagacctatggttctctttagttaagcctaaaacaactgtttgaatgaatcatgatgtttattttttgttgctttcccttgaatagtttttggttggcatttcatggtagaatgtacccacagtgacactgacatgtaataatttttttcttgtgtttcagggacatgctcccacctgtgctccctgctgcactgctgtgtggtcaggcccaatctaagaaggaaggctttgcttttttttttgagatggagtcttgctctgtggcccaggctggagtgcagtggcgcgatctcggctcactgcaagctctgcctcctgggttcatgccattctcctgcctcagcctcccgagtagctgggactacaggtgcccgccaccacgcgcagctaatttttttttttgtatgtttagtaaagacggggtttcaccatgttagccaggatggtcttgatctcctgacctcgtgatctgccctccttggcctcccaaagtgctgggattacaggcatgagccaccgtgcccggtcagaaggaaggcttttcttacagttttgattttcttctcactatcctatacacatatgatctggtatttatcctcaagactttggatgaagatatatatagacacactcacacaattgttggaggtagtagatttggtaaaaaataaagcacccctgcaatatgtcttattctttgtcttctgtttttaagtactcaagtatttgcaacaaaattgcaaaaataacagaaataattatgtttgtctttttatgtgtaatgggactcatttatattggaatgcccaaagggttctctctccttttttttttttttttttttttttgtagttctcattggaaagtctggttaaccagaattgaattaattagtatgaagtctttaaagtgttttgttgtgttgtatttatatagttttatgagagtttattttctgaaagccttcatctgaattataaacagcttataattatttttatttctaatgatgagtaaaagtttatccatgtgggctaattcgtctctttatatatatttgttttctatctttatgcattcttttttgttttatttagttcaggaccgataaaatatgctatataaatctatgagtgaaacagaagactttataccagaagacataaatcaggcaggcctcatccacttacctacttttccaagacctggtcctattcatttcttatataaaacttaccaactgatgttcacagcatcatgaatgcggatagctaatagtctactctagaatacagaatgtgatacaggcagtgatttttctgtccccaccaattgaactatatacttaacaagagtttctggtttgttcctaaatctatttagatctttactttttaattgtgattgtgtaactcagtagactattatacaaatctatgaaatgtgagtgtgaaagagaattgtagcttctacataaattaacttggaatgctttgcaaagtgtcagtataggtgagtaacattaaaaaaaaattgccttcaaattaggtgtaagagagaactgtgaaagcttaggaagaaaaatcatgaacatccagaaaaatcgctctacaaaagtctttaaattcttgttctattttagagaaatagagtggagattgtagatgatgcattgtgcaacatctgataagccagagagttgactcggaacttccatcagtggacccgcactaaaagacaaggctgtagccctcattaaagtagtggttgattaaaacccactcatgggtttaaagcaaaaataaaatgtaaggtttgtatgtgtggcagttacatattacagtttaacaaaccataccaatgtttaacagcttaaaataaaaaccatttattagctgtcatggtattgagtggtttttctgctacttacggtgttggctgcagagcagggacaaatggagatccaaaatagcctcactcatagggttagcaagttaagttggtgctggctgtcagctgggagctccccaagtttgggctagctagcttctccttcatgcacttctccacctaagttgggctccttacctggtggctagctttcccagcagtacacaggtggccttcttaaggtttaggcccgggactggtccagtgtcatttttgctacattgcttgggttaaagcagtcacaaagtcattccacattcaagcgtagatatgcaggtttgtgaccatgaggaggccggtttcatcagggacccccaaagtaacagctgccacagtatattttttttgtctgcatgtttcattgttaatgtttttgtatgtatgtttaattaactgtccaagcacaagttccagtggcattggataagacttctaaattaaagtgtttacaagaaaacaataatttgattaaaacttgtattcttactagtaagtgtgggggcgtagggatttcattattggcaaaaatcaacaatccttcattcttgtagcctttaaaaaatatattttaaaaatagtgaaatgttattgtattttaaaaggatttggataatgattaaatccaaagtatagaagataaacttacttgatttgtttattcaatcagcaagtagttttgaacacataatctgcaccagccactgttctagacaccggagaagcagtggtaaggatgacaggctcctgctcttcagtaattgttggggagatagcttcttattcatttccataggaaatctttttttttttaaatctacatttgttttaaaaagatgaattttcattaaaaaacaagtctaaatgtctatcttgaaaaataagcaagattagttaggtttgtaaagaccctatgctctgaaacagtgcaaaagttagatagtacatgttggataagctcgaggtttgaccgttcacctggaggtgagctgataaatgttcagctgtagattgatgataaagataactaacattgataaattgactcgtgtaatatggataacttattaataaattggctcttgtagtatgaaccaaacatacaacctcaaactgagcttagctccctttgattaatacttcaggccaagcaagctatacacattgtttaaagaaaaaggaaacctagaaaatctatcccttctgcctatgtccctcctctctttcccccaatagcagaaatctccctaatacttattacctaatagagaataggtggaggtggatgagagaacttcatacagatgaatattatacttcacaagtggttaaaatatccatttatttcgaaggatgtcgctaaatgaagtgttttgggtttttttggcgggggtggtgttggggggcaggggtggcttttgcagaaccacagatgttttcagactcatctaatccgacttcatcattttacagatagctatttcaggcaccattgtggtttacctaatatgtcagagcagaactatttaaccctaagtaacttgaatttttgttttgttttcttttcacacatttttcctctaaaacctacaccaaactcccttgggttgagttcaagacatactttgcctagaccagactgtagtgtaataatagtactttagcagggttttatggtaaaagagtgaaatgttttacgtgactgtcagaagtttagtaccagaaagacatttcacatttgcatgttattaaacacaagtaagacaaatgtttcagggcagctgatgtagaccttgtactactttgctcatcccaaatcattggtatacatgtaaacattctgaactggtcggctgaccacattagctcatctcacatgaacgattacaaaatgaggttttggatgcttacggttagttaattgaaatgatgcaagttcttttgaacttaccactagtatttttctggattttgtgtataagtgttttgtttgtttgtttgtttgttttaaagaaaaaagaataaaactttgcttgatttctttccctcctattaatatgttacttctaagctaaggccctcaaactaagttttctctggctgcttttaatattcttctcttcgtcattggttttcagcaatttggttatgatgtacataacaacagactgggagttttctttatagttctttagctcagagtttgttggatctgcgagcttatggttttctccagatttgaaaaattttcagcccttcttcagagatttgtttctgtgcctcccttctctagttttggactccagtaacacatggttaaactgcttgatactgtcacacagggcactggtaccctgtttttttatttctcccaatctttttctctctgattcattttcaatagtttctgttgctgtgtcttcaagttcactgatgtttttctgctgtgtctggtctgctgttaaacccatatttcagatatattttttatcattataatgtctacttgagtcatttctggtctgtttctttgggtttttctcctggtttggatcatatatttttttctttggtatttttgtttgtttgtttgtttgtttgattgagacagggtcttgctttgtcacccaggctggagtgcagtggtgccagctcaagtgatcctctcgcctccgtctccttgagtagctgggaccacaggtgcatgccaccacacctggttaattttttgtattttttgtagagatggggttttgccatgttgtccaggctggtctcaaactcctgagcacaagcaatttgcccacctcagcctccccaggtgctgggattacagacatgagccattgcacttggctggtaattttttgataggatggaaaacgttgtgaatgttatttattaggtgctagactctttttaaaagaaagtttctttaaatactgttggattttgttctgacatgtaggtgttactaagttgcttggatggaatgtaaaccagtatcttttccaacaagtgagaataccatgttgactgcattaagtaaatcctaagaaaatattaaattcattttaattacgaattataagtatagtggctggtagtaccatatgacattttcctaactcgttttctgtgatgcttaatgggtaaggaaggataaaatatactgtgttttgtcttattttaatattttgtttatgacagtattcatcttcgtttcagtgtgatttttaaatgtttactgctagaataattagataatttagaaatactttgaagtcagtagttgttcattgtgtctatgtgaatgtataaggataagacagatgacttttggttttgtaataaatgcagatcggaaaacaagggactgttagcttctatagaattattacaaggatttattcttgtacttttatttgacagtacagccacattaatttttccatgtgtagagaaataatttgtctacagttggaggttagcacaacacaaatattcttctgggtccccaatgtaaagtcttcataaaagttagcctttttattatatgtactttcttagaccctctttatctgctaaagcacaggactcaattcccatggcatgtagatcccacaaaggtacttctttatttatttttaaaaaatcagctgtgcttgtctttttagatcgtgacgctcctcaggtcggggggcttgatatttggatcactgaggtttgatattatcagtccctcctcacaacaattctcctccactttcactctgcattgcattaattcatcatccacacagtactgctagatactagcaaaacagaccattttatatttttcgtagccctttatttccattactttaattttaaaaacacctttacaactgaatttcctgaaatggttagaatgtagacctttaaaattccagattattagtcttaatagtcttagaaagattcaataatggatgcttcacccaccaggacggctgagacatggccttagcttctgagttcacattcctcctcaccacaaaggatgtgttttgaaagagattttgtttgctatttcgtatctgacttcatttttctaattatcctgttattcactgctgtctggctttgatgtatttaactgactaaacatttatgctatagtttcctggcagttaccattcttatgtgttaagtgcattattatgaaaagcactgaatgagagccctatgctggacagtcctggagattcaaaagtaataaaatatagtcttttcttagtgtttcctttaagtatattaagtgtggaaattaaatgaaaacagaaaccttataatattgagttcgaaagaattcagcagatgtttcagatgttaaaagtgcttccaggcctacaccatgctcaactcctaggtgagcttctctcttaaggtgaagcagatagatgagcaagaactcaggttccctcactgagcacagtgacctcccaaggcctgtgatatgagtggtatcaagcatttagtgaacacttactatattctgactcttttgttaagtgtacattattgggtttaatcctcataggaataagtatttataagtctaagtatttattatccttattttgtaaatgtacacagagagaaaatttgtccaaggtccacccagctaataggcagtacagctaggatttaaacgtgggtctactacaccaccaagcctatgctgcttttcattccaaacagtgttattaaccactgcaacacatggaaaataaataaatgattttggtgcttatagccatgttctttaatcagtcaaatcaactattacacagtgagtatagaagaagtgggtgtaagaaatttcaagttaatctgtaagattacactttattgtgtgatgttatgagacttaaataatgtagtttaaggaaataggtgcatttaaaacgtatttctaaatttgcacatggtttgaagttagctttcagggcatttaactcgcatgtcttgtgtgtacacatatgtttaggagcacatgtgtactctcataaagtatttagagtggtctttaaaatgcagttattaaaaaatcagtttttgacctattagggatcttttgtagatttcagtactgtaaatttttataattctgcaatatttttatttttcaaaaggtaatttattttctgcagttttgtcaatctaattcaataataatgggatcatacattgtagagtagcttttctgtttcccttatgactttgaaatagctttgattttatatcaagatatgaattgccaggaagaaatggattatatactggatataatttggagttatgtttataaaatataaagcatatttatataaatataaagcatattttataaatgttcagaaagaggtagactgtgatggtacatatttggaaagaatttcatgattgattccttctgtttcactttttaagaattgtatttgctctcaatttgtatcattaaattttattttgttagctttgagaaattgaactttgtcaaaatagtgatattatttgagaagttggccagggatagagaattggcaggcagtgtttttagagaacaaattaatgagaaattgcattttgaaggtgaaaagaaacaattttgtttttcctcttttacatcatccttctcccctgcaccttgcttgagttctgcactgtggtttttttcttcccaattttttattgtgttaaaatacacataagataaaatttaatgttttaatcattttcaagtggttcagtggtattaaatacatacataatgtctgcactgtaatttttatcagacaacttaggaaatggacctgccatactttcttggtacttcgtgctttgctgtgtggatcatagcaaagtgctcctatacattctgttttctgtgtgtttcaaagacagaaagaggcgaggcactgaagttcagagcaggactgaacttgcccactcatcaattaagctgtcagcagctagcacataagtacatttttagttctgtctgatttgtatcttctagtccttcgctggtttttccttaaggcgtaagtttttagttctatatttcatttgtgttagaaagagctctataaacaagagaaacagaaagcataacagctctacccatgtggtactccttgttcatggtaggagaagcggcagtcacaattattactctcttcaagcaaaagaaaagttctccttttgagttttcacaggtaaaaatgaggaggagcacagtgctgaagagatttttctgtacaaaagttttacaaagaattatttaaaaaattataagtaaatttgaattcacttaactgtgttgctgaatattttccctgcacactgtctttcataggcaagagggcacattgggagattcagcttgcaagagtcctgaatctgatctagaagacttctccgatgaaacaaatacagagaatctttatggtacctctccccccagcacacctcgacagatgaaacgcatgtcaaccaaacatcagaggaataatgtggggaggccagccagtcggtctaatttgaaaggtgagtcttgtacttgaaaagaggtgtacatgagagggtatggcacttgattgattctttcaacaataaagttagcaatttcttttatttttaatttgattttaatgctcctgtaaagttcaattttttttttgaattattaccattagtattaataaaattgacacatagttttccagagatagaaacgtttgtcctgagtaatggttaaagccagcaatgcacgggcatttgaagaagtgaaagagggcaaatgtttcccagtgtactaatacaagatggcaactggttacatgggatagatggccttctattctttcagtctcttaggctgaagtttctagatttcctctgcccagaagtggtgtattggggatttgaggagagacagagccaggctgtcttcccctggattccctctgctctctgctggtgccccggggtgctatctttagtgtgtagggctctctttttcatactaagcacagtgaccccacacctaacaaccatgacagaacctgctttctacttttctctttatttaggatcgtaaagtccacatattgctctattagacacggagagtttcgtgctttttctttccccccaacctccttttagtgggacgtaactgttctttttttgtggtagatgaattgaacgatactgcgctgcagcctccttgtaccctacgtgatggcctggaatcttgtggttttagaatttacctgttaatctcagcaaaccacttgtcctaaaacaaatgccatatattcctggaatttattcagctattactgcatgagatgcggattttagtcttcatcttgtctgagaaatttcttcctgttgacctcacactcatttctacctctccctttctgtagtctgtgttcattcttcctctttgttctgcttcctctttctgtagatttcttccatatattgagctttgatggctgttagtggcatcttcactttgcattcccatcagagcccttcctcaagagagcaggagggcaagagaagtgggttttgttgtgttgatttgcttgagtgagatgctatacaagggaagttcccaagcaggaaagagtctttcccacaaatgatttttccacataagatacttcttataaaatttgatttgctgtaattttttaacctgtggcctgtacttaccccttcggaaatttcccactgcaatttgtcatcttgaaaatcatttattgtacattttctcaaagaaatttctcaaatgactatagaagtttcttatctatggtaggaatcagtgaagtagcatctactgaatcaacattagttaataaatatttgcttcgtgttagtaaagtaagaagatgccggtagtacacttgctttttcttgttgattcatactattttagaacatgagttgagaacacaatttccccattttatagattgagaaactgaggcccagggcttcagagcaaatctttttaagtccagaaggcttgagatagtgtcaggactatttgtaccactagttctcctggtactctatttggactttttcctagtacaagcaacagtgtttacgcttatccgaaggcaatatttgagttgactttatggtctttcactaatcagtgagacagccagtcactagatgtttgttgaggttctgttgtcctgctggtctgtgcgagagatagagggaaaggaaaggattggcccttttcttccacaatttttaaaattgtttattttatgaaattatagaattttagagccagaaggagcctcagagatcatttgctcaagttcttgccgtttttcagatgaagaagctaatgctcacagaccctttgatttatagctatctgatagcagacccaggacaccaaaatccttaataagttattatttttcttattgcaaaagattatgtgtttgttgcaggaaattcagaaaatacagacaaaagaataaaaatcacccattaaacctaatacacaaaagtagcttcttttaccatttgtaaaagcctgactacagactctctagctttttgctatatatgtttatgctgtactatctttactattttataatggcttcttaaatttaatgttttatgaactttttttgtcacagaatagcctgtacttttaatttaaatggctgctatatcatttgtagcagcatcttcacagttatcattagcaattactgggtgcttactatcggttaatcactgtgcttaacacctcaaaagaattatcttttgaataatgtaataacccagtgaggtgttggtcttatataatacaaattttgagtatccctaatctacatgctccagagtctgaggccttttgaatacagacatgatgctccaaggaaatgctaattggagcattttgaacctcagatttttggatttgtggtgcttactcagaaagtataatgcaaatattccaaaatccaaaacacttctggtcccaagcatttcagataaaggactttaaacctgtacttattttacagctgaggaaactggctcagagaagttttacggctttcaattttaaatgtctcagtcacatgtatattagaaagtggcttcacatgtatgccagctggtgaactatttcttgcggacattcttgtttatgaataccaagacaaggtggaaatgggacgccagtggtagacaagtgggccattttaatgtcttagtcttggttgtggtggttaatagtctttgagaatttatttgttctcagactattgcagcacagcatggtggacaaaagcagaatcttggttgcttgatcacccggactccagtcctggttccgctatcttctgcgtatgcagcctccatatctcgtttctctatctgtaaaatcatctgccttatagtgttgttaggattatgtattcagtattagttatcatcattattattgtaaactcaggatttcttttattttttctgagacggagtttcactcttgttgcccaggctggagtgcagtggcgcgatctcagctcactgcaacctccgcctcctgggttcaagcaattctcctgcctcaccctcccgagtagctaggactacaggcatgcgccaccatgcccgactaattttgtatttttggtagagacgatgtttcgctatgttggccaggctggtctcgaactgctgacctcaggtgatccacctgcctcagtctcccaaagtgctgggattataggcacgagcaaccatgaccggttgtaaagtcaggatttcttcccaacacttactactttttttcttgacttaaatcttaaagcaaaattaaataattacattgttgacatatccttattaaatggtgtgcccatttttaggaccctgagtcttagattaaatgattgtctcaagtcgtgtagctactgttcctgcttctgtcctgcctggactacacatttccttgtatgtcttcctagtccttcgctttatctcactacataatgctgctagtacattttttttgttactgttgctgttgcctgtctttccttccttccatccttcctttcatcctcttcctttcttttctttcttctgcctttctcacgctttctctcctcacttccttttttcctttcctccctctgttctttccttatttctcctccattctttccattgaatcagcatttgagtgactccataggcatgtgctcttttggaagatgaataagacctagttccaggtcaagtagggagtacacaaatgaccaacagtacaggctcatctggatgcacacaggaggcagtattgagaagacctgggcttgggaagacttctggaacaagtgacatttgtgctgtgacctcaaagctgagtcaggaagactagtatttcagactagcatgtgactcataataatatattggccccctcagtattttgaggagctttttagaattaattagattggtcagatttatttaaaaagctgtccaaggaaatgtgaactgttacattatttctttctcactgcaacagacaaaggatctctgagtcatactattaactttagaactgcggtcagagttggactcatcttttaaatagtcaccaataacatttgcatttttcagattatctattgttgtgtaacaaaccactgtgaaacttagtggcatgaaagagcaattattttattgctcatgattctgtggttcaggtgtgtaggcagggtacaggtcatccctgtcccaggatgtctggagccttggctggaatagctcagttggctggaaacatcctggcttggctggggccctaagtctgagccctcattttttttgtctgcatagtgtctgctggatgtcaaacatccacgatggctccctcactcacatatgtgtctgttcacttgggctgagagagcaggaacagctgagggctgctggcacagttttctttccatgtgatcttcctcatggctagcccagggtggtccttgggtaattggacttcttacacggcagctgtctttcctcagagccagtgttttgagagactgaggtggaaatcgcaggccttcttaggccttagcttccgcggttgtgcagtgtcacttctgttgtgttcttttagttccatgaggctggcccaaattcactgtgggaggcgactgctcaaggcagcggtaccaggtcgggtttgtaggttactttgggaagttaactgctacatgcattcattgtaaagctttggggaattagaatctggtcagtcatactgtctttgcttcccctagccccgaacccgcaaaaatgcaaaaaaaaaaaaaaaaaaaaaacatcaagtacatccctgaaggaatgtaaggactcagaaaggtaactgaggggactatttagaggaagagataagaaccagcaatactggctttttagctatggtagccatgctcatgaactgattatacaggtatgattcttgcaatgttattacctctgtaggctcagagtagctactattgtcatgtatttgttttttataattgtaaattcagatcttgagaaaattgatagccctaattgtggtgcatatgtgtgattagacaattgactcattgaaattatttgatggaattataatagtgctaatttcctgcaaatcattaccagtgacatgttagaatgggaagttatagacaggagaaattagagataaaacattggtactaagaagaatgcctgtaaataagctcttagttttgtaaagataagagagatgcacaccataaatacagcattatggaattttacaaagttagttgaattagaacatccaacatataactgctcttttccacttagtaataggtggaggccattgttctgtgtaaggacatttaaagtaaggtattgtttggatcattataaccatgttccctatagcgtgtttccatagtttcaaacaaaaaatactattgcggggagcatctctgttcatttatctttactcatatatggagtatttttgtagattagatacctagtggtggaattgctgtattgaatggtatgtgtgttttaatttggtagatattgtgcgtgtcattctgcaaaaggacagttcattttgatactcctaccaacaatgtatgaatacctcgtttctttgtattttctgtattagtaatataaaaatctgccagtttagctgtttaaatttgcctatttctcattttatatttatctttactaaggagaatatagttggggattgtggttgaatgcataaggccagtatgaaatttactggaaatatgaggctacatacaagtactatatatagacatttacatggtgtgtgtgcaacctacacacacacagatatatacagcttcagaaatgtctcacttgaatcacagtatttaattgaatgcaactatttagaaaacgtgaggaatcaaagaaagttatcaaagccctatttatattgcaatcacgaggattgtgggtccctggaaactgaatgcagattttattatgtgcatgtgtgcatttttgtaaggagtccatggttttcatcagattcgcaaatgtagtctgtgacccaaataaggttaagaagcattgacctagataacatttaccatgaatttaacaaaactgctcatcctgacatgagttgcactcaaaggataaagccatcagatgcatagcaaattcaaaattagtgcaaaggctacaaggtctcttccacactagccaagaacagagatagtcccccaactccacatttgctggttttacagaaaagactttttaaaaggtcataaatgtcaacaagtttgttcagtaagaggatattatctttgtgcaaatagggatagaagggaggcagtgactcctgtgaggtccacccactttctccccattgatcaaacactgttctgcatgctgctggccagtgggttctgcaggtgcagttaacctccctaacctgttgatgttgagttaatgaaagggagattgtcttccacgggctggcttaatcagaagcctgggagccacctggaggagaaggtgaagcagccatgtccagagtgtgagtaggagaaggctttgggtaggagaaggccaaggtggagcagagctagaactgctgccctggaaggagggcctggtggcttccagcccaaggaatagcaggaggaccagccctacctccagcacctgcccaaggaacatatagctctaggattcactttctcaggacccaacctgactacctatcggcaaatccatgaatgctgaccacgctgatgccttcccagcacctgtctgtgggtaactatctcttaacaggagcccctgggggctggagtgcaggctactggcatctctacgctgccagtcatccctggtccttcccctaaccctgccgaggcccaggaccctcagcccacaggcatctgtgagggagcaaggaagtgaacccctgagatacggccatttgcagggctgtcgcatggaggacttgcctctaggggctcagctggtatgggggcaagggtagggccaggagcctgttgtcggctaaggctccagagaggaccacggccattgcagcagcagctttagatctggtgactttcaggagcacaggaaatcatcttcctgatgcctcggacatggcccccaggtgcacttgggcctcaagtggggctgccctgtgcagccactcccactacagcttgtgcagggctttaagcccagtgccttgtcttggaccttttagaccagtgtggctgttacatagagagttgacgagcagaaactggtatctccacttcaggtgtgggctacttgtgataccagacggacagaaggtggacagactccaaccatggacaggcagatgctctcagggagggtaaaggccttgagttattgtttctttttttttttttcttttttttttttttagagatggggtctcgctatgttgcccagactggcccggaacctctggactcaagtgatcctcccgcctcagcttccagagtagctgaccctcctggtgcgtgtcaccaccacaagtttcaggccttcttttaaagggcttttatgtgattaagtcaggcccactcaagaaaatctcccttttgattaaacaaaaatgagctggctaaggacttgaattatatctacacagtcccttcttagcagcaggatgttagtgtatgtttgaacagtggagagaagaggctgtgtactacaaaatggctgctgcatctcatggcccagccttcaccaaaagctgaaaattcctgtcttattgggaaaactttcttaatttatatgatagtttaaaaaaaggcattttatctaaagactgtgtttgagtgttgggtaaggatgattagctctgcattacctgaaagtctgctatctgacgtcccagttgatgtaacctaccaggtaaactcgagtgaactcagtgaacaggcttgatttcatactgtggtgagtgttaagtttaacaccacaggagctagctgcggtgttatttgagattatgcttttggataatggtagtcattaccaatttatagcaattaagattttgatacgttttggacaatatttagtcaaatataactgtttgttcttaaggttggtttaagagacagtcaaaccatttttttccttaaatgtttgttttctttttaatatagcagaaggaagtacattcagtttatctcatagtttaagtaggtgaaataggaatttaaaagacacccaagccaaaaccctttccagggcattgctgggcgatcattgtcagcttcattttgcatttctattctagcactgccatagcgggatggtcatcagccatagctgggttacagaagtagagcaaatattttgcaatttatatgagaatttgcacacacacacacacacacacacacacacatccctgttaggaaatatctcaaggtgtgtgtgtgtgcatgcatgcgtgtgcctatatatatgtgtgtgtaaatgtgtgtatctgctaacagtagtgaaattagaatgtttgctttttaaagaatatcatactgatgtaaaatggagctggtaaaatggttacaaatcagattcaatctatatagctagtgaaatgtttgtgtcaaccagagtggatttaaatccatatttcagctctttagtctaaacttagcctgactttcagggtcctggtttgtgtttccaggcttccatatacaggctcagtgttcagccacactcttttctttgctgcccttgtgtctcttctttgctggcttcagatatgctcttgccttctttacttcccttatttaagcttccattcttcgaggccccaaatcaagtacttgcttttactttaagcctttacagactagttagcctgtgtaatcttttgtggtactcgctgtcttagcctttccttggtcagttggtactgccttgcaaacacctttgacaagtccaaggatggtgtggtggcaccaacttgggctaggacccctgttctgacattaaccatgtgtctaaccatctgtgttctgtgataatcttcatcatcatgttgttatgaaaattacgacaatgtctgtgaagcccttacctggaaaatggaagctggataaagcaatttctcaaaatgtggagccattgtagccatgtcagagatacgtgcactttagcaggaacgcagtgatttcgaacatacactgaaatttgagaagcttgagctagatgatctctaagtcccttcaggttgctgacttgtctggtattctagttcatcattactctgaagatcatctcatacttaaagattatccatctgtttacatctcatttgagagctcaaataaggctggtttctaaaatttggacaatatgtatatgggagaacataaaaattgcaagagtttgattaaaaatacaattaatacatattctaaagagccatttttagttgtagatggtgggaattcatttgtttgtcttatatccgtcagatgaaccatattgcttgtcattggttcctttcagtttcattataaagttttcttttaaaaaaatttttatgttcttctgattttaccagaattattggtgattggccaaaggaaaaagtgttccagaggtttgctttaattgtgctacaaaaatcacaccatttcatttatagtcacttgggagatcaggtgtcccattcatcaagttattaagaactatttttgtagtcctgtaattagaacttgccaaataaaacattctatatagctaactcctgtactttttattcattttccttttcagaattctgctctgtttccatttgacttttgttaattgcaaaggaatttagtattaataggaaaccaaaaaacaagcacacctgtccatcagtaataggcttttggttgttattaaaaagttccttagtcatgtcagagtgggtaaagacaaaatgtaaaaatgctcagggaaatgactaagtctatagactacccccgcacccaacaccctagtgttgttctcagatctcccttaagtcataagtcccttatgattttatagaggcctaactggtcatcagttgccagaaagcactcttggatttactctctgtgtcagtccattttgcgttggctataaaggaatacttgagactgggtaatgtgtaaagaaagaggtgtatttggctcatggttctgtatgctatacaagcgtggcaccaatatcaactcagcttctggtgaagcctcaagaagcttttactcatggtggaaggtgaagaggaagcaggcatgtcacatggagagagagggaacaagagagagctctcacatgaactaatagagcgaggactggctggttcccgtggggagggcactaagccatccatgaggaatctgcccccatgacccagacatctctcatcaggccccacttccaacactgggggtcacatttcagcatgagatttggagggggcaaatatacaaaccaaatcaccctctccttctgtcacaagtatattattctaaaaatgtagctactgctgaggtagagtaattggtatatcctttttgcacagtagctagacacgagtttgtctattttaagttcgaattgcgtcattatttaaactaagatgtatgaatttatattttgtgtatatttttccaaaaccaacttgggttttgttttggggtgggggggaacaaaaagcttctctgtcccatcttgctcctttcccaatttgcttttccttaaacctactatgtaggtccaaatattaaaccattgctttatctgaacacaaaatttcaaaaaattgtgtaatagactgttttgtatgctgtgagataaacttaacaagatttgtatttaacctataaaagttactttttcaggcttgctgaaatgagattatgtttatgtggaaaaatgggattgtggcattttttcttagattgctttcattgttggaataaaggtctagggtgagaagcttcatctgttattattttcatgttttgcccctggtaagtgtagcacagatttggaataatgcttgtagccagtcttctgggactattaaagtcatttaatccttagttttcacttaggacctttcaatcatagattagaagaacttgaataaattatataagaaaagtaatattttttcactctcaactattactttccaattataaattgtatgcagatagtctgtggccattatcaataatgcaccacattagttctataaagtattttaaaaagcccaacgcctgagccaacaagattgttttttatttcacaattttttgttttctttgactcaaaatcatttatttgggtgtacataatagttaatacacattctattctaggtcttcattgcctttcttctgcacacttttcttggatgttcttatctactatcacgatattaaataatatctgtacatactaataatttccaaatccatttctctggatttctctcctaagcccaacatgtgtgtttttttagttacctatagatatttccacgtgtatgtcccataggcacgtcaaattcagtgtattagaaactgaactcattttctttacctccagtcctacacagtgatacaatgtatatgtcattttgtgtttcccagtaataaagtataatatgaattatcttgaaaaatatagtggagttaaatgtggaagcactggtcatttttggtttcaaaataccatgggttaaccaaatagtatgtatgtgctctgttaataaaggtataaaaaacacagttaaacgcatcagagcaagagaattaaagttggtctaagcaatttttttatataaataagagttgataagcatttatagctagaaacaataaaactgtgaagaaattttcttaaatggactatatgaaaagtttaaagacatttagaagtagattagtactaaagataaaaattctatcttaaaaattttaaatttaaaaaataataattaatagtagtttgtatactaaaatacagcaaaaaatctctatggacagattggtttaaaaccttttttgatggatcataaagtaaatttaaggcaagtttaatataagaaaaaccaagctataagtgctctttgggaaatttgtttaaaaatccttattttaagactaatttgaatcggttaggaagtaaattggttttaagcaaattttcattggtgccttggtttgtggtatattggtttgtaacccatgtaaatataccctattccatcaaatctgaagatatactaatatgtctttagatattacattcacaactaatctcttatatattcccaactaatcacctaaaactaggtgatattatatactaagaaaattatataataatttcttagtataattattatattaatatatataataaaattcttagtatataagaaatatatactaagagattataatatattctaaggtaaaaacagcttataattgatggtgtgttcttataattggaatttttatttatttaaagagatcttttatactttctgatatgtagatatatatttcacttatgcatatatatatatatatatatatatatatgtttaaaaaaatgggccaggcatagtggctcatgcctgtaatctcagcactttgggagacagaggtgggaggattgtttgagcccaggaatttgggaccagcttaggaaacatagtgggatcctgtctctacccaaaaaaaaaaattagctgggtgtggtgatgcgtgcctgtggttctagctacttgggaggctgaggcgggaggatcactcgagcccaggaagttgaggctgcactccagcctgtctcagaaaaaaagaaaaatgtaaatgaaaaatattggcaaatatgtccctaaaacttacttatatcatcattgattatatataacgttctaatttcagagatgttaatgtatgaaaaaatgtgtgtcctagattcaatgaaataaactatgccttgagtgtagagggtagattgagatggcgttataggtttgggcattatcgatatatgatgtggaaatgaatgagatcacccagggagaagagatctaagattagcacttggagaaacattaacattttatgtagtgagcaaagctccaaggaggtatttgaaaagaagggactaacttaaggaagtgtaagaacccagaagcaacagaatgaaaggatttcagtaacgtagagcaattagtagtgttaaaagtgccatacaggatgtatgtgtgttcattttaaagcttggaatcagattatagaacctcttctagatgtttgaaggaagtgggtggtttttgcttttttcgcattaattgtaaatgattttacatggcagtataacatactaagcaaattataccaaattagtctatatgtcttcagtcttgctaattttaaatttaaaatgttattgcccacttgtttgtggcaaaggagaaataaaggaatagaataaactaacgtcagtgtttttgtctgtcaactgtctttcagttttttatgagaataatcttagggtgccttaagtattcttgcatcaatgtgcctaattttatcaatgagaaaagtaatccagataatttacgtgatttcctcttaagtttacacatttagctaatgacaaatgcaggaattaaatatattttctcatccaggtgtccgtcagatctcccatgctgtttcttcctccttaaattgaaggtgattacttacggaaatttggttaaatgatttgataactatgctttgtagcatagagagaaataaacagctagtttaggtaattagttgtgaatataagagaatacagcaaatactggaaaaatggataattttttttaaaatatagaaaatgtcatatatattttttgattcctttaatttttaggatatggtatgcttttttttcttccattagcagtctgaaaatataaatatgtgtgaataccagttttattgaaaatattgagagtagcttcatattttagagttatataatgttctgtttatttttttttttaatagaaaaaatgaatgcaccaaatcagcctccacataaagacactggaaaaacagtggagaatgtggaagaatacagctataagcaggagaaaaagatccgagcagctcttagaacaacagagcgtgatcataaaaaaaatgtacagtgctcattcatgttagactcagtgggtggatctttgccaaaaaaatcaattccagatgtggatctcaataagccttacctcagccttggctgtagcaatgctaagcttccagtatctgtgcccatgcctatagccagacctgcacgccagacttctaggactgactgtccagcagatcgtttaaagttttttgaaactttacgacttttgctaaagcttacctcagtctcaaagaaaaaagacagggagcaaagaggacaagaaaatacgtctggtttctggcttaaccgatctaacgaactgatctggttagagctacaagcctggcatgcaggacggacaattaacgaccaggacttctttttatatacagcccgtcaagccatcccagatattattaatgaaatccttactttcaaagtcgactatgggagcttcgcctttgttagagatagagctggttttaatggtacttcagtagaagggcagtgcaaagccactcctggaacaaagattgtaggttactcaacacatcatgagcatctccaacgccagagggtctcatttgagcaggtaaaacggataatggagctgctagagtacatagaagcactttatccatcattgcaggctcttcagaaggactatgaaaaatatgctgcaaaagacttccaggacagggtgcaggcactctgtttgtggttaaacatcacaaaagacttaaatcagaaattaaggattatgggcactgttttgggcatcaagaatttatcagacattggctggccagtgtttgaaatcccttcccctcgaccatccaaaggtaatgagccggagtatgagggtgatgacacagaaggagaattaaaggagttggaaagtagtacggatgagagtgaagaagaacaaatctctgatcctagggtaccggaaatcagacagcccatagataacagcttcgacatccagtcgcgggactgcatatccaagaagcttgagaggctcgaatctgaggatgattctcttggctggggagcaccagactggagcacagaagcaggctttagtagacattgtctgacttctatttatagaccatttgtagacaaagcactgaagcagatggggttaagaaagttaattttaagacttcacaagctaatggatggttccttgcaaagggcacgtatagcattggtaaagaacgatcgtccagtggaggtaggtttccagtaggtattaatacaatgatatccttagttccatttatttattgcaaattataatgttggtgttatgtactttcatattctaatatttttgaacacaaatggcagttataaattgcacatttaagcatttctgtaaagtactatgattaaatagatctatgaaaactgcatgaaatttagtgaattaagtgcagggtggtatgtggagggaataagttcaaccacgtaaatacaggatggcaaaggacaggctgggtataaacaaaaatggaaggaagaaagccatagtcatggatgaccacaagctgcatgtgagtcaggaaaaaagtccacgtcacactcaggtgtttataaatgaatagggcgcccaaggtcaaggagagagttctttctctatcctttgaagttgttttctctcttttgattagcatgtcaagttttggtcactgtattttaaagagatgtaaattatagagaaatgtcagaatgatcaaggggaaaaagccaacactatctcgcaaggttaaagtgttcggtgcaggtgatgaaagtttaagggaagtcctgatttttgtcagatatgtgtttcgatatgtgtagatttttgtgagaggaatgtgcccactagaggaagtgacttgaaaacagtatagatttgcttttgatagcttgacgtgttataaattccttattgtaaagggtggtaatactagacaagggcattttgtgggatatcattcttgagagtccaaaatagtactgtacaagtgattttgcttttctggtgagtttgcatgttcgtctggctaaaagtgaaacccaaatctttgaaataccttatacccgtgttaagtctgtgattctgaattttagtagctgtatacatacatatgtacaatccccttggtatcagaggtggtttggttttgggacttcccacggatcccaaaatccgaaaatgctcaagtccctcatacaaaatgatgcagtatttgcatataaccaatgcacaacctcgtatgctttaatctcgagattatgtgtaatgccttatgtaatataaatgctgtgtaaatggttgttaatactgtatagtttggggaataatggcaagaaaaaagtttgtacatgtttaatacagatgtagtttttcttcccaaatacttctgatctgcagttggttgaattcatggatgtggaacccacggatatggagagccaactgtatatacttgttatttttatttttttaacttcattttttttttacacagcctggcttgctttaaattcattaacgataaacaacttggaaactatggaaaacacctgaagagaacttgagtttgcaagattttaattttttattctgacagccggattatgagcccttaggaggaacgggttaagcattcacataaattcaggaagatgtttacaacatgaaccagtgctttgtagctatattttaagagatttactttgaatattattttgattagaaatcttaaacatgaatggctggagtggtttaatttcattaaggacatatgttggtaagacaggattgatgtttaatttgtattgtgaccactggttttgaagtaacatgagtgaagaaaaaagtcctggcagtaccaacatcccttggtatctcatcccagggggatttgttccaggacccccatggacactcaaatccttggatgctccagtccctcatataaaatggtgtagtatttacatacaacctatgtgcatcctcctgtatgctttaaatcatctatagattacttataatacctaatacaatgtaaatgctgtgtaaatagttgttatactgtatcttttttgtttgtattattactattactgttttagagacaagatctcactacgttgcccaggctggactcaaactcgtgggctaaaacagtcctcctgccttagcctcctgagtagcttgtattactttttattgttgtattcttatttttaatgttttttcaaacattcttgatctgcggatgcatatcccagggtttcagagggccgactgtataacctcacctctaattcagtggttcttataggagagcagcacatgagaagaggccacggtggggcgggggtgagttggacatgtcgggcttccgtaaactgcttcacccaccctccctccccaaattgtcttccttcctctccaggctcttcgtggtgattaactattgctactaatgaggattgtatcccttagatatgttatagcaagaaaagattgagaacacgtgccctacatcttatattagaactcatgttgaaaaaagacagtaatagtttccccagagttctgaattctcatctgagttgtagttctttggtttgaccaattgagatttcgctgaagaggtcatctttgttatagaagaaaagaaacacgaattcaaagtttataaggtatataactgaaagactttattagaattttgtgtaggttgtttgcttttcaaaaaatgaactacagaagcccctgttgttttaaattttggttcataagatgctaagtgttcatcagataatgaaagagtaacagagagcgaaagtgggacttcttcagtattggggattaatccaaactaacaaaagataaggctctacaattctaattaacttagtgggaaagtaagattttatttttattcccactttaggaacataatttctataaagggaggcgtgtgtgtgtgcgtgcttgtgtgtgtatgtgtgtgaatatgtgtacagtcccccactcccaggtttgttttagtcgttttatttggtatgtcaggaaaagagtcacaattttgaagtccattaactgggtttcatttctcactgtgaccctttcttaccatagaacgttgtggataggaatctttctgactcgaagcctttgcatttatagagtgggtataatactaccttcttacctacctcacaaggtggttgttgtgaggctgaaaaagataggcggtaagtggtgttttcattcccacactgctataaagaaatgcctgagactgggtaattaataaagaaaagaggtttaattggcttatggtcccacagattgtataggaagcatggcaggcaacatcagcttctggggaggcctcagggagctatagtcatgatggaaggcaaagccagagcaggcacttctcatggctggagcacgggcagggtgaaggtgctccattcttttaaacaaccagatctcttgacagctcactcaccatcatgagaacagcaccaatgggatggtactaaacggtcacctcccaccaggccccacccccaacattggggattactattcaacatagggtggggacacagatccacatcttatcaaatggtaaaatgctctacaaatcaaccataaacttttagaagttttattactttttcttccttgaagctaactgtaaatccatatgggtgcaactgtatttttatttttaagatatcttctgccttttaacctctgccaaataattgtacattttaagggcatacattttaggcagtaaaaccttttaggtttgaggacttttttgtttgtttgtttgtttttgagacaaagtctcattctgtttcctaggctggagtgtaatgggaagatctcggctcactgcaacctctgtctcccgggttcaggcaattctcctgtctcagcctcttgagtagctgggattacaagcgtgcaccaccatgcctggctaattttttgtgtttttaatagagacgggggtttcaccatgttggccaggctagtcttgaactcctgaccccaaatgatccacctgcctccgcctcccaaagtgctgggattacaggcgtgagccactgcgcctggctagtgtttttgttcttaattgttaaaatatctgaactgacaaggtaccacagattgtacataatgcatattttgcagtttttgtggtttcgtgataataggaatgaatataggtgaaggattttgtagaaaagaagaaatacacgtgatgtttgatttttcttatctatgtctttatatattttttgattacgttacttataaccagtgtttgcaaagcacatgtgatcttacatttaatttccctttgtaagcatgctttacaaaataatttttttttgagacagagtttcgctcttgttgcccaggctggagtgcaatggcgctatctcagctccctgagacctttgccttgggggttcaggctattctcctgcctcagcctccggagtagctgggattacaggcatgcgccactatgcctggctaatttttgtatttttagtagagatggtgtttcaccatgttggtcaggctggtctcaaactcctgacctcacatgatccacccgccttggcctcccaaagtgctgggatgataggtgtgagccaccgcgcccggcccaaactaatttttctctaaaactttattaatatttcaaaatattttaaaagaactgaactagcaatactaaaaaaaaatctgtttgcagtttgttttcataatatgaatgccataaatgcctttaatgatttgttcaaaattatatgaagttgtagctctgtaccttctgtaaattgatttcctcaggacacatttctagttacataggcagtctctaattgaaacaaatggattagtttccagagtccacttgaataggcagttgtttgggatcttgaaaatacttatctatagaaacagtgttgtaaataagagagtctcagattatcaaatgaaacttatttaaatccatgtaactgaactaataataccagctgcagttttatcctggctgtaaggactaccatgatgggaaaaaataagaggaaaccttaccctcccccatatccatttgtggacccagatacaatccaagatcttttttatattttctcatttatcttcttcttctcttattccattgctgtttagaacatcccaggatcttattgtttgtacttatttttccaccttgctgtaataccagttcttctagtctgagtattgttgatcttgggtcttagggatgaatgtatcagccatttcataatgtatcatggtctctcaatgacagggattgtcttgcctccaactcttgctcctctttcattagatgtgcttgtatggtgacccttcccaaccctgcttaaaagttaacaagagtcatctcagcagtccagtagtttccaggtgtccttcccagcagttactgtagctaaggatgggttttgtaatactatttacagttcaatttagcttagaaattaagaccaagtaaacatatataaaagatttatccttaatatcaaaactactgcatacaattgtattttttagagcaaacttttcatcttggaataatatcagattgatagaaaatttgcaaagatagtacagaattcttatatgctcttcatccagcacgccttaatattgacttctcacttacccaatacatttgttaaaactaatatattaacattgatacaaagtgctgttaactaaactacagacttttatttggatttcccactttttctaataattcccttttctgttctaggaaccagtcgaggacaccacattgcatttagttgtcatgtccatgaatctggatttgtctgatatgttctcatgattagactggggtgatggggcttgggaatggatgccacagagttgaaatgccctagtcgcattacattgtcactgttgatgttaaccttgatcacttggttaaggtggtgtctgctaggtttctccaggagttactattttttcctttccatactccaattctttggaagtaagtcaccacacacaacccactctcaaggggagggaaattaatctctacctcctggaagggggagtatctaatgtattatttggaatttctccagatggaagttttgcttcttctcatttatttggccatttatatcagtatggactcataaatgtttgctgttgtttttactttgaattataatccagtaccattgttactgattttgttgctcaggctgttcttgttttagcccattggagctctttcagttgccttctgtgtcgtttgatatgctcccctcttttgttgtattattttccttttgatttgctttttgaatcatttcttactttctggcaccacaagatgctctgggcttgtcttgtattttccctcgttctgtcctaggatcagccatttctccaaggagctctggttccttttactggataattgtatttagaaatgaagatgtgggcactgggtgtgttcggtgctgttggggtgtcattgcttttaggccttctcagtgatagaattagaacgtacaggtatgtcttctaacctgtgtatacacacagatttataattccctatctaaaataatcatgagttcatactgatgtctttcgctctgattcagcacaaggttcattccgactttcctcccttgcttatctgtaacttacttctcttatagtgagaaacctggctaccattactacaattaattacatgtttgttcaaccctaccatacgtgtaaagtagtttcagaattgctaaccagtacccctgtgaggaataaatttatcaactagggtgtagtgtttcagtcaagttccttttgtctttagccttttatagtcaaaacactattctccaaagtaacttaggtcagcacctttttccttcaccttcctcagtgaggtggtatcatacttttgtaatttaattagattcatttatttcatctgcgttgcatcctgggatcctccaaaatcctgattgactttttaaaatgtgcatactctaaagttcactctgtaatatatagttctatgggttttgtgcaatttaaaatgttaaatacaaaatactgtaatatggttattttgtgctcctcctttttgatttccttatgaactttattttcagaagaataagatgaatatattgtaatgtaatgtacaaaatgtataattgtctgactttgttgcctcaaatactgggaatatttttgttttgattactgtcttaattgctttctttagaattagaaacgatcatgtagttattataaatttaatggccaatgaaatactctttgtgtttggattctaacaatagttgtgctaattttttcctgtacacacaggaaacactgaagaggttgccgtttatattcaaagcagacaaagcatgtagaaactaggaaatcaataacagcagctaccatttattgactctcacagtgttccagactcaacaaccctgtgaggtggtgcattttccaaatgcagaaaccagtttaggtacagtagataactttcacaaaaatcacagagctatagattgttagagggattcaaattcaggattctgggataccagactttatcctacatggtttcgaaacctggctgcacctcagcattacctagagggcttttaaaaatacgtgtgcctagccattctgagagtaggacaagtcagaatctcccagtgggggacacgagcactgacattgtaaacaaacctcctgtgtgcctcacgtgaagctagaccagcaacagtgtagttctggtactcactggaaacactgattaggctccagtgctcttccgccccatgcctttaagatcatgctgcttaatacagttgttagagttaacttattacttgtttcaatcattccctgtctgatttcataagattacaagaactttgtaattgaatgacacactaacaagcacatacttgctcatttgcctttaggttttctgttttcttaaacatacaaacatacaaaggaaagtaggaagttgtgtacattattttggactatagtgagcaaaccgactcaaactgatgtaatatcacaggtaggatagaagtcatcaactttgagctgagaactggatcccgtgataacaacagcacaatagtaatattgagaagactagtagctagcattaactgaacactcgctacatgccggggcaaggaagagggctaagtaacttgatcaggtcacaaatctagaaagtggcagagccaggatatgaacccagagctctggctgtaaagccatgtatgctcttgacagtgtacagtctcccaaagttacattttgtcccacacagtgttttaaatattttttttgacttagtgtctaatatttttaaatgggaaaatccagattttgggttttcctagaaatactgggaagtctgtcaacactgggtccacattcccacatgaccagcagcataagggctccaggttaccacagtatccatcatttgtcttatggccacccaagtacacctgtttacatgacttactgggcctgtgtagaaattgcagtttgtgataggatcccagtatagaatcacagaaactgacttttgaagggtaatgtaaaggctatttgtatctaacacttttttaaaaaacagtatgcttttgttttatttattggagtatatttttgaagtccctgtcctctgtcactgctcagagtaattatcatctggtttatattttctagagttttttgtgattctataaattatgtctttgttatgtaacacatgtaattttttacaacaaatgtgataatgctatacataatcctactacaacttgaagggtttcccccgtgttgtctactttggatctgtccttgtagatatatatatatatatatagctctcgttgttaaattccatttaacaactacatgatattccattctatgaatgtaccataacttatttaattatttcactcttgatggaaatgtaatttttttgcttgtgtaaacaatgtagccacagacattcttgtacacacccctttatgaacttattctgttgtttttgtaagaatgcttaattgaaatggaattgttaggtcatggggtatatgcacattcacatctttgatatgtattgccaaattgctctccaaaaagactatactaatttatacttaaaacagtgcaggagaaatttgatttttcctcatttttataaccatgatcagcaaaaaatgttatttcattgattgattgatttttttttttaagtcagagcctcacactgttgcccaggctggagtacagtggcacagtctcggcttatggcagcctccacctcccaagttccagcgattctcatgcctcagcctcctgagtagctgggatcacaggcgtgtgcaaccacacctggctaattttttgtatttttagtagagatggggtttcattatgttggccaggctggtctcgaactcctggcctcaagtgatctgcctgccttggtctcccaaagtactgggattacaggcgtgagccactggcacccgacctaaatctttctcttcatttctagtgacactgagcctgtttttcatgtttattggccatttgcatgtcttttcgtttgcttatttattttgctcattttctgttaggctgcctttctattattgatctgttggaactatttatgaattttattcatttttctatgatggttgtaaatacttctttcaatttgccttttaacttgtttaggatacttaacactgtatagaaatttcacatttttatatagtcatgtctgttgttattttatgactaccttattttatttgtactcagagattattttaaaattttataattgtcatggttttctttttacactttgaatcagtttgcaaataatgtccatgtgttatcattgttcattatatttctaaagtgttttagtctgtagattccccctgcctttttttttttgccatatatgaagaagcagggtcatttatcctgtagggtctgaatttttatgattgtatcccagttgccccacatgtttctattttctgtgtcttctctgtgaattggctgtaaaatagagtggcttgatcaaattcaggattttttaattggttggttgtattaacactactttcccaggacacacacatatctgactatttgtgccattagtagtagttgatgaacattgcctagattccttaatacattaagggctgaaaagtgaggatattctaattctctcatttcttcttcatttattagcttctttattattcatttcatttattagatattgctataaggataaacttttcctcacctattatatggttacttagtggaatagttgacacaaatggcaagattaatgtgcttgattctttaccttttatttactattttttaaaataatgatgtggtttattgatgactaattagtgttattagtatgattttgaactcatgaatttaaacatatttggtatgtttcaatccatggatgtcattaatgtattgaagtaattattgtaattaatgttcacgtcccatctttggacaatgggaacatattcaattggcttgactccttttttcacagtcctttgatagcttccatgttatttagtgtaactggctatcctaggctgacattgtatatctgttccaggttgagagtcagatatgttttgttttctttttctttttttttttttttttttgagaaggagtgtcactcttttgcccaggctagagtgcagtggcgtgatcttggctcactgcaacctgtgtctccctggctcaagtggttctcgtgcctcagcctcctgagtagctgggattacaggcatgcgccaccacgcccaggtaattttttgtatttttagtagagacgggtttacaccatgttggccagcccggtctcaaactctgacctcaagtgatctgccggcctcggcctcccagagtgctgagattacaggcacgagccaccgcgcccggccactgagaatcaggtacatttttaaggaaccctagttccctttattgagaaatggtatattccaagaccactgtctgtaccccagcattgttcattgcagcagaaattgtggctggtcattgttttactgtttagtgggcagatgaaaacacatacacaaaatgcatcacatgtcctttctgatagttctgattcaaattcaggatttgagaattttgcttaatctcttctgacttaatccatatatcaccacctttctttttttattgagaagcccaatgttctgtgataccaggtgtgacagaatatcagatactgactatattccaaaatagacaatcatctcagtgtgattactggaaaacagttcaagttttgtttttgaccatccttaggttataaccctctgtggatgtaacatcagataactgcattttaaagacttttggaacatttcttctcgtggctctgccactgactagatatacagttagattcttttttctactttatttccaaaataatagctttattgagatataattcacttagcataaaattcaccatttaaagtgttcagtggttctctgtatttggagttgtgcaaccatcaccactgcaaccatcctcactgtgtaactttggaacattttcattgcccctaaaagaagtcctgtaccctttagctgtcacctccacaattcctgtgctcactagccctatctctaggcaaccgctaatctactttctgtctcttaatatttgcctagccatataaatgtggtcatatggtatgtggtcttttgagactggcttctttcatttgcataatgttttcaaggttcatccttgctgtggtatgtattggcgcttcattcctttttatgactgaataatattccattgtatggctataccacgttttgttgatctattcatagatttcttaaaattttatttttaggtattggtttttaatttgtttttataagaattatgtgaagtacttggttttacaagaaaatctaaatgtattctcaaagaagtttagcttctctgacagggatagttaatcttttaaaacattttatgttttatacttctgttttttagtgtaacctttttggaagtatgtagttttgtttatttatttacttttaatgtttaagatgagtttatttcccccaagatgtctttgtattaatatctttacataacacccttaatatcccctcttcaattttttaatctgcttgttcccaactttgagctatattggaattatccttttatttctaaagtttcatttgaagtaattttcttttactgccagtgaaatgccaagttatttcatatgccctttcttttcccccagatggtggtggtgtggtatatctgtattatcaatcatacagccgtgtatgacagtactttctcccccatagctgtcatttagtctcagttcttcagggttgtgtgtgtgtagatagataaaatatttataatagacatgtagatagaagtttcagattttgtttaaaggctcatttttaattattatatcccagtctcttgagtcattctggttgagtgacacctgttctttagtagatttctgagtaagggctcaggaggacagcatttcctgagttctgccatgtttctaacagtttgcaacatttatacttggaagtttgtttggctgtccataaaatctttggtttatattttctttccttggataaatttgttattcattcttttgacaggaagcattgatgttgaatggtctgatgacaatgtgattttttgtttccatttacaagacctttgtttgtttgctgaatacctaaaggatttttttctttaaactctactagttttacagtgttggtttttccaatttgatattttcagatacatggtgtacactttgaataaatagtttagtttgtttgtttgtcagtctgttttttaaatttctagtgagtttcttaacttacagtttcacatttttgcttcactgactcagttctctttgggaactgctctttatatattttggatctactttgcctgtcttctctgtcatttcatttcagatcttttctttttcttagtttctttttgagttataaagttttcttttgttgacctcatttcagtgaaggcattatctgttctgtttatttgctcttatgtgccttctagtttgtttttgatttgggacgtaaaattgatttgatttttgattaaaaaattaaattctgagttctatcactgaggttttttttctaattctaatttttgtcattattttatattttttatgattttcttaatttcttttagtttatttcagaaatcggtctacaattctcatctgcttagtggacatatctttctggcaagcgctcactgtctggagggttattctcctttttctctctctgcttatggtaaccttgtgctagattctactacagttcttttctgttgcttatttttaaacatgatacttgtttccatgaacttaaaggagagagggagttaggaaagtgtttgggattggggctctgagtaccttcttctcaagtttcaaaccatcttctctgttattgtttgaggtctgtggactgttcttcttcccatgttctcgatctcctcttctctttcctcctgttgtcctttactggggagttggatttcactttttttcctcgatgtggagccgagaattcctggaagggaatttggggtactagttttaagatattatggggcctaaaccactccagccctttcagaccttactgccaaccccttgccttcactcatgaatagtgccaaaatcattcctaatttcacagaagttctctgtagactctgtgagcttttcatagagcactcatcatgacttgggaattgcctctttacgcccttcagacaccctgttaatttcctctgcttccctccgctaatgctgataccacatggctcttggaactgttcatggttttcccaccacctcttctctttggggagtcatgaccaccccttttcatctagttttgttggaggtttgtctcacagagttttggttttgctgtcctcattgctccatttttatgagagggcgttgaagggaaattgaaaccctgttgccaccactttttcccagaattctttttttcagtttgacctgtactaaattgccagtatttgaccattttcaatgaacgaaagtgggaatttttatatagtttaacctaatgcagagctctatctttagattttactacattgggaatttctttttccaaatatattgttcaacatgtatttttgtgtttaatacatactttgatttcccataataaccagtaagaatttctaaaacagctgcataattttagaaatgaatacttgtgatactgtgaggtatagtatgaggtaagcatgtcattatttttctgttaattgcttataacatacattagataacccattattttccaacttcttaaactgctgcctttttttttttacattaaattctagataattgggtatgtttctgtgttctgatctgtttattactgtgcaggcttattctattttaaatagagtaggcttattagtaaggtttggtatcttgtaggacagtgttgcccattgtttcttttcagaagtttctgtgctgtttttatttttgcacattactttcttccacatgggctttattatggatttgtcaaatccacacaacatgacatcagaattattattgtaattacattgcatggtcttaatatagaatctctaagatggagagcaccctttcaatgattagaagagacacaagatggaaataaagattttattacttgcaggttctggagggtacacggcacgcctacaggccgctcatgcagaggtcaggaagtgcagacagggagagagggagggacccatgggccaatgccttcgtggagtccaaggtattgtccaaacaggtttccctcaggaaggtttaattggtggatttaaagcaagcaggcacaaattccaggaggtcacgctgttacagaggtagtcacagtgctgtgtctgcactgtccatgagaggtatgagggtcagggccagtgaaccagtctgtgtgtagctgtccatagggaggtggtcactaggaggaagttgtataaggcaggtatctggatcagccacattgaggaactgggaggcagtgtagaactgcaccctgtgtcaagggtgacagagccctgcttctgctatgtgaaggttccacttagattcaaagtgcataccaaggcaacataaaattatgagaatttactatgcattttatccatgtccttatattattgaatcttcctagtttggctaggcttgatctggggttttacactgtgtttgatgctgtgctcttcactggaataagatgataacagatatgtgttcctgcactgcactgtccctttctccgctcactggttttattgtaataatttggaatgcaagatccaggccttttctttatagtgtacttaaaattgtgtttttaatatttcattctagaactcgaattgtagtcagtaaccaaattatcatcatatagttgtatctgcctatacagattgaaaatcccttatccgatatgcttgggaccagaagtgttttagacttcagctttcttcggattttagaatatttgtgggctgggcacggtggcttacgcctgtaatcccagcactttgggaggccaaggcgggtggatcatgagatcaggagatcaagaccatcctggctaacacagtgaaaccccgtctctactaaaaatacaaaaaattagtctggcgtggtggcgggagcctgtagtcccagctactcgggaggctgaggcaggagaatggcgtgaacccgggaggcggagcttgcagtgagccgagatcgcgccactgcactccagcctgggcaaaagagcaagactccgtctcaaaaaaaaaaaaaaaaaaaaaagaatatttgcagaatggataccagttgagcatcccaaatccaacatgtcagtgctcaaaaagttttggattttggagcatttcagattttgggtttttggattagggatgcgcaacctatataagttttgttaaatttatggcttttctctttgtttgctatttttctttccctatcttgtgatttttttattccagtctagttgtcatttaactagactctaccataaccatactttgaatagttttttagagaaggtaagtgaattgtactttgagatcatccctattcagaggctgctgctgctttacatcttagtggtgttttgactatgccaaatgcttttctccccttttccttttgttctttatggaactctgatcttacgttagagccgctagatctgacttccatgtctcttgtttttactcaaagtttccatttcatcttttctttttttttttgctctgagttatagtaataatttctgcagttaattctagattattaaatcagttttagcagtgttcattctattttcactgtcttcttgagtttatttcagaagtcttaatttattattttccagaggactttaatgagatctcgtattagagtatttttattgttctctcctgttttctacattaaatcggtattaattgagcccagctgttctgattcttccctttagtctcctcttaaggaaattgctgtttcctctgaagtgctgaatttttgaaacatctgctcctctctgtctggacatgtattgacataccaagctcctccagcaggaaggggtttcctctgtgactgtggaggtctggctgttggctctcccaggcaatgtggtcttgcacttttttgagaactagggattgtgcctttggctcattgagcccgtaaacaaagtcagcaggctgggactgtttggaatgccgaaagaattatttagaattttatcttagaaagtttggtgaattttatagagctttatataaacattgttttctgatatcattataccagaggcggtggagggaagcatttacagcgtctaaagcctttacttacacataccttaagctgttaaccctgaatatctgagacaggtctgttaatttagaaagtttgttttgccaaggtcaaggatgtgtgcgcctgtgacacagcctcaggacgtcctgactatgtgtgcccaaggtggtcagggcacagcttggttttatacattttagggagacatgagacatcaatcaatatatgtaagatgtacattggttccatccagaaagacaggacaactcgaagcagggatggggcttgcaggtcacaggtaggtaagagacaaaacgttacatttttttgaatttctgattagcttccttatgcatcgatctcagtgagcagagggaacaggatgggaggcaggtttaccctaagcagttcccagcttgacttttccctttagcttaatgatttgggggctccaagatttgttttcctttcacaaccctgaccacatttattacaagtaattattttagtggttattttagaaattcttgcctgttagggaaacccaggtgtgtactaatttaagtgcaaaagtatgtattaaatgtagaaggataaattaatcttgttttccttagtgctaatgcagattactacgtggaaacggtgtgttcttccaactttatattttagtggttatatactaacattgtttgatgtcaggttataatagactaaacgtctgtgttttaagagacaagaattttttcctttcagacgtttaatcttgatggtaattttatactaagaagaaggcatatcctcgtttctgtcattaagtgtatctcagttatgccaagtatatgttattctttttgaaaatcaaaacatccacttttaaaactgtagaccttgtcaatctgtcactaacataattactgttggcattaggagtacaatagggaatttgagaactaagagcttgttaacaaggttgatgacatcatatgttccattctttagtgttagattgttaatagctggggaagaagaaacactggcacttttataggagtatttacctattaatttattcatcaaacataagcatctattatgtggcaagtaccgagctaagttttagagacccatagttaactggagataaacaatctttttcatggaactgatggtctaatgggtaaatagataaaataatgcattacagtaaagcatgataaatacaacagaggaagcatttgcaaggcacaaatactgtgagaaaagggagagattaaatgagttatttgaggcaatcacagaaaacttcatagaggagggtggcatctgggcttcttcctaatgagaggaagagttcaccagggacagaacactgtctgcagatcagaacttctgataataaaagggattaatttgtgcaaaagcacagaggcaggtttgttatgggtaaaggagaaaaaggtggtggcaggagataaggatcaagatctatgcagagacctggccattaggctaaataaaagtgtctgacacttagggctgtcagtgaagcattgcattttaaattagaagggctaagacaagccttggaacaaaatcactttgtgggttattgagaggtcagtggattgacgcgttgtaatcagaaaagcagttgaagatccactgtgagttaaggcagagggtagaggagaaggtggatttaaggagtatttagtagaactgataaagcatgttaaacgtctgcatgtatggttcaaggaaagaaaagtgtggaaggccatgaatgagcattaattagtgaaagccaagctgtccgttggaaatgggaaaacacagaaacagggaatcatcttgaagaagataatagccgtaaaaattagtccactctgcagctgaggctctttgtgattccttgagtcctctgacagttctagatgtgggggtttatgcaaacctgacttaagatatggcttcttctatttgctgtaaagcaactaatggtccagaaggagagaccaacatgttaacagtagtgattttactaatgttatatgtagtatgtttttagagcgtttttcccatgtgtacagcatgctgtttaatcttgttaagaggtagttgatggctctatttttaaaatgaagaaatcaaccctgagagactactcagtgcttccagaatcacatcgctaattgactcaaaaccagcttttctgatttttggacattggttgttttctcattaagccacaccgtctctatcatgaaagtcaaggtaaactcagggtttagagtattttagtggcatgctgttgggggcgagaagaaagtcactggaaaggtatcatgaggtgaaccttgaaaactaaggattttgaagtggaaaataaagaggcgagcatttccaggtggggaggcagcatgggcagcgaggctggtgatggcacacgtgtgtgagggttggttgagagtgtcacgtggaggcaggagagaaggcagcactggagggtgagactaggtcatggagggtcttccatagcagctcaagttgtttgggccatatttggtagatgagcaggtcgggggcagcacttggaagtgtcagatgagagtatcattcatgaatgcagcaacaattactgtctgctgtaatcagtgccaggcgtggggacggtccttttagtatagtggtaaggaagtgaaagtccttgccctcaggaagttctgtccccaagttatggtggagtgtgaaatactctgatggcagggagtaggggttctggtgaggaatgatggggaggggagaaatagctcccatggagcagggagaaggtgggtgaggaccaaagggaggagaagcaggggccttggggagccagggaggagtgaccaggagcagagagagtgctcccaacattccagatcccctactttatggggaaaggtgtaaggaatttgagaggaacagctaaaagaacgggggtgggggcggacaacgcaacactagggttcccgggaagcatcacaaaacggataactgagtcatgccaaccaggttgatcttaacgattttttaatttttctgtcagcatcgttcattacagctcaggggaacaaatggacagaagaattagtggaactgattagtttttatgttttcataaatggctacttaggatgagctgttatttgattttgtaatgttttctctaatttcagtaattctctggtttttttcccagtctagagatagttgtcgatagtactgtatataacctgaaaaataaagtgttctgatcattttaagtgtgaggcaaaaatgttaaagatgaacctgattctttttctaatatacttctttgatcaaagtattgcaatttggttttggttctcattatggtttccagcattcttagaactttttggatctatgttgaaaatgttgaagttattaaattcattaaattattaaatattcttttccctgtaaaattagaatttttgtagatttgttagcacattgtagagaataagagtttataaccacaaccgtagaacgttgtctcgtatgctcttttaatctgtgcctgttgaatttttgttatagttttctgaatttccagatcccatgtggggttcagattatgtgcagttgtcaaggacaccaccttcatctgaggagaaatgcagtgctgtgtcgtgggaggagctgaaggccatggatttaccttcattcgaacctgccttcctagttctctgccgagtccttctgaatgtcatacatgagtgtctgaagttaagattggagcagagacctgctggagaaccatctctcttgagtattaagcaggtttgcttcaaagactctttaaaatatttagcaattattatattatcctacaggcttatcatttttattttgagagttcctttttttttcttaattgtcgcaaatagtgaaaaatgactgtttgtccatggttttaagctgtatattttagggtaattaaaaatgttctttatatgcggtcctcaaaggtaagattgtggttcatcctttctgtcatccacttccttgttctaagtattttaaagtttcagtctttgaagactaaaatttaaaattcattcataagaggtagagtataagattcttaaatttatttattttttctatttgaagtacatgtaaacagataaatgtctagaataggcatggggaggggtttggactttctgcttgcttaagcagtggtatggtttaaacagtagtgacagcttatgatttcttcgttgttgttcattctgggtgggatcttacggatgtttgatatcccaggagcagcagcggaatgggtggaagcagttgtatccagcagagtgagtgctgaagagggtctgtatttattatttatgatattaacatattgatattcaccatataaagtaaaaatttccagaccttgtccccaaaagaagaaaggttggtatgttttttgtagactgtacgtgtctatcccatagggattggagggctaagagctacccggctctgtgaatggtaagacaaagcataggtgagcagtgcagattgaggaaaggcaggtgaatacaggtcatacagtaggtacaaaataggatttgtttgtttaattaggagtagaatagaatgactaatgaaagtcatttggagattgtcccctgcatctcatttccatccctttggttcatacccagcaccgccagagctctgtttccatgttagctccccttccttctcaccctcttgtttctggttattgtcgtgctgtccactttggccttgcttttaactcatcctcataatcgcagtggttatctaggacattttgggaaaatacttctcagcttccttctttatgaaagaaatacttcagaaatatagcctggtaaagcaaggtggagtttatcttttgttgatggggctattgtgaggactaaatagtaatgtatgttgtaatactttgaaaaataaaaacaatacttagattaatgtagcactgctagagtagaaagaaagcagaaattttggtttaaatgcattcaaagatcagttacaagcacctaagtgacatctttaatagagaaattgataattatataatctgaacagaacactttttgttagatttaactgtagccatagctctcttacagtggataattactttaaaacatttctgggagagacttctgtcaataaaagcaatccatgtttattttagaaatttagaaaagtacaaaaaaagataaaaaatcaaaatcaaaaataattgtaaaaaccctgttattctgacattcagagataactgctatgacattttggtgtatttctatccatttgtttttcctgcacatacataacttcctacacatacaagtaagtatgtgtgtgtgtgagttttttccctgtaagtatttttcaaaagcaagaatttaaatggctgcaacagtattctactgtataggcacatcacaatttatttggttaatcatcgatttaagtaacattgtgataaatatgcttgtatagaaatcttagtttagatctctgattatttctcgagtgtaaaacataatagtatatagatgagtcatacatttttagactctagaaagtttgtatcagtttacctttccattagcggcagtgaaggtttggctaacatgtatgaaaacgaatgtgactgtgtgatctcatattacagtccctgtttattagaatttgcgtacattgtgtctcagtctttttattaatgggaagggctttccagattgtctcatttcaaccttctgcccacgtttggcaggttattacctattagatctatatattgcaaatttgcccattttttgttttgtttttttctgttgatttttatctaattccatcacataatattaagtcggttggttggttttggtggtcattatttgatggtagactgggccacaaatcacagtaggtaaactatgctaaattattgcgaaggccacctgctttgtggtaaaaagtacctttgaatctttattatgtttttgatcattaggaggtttttctttctcacatttcttgtaatgtaaattagtagaaaaattgattttattctatgggatttactttctatataagtttgttgttaagagaatttattttagcaaagcagtaattgcctatatggtattttctctgtgtatccatgctgtagtattaaattcttttattttcactgttttgttgcttctcaattgagactactaaggtatttacataaaatgaactgatcaagaatctagaaactattgtaggttttttagaggcaaggttccctctgagttttttgaagatttaagtaggaagatataaaacacggatcgtctggttggagtttatggctgctggaacctgtgtgtgttgttttgcagctggtgagagagtgtaaggaggtcctgaagggcggcctgctgatgaagcagtactaccagttcatgctgcaggaggttctggaggacttggagaagcccgactgcaacattgacgcttttgaagaggatctacataaaatgcttatggtcagaagcagtggggaggaatttttctttctttctttgtttctttttttaaaaaagtaagcctgtatttccttgttttgcaaacagcgttggcatacatattcagataaacttctctagtaatgaattatagaaatgatccctgaaagtatagcttgtgtgtgtgtattgcggagggcggtggtggtgatcttgaatcagagtctttccatctggtattagattacatttgtttctctgaaatccacatttaaaaaattctcaattgtttttaagttggaagtttttgacaaacgttaacctagttcattctttacttgtagaatagttcatcttatggcagaatggcccagaagtagaatcaaaatatggtcctatgttagtgaaccgtctgtcatcagccatttttataatacctaggatgtgctagggaccttgcatggctctgggagtgttgaagatcaacaagacactcgtagtctggtgggactaggcatggtagatggtaacgcccccgagggctcagtgccagcagagaagcttgctgtgttgtctgggaggcacttccagtgaggaagctgaatcttaaaaagatgagttaagggttagttaaggaacctggcacatttgaggacttgtaaatagtttgattgggcaggagtagacctatttttattttgtcataaaaagagacctcctgtcttctcacttacactgaatgtgccctgtgcttttaacctctgttcacattcttctttcctgttagaaatgccccctcctccactttatctgcctatttaaggcttactttcaggttttatttttctctagaaagctttatctgacagttttaacttttagtctgtgtttataccttctttgaactctttttagcagttacagttagaactatatggtttaacatttaaacagagactcttttctcaggttgccctaattagactgaaagcttcatgagccaagggctataacttgaaattctcttgttttccatagtatctgatagtgttcatgtatcgtaagtacacgttagattcattagggtatatgcatagatgattacgtaatgtgacaggttaatgaaataataaaactgtatcgttgtaggtggggtgcattcattcttgcttaacatgtactgtgtcctgcctaaggatggctgcagcacctacagataccactctcactttctaagcgggaagaaaaggggaaacagaccttaccagctaagtccagacctttttatcagagcaataggagctctcctggcaaccccacccagcacatttcccctgccttttgttgaccagacctgttgcatggcctcactgttgccatggaggctgggaatgcacatgttgagctttccagcctctgtagtagaagtagagaaggaagaatgtggctgggaatgagacatattatatctggcatattgcaagaaatcattttaatgagttagaagttattctctatataaaagacctgagtgtgtaaaatggctgtattttgaaatactatgtatttattttcttttttgagatagagttttgctctgtcacctagactgaaacgcagtggtgtgttgacggcttcctgtagtctcaacctactgggctcaaacgatcctcctgcctcagcctccctaataactgggaccacaggcgtgtgccaccacacctggctaatttttaaaaatttttttgtagagtcagggtctcactatgttgcccaggctggtcttgaactcctgggctcagtgatcctcccgccttggcctcccaaagtgctgggattataggcattagccaccacacctgcccactatatatttcttatgtcaaaaaaatctttatcttgaaaagttgtggaaaaaagcaacaagcaaattattatttttctctctttatgggtaactaaaccagaagtttaagaagacagaatatgctttgcttcgtaaactgtgtttgctggccctttatcctgtagtggcaggggagcagggtgaggagcatcaggcatgtgaaccacgccttcctggtcagccagtttctgtgccattggtgagcctgtgtgatagtggaagtctaggctaagtgacttaccaacattcacagctagttagttttagaaaggcttagagtttagttttggcattactgtcaattatccacatctctcttcttacagatgaaaaaactagagactgtcagtgttttaaaattatggcctataatgtgctagaaggatcagggcaaaggtgtgttctgaggactaggggagcccaaacaaaatcagtgtttctattaggaaggaaggaaagaacagcaattgaattggcagtcaaattatgtttaacacccttgtctggaaacccaccgaaaacagcaaatggaaaaattccttcttcagagaaggaggaaattggccacaatatcctttcccatacccttccaaaaataaaaagacttagaattattcgccttgaaatgtaaactaaaatgaaggtaaacccaagctctaaatacgtgtccgccttaggcccagaaggcccacccagagattaactagagccttgatatctaggggtgtgacagccatgaccgaagctgagcctgtctctccagggattctgttgttgactgaagagctgcccgacagaaggagcgcgagctataccgcagccttctctggttgtcaggaagactgccgaatgggagctctcttagcagggggaggggaagcagtgattagcaagttatgatgcagaaattctgtgaccttgggggctttactctgcgttaggacatccactgtactcgaaaaactgagacacttaagcatgtaggtcaaaggaagtaacttggtgagcatttggaacatcaaatctaaatcaaagctgtgaattgttatctcatttcctgggtccctggcctcagaagtaaccaagacaataaacataataatacatgatgtaggaacatgtgacagccttaaggaaaccacttaaaaagatttataaggattgaaaatatgaaaatgataggcgagatgtggtagttgtagaagagacacaagagagctcacatgtacacaatttgagtttctgcagaagaacaaagagcaaagaagcagggaagctcttaagttttcatcctacagataattattgggtatccactgtgtgccaggcaggcaccatgcggggaccaaggaactagtgccgagcgtaaactccctcttagagtttaagaataggggggtccatggtgattgtagaaccatgtgaacaagactacagctgagaaaaatgccctcaggaaaggcacaggtcttttgtggactggttaattcgattcaactttttgtggaggtcaggcttctctgaggggggagcattgcaacttatcggaaatttatatacattataatccagtttaggtaacagatgaaaaacgtagaccaaacaatactatatattgtagtttctgtaataagagattgttttaaaaagcgtatagactagaaggaaatgtgctcagttcatgatcattgttgcctctggggagggaggaaagagatagaagtgaagagagaacaaaggagaaactaactttctggtaccttatttcttattgaaaaaaatatctacatgtaccccggaacttaaaataaaaattaaagaaaaatcaacaagaacatatctaaagcaaatatgacaaaatactaacatttgtttattctgggtgatacttgtagaatactttttagaatttttttagcctctttgctttttaacttataaagagagggatcaagagaagcccctttttggtagcaggtgcggtccgcttgggaaaggagcctggcaagagcaaggcaccgcaggcagcctgtgggggctccagctgcaggtggagagtaggctgggggtccagagcagatgtgagaggaacagttcaaggccattccaggaatgcacatgcaagtccttggattagagggggtaacatacattcagaaagaagtataaggattcaaaggaaacgtaggcagtgaaatggcaggactcgggtggatcaaatgtgaacaaggtgttgggagtgactgtgggtgtccagctcctgcagctgtgtgagtggtgaagatgtgagtccggtgaggagttttaaattgggctgagggcatttgaaagccctcaggcttgactttgcaaactaagggaaagagatgggaaaaaaatatatatatgtattaatatgtatatacgagaaaagggtgaggttcctcagacttctggaggagatgggtctcaaactcaaagcacaagctttgggattaggaggaacagtagttcctctgctataaagaagggaggaagagaggatgtaaccctgtaggtttgcatgtttgggaccaggaagattttataccaaatgacttctatttttgtgtggagaggtagagatcatctgctgagaatgggtggtggtgggtattggcagttggaggaaaatggggaagtttcaaactggtggctctagacagaaggaaagtgagctaagtagagatagaaatatgactcccagaaatgttatgtggctggtgattatgactagtccccccagctccttgagtgtgggcagggggaatgggatggttaggcttaagccagctttggggtcttgaccaacaggtgagatgaaaagacagtaaggggctgcagggtgcaggcagcagcggggacgccagcatgctgatagcagtgcagttgaaaggataagcccatgggatctgaactgaagccagaggaaagcgaacaaaggaaggggttgtgagttgcagaaagatgagcagtcagtggactgggttccagacagggctaaaacaagttgcagtggtagtggttgaacaaatctcctggaaggaggagagggggctttattatcaggtgtttgaactggtgatttgggggttggagcagttctggcaatgacaagatccaaggtggaaccccatcaaaagtggagaaagggccactggagatggaggcagtcaggaagctggactgaagaagtgttcggtgggttttccgcatgatgctaagccacggcagggtggccgagcccgagatggaggaaagactgttagatgaaggccgattagaagtccataggtgacagtctgaagagggggccagtggtgtggctgatgacgtaaatcttaaaggggtagggtcttttgttttgctttctaaagaagaatatatacaaattatggtttaaaaggagcagttggagccgggtgcggtggctctcgactgtaatcccaacactttgggaggccgaggctggtggatcacctgatgtcaggagttcgagaccagcctggccaacatggcaaaaccccgtctctactaaaaatacaaaaatcagctgggcatggtggtgtacacatgtagtcccagctacttaggaggctgaggcaggagaatcacttgaacctgggaggcagtggttgcagtaagccaagatcatgccattgcactccaacctgggaaacagagcaggaccctgtctcaagaaaaaaaaaaaaaaaaaagcagtgggaacaggaggaagctgactttgcagcctttgagtgcatagaaagacagagagttggccggacgcagtggttcacgcctgtaatcccagcactttgggaggccaaggtggacagattgcctgaggtcaggagtttgagaccagcctgaccaacatggagaaaccccgtctcggctaaaaatacgaaattagccagttgtggtggcgcatgcctgtaatcccagctactcaggaggctgaggcaggagaatcgcttgaacccgggaggcagaggttgcggtgagccgagatcgtgccattgcactccagcctgggcagcaagaggaaactccatctcaaaaaaagaaagaaaaagaaaaagacagatagttgccccttgggggccgcaaggaagaagctgtcctcaggaaggaaaaacacggagatgggggagctcaccaagaagtgaaagggcggttctgagcctcgtgttgaggacggtagacccatgaattgcagattctgcacacacaactctagtcataacagacccagaacttcagagtcacaccacacacctggaggatggaggactcagacacagtgaacgatacagcagaagagagttgtcttgagataaagaatagacttcagatttgcctactgaaagttattactagatctcagaaaaatatctttcccaacaatgaagtctgagatgtagcctggtgaaaacactgaaacctaggatagagaaaggaatcctgtaaacatctgagtgtggacacccgagtgtagtcaccttcaggatgtgggagagcagtggtgggtgggcgctcaggttggcgacagactgcttcacgctgagtcacactcggggttggaagggagtggagtgatgtctgaaaagttccgagagagaatgtgtgactcaaatatctcctaccccgtcaagctattcttttaagtaaaggagtccatagacagggttgttctagaaggtggccattgcaaacctgttgagaaaaactgcttgatagttgaaccctgctgaccacgggataaatccaaaggaggatttaagaacgggaaagctgttgtaataggacttgtggtgggcataaatcccacttcagaacaactggatattttggttttagatcatcatttatatgttgcaagccttgaaaacattttatcacgcaaatccggatgttaggaaggggtggtgcgaagaagggtgttgacgtcctcctctctgcacataaggcaccatttcaagctaaagtaggtcattaagtgaagatcctaacctcttaaaggaataatgttgacagtacattcataatgaaaagttctgggtactgttcttttgattttttcccctttattgtagattgtgaacatttttgttgttaggattttgaaggggttgtcaataatatgttaaattgctggggagttagttttgtgattttttaaaaaatcctcatttagacctcagctaacagtggtgagaaccttgcttctgtcggtgctgcgtgcctgtgacagcccccggcccgcccccactttaccctgctgatgtgtagctttcaggtgagagcgctgagttgccaagttctactttcaaatgtctccctttactttttgtgttttaaggtgtattttgattacatgagaagctggatccaaatgctacagcaattacctcaagcatcgcatagtttaaaaaatctgttagaagaagaatggaatttcaccaaagaaataactcattacatacggggaggagaagcacaggccgggaagcttttctggtaggaatccttgtgcttctgaatgcgacgctcccaccttctcactctcacaccatttactcactgattctctcctatgtgtttgtatgtttagttacatgaaaattgcagttatccatatctcatatgtgcaccctcttccaagttttgagtggtgtttctcagtcaggggtgattttttccccttggggacattgggcagtatctggagacacttgatggtcatgactgggaagatgctcctggcagcgagtgggcggggggagggaggctgccgcacattcacggcacacagaacagccccacaacagaattatccactcagatgtcagctttgaacttgagaacttctgccctagaataaactctttttccccctaataaaaggaaggagattgtaagtccttcaagagtagaatatacccgcgtatatcagtcttggtggggacatgcagaacttaagaagtattttaagcatttttactgccactgtttggggaatgtagtgctcatcacagactctctttatgaattgggtgtatatagggtgaaggaatagaagtgtaaacaagggggaatcatgaagagagcagtgcagagtcgcagggctggtctgtcagttctaggaaatgaacatcttgcatgcaagcttgggatcgctgggcacaggccgcgtctccgtggtctttgctggtggccactgcacctcggacttgctttggctcagatgaggatcagtgtccttctgtgctttagattctgctgctgtcttttggcaccaccttctcccacttgtctcatcaggcattttattttttctgtatcccttttataaagtctcattcataagagcatgcctattctagtcctagaccccattgcattttgtctcttgtattagagcagcagcttctgctgcctaccctgtctcctggtcccgtcagcgtgacttctgcaggactctagctttagctttgttcttgactctgccgatttctcctatgttcagtctcggaatctcgtatccacttctctgttctaatggccagttctttttacatcctctctctttatttggagtggacagtgaacttgctctcctctcataactccatccgtcaggctgtgatccccaggctgtctttgcttgtctgttcagcttggtgcccatagtcagcctttttaaaaaaggcattcattgtcatttgcaacatgtctccccccttacttttccatgattctgctttgcctaattccttctgtttgcattttctgtttccaacctgtcaagctttgttgaagaaatgtttttaaaggttactctttagtttcactacaaattcatgttgtttagtgtcactgtaccctcacttcctcttgtcagtctttgtgtttctatctttgcttgtccttcaaattccctagagtgcagtctctggcctttgctttcatgatcctcgccctgagaagctccagggctttttcattcccccttcttgtgaacagtccacttttattctagttctggactccactgcattttatctgttgtattagagcagcagctccggcttcaaacactgtttctcccagggtcagtcggtgttggaatcagcgctgactcctttgtttcctgcacacactacctcgactctttttgggtgccctttgagggtatatccagaatctgacctctgcctctcaagcactccacacttccactcttcccaggttgtcatttctcacgtatgttattgcagtagctctctaaacagtctccctacttctgcctgaagcctcctagagtttattctcaacaccacagcctgaatggtctggttaaagtgtatgttagaccattgtcttctctcaatttcccagtggctccccatcttactcaggaaacgtaagactgcctaacaatggcccgcaaggcctgacatggtcctatttctcattacgtctttgtcctccttctagaccctcctgtcctgtgctcgcttcccagccacagtggcttcctcactgtctcgggccaggcatgttccagccttaggcccttttcaccagctggcccctctgcatggagtgctcttcctcccagttattttcatgacttgtttccccacttccttcaggtctttatccagatgttaccttctcggtatatttaagatggaaattcctacccacaactccttagcttttttctctgttccttttctccatagcacttaccaataacctgaaatacatttcacatttttgttttatttattgtgtttctccatccactggagggcttttactggttttgtttgctgctgcttagtacgtaataggcactcaatatttgttgaataagtacattctagtatttttgtataatgttctttaaaagcattgtttccaatcagacccctttcccaatcagatattttaaaatttactctctttgcttatcaaacgccaaactaatgagcatgacatccattgccctccacagcatggccgcaggactttcccctgtccctttgtagcctaaatacccactactcttcagattggatgattttcttttttcatgaacatgcttgcttgactacatcttcatgctttttaatcatatttattgttcttcctggactttccttccgccttttccattttcttcctcgcagattttccttttcccagtattagtccacctgttaaaattctgcatttgcctgcaaggcccattgcagggctttctggacatgaagccatgccttcaatgggtctgaaactgtgccttcggggttggtctttctcctcctccgacaagcctagcacttacctcctgctgcatctgatattagttctgtgcttacctgctctctgttactagatcctaagtttttttccttgaacatcctaagtcagtaaactgtggttgaattttacttcactcatttagattcattttatatactggggtgtacattttaacactagtatttagaattgtgtactcaatgagaaggatcagccagatagagtgtttcatgtttattgactatacaaagctaattgtgggggaaatttgtaaaaacagttgaatttaaggaattccctttccctcttatcctatcatttagtttgaggccattttatggaaaatttccatttagatggaaataacatttgtgtactaattccatagctactatgaatacagtttaagattttaaggtttatattgagatactgtggtagtagaacaaaggtaggtacatgtcataatccagattcctatttttccacgtccagggttttatattaaaagaagagaaatttttcatttttgatttttaaaccattagagcagtagctgagcctttcaagtttctcagtcaagaattaggctatgagtagggacagttttcttctctgttttatttttatttttgttcccttagtgacattgcaggaatgctgctgaaatctacaggaagttttttagaatttggcttacaggagagctgtgctgaattttggactagtgcggatgacagcagtgcttccgacgaaatcaggttggagttgtgcttcctttccccttccacttcttatctcgtagtttccttcctcatggtgagatcctagaaggagccttgttcaaaccaaattgtgttggcctggaagaatttgggcagtagatgtaaagggatttatttataactgccttgtcttttcatgtgatttcttagttatggttttatgtgaaattttctttgaaggggaacttagaatttatttagtgtgataaaaatagtgccaactggctgggcgcggtggctcacgcctgtaatcccagtactttgggaggccgaggtgggtgaatcaccaggtcaggagttcaagaccagcctggccaagatggtgaaacctcgtctctactaaaaatacaaaaaaaacagctgggcgtggtggcacgcacccgtgatcccagctattcaggaggctgaggcagaaaatttcttgaacccaggaggcagaggttgcagtgagccaagatcatgccactgcactccagcctgggtgacagagcaagactccgtctcaaaaaaaaaaaaactaaagataaagagataaagttgactgaaaaaaatgagtagaattttctttatttacattgtctgggatgccttttatattagtttctgttcttaaaaaatctgtgtagtggtccattaatacattttaatgacatttggtacatttttattcttagtgcattccttctgttgaactttaaacttaagtgtatgaaactatggtttttctctgttgaatttcctccagttctgtgcagatggtatttaggtcgaaacttttgaaattgctactctttgtggtatatatatcaggcgtatagcaactttgtggccatagaatcagcaaggtcatatgagtcaaacttggcgaaagctcatatagaactgacttctccaaagcgaaaatgttttcgctcaccattcaaggtttgatgaaaaacacattttgagtttcagaacacctggtatgtttttatgccaaggttaaagaaagaagttcccacatggtttctcacctgggaaaatattgaatagctgagaaatggaataaataagtttgtaggtctcacagttttgagagctaacatggtgggttcaaaataaccccaagcatgtagattccaaagaaacatgagaaggcaggaatgaagatggtgaactagagagcggttccagttcagggggccatgggcagtggtgtgctggagctgcttctcccggcttgagagagctgatcatgcacatctcttcccatttcattgctcagtgacatcatactgctgccttgaaattagctatgatgggagtatttacaccacagaaatcggcatgcattacataagatagtaatttagggtcacccagttgttaaatatttcccagatcacactgtatagatttctttttagattacgagccaggagttaagaacttaaccttaaactccaagaaatgatcataatgaaatgttaagaaaattgagcttcctattatttgaaggttattaaatgtgccctgcttacattgaaaggatatgaatattttctacaaaactgtcaggagcaggcttctgaatgttttgactacatcttcaataatagtttgttcccatttaaaaaatcctcagtctttatttattactgtgatttggaatttgcttcatctttattgttaaatccctcttgcacctctggaatattccctaatgtgttctaactggacttgaatccacttggcaggaggtctgttatagagatcagtcgagccctgaaggagctcttccatgaagccagagaaagggcttccaaagcacttggatttgctaaaatgttgagaaaggtgagcttgcaatcctgattaattagtaccttttttcttgtttttcttttatcttatttttttaatgctaaccgtaaagaagtttctttgtaactgtgatcctaggacctggaaatagcagcagaattcaggctttcagccccagttagagacctcctggatgttctgaaatcaaaacagtatgtcaaggtaagtacttcaaatgttgtgattgaaacattttgcctttccttctttattctaaaacaggcagactttttcttgaaggtccagatagtaaatattacaggctctgaaggctgtaccacaaccccagttgtaagactgtcctgtaattcaccagtggaataatgaaacagtctttttcatacttgacttactaacttgtcttcagagtgtagataaataataaaaagtttactcatgctgtttattaatttagttacacatatttaaaataatgtgtataaggagataatattcattttaaattatggttttgtttttcacccttatatttcctgatgcagttcaaaggttttacagtgaatctttgacatcaagatcctggtcatcactagagccactttttgagtcagcaactttactccactttaagttgttggagatttagcacagttagaatccgtatgtgatgtcatcactggacattttatcccaagcccacagttgtatcccgctcccatactgagagtgggagggatgacctgcagcgtgccaccacatgtgtaccctttgagaaactgatctcaaggagccttcttgtgatgaacccctggctccctgccctggaataattagagaatctgtattaacaatttttgcctttttcccaagccaggtgactttttgtaagcatcacaaactagcagtggttgaggttctttcaggctgccttgcctccccgtcgagtattttctttgttgttgaaaataaagcagtgaggaggatgtccaataatcggggagactctgtaaggcctctcctccagtgcgttcacagactctcctcctcctgcctccttcagtcacactgaagccggctacctgcagttccctcactgctccaattcatgcccttcccactttccctttcccaaacctgcctctcctttcctaggtttgttttaaataacctatttctctaatgtacagtgttccttaagattttggattatgtcttttgcaggtgcaaattcctgggttagaaaacttgcaaatgtttgttccagacactcttgctgaggagaagagtattattttgcagttactcaatgcagctgcaggaaaggactgttcaaaagattcagatgacgtactcatcgatgcctatctgcttctgaccaagcacggtgatcgagcccgtgattcagaggacagctggggcacctgggaggcacagcctgtcaaagtcgtgcctcaggtggagactgttgacaccctgagaagcatgcaggtacagctcatctccatctttgcagcagtgttacttcaaggacttttagtaagaatgaactgttagctgctcatgaatgaggggtttgactaccctagtaatcacaagtatatacttcccaaaaatatgcctcaatgtgttaataggtcattttgcagcataatttgtacaatatatcattctgttaagttaaattatactggaatacttgaaataaaccatctatctggtttatatcttttcttagttcagtcatgtagttagatctgtggagctatgatctaaaaggagttatgtcactaatataatttgtagttctagaaatcccagttctccaagtactcaggtttactggttatttaattttaattttttgtagtgaaggctatcccctccctacctaacagggacctcgtgacagtttctataactcattagttataaactatgagaagctttctcatttatctgtgttcagcttaggaacagtcatggtgagtgttcatatgcaccttgagctcagcctcaccagaactgagtatacactggcctgctgcatccctcaccccaacaactctgcttttatattccgtctcagtgaatggttccgcgttcactcacatgtttaaaccagaagtgtgacagctaatataaattcagcctccca

SEQ ID NO: 15899 - DNA, 98701 bp, Human; identical to SEQ ID NO: 15898

SEQ ID NO: 15900 - DNA, 13284 bp, Human
cgccctccagcccagcccagccctggcccggccccacccgcgcggcacagccactttctccgccgaggcggtaccctaaccctgtgcctccccaggatcgcgggctgcaggcactcggttcccgaagcggaggccggagccgcgcggagaagccaacggtaatgacgccccctgccgaccttcaggaggggataggctgagggcctggacgaggtcggaagcgcttctactgcagctccggaaagggcttaccccatggggcaacagggtggactcgttctcccctccccgccatagagcgtatgactcttttggagtacttgtggttttagctctcatcagtgtcaaacagagatgctttgcctggtgttactgcttaacttctccgagcctcagtttccccacctatagcataagaggataagtgtgtcccctgggaggccatcctgaggtgctggtgggagtgccacccccagttccataccgcaaccgttcattattcccggggcctctcctcttcctccaggctgccctgggctggagcccctgcgacagaagttggctgccctgcagggggcccatgcctggatcctgcaggtcccctcggagcacctggccatgaactttcatgaggtaggtccccaggcttccagactccttcacgatggcctgggaaggctgagacccagcccagggaagatgcagagggcccagcccagataccctcccagcagcctggggtcgcctctgccccagctctgggggtaggtagagggtccgaggggaagggagtggggcctgcggagtgtgagccaggccactgggggtggtggtggggagagtgagtagaggggtgggtgggagtgtccacatgagcgggaaatgagcagggtttccaggtctaggtgagagtttctggggcccagggggagagggggtgacctctggggtttcaactcaggagtgagtttctgggcccctgatccccactcctccatctgtaggtcctggcagatctgggctccaagacactgaccgggcttttcagagcctgggtgcgggcaggcttggggggccggcatgtggccttcagcggcctggtgggcctggagccggccacactggctcgcagcctcccccggctgctggtgcaggccctgcaggccttccgcgtggctgccctggcagaaggggagcccgagggaccctggatggatgtagggcaggggcccgggctggagaggaaggggcaccacccactcaaccctcaggtaccccccgccaggcaaccctgagccatgtctgggcccccagcccctggggaggacctactgctcccaggggctgagaggggttcgggagcataatgacaaactgtcgctgccccagtggctgggtgtgtgtgggtgggatggggtgggggtcctgggccccccgtgtcttcccaggtttacaatcagagaatcacagctgctttaataaatgttatttataatacacggaaacaactctggagctttcttgggatgggacctggtgggtggacattcagtctcaggggtggggcccaggcagggctgcctctggaagcagttggcaagggtaacagatgctggaaaggggctgtaaggcccctatctgagcctatctcctgcctcctgagaagcagcagcagctggcctgcctgttgccccgcccccgtgcatggctgcccagcgctggccccagtgcccagcgtctccgcccagcacccccccggccctccctccccaccccccgcctccgagctgcggggagtcccagcctgggatctttgcctcatgtccttgggctcctgccctggctggcccgtcccccaccgccatgaggtgtcagattgtgtttccggctgcctcttcccgttgaccccctcctcccccaacacctgtcccctctcccgcccaccctcattccacagccctgtagacaggaggggcagatgcacgtcccagtcagagggatgggatggaggggccggtgctgacactggggctgctggctgccctggcggtgtgtggtaagggaagacaccctccccaccctggggtcccccgtgatgcttacccaggccccacaccgcatggctcctcactcactccactcccactctgccatctctccctgtggggggccgccttctggggtccccactcccagggagtggttgggttcccccctgctcatcccaacctcatggtccagcaggacctcagggcagcttccttcctgagtcccctgcccagggccccattcagtccttgtcgctgaccctccccaggcagctgggggctgaacgaggaggagcggctgatccggcacctgtttcaagagaagggctacaacaaggagctccggcccgtggcacacaaagaggagagtgtggacgttgccctggccctcacactctccaacctcatctccctggtgagaggccctccggtgctgggttgggagggagggcagggatggctttccagtaccaggatagccatggaggaagctagaagcccccacctggcctatggccactcccttcctgggaaacgtgctgcggctgctctgtgccctgagaggctgctgtcctgcccctccagtgtcagctctgcggtgtcccccaaccacacccatagcatgccccatctgtgacacacttcagaggccactggtcctctctgctccctggcggcctacccactcctgactgcgagtgatcagggcccagatgccacggtttccctgggtgccaattgacagtgggtgaatgtaggctgggtgtggtggctcatgcctgtaatcccagcactttgggaggcccaggtgggtggatcacctgaggtcaggagctcgagaccagcctggccaacatagtaaaacctgatctctactaaaaatacaaaaattagccgggtgtgatggtgtgggcctataatcccagctactaggaaggctgaggcaggagaatcgcttgaacccaggaggcagaggttgcaggttgcagtgagccaagctcgtgccactgcactccatcctgggcaattgagcaagaccctggaaaaaaaaagagagagagagagagagagagagtgggtgaatgtgtgcggataaaagaatgatatggccctgaaggatggccctaccgtctaattacagaaagaagttgaggagaccctcactaccaatgtgtggatagagcacgtaagaatgcccctcccagccgggcgcagtggctcatgcctgtaatcccagcactttggaaggccgaggggggtggatcacgaggtcaggagatcaagaccatcttggctgacacggtgaaaccccgtctctactaaaaatacaaaaaattagcttggtgtggtggtgggtacctgtagtcccagctactcgggaagctgaggcaggagaatggtgtgaacgcaggaggcggagcttgcagtgagccgagattgcgccactgcactccagcctgggcgacagaacaagactccatctcaaaaaaaagagaatgccccgcccagagccggtggggtcggggagggaatgcagggcaccagattgcttctgcatggagatcccgtctgccttggacactgttctccaggaggggttggtgcctccctacagggaagccccaggcccaactgtccttcccccacctagtgccctcaccagccctgatgtcaccttcaagtggattaggattcacatgttggaaaattgccactttatcttgatgtttattagaaaacattctcttcctgcctgtcaaaagtccacagtacagacacaaatcgtctatgctcacagtagaaataatgctcccttagttgtgcagtgagcatcctgcacagctgtccatgacagacctgaatccgcactctgtacctgccttccccaaacctcttttgtcacagctctcagaccctgttcagtcttctctcagggaagtggggggagccaggagcctggatggctgcagagtgcactggtgacatgcctttgggattccagggctggacagacaaccggctgaagtggaatgctgaagaatttggaaacatcagtgtcctgcgcctccccccggacatggtgtggctcccagagattgtgctggagaacaagttgagccaagccctccctgacctcccctctgtcaccctgcctcctttccttaagcctcctctgcctcccccaactctgccagtcgtgagtggccagagctcactatggttcttgtccctgtcccccagcaatgacggctccttccagatctcctactcctgcaacgtgcttgtctaccactacggcttcgtgtactggctgccacctgccatcttccgctcctcctgccccatctctgtcacctatttccccttcgactggcagaactgctccctcaagttcaggtgtgcccttttctccagccacccctcaccccaaagcaccctgccagaggccaaagaaggtgactgaagcaccctcagacagaggcccctgccctgtctggattagtgctgccctccccacaatggtcctcccttaccagcccttccccactctgtggccccagccactggccgagtgtcactctctgcccattgccctccccagttccctcaagtatacggccaaagagatcaccctgagcctgaaacaggatgccaaggagaaccgcacctaccccgtggagtggatcatcattgatcctgaaggcttcacaggtgctgggaacagccgccagtgggtgggcaggtccctcagacacacacagacacactggccctgtccaccccagagacacacacgtgcacacacacacacacttaggacaccaatacacagctcctcacacacgcagctagacacagaagggcagacacatatccgcccacagaggagcacacagacactcacacttcctgaatgcaaagctatcccaaaggcagagagagaaggtgccagggccctccccatgcctctgcccaggcccggaagtcatgcttctcccacatgagatgcctgtggctgacaggggtttagtctttcctgtgcctggtgagcccaggggtgtggttggcatgagggctgtgttatcctgatgggggtgtctgccacccctcctgacatcctcatccccgatctgtacccaggctcggatcctccatggggcctaccacttgccctgtccatcagaagggaccctgtctcactgtctcaggctggcacatcatggcagggatagttttactgtcactggctcattatccccaaggcccaggccgaggagtggctcaattaatgtccaggaggcttttctttgttactcaggaagacaggctcaatgtctgagagcatttgtttgacttggtgtcttaatctgcaatacctgtttttggctcgtgtatcttttgagccaaaagatactccttatttgagtcctgtatggcctcagcttctattttttccgaaaagataaaaaagaaatcagtcacagaggaagatttcccctcacagatggaaacttccatcccgaccccccagggaacgacacccaccaacgggaccccgtagacagcccatctgcgtctctggactggcttgccctgcccagcccctcattctgtccccaggccctgcctagcccccttggcctggcctgaccctaagatgtccatgtgccgccctcagagaacggggagtgggagatagtccaccggccggccagggtcaacgtggaccccagagcccctctggacagccccagccgccaggacatcaccttctacctcatcatccgccgcaagcccctcttctacatcatcaacatcctggtgccctgcgtgctcatctccttcatggtcaacctggtcttctacctaccggctgacagtgagcctccaggccccgtcccctgctccccctccccaagcccacctgagcacagccagccccagccctgccccctcacttcctcctgggagccacctggggtctccattcctggagctccctgcctggatccaggtgtgagggccaggtggccacccagagggagggctgtatgattctgggcaacatccccaaatggacagggcagggcatctccaagatgctacttcccacggactctcagaagaactgctaaactgtccctctgtcagggcagagaccaagtccctcacggtcaccagtgtgtgaccgtgggcctggcacacaggaggccctcaactgttgaaccagtgggtgaataacagggtctctaggacagtagggtgtgaggcagaaaacccatctatgctcacctgactctatgaggcagtggtttacaagttcagagtatttactatgagcagggcatagtgagtcccagggtcaaaggccacccagcccctgcccccggcaggacttgaggagggagaagtggggcaccttccatctgcagtggggttgggagggcttctagaggaggtggagtttgaatggacttgagcaggattgggtggggctaccacaggcaggaggagcaatgccaataaggagggggccaggcaggggctgaagggacctcagcaggggagccccccttcccgcccttgccatcacgtgcaggagctcaggtgggaagagcaagacagcactgggctggggtctctgagtgaggggctgggagttgaggtgttatcctggttctacaaggacaacctggcactttctaagcggggagtaacgcacgcaggtctgtgctccaggagggttcagtggcgtgggtgggttgtgacagctgattttcatgagcacttacccagtgccaggcagagtgatgcgtgttaaacacactctgtcaccacatttaacagttgagaaaactgatgcacagagaggttgggctacttgcccaaggtcacccagctagtaagtggcagagctgatatttgcacccaggcactctagctccataacccgtaattttcatcagggtatgatggtactacagaggtgccaggggccacagcgggaccctctaggaccggtgccccaaggtcacagctggaccctctaggaccggtgccccaaggtcacagctaagtctggcttccccaggtggtgagaagacatcagtggccatctcggtgctcctggctcagtctgtcttcctgctgctcatctccaagcgtctgcctgccacatccatggccatcccccttatcggcaagtgagtgacgctcaagcccggcctcaccctgcttgccagcccagccctgggagctccaagctgagtgtttgcccacaggttcctgctcttcggcatggtgctggtcaccatggttgtggtgatctgtgtcatcgtgctcaacatccacttccgaacacccagcacccatgtgctgtctgagggggtcaagaaggtgagtacttggcccggcgcaaaagctcaccactgtaatcctggcatttcaggaggctgaggcgggagaatctcttgagcccaggagttggagaccagcctgggcaacatagagacacccctgtctctataaacaatcaaaaaaattagccaagtgtggtggcgcatgcttgtattcccagctactcaagaggctgaggtggatcacttgagcctgggaggtcaaagctgcagtgagctgtgatcgcgccagggcactccagcctgggcaacagagtgagaccttgtctcaaaaaaaaaaaaaaaaaaaaaaaaaaagaaatgagcactctcaatagccaaaagctggagactaagccaggtacagtggctcacacctggagtctcagctactcgggaggctgaggtgggaggatccctggaacccaggagttggaggttgcaatgtactatgatcacagttgcaccccagtctgggcaacagatcgagaccccatctctaaaaaaataaaataaaatgaaaagcagggaccgggtgtggtagctcacacctataatcccagcactttgggtggctgaggcgggtggatcacctgaggtcaagagttcgagaccaccctggccaacatggtgaaactccatctctactaaaaattcaaaaattagccaggcgtgatagtgtgcgcttgtaatcccagctactcggggggctgaggtacgagaatcgcttgaactcgggaggtggaggttgcagtgagccgagatctcaccactgcactccagcctgggcgacaagagacaagagcgaaactctgtctccaaaaaaaaaaaaaaaaaaaaaaaatctggaacttgtccaaaggccatctgtagaatgggtaaagacactggacatatactcccacgggagtgccgctcagccgtgcagaagcacctgcggctgctgcagccctgcacgtgtgaacctcctggcacagtgttccgtgaaagaaaccagacgcagcagcacatgctgcaggcctcactttgtaagaagttcaagaacaggccaaatcagtgtttggtgatggaagtcagaatggtggctatctctggggctgggagggtactgagtgggggcaggtgtgagggagatttttggggatcatgttcactatctcatcactggtgatttacccagtggaatgcatctgtaaaaattcatctagctatatacttaagatgtgctcattccactgtatgctgcaactcagaaggaagaaggggaggactgagtgcagggtgctcaggagggggctgcccttgcctctcggctgctgcagggccggctggctgttctgggacagctgaaggcagtttagcaactcttttttttcttttttgagatggagtctccctctgtcgcccaggctggagtgcagtggttcgatctcagctcactgcaacctctgcctcccaggttcaagtgattttcatgcctcagcctcctaagtagctgggattacaggcgcccgccaccatgcctggctaatttttgtatttttagtagcgatgggtttcaccacgttggccatgctggtctcgaactcctgacctcaagcgatccacctgcctcggcttcccaaagagctgggactataggcgtgagccactgtgcccggccttagcaactctttttgtctttcagcatttgatgggggagactctagcatttggagcatttaccttagtttttggtctttaattaatcatttttagtgaatgggttctgctccgcaccatgggtgatgtgggagagctggaagcaacctgcatgtgcatcagtaggagatcggggaatcaatgacagagtcagacgggggagcactttgtggcagccaggaatgaagtcacagatgttaggatgtgtaaaggtcaccccatgcttgtaaaatggcctttttggccagacacggtgcctcgcccgtaatcccagcactttgggaggccaagtcaggcagatcacgaggtcaggagagcaagaccatcctggccaaaatggtgaaaccccatctctactaaaaatacaaaaattagctgggcatggtggcgcgtgcctgtagtcccaactacttgggagactgaggcaagaaatcacttgaacccgagaggtggaggttgcagtgagccgagatcgcgccactgcactccagcctggtgacagaatgagactccgtctcaaaaacaaagaacaaaaaacaacgcctttcttgtggccccttgacatggccccagctcttcctggagaccctgccggagctcctgcacatgtcccgcccagcagaggatggacccagccctggggccctggtgcggaggagcagctccctgggatacatctccaaggccgaggagtacttcctgctcaagtcccgcagtgacctcatgttcgagaagcagtcagagcggcatgggctggccaggcgcctcaccactgcacgtgggtccccgctggtcttggttttcagcccatctgtgggaggtgggtggaggcaggcctcacacccactctggcccctcgtctgtaggccggcccccagcaagctctgagcaggcccagcaggaactcttcaatgagctgaagccagctgtggatggggcaaacttcattgttaaccacatgagggaccagaacaattacaatgaggtaagggaccacaggattgccatgtacaggtgttcaagtagggcactgattaagtgtattctatcttaagagggcagggttccccttagaggcacacaccaacttagatgagggagttaatgtgacacagattccaggcccccccgccagggagagagaactcctgcctggcaccctatagcagcactggggccaggcacacacacataggcacacagctccaccctgtccaggccacactctgagcatcccttaggatcccttctttctcccagctgccaatcattttctgtccctactcagttccaagcctgatactccagacagaaccagacattttaaaggtagccatatatggttattcaacattatacaacttctaaaaactatctcttgagaaagggcaccttttcccagttcacatatgggctggcagcagccctgacttgctgagatgggggagaagaagagaggggtctatccaccttcctcagcccctaggagagacccctgggcctcagttcctctctagccccagagccctgtgctacagcagagagggaggctatggtctgttcccgcctcctcaacagagtgatcagccctgcctgtggccagaggggcctgggaccttgctggggacaagccagcattatcctgcaagcccgaggcagcctctgcaggcacactgagccgccctctgcctccatggctgggccccagcttgggggtggggctttgtggcctgaggcccttctcaccccactctctctgcccctacccacaggagaaagacagctggaaccgagtggcccgcacagtggaccgcctctgcctgtttgtggtgacgcctgtcatggtggtgggcacagcctggatcttcctgcagggcgtttacaaccagccaccaccccagccttttcctggggacccctactcctacaacgtgcaggacaagcgcttcatctagggtgggcctgttggggagccaggagacagcagggtctgagagaggagccacagtccctaatgacacccactcctagccctgaggctcgtgcccctcagactggggaagagtccaaggaagggagggagcagccactcctcaatgctcaatggctcccctgaaatcaagacaggggccacccgagatggtctgagggtggacatcggctacagtgggtgggcaggacgatttggggggaggcccgaggctggctcaggggccagggaggaggccactcagggtggcctcagggggagagctctgataggggtgagacagatagggccccttctctgcttctcctcccccaaggtgtggggtagagcaggcaggaatctgcgccttcactctctggcccctccagcctccctcttcctacctacccttcaacctcaggcttctgaggcctcacctgggactgaggttgaggacacctccctccctccagaccccagagtatcctttcctagctctttctgccttgacctctctgcctaggtccctttgggaagttgaggactggagtggaaaggtcaggatcgacatccacaaagacttggggtcagcctgaggttgcacacacaatcctagaggaccagaacgcagcacctctccccaaagggtccctgccccccagcacctactcctctccaaattagggttgtcatgcattatttggggcatacatattctaaaaaatcattcgttgtttctctgaaatttgtcccctatttttatttgctaaatctagcaaccctatcccaaaggcagcctccactcaatcttatcctgagggccaaaggccaaggctgcaggaattgggagacaagggtctgtttgtatggtggtccacctccaagatggccccagtgatgcccagtattcacacccttgtgcagtcccctcactctgtaccagggtgggtctgggtaaccaatagaatgaggcagaagtgatggtacctcacttcccagatttggttaggaaagacactatggcctctttcttgctcattagccctcattctcacatcagttggatctctcactttggggaagccagctggcatgttaaggagccctatggagaggcccacatggcaaggaactaaggcctcctgccaacagccacgtgagtgaatgtggaagtggatcctctgccccagtagggccttcggatgagatcacagcccagtagacatcttatgtgcagccccatgaaagtccctaagccagaaccaccagctaagtgactcctggattcctgacccccagaaactgtgtgagataataaatgtgtgttgttttaagtgacaacgttttggtgtcatttgttacaccagcaatgtgaccttgagtgagctgctcctcatctcactcctcaccttccatcttctaatctgcaaaatgtgtgtctagtaagtcctagtcatggggtgttgtgaaaattgaatttctagtaggagcattttcatgtgacctgcacatttaatgggtggtgatttaacccatttccctcaggggggaattggtgacctcattaactcagatatacagaaggtgagatttttaatgtttagatgtaaccaaggaaaaagaaaaaccatttaaaaccaaaactgaccctagtaacttctgccttccagcatgaactattcacaaaattcaaggtacaaatctttaattgtcctgtctaaataggaaagccagtttgttctcacacctgtcaggtgagcaggaaatctgagacttccccaggaatagcccatcaactcagggagggtccgtcttgtgcacagagagtctagggccctcagccacagtctttgcttctctctgcctcatggtggcgctgctggcagcaggtcttggttcaaccaccaggtgagtcctcagttctattaggccctgctcaagtggctgtggacttccagagaagacaaccccaaaatgtcacacaaaaccgggggggtgcctcctgcacaggctcccagggtcaccacagtttccaccagaggcacccactcccccagcacggtggtgctgtcaggactggtccactctgactgacatagaactccatcttctgtccccaggaagccatgctcacaggcacagctttccgggaagccagagagtgttcctt

SEQ ID NO: 15901 - DNA, 7398 bp, Human
gtctcactctgccacccaggctggagtgcagtggcatgatctcagctcactgcaacctccacctcccaggttcaagtgattcttctgcctcagcctcccaagtagctgggactacaggtgcatgccaccacacccagctaattttttgtatttttagtagagatggggtttcactgtgttagccaggatggccttgatctcctgacctcatgatccacccacctcggcctcccaaagtgctgggattacaggcatgagccaccgcacccagcttgtattatttcttacaactacttgtgaatctatagttctgtcaaaaattccaacttaaacatgaaactcagggtggctataaagcctcctgactcaccttgactttggaatcaatcaatcaattaattgaggagacccattagtgagtctcctctgactttcagccaagaatgttcctaactcagcaagatgaagcaggaggtagaggaaactaagggggcaacaagcagggggcaagaaggacctatgagagcgacatcttccctgagagccccaggacgaccaccgggaagccaggagggcgcaggcaggaggacccgggaaagctcggcctgagggaggccctaggcgtggtggggagtggggcagggcaggcagaggctgggcagcaggtgaggtcccctgggttctgagggccaagcctggggtttgaggtaaacaggctcgagtggagaaggggctgctgtggttgggctggggtgggtggagctggaggagccttttcttcttgaaccagtttttgaattgtgctacaaaacacggtacatcaagtttacctccttcaccattttcaagtgtacagggcggcagtgttgagtacacgcacagtgttgtgcagctgatctccagaacattctcatcctgcaaccttgaagctctgtccctattaaactccaactctaaccctaaccccaaccctaacccattgcctcctccctcagcctcaggcaacctccattccacttctgtctctatgtatttgactcccctcgggacctcagagaagtgtgttcgtgcgtatttgttcttttgcactggtatatttcactgagcataatgtcctaaggttcatccatgttgtagcaggtgtcagggtcgcctttgttttcaaggctgcgtgatactccattgtatgtgtgcaccctgtttggtttctccatttctcttttgctggacacttgggtagcttccagctcttggctgctgtggataatgctgctgggaacatgggtgtgcagttatctgttcgagtccctagttcgcattcctttggctacacactcagagtgggatgtctggactgaagcaatacttttgaactcagcctgaggttaccaaactctctgaactccttatcagaggctacacttctgggtgttccccggggcccatggaaaacagactcaccccaggctccatctacctgtgcaagggaacaggggtcaacctcaagtgcacaggctgctctggaagacccagcccaggtctggctgacccagagcactggccccttcccagcctgcgtcctcaggacataggtgtgggcacccatatacaccaagtgggttctagggcagccaggccacccagtgtgcctcctttcacactcctctggggctcgtgacattacgagccctaacccgggccctggcctaggctgtgtgtttccagtctcacctctcttcacaccttgaatgaggtgaatgaaggagtggcaacgcgtctcccacaagacactgtgagccacacccagtcccttcccttcagcaagcttggcttcaggtcacaggactgggcggggtcaagatggacaccaggggtgtggggagggacgtggagcatttacagccaggggcaaagtcctcccctgatttaaacccaggcagcctgcgctgcagccggttcctggtgtccccacttcgcctccctcctgctgcccccaagacatgcaggggccctgggtgctgctgctgctgggcctgaggctacagctctccctgggcgtcatcccaggtaatgaggctccccaagctgttccacacacagggcaccccctcagccaggctgacctgatctctactctccccctggccagctgaggaggagaacccggccttctggaaccgccaggcagctgaggccctggatgctgccaagaagctgcagcccatccagaaggtcgccaagaacctcatcctcttcctgggcgatggtgagtgagcaaggcctgtccagccccgtagtcctcacagccccggcacccgggaccttcagtggttccaggacaaccctggggcccaggactcacacatttctgctccttcagggttgggggtgcccacggtgacagccaccaggatcctaaaggggcagaagaatggcaaactggggcctgagacgcccctggccatggaccgcttcccatacctggctctgtccaaggtaagggctgggccacctcagagtcctccaagcagaggagagggatcaaggatatggagtgtggcaggagggagggagccaggacagctggggcctaagttaggagctgggagcagttaggatcccagaggaccagaaccaggtccttggttggggtctgggtgtccgccccgaagtagagctcagggtgtctccgttcgcagacatacaatgtggacagacaggtgccagacagcgcagccacagccacggcctacctgtgcggggtcaaggccaacttccagaccatcggcttgagtgcagccgcccgctttaaccagtgcaacacgacacgcggcaatgaggtcatctccgtgatgaaccgggccaagcaagcaggtgagctggggcccgctgtggggtcaggaccaggcccaagatctcggtcaccgatcctgacctctgtcaccctcaggaaagtcagtaggagtggtgaccaccacacgggtgcagcacgcctcgccagccggcacctacgcacacacagtgaaccgcaactggtactcagatgctgacatgcctgcctcagcccgccaggaggggtgccaggacatcgccactcagctcatctccaacatggacattgacgtgcgacccccgggccaagggctggggctgggcagaggggaaggtggcacaggctcagatccaggcaaccaaaagcctgatctgggtcagcaggttctggaggtggagttggggatgtagaatgtgcaatacaggctgggccattcccacagccctggggaggggagccaggggctatgcatgaggagggggcacggggccagccaggcccccaaaccacctgccccatccattgtcctcaggtgatccttggcggaggccgcaagtacatgtttcccatggggaccccagaccctgagtacccagctgatgccagccagaatggaatcaggctggacgggaagaacctggtgcaggaatggctggcaaagcaccaggtgatgggggctggtgggtgtgggaggcacggcagggggaggccaagtgtgtgggtctcagggctgtgggctgaagcctggctctgtccctgcagggtgcctggtatgtgtggaaccgcactgagctcatgcaggcgtccctggaccagtctgtgacccatctcatgggtaatgacccccttcctgccctggcattcctcagacaacctcagagggtgccatccgagcctgtgtgcccatttgccagcaccctcccgctcacagcctgccaatcaccaccaagctccttgtcccacaggcctctttgagcccggagacacgaaatatgagatccaccgagaccccacactggacccctccctgatggagatgacagaggctgccctgcgcctgctgagcaggaacccccgcggcttctacctctttgtggagggtgcgtggtggcccctggggagtggaggaaggcggggcgcggcagggcaggttcaagcatcacccccctctggccttcctgcaggcggccgcatcgaccatggtcatcatgagggtgtggcttaccaggcactcactgaggcggtcatgttcgacgacgccattgagagggcgggccagctcaccagcgaggaggacacgctgaccctcgtcaccgctgaccactcccatgtcttctcctttggtggctacaccttgcgagggagctccatcttcggtaggcctggggagagtggcaggtgctgctgcatcaattatgagggtgaagtttgagcctcagtttcctcctctgtcaaaagtgtgcaatgctggcaccagccctatagggatcttgtgaggaccgagcccccgaacaggcaaaaagtggcggtgcctggcacataggaggcactcccacagctgtggtcagctcaactacagggacccgcatctccctacagggttggcccccagcaaggctcaggacagcaaagcctacacgtccatcctgtacggcaatggcccgggctacgtgttcaactcaggcgtgcgaccagacgtgaatgagagcgagagcggtgagtgaggctgaatggcccgtgcagggggaccagggtgccagggatgggggcattcgcgggagggggacgccgcctgcctgccctgaagtgcactcaccctcctaccagggagccccgattaccagcagcaggcggcggtgcccctgtcgtccgagacccacggaggcgaagacgtggcggtgtttgcgcgcggcccgcaggcgcacctggtgcatggtgtgcaggagcagagcttcgtagcgcatgtcatggccttcgctgcctgtctggagccctacacggcctgcgacctggcgcctcccgcctgcaccaccgacgccgcgcacccagttgccgcgtcgctgccactgctggccgggaccctgctgctgctgggggcgtccgctgctccctgagtgccccactccggagttatcctgctccccacctccgggcgtcctgccctgttccccgtcctgagccgccacttccagcgaacacacacaggtgtcctgccgttggaccttcacctcctagagataaaccagcctcagctggcgcagcggggcccttcttccctccgcatccccttcagggagcaggagcccagggcgccctgggagctgagcctgggacttccaggacctcccctcaggttgttctctgattcttcctcccaaccccagagactgcagatttgtgccatgcggctgcctgcaccccagacaataaagggaccaaaaccacccaacccccaccctgcctctatcctaaggaagaccaagcaggcctggacccagagacgtcccccatcgtgggacacgacacacccagaccgcgtgccccaccgtcttagcttcaatcctggcagcacctggtagacccaaggacttgggtggatcaggacacctgaagaagagaagcttccggcaaccctgcaacccacccaaggaggctactggatcggggattcccaggggggctttgacacagtcctctgctgtctccccactaggatcattccacacccctgcacctgaccaagggaccaatgaggcagaggcttgccccaagtcacagccactcagatgcttcctgccccccagtgcccattccaggtcaccagatccaaggagcgcttgaggagctctgggtacagggcagcaacccagagcccatgggccctcccgggacatctggatgctgggcatagatttctcaacaaggaagactcccctgcctcctcaaggtctccattctcctaggagacaaagcaataataaaaggtgttagacaatgtaatgccagtactacttcctaggagaaaaatcatgagtgagtgtgggcacagtatctggagaggtggataacgcaggccaggaggtactgctgaggggcagatgattgagcaagagacttgaacagagtgggggcttgagcaaggcagcacagcagtgcaaacgccctggggcagtgtcagcaggtgctctgggaggccaagggctggatcagaggggtgggggtgggtgggcagagtggggaaagcctgaggggtcaggagagtggggtgtgcatgggggactgtgaagtctggttagaggggtgtggttggaggtctttgaggagggctgtgacctgccctggttgggaaataagcactctggctgctgccaggagaagggtctggtcttttgggcagagggtgggggtggtggcaggctcaggtgaaagctggggaaggagctgactccaggtgtttctgacctccctctgaaagtattctggagcgcccatcccaatacagccatacttagtgagtacacacctgctccaagagaacattgaaaagaataaaggtgaaatcaaccacattttccagcaaattttgcagtattacaaatttatttgtacatttacaaaggtgcaaaaaagcatcttgcttttgcaagaaatagtaacatcattcaatatgctttcttatttactaaaaccttgaaataaaattgtaaaacatcagtttgaaggcctgactctcagggtagttcttttttaattctgggttttagtagctgtcacaaaaatattggaggaccatgatcccacttgtgaatagccataggactccagcctgggaagcatagcgaaaatctgtgtctaaaaaatgaaataaaaggatgaattttatggtatgtaaattatatctaaattttaaaaaacagattcgaatatataatctgctttcaagtttttttaaatgtgtagggatcagggttttatcagtcaaatacattttttaccacaaaattcacatgtcaatgaaaacattctcaaactttggttctaaaaaatgttttctttggcatgagttttcattccaagatgattactttctcattttttcattgaaaggacatctttaccttgaaggagcagatgcaagaaaagtacaattatttttcaagctttttcctgattgcctaaaacagacagctcttgtcatctcaaaagtgtcagcattttggtctttaggaaggagggagcccgggcgcagtggctcacgtctgtaatcctaacactcgggaggccaatgtgggcagatcatttgaggtcaggaattcgagaccagcttgatcaacatggaaatcccatctctactaaatatacaaaaattagccaggcatggtgccgtacacctgtaatcccagcactttgggaggctgaggcgggcggatcatttgaggtcaggcgtttgagaccaccctggtcaacatggtgaaaccctgtctctactgaaaagacaaaaattagccaggcgtggtggtgggggcctataatcccagctactccggaggctgagacaggagaat

SEQ ID NO: 15902 - DNA, 22471 bp, Human
gtttttaatggcatctaaaatggtgaatcctttccagaaggttttcaatttgctttgcccagatccatcagagacatcactatccatggcagctagagccttatgaaatgtatttctcaaataataagacttgaaggtcgaaattaccccttgatccatgggctgcagaatggatgttgtgttagcaggcatgaaaataacattaatctcctcgtatatctccatcagagctcttggatgactaggggcattgtcaatgagcagtaatattttgaaaggaatcttcttttctgagcagtaggtctcaacagtgggtttaaaatattcagtaaaccacgctgtaaacagatgtgctgtcatccgggctttgctgttccatttatatagcacgggtagagtagatttagtataattcttaagggccctaggattttcagaatggtaaataagcattggcttcaacttaaagtcaccagctgcattagcccctaacaagagagtcagcctgtcctttgaagctttgaagccaggcactgacttctcctctctagctatgaaagttctagatggcatcttcttccaatagaaggctgtttcatctacattgaaaatctgttgtttagtgtagccaccttcgtcaatgatcttagctaaagcttctggataacttgctgcagcttctacatcagcacttgctgcttcaccttgtgcttttatgttatggaaatggcttctttccttaaacctcatgaaccaacctctgctagcttcaaacttttcttctgcagcttccacacctctctcagctttcatagagttgaagagagttagggctttgttctggattaggctttggcttaagggaatgttgcggctggtctgatcttctatccagaccactaaaaccttctccatatcagcaataaggctgtttcgctttcttatcattcgtgtgttcattggagtagcacttttaacttccttcaagaacttttcctttgcatttacaacttggctaactgtttgccgcaggaggcctagccttcggcctatctcggcttttgacataccttcctcactcagtttaatcatttctagtttttgatttaaagtgagagatgtgcgactcttcctttcacttgagcacttagaggccattgcagagtcattaattcgcctaatctcaatattgttgtgtctcagggaatagggaggcccaagaagagggagagagatggggaacggtctgtgggtggagcggtcagaacacacacaacattaagttccacgtcttataaaagacgctgtatgtggcaccccaaaacaatgacaatagcaacatcaaagatcactgatcatagatcaccataacagacacagaaatcatgaaaaagttttaaatattttgagaattaccaaaatgtaacacagagacaccaagtgagcacatgctgttggaaaaatggcgctgatacaattgctggactcagggctgccacaaaccctccatttgttttcagaatgccctatctgcgaagcgtaataaaacgaggtatgccatagtacagtggcgccgcgaccgacaaaggaaagcctccgggaggtcaaaagagataccagagagtgcgtcccgcactggaggaagaggaaggtttttaccaagcagcgagtccagagcccgcgccgtcaacgacgcggtgctgccttttttccgagccgctgcgggagggggccaggacacgctcccttaggagagcgggcgggtcacaaggacctggacagaggcagaactgaggccagcagccagctccgccgctgagtccagccctctgcgcagccgccctgagctggcgtcccgagatagccgcttccaaaccgggcctgcgcgccgacgttccgctgcgccccgcgcaaaaccggaagtacccgggcccaaggctgagggacccggtggagcggaagtcactccctgaggcagtggcgacagcggcggcgagaggatgaacaacaagttcgacgcgtgagtggctcgtggccgcccccggggccccttccccgaacagttcccccgcgcccgcccccgctggggctggggcggcgcaaaccctgcggcaccggcttccctgctgggatccggctgcggccggacctggcctggactggcggggaggagggggctggggagcaatggataccggagtcccggagaccccagggccgtccgaaccgagggcgaagagctgggcccgggggaggggtggctgtgccgcccggtagggggagattttcggacgccccgccctggtggatgcggattgcctgcgacgtggaggggtggggacctcggcggtttgggtgtttccgcagtctggcagcgctgcctctgaatccagctttccccacacactccctctcccctctgagcctcagttttctcatctgcagagtggggacggtaacaccctttgtcgtagagtttggaggatgcaatgaggtaatgtggttgctgccctcgacgcggtggaaggctggcttaggaattatcttcctgagactcttcctactttctttctcctccccttcccgttcccgtcttccaacacactcgccaagacctaagtatacttgttgccctctcctgcccgctccggtttctagtttcagcatcaaacagtttggaggtacagagagaaaatgcagaagtatctttacttatccccctccaaggattgtatcttgaggtagaatatgttccttcctctcttctagtagtctagtaaatcgactgtctcttcatccgaaaacctggatttctagtcccagattcaccacttaccatctgtttgactgtagaaaagttacccagcctctaagccattgttgctcaaaccacattagtggctaggaccctgctgccacgccggggtgtgataagggtcagatcacactcagcgatgcttaaagatgcttgtgaacattgctaactattgcgatataaacgtaaagtggaattactattagtttaggttgtgacctggtgcttttgatgggaaattggggtgtttccaatacagagagtactgtgcaaattcagggaatactggatttccaacactccaggcaggtaggtcctcaggaatgttttctggttgctgagaggtctctgctacttgagaaagtctttgcccgacctcttctctatcctgctgtttaactgagcctgtccctctacgaacctctcccccgctgccgccccatttcatctctattgtaaaccctgcaacaactagctccagatccaaatcctgcctcagtggagctttctggaacccttataccccttcctccactgatttgaacaaatcaaatgtcatcctaagaagacatcttatgggtcatctagctcaagcctacccaaatcatttgggagtctgcagtaagaatggtaataatggacttccacagggatcttgctaggtatttttcatatatatatatattttttgagacagggtctcgctgtgtcaccctggctggagtgcagtggtgtcatcacagctcactgcccactcaacctcccgggcaccagcaatcctcccatctcagcctccagagtagccggactacaggcatgtgccaccctaccttgctaatttttttgtattttttgtagagacggggtttcgccatgttgcccaggccgatctcgaactcgggctcaagagatccacccaccttgcctcctaaagtgctgggattacaggcatgagccaccacccccagcctcatatgttatttctactctaacaattctgtgaaggggatcttgttgtctccttttacagatgaggaaagtgagactctgaggttaactaatgcccgacacaaaggaagggctatcccaggtttgttgtgtaaccttggttcaagcacctcttgagaaaaattaaacttgccctcttttttttcttacctcttctacgattgaagaacctgggtcattttaattactttgaattattaactattgtattgagccagaatcttttaacatctgccctctagcattgcaggaaaaaaaaaagaaaaacaagctttctttcatttgaaattagcaattgaaaacagcactcctgcccctagttttatttttttatgttgtttttcattcagaaattctgcggtgtttaggccattgctgcatatttggagtctttaccacattgctctctctagtaatctgcactttttaccacattgctcttaaggacatgttccagtttgccagaatccttccagatgtccagtggctggagctgagtacagtagtatataatctaatgggctcatattaaagattagctctaatctccgttactgtatggactcaacttctctgaatgaaacctttgattgtaattgcttttgtggagaaggggtagacctatcaagtccttagatctcattgccattgatcctattgataacgtaaaaccgtaaaaactgcagtcctgacttaaacatagttttcagatctacacaactgtacttgattttgtccgtattctacatcatttgctttttattctatatcgttaactttgggcccattcctaactattgtctaaaccacttatttggcactcattgctttgattctatagacccattcattaaacggagattttttttatgccactgtctgatggtgagggtataaagatgaattgaaccaaggtcctgcccacaaggtattggtctagttcagagggtgaggaaatacgtgggcagaagcttagcaagctaactaaagtgcctctcagtctggacagtctcagacttgctaactgcctaagtttagggagcactgatttttcagtctgagttgtatcttgactcaaatccagcttgaagctgggaagagtagcttgtaagatttgccttaaatgtaggcttagagggcagagtggttggttagttccactctcaggtaataaaagcaccagatataggtccattagggttcccatttactgtcttagaaaggagccctaagtggtccagggatcacaggagcattgtttcttctctgacaattatttttgtttcctggtagtgatcagcagcaaaaccactaaaaagaaaggaaggtatatacttttcttgggtctagcaaaaacaagatgctgggatgactgtacccctcttcaaccaagatctaaatgcaagggaccccagaggctatagtgggagttggaagctaagaagggaggaaaagggtttgcatcccaagggtgtgccctgaagaagagagttgtcctgggcctaagcagaagaacctttgagatgtttttgatcaggagacagaactggccatgagagtatagctggaacaagtacaaacatttatatgggcaagttcagaagaggagaccccaactcagcctaggttggaagaggttaggaaatgttgccaagagaaagtggccctcaatctgagtcctgtaggacaagttaactaggcaaagaaggacttcttgaggagagaccacatgatgagcataacagaaggataaaatgggggcaccaaaattagggtgatacaactggagtgaaaagagtttgttgggaccagggaggagatgatattgggacatgtgagcagagcaggggcctttgcaccatgctgaggcgtgggtatatctgtgtaccttttctcctcagctaggttcttggggacaagcactctggtagctcatacacaccatagatgcttggtagatgttggtaatttttaatctgtagatcttgtgtgctagacaggctccttttgaaaaggaaaccaaatgtttaataaaggggaagtttaataaaggggaagggaatatcataagtacagatgatggtctcctggaagtccagggaggctgaataaaaccagagagatggtagcattagcaacaaaatgaaactcccctccattttctctgctcatctgctccattctcttatctcatactggctttctctgcttttgctcattgtcttaattctctcagggcttttcttgcatggggcccatatggctgccccagctcctgagtctatgatctttcatctcctggatgaaatgctgaggggaggaatctgctcatatttttgagcaaggctctggggcataggttattgcccaggctggactaccctttggtcaggtgcacttcctagttgtgtcttgaccagggtagggatgggaaggttcatggcacagggcataacctcctgggtatatcctacagctagggctgtgaaatgggcagagcaggcaccccaacatgtgactagctcattcattctaatatttattggatacttttaatgtactaggcactggggattcgtgggcaaaaaaaaccagaccacaaatacaaagtaccctgcaacatgtttatgtgtcagcatagggtagtatctgaattataactggagcatttctagtaccattcttgagaactgcctaattttgtttgaccacacatatagttattggggcgagaaagatgattggagagaagatctgtgatgaattaatggtccagccctagaataaatggctttcttattgtctttgcaaactcaccttccatttatctttttgtctggatccggtgattttaggtgtacctgaaagccttggggtagtttcactgctcatgaaagggtaatccctaaagttcgtttgactctgtgcttatgaagcaagaacacatttattctttctttcagtcatttatttttccttttggtttaccatttattcagcatcttctagtgccgcatgttaaggcaacatcttgccctgggtgctggagataccgagatgaaataagacactgctctaagggaactctctctctagtagggaaagcagacatgggaggaatggtgtgacagaccgaaggggtggtgtttgcaaatggcaccgatacggcaacatagattgctagaggaggaggatcctggctggcaggagtcagattctagaggatcttacattttgctgtactttatcttagagggtaggcatcaaaaagcgagggacagttgaaagtttaaagcatgcaagttaaatgtcagatttgcacttaaaaagataatgctagtgaaaggatggatagagagtgagagatttgtgtcaggaagaccactgaggaatttattatatgattgacgtgtcaggagaagagggcctaaactaaagtagtgacagtgagtgtagaagaggtggtaaggagaagtggcaaagcagatagtacgtttttaaccttcatttgaaatgccatagcattagagactcttctcattttttactccatttttggcagggaaaacaatcccttaaactgtataccttaaacattccctttaactggttctttgtgtggctttttagaaaactgaaagacagtgctttgtggagttcacaagttagctgatgggtgtttcgtttttgtttaatcctaatttgcctgtctgtgttattttgcccttcttacatctcagggcctgaatttgagtgactttgggttggttacatagtagttcgtatgacctggtggctttgttaggtaagcaagaattgacttcgtcacagaattgtattgtgttgcctttccattcagtttgaaagatgatgacagtggggaccatgatcagaatgaagaaaacagcacacagaaagatggtgagaaggaaaaaacggaacgagacaagaatcagagcagtagcaagagaaaggtgagtgttggctgcacagatgtagttgcctttgaacttgagactttattatcttgtggaatctgtttatctggaagataccagattaacttgatggcatcctgtgttggaatatctgactttgttctcagaaaaacattgtgcaatcattgatgttcattttcagacctagaacttttctcttgccacagaatcttgagatgctgccttgctttcaacgttctcctagcctgagatggagattagtcctggagcttaacaaggctgttagctgcttcataagccactgctgagtgtttcaaatcctacataccccttgaaattgtagacagtttagtcagcaatagtctaaggtgaaagtgacttggaaaagggaaaacttagggaatgagagagagagagagatcaattttttccttgaaatatcaaagcaggctgggtgccatggctcatgcctgtaatcctagcactttggaaggccaaggtgggtggatcactaggtcaagagatcgagaccatcctggccaacatggtaaaaccccatctctactaaaaatacaaaaattagctggatgctgtggcgcgtgcctgaagtcccagctactggggaggctgaggcaggagaatcgcttgaacccaggaggcagaggttgcagtgagccgaggtcgcgccactgcactccagcctggcaacagagtgagactccgtttcaaaaaaacaaacaaagaaatatcaaagcaatcactaattcatttattctacaatattgagtaaccctccaagggttactagcattttatgctagatgctaagaggacacaaaggtgaatgagactgtggaaggggcttacgtttaatagtaccaataataatactgacatctgttgtgcacgtactctgtgccaggcactgtgctcagcattgtatatccactgattcatttgatcctctcagcagtattgtgagatggttgttacaattttcctcattttgcaggtaagaagatgaggcacaaacaggttaagtaacttgacagtgatgaatctcatagaggaggcagtgcttggactgggcatatgctgagataagatacaaagatgaatacctattatatgagggagaaagttacaaaggccataagaacacaggtaaagtgtttcaggaatttagaatcagttaaccactgaggaaatgtactgtgtaagcagaatctttggcacattgcagatagttgaggttgtatatccttttttaattgtggaggtggtaaggattgacactgcaaaatgttctctcagtctcagaccacgtgacaaatgcccaggactaacacaccttctttacttcccaggctgttgtccctggaccggcagagcatcccctgcagtacaactacactttttggtactccaggagaacccccggccgtcccacgagctcacagagctatgaacagaatatcaaacagattggcacctttgcctctgtgagttcttggtgaattaatggagtgtgccttgatagttcgttcatgcctgtattgatatgatgtttatttactttcctagtaacctatttaagattctggttttcttaattgactgacctgagtctccggagtcagatttgttcattcttaggtttctcactagatatccatggttagcatgtaggtatcaacaaatatgagaattgtagagttgatcagaagggcataatacaaaagaacagatttgggtttttttatttttatttttattttttaattgagacagagtctcttgctctgtctcccaggctggaatgcagtggtatcatctcagctcattgcaacctccgcttcctgggttcaagcaattcttctgcctcagcctcccaagtagctgagattacaggcatgtgccaccacgcccagctaatttttgtatttttagtagaaacggggttccaccatgttggccaggctggtctggaactcctgaccttaggtaatccacccgccttggcctcccaaaaggctggattacaggagtgagccgctgcacctggccctgtttttttttgtttgtttgttttgtttgcttgtttgtttttttttttaagtatatatttatggagtccttactaagttcaaagtgtcatggatacagaagtttataatacatggtgtctatcttcatgaagtttgacagtaaagtgaaaaattttgaaagttttgtatttaagaacctcccattagggttttggctgtattaatgattatgcataaaatatctttttcctgtgttcagaaagaaaatgaaatctctaataattgcttttgtgggtactggcagtcagagagcccagactgtctcatctctctcccaggtgacttggtttgtgtaccccaagaatccatctgcaactaacaccactctagttgaacaaaggttattatgtacccagtgtgtgctgtacattcaatctctgggcagaatcaaatgtggggtttgtcattttcttgaaattggtgaagtattagtcctgtttaaaatgcagaaactacgggggagcggggagggatagcattgggagatatacctaatgctagatgacgagttagtgggtgcagcgcaccagcatggcacatgtatacatatgtaactaacctgcacaatgtgcacatgtaccctaaaacttaaagtataaaaaaaaaaaaaagaatgattcagtgtagttgtagtgctagatatattatatggaattatcagcagtttaccagttggttctttattagtactcctgatgtcttaaacaaaaatgaataattgtttatcttttctcaaagtgtctcatctgttcagtaacaatcacagttttctccaacagtcttgcatattacttttttttaaagtgctttggtttgaaaaaaataaaaaaataaaataaaatgcagaaactagaaaagaatactccagtaggaaatactacaacaaactgctaaggaggaaggacatataatacatactttatttgtataatttccttccaacattatgatagccctatgaggtcagtgatattatccatgttttacaaatgaggaaagtaaaacttgggttaagtgtctgatctaaagtctcaagttatggtggggcacggtggctcatgcctgtaatcccaccacttggggaggctgaggtgggaagattgtttgagcccaggagtttgagaccagcctaggcaacgtgatgagaccctgcctctacaaaaaaagtttaaaattagctggcttggagaaaacgggagcattaaaaaaaaaaaaaaaaaaaggctggccatgttggcatgcacctgtggtcccaactactcaggaggctgaggcaggaggatcagttgagcctaggaggttaagactacagtgagccttttttgtgccactgcactctagcctgggcaacagagatagatcctgtctaaaaaaatttttaaattctcgagtcagtcataattcactggattaagtcgaggagccagtataattgaaactcaggtacagaagcttccagatagctgaacacatggaggtgcctggagggtggtgcgcctagaggggacatagaagctccctgaaccttcctccataccttcccccataccttgccctacacatctcttcatcgtatcctttgtttataataaaccagtaatgtaaggtaccaagacaataactggggaaagaatcgtcttttcaacaaacattgctgagacaactggatttccaggtgcagaagaatgaatttgcattccttcctgacaccatacacaaaaagtaactaaaaatggatcatagacctaaatgtaagagctaaaattataaaattcttagaagaaaatattagtaaatcctaatgaccttaggttaggcaaagccttcttaagtaacacactaaacgcacaagcagcaaaagattaaatacttggctgggcgtggtggctcacgcctgtaatccttgtactttgggaggccaaggcaggaggatgacttgatctcaagagtttgagaccagcctgggcaacatagtgagaccccatctgtataggatttcatcaaaattcaaaacttttctgcttcaaaggacgctatcaagaaagtgaaaagatagcctacaaaatgggagaaaatattgcaaatcatatctaatacttgtatctagaatactcttacaactcagttataatctgcttaatatgaaatcaacatcattactatgctgagctgataaaatttcagcctaaagcaaagatcttgtttagtttgccagtgctatcttagaatcagcaaacttaggggttttgtaataataaactaccttgtgcactggttcatatttggttcaataaatgcttgttgaatgaattcaaggctctagtaggcttctaaaaggaatgaaggcacagatcctgtccttggggaaataagatgtgcccaggaatttctaatacagggaagacagtaagtgatactatgggaaaggcatttagagtgctcttggagtttggaggaaagaaggaattgattccagtttggggaatactgccttggaagagatgggtttaagattgattttaaagaatttggccaggcctggtagctcatgcctgtaatcccagcacttcgggaggccaaggtgggaggatcgcttgaagccaggagttcaaaaccagcctgggcaacatagtgagatcttatctcaaaaaaagatttttttggagtaattatgcatacttcttgcatttttatttccctcttgtgaaaaaaaaaagcatataagaatttacccaaattgtacgaagagggtttttcttttgtttcagtgtatatgttaaggagtggtttatcatcaggactatcttgggttaaggcttcatccatgctcactggatgtgtgacagtatttaaagtctgtcattttgactctgtaggtctggacctgaaaaatagaaataaagtctgttgtgtaattcaggtcactaggaaatggctcacaatattaaatgcatcacagataaataattacattatgaatccttttatcaaattgaaagcagtgtttcccagtgattcttagcctaatcattaacaacatttaaaagttcttgaagtcagagtgactaggaaggcatcatcttgaaatggaaagagcactagacttggtaatcagagctcacctattctgatgcttgaccctcttggttagagcaactcagtcctgaaacctttctcaactataaaacaagttgctgacatgatttctgaggtcctttcggcacctcatattctgagtctgtgaatgcttatttttttttttggtttcaattagaactgtcaaatcttttaaagtttaataatatttctcaggccaggcacagtagctaatgcctgtagtcccagcactcagggaggccaaggagggaggatcacttgaatccaggacttcaagaccagcctggcaacagtgttagacttcatctctacaaaaaaagtaaaaaaatagctgggcatggtggtgcccacttgtggtcccagctactcaggaggctgaggcaggaggattgcttgagcctgggaagtcgaggctgcagtgagccatgatcacactgctgcactccagcctgggtaacagagcaagaccccatctcaaatgatgaatgaatgaatgaatgatagtctcgagctgtttaacttcatctctcttatggtttgcatataagattgtgcagtggggctgggcgcggtggctcacgcctgtaatcacaacactttggaaggccaaggcaggtggatcacctgaggtcaggagttcgagaccagcctggctaacatggtgaatggtgaaaccccatctactaaaaatacaaaaattagccaggcgtggtggtgtgtgcctgtagtcccagctactcgggaggctgaggcaggagaatcacttgaacccagaaggcagaggttgcagtgagctgaggcaggctgcaccattgcactccagcctggacaaaaagagcgaaactccatctcaaaaaaacaaacaaaaaaaagattgtgcagtgtagttgtaagattggggagaccaaactgttaaagcgattattgactggggaactggagatggttgacatactttgtcctcaccaagcccctttcagttccttattcacaatgagccactagtgggtgtacttggttctagtgggtatatgtggttttattcaactatgttagggtggataaaggtttacattattgccgattgtattcatatgaccatttactattccgagtcactacatgcagctaagcttagcagttgctgagtataaagcactgccttgaagccctatagatggcgttagttctgacttctttttaccatgtaagatgcatcacgtgtgcttgtgctagagaggaactaaagggacagccatttcacgcagtgtaaggctgatttctccttaggtgctccccatatctagaagtatgacctgaatctttgtctactcgatacccattgtcagctccacagttgtggtatcttgctgtatgttgatttagagcctgctcagcagtttagcagataccagctatttctcattggaatgttccgtgttttctctttcctcctaaagtgtgcctcttcactggccagtacttactacgtatcctctgtgaataaggaaataatctttcctatcaagacactagtgaacctgtagtcccagctacttgggaggctgagatgggaggatcccttgacaccaggagttagaggctgtgatgagctatgatcatactgctgcgtagaccctgtctcttttttttttctttttttttaaggggagggggggtgacactaatgagaaaaacaggactactgtgatgaatacaaataagcatatacttgatggaaaaatataaatctagttttctcacgggattgtgaaggagcggcaaggagaaacgtaatttttctagctaagaagagggccttaaaccctagctatgagaagctaagtcctgtatgattttggattggcctggacttagcaacagcaccatgatgtagagtggtatgtgtggtacatgtggttgattctatcacttatgcttagtaactaaacaggtctaagaggtatttacatgtggttgattctatcacttatgcttactaactaaacaggtctaagaggtatttcattcagcaaatgctatatttgccagttaaacaatctttcatcggtaagtgatttggttctaaaaaatgcattcaggctgaggctgtgtgacacttacatacctcaaggctaaagagtttccattgtgcaaaaacctggtcctcttactgcatgtgatgactaccctgcagcttgagtgggagagtgcgtattaacatggtttcaccaactaaagctcctggctgaggcttgcatttctcaccaaagattttattcttgaattgcgaatgttacattttttattttgtcaaactagatggtatgtttttcctctaatatgtcttccctcacaacaccacacatgaaaatgagtcctctgaaaaggacagcctgtagtatagtgtcttccatgcttatgttcttaactaaatctcaaccttgggatgcattcaaagaaaagtaaaagacacatgttttttactctggggtcttctctctgcaggtggagcagttctggaggttttatagccacatggtacgtcctggggacctgacaggccacagtgacttccatctcttcaaagaaggaattaaacccatgtgggaggtaaggactaatggcttctgactgcttttttgagcaagtttgggtttttttgttttgtctcttagccctgccaaggttaaaagtattttattttattttattttatttgagacggagtgtcgctctgtcacccaggctgagcgcagtggcgcgatctcggctcactgcaagctccgcctcccaggttcacgccattctcttgcctcagcctccctagtagctgggactacaggcgcccaccaccgcgcccggctaattttttgtgttttttagtagagacggagtttcaccgtgttagccaggatggtctcgatctcctgacctcgtgatccgcccgccttggactcccaaagtgctgggattacaggcgtgagccaccgtgcccagctggttaaaagtgttttaaagtctctcaaaactgcatcactctccagtatatccttggaacccgagcctctagagaaatgcactgatgccattttttgtctgtgtgggttggtgctgggtgttttttaaagactgttttatgactaaaatggtattagaacattaaaggatttttgttttcagttacctttatccttatagaacttgtttgtgcgtgtgtgtaatatttttacatagtacaaatatgattaaagtgggtaagaaaataagtttaaaggcaggaactggagacctagaactgtttgcagagccagtattcggctgcgccctggtgtagtgcatcttctattctgatgccatggcatttttcgagaagacaaatgtggtcacatccacgccacccatcttatacagctcctcattgctcacatgatcttgcacctcatttacctttcaagcctcatctcccatcatctctaaatcttcccttccctgcaggtggaccctcctgtcagtttatgcacagacatgttcttcccagtgcccgcagtgcccttcagctgcttttcctgactcactcccgttgaccttaagacccacttcttggcagggcatggtggcccatgcctgtaatcccagcactttgggaggtcgaggtggacagatcacctgaggtcaggagtttgaggccagcctggccaacatggtgaaaccccgtctctactaaaaatacaaaaattagccaggtgtggtggcacgcgcctgtaatcccagctactcgggaggctgagacaggagactcacttgaacccaggaggtggaggttgcactgagccaagattgtgccactgcactccagcctgggtgacagagcgagactccatctcaaaaaaagaaaagaaaaaaaaagacccacttcttgactgtttccaactatcttgttcttccttaacatagtgtgcatatctgttaacagcagcacttataattatagtatcattgctgtaattaatatccttggctgtctcttctactggactggatctgagtagagattggggcttcagccaggcgcagtggctcactcctgtaatcccagcactttgggaatccgaggcagacagatcacgaggtcaagggttcgagaccagcctggccaatatggtgaaaccctgtctctactaaaaatacaataattagccgggtgtggtggcatgtgcctgtagtcccagctacccaggaggcagagacaggagaatcgcttgaacccaagaggcagaagtggcagtgagccgatatcgcaccactgcactccagactgggtgacagcgggagactccatcgcaaaaaagaaaaaaaaaaaaactagattggggcttcatgtctgtgtacttggtatgtagtgacagtcagtacttttttttgtcgtcgttgttgttttgttttgttttgttttttgagacggagtcttgctgtgtttcccaggcgggagtgcagtggcacgatctcggctccctgcaagctctgcctcccgagttcacgccattctcccgcctcagcctcccgagtagctgggactacaggcgcccaccaccatgcccggctaattttgtttttgtatttttagtagagacgcggtttcaccgtgtcagccaggatggtctcgatctcctcacctcgtgattcgcccacctcagccttccaaagtgttgggattacgggcgtgagccactgcgcccagcagacattcagtacttttagcaagtaaacggatgatctgtgcttgaaatatgacatcatttcgttttgattcctaaagtatttccagtaaaggggattatttttaaaaggtctgtttagccattttaataaatggcttatgccaaggatcccagccttgtttttctttttttccccatttcttctctccctagtcctaccatcagtttttctatagagttgaataattggaaagtgatatgacttcttagtgtttaagagattcttggctttttactgccttcatacaaaaaaaggctgtgaaaccatattttaacttcagtgctttctgtctttttacaggatgatgcaaataaaaatggtggcaagtggattattcggctgcggaagggcttggcctcccgttgctgggagaatctcattttggccatgctgggggaacagttcatggttggggaggagatctgtggggctgtggtgtctgtccgctttcaggtaagccacccatgagccaggctggtttcttgtgttgcctttgctctcctcgctgcccctgatttgctttgatgattccttctgttcctctggtaggaagacattatttcaatatggaataagactgccagtgaccaagcaaccacagcccgaatccgggacacacttcggcgagtgcttaacctacctcccaacaccattatggaatacaaaactcacaccgacagcatcaagtacgtgttggggggttatgggaggacgtgtccctaagcttagtataagtagatctgtagttgggcccagaggaatatggccggacaggagacttacttgtggagaagggacagaccaggccttccctctagggcttctggctacttgctgcagttctttgtcagcgaggctccctgccacctatactaccaggtgctttgtagcagagagagcccatctgcagaaacccagttgtactacctgggcttgcttaatttctacaggctgtcttgtctttcatatgctaaccactatcttaaaatgaaagacaagtgcttttctttttcttgctgttttttaagataatttcaccctgcccaccctcaccccacttctgcatgtctttttaacttgttagcttcagtctattttctttgtcctgggatactgactacttatcaggaatgactccatttccttgtgtatagagctgactcttagaagaagggggatagtgtgtgtgtgagagagcagaatcaaagggaagcatgaaggccacagggaaaataagcttggcaatctccctaggactcagggaaatagagctctctgtccacagtgagaatcactgttaggcttgctcctcagtgattgagtgtcagaagtaagctcaggctattgtgaaaaagtgtggggagtggctgtcagattgtctcaaagctggagggagagctagccagctaagagttaggactcttaggtttagttctctcatatggccccataccaatatgtgcctttgacaagtgtctttgcaactttgcttcagtttctccatctgtaaagtgggagacagtactttatctaacaaggctattgtgaggctgatttaatctttaactgagggtcttcagatggagaatgcttttacggggccaagtagtagtattgctatcatcatcatcatcattagtaagagtatcatcatgttgttattattgaaggctagtagtgagcccagcaattatgttcagcagacagaccatttgggaatctctttcccatgcattcatagataatgtggagtggagttggcttaaaccagctaagtgccagtttttaagtgggaacactgctatgggcgttggtccatgatcaaacggctggcatgactcatcatagtcacgaacagttattagccagccatggctgtggttgcttgccttagcagtcctgtgttagcattgctttactctgggcacatttttcttattctctattctgggatagaagtagtttctgacttctagccacgttcagtccaggctggagagatctacacctgtttctaggattctcgttttcaaggtttctgaatatcccctactcccacttacccccaaaataagctttttacctggataggagagggaaagaggtatttttcatcaattctccccttctctgctcttctccctttctaataccataaggcagttcttcgtgacttttacagaaacatatgtacacgtccttacagagtttaggagagcctgtgggctttttgccttagtctgctagaaagactggcctgctgctctctgctttatccagaggtctgcctctgggacttcagccctgtagctgtagagaccagaagaccaaccctctttgagacccagatgctactttcccttgcgtccccctctctttcctctcccaatgagccaaccttttgcacttccactagaatgccaggcaggctgggcccccaaaggctcctttttcaaaacctctggaagccgcggttgaatgtgccatgaccctctccctctctggatggcaccatcattgaagctggcgtcatcggagtctcttgttctgttggcgtgctacctggaagatccttctgtcctggacaagaggaattggaagagcattttatgttttaagaacaggctgacacgcagcagctacaacaacagctgagatcacttaataaatggtgctaaactagcttgtctcatgctcttgctctttatggtgcatcaaagatgtggcctttcggactgactgtcaccatattaagggatggcacagacttttccatggagggccatccggggaatgcagcctcatttccataagcccattgtgtagtgtcatgtggtattttgttccaggactgctgaggcctgacataataaggtgacatctagcttagaaaataagaccccattttctggtacttaaatttgagttcccatctagtcacaccgatgaccagaacagagtgatttctgatatagaattcagcttgaaagtctgttcaggttggaaagggggatccttggcctttgcttcgctgacttccattcgcctttacttcaaagaaatctcttgcttggaggtaaatccctgcttctgtctgtgtggctgtgtgtatatagcttccttgctttgtgctaatggggttttctcgctggtgccaaagctgcccaagccacagctcttttccagccttctcccttctgctttccctttagagccaggtcatcttcctctttgagtcagccctgcttgcaagatctcagggttacagcccttccctttctcctgggcccggtgttactgcacatcaggatctggggtaggggaaacgtcttcatcccgtgtgagtttgctctgtaggatatctgaccgtagcacgtacggaccccttgtgtgctttgtggctttggcttgtatgtgctgcagcttggcctttaggcccctaacctgcatgtagagtttcagcaagcctcatgctactttaggttttcttaggagctaccaccaaaaacataataaacaatcatttttttgcaaacactgggtcagcctgcctgagaggatctgtgaaagtgtctgtggacttaaggttgagttttccagagtggctgttccactttggcagtgataccctgtgcttgtaccatcctgacttacctctgatctccatgtggcccaagatcctgcataacacctattaggattagcactgtgggctcagtattctaggggtgtttgtgtcattgcatctttgtttattacatatccaaaattggttgaagtacctataaaatgagagatttgctggaatatggaaaggcccattctctacgtttttagtatttgtcaaagaattaccttctctggccctttccctcttgccttcaaaaattgttacatacattaactttaatttcggctgtattgtaactgctccaggggataggcttgatgtcacctcccagagtaagagttgattagaagcaccaaactgaccttgagacccttctgatccttgtcaatatgaacaaaagtcagaactatttctgctttcttctattccttgtggctcttccatggatatgactttgtttgagccaaggaacagctgctactgagacttaagaattccaaggaggccgggcgaggtggctcacgcctgtaatcctagcactttgggagctcgaggtgggcagatcacaaggtcaggagaccagcctggccaacatggtgaaaccccatctctaccaaaaatacaaaattagccgggcatagtggcaggtgcctataatctcagctactcggggaggctgaggcaggagaattgcttgaacccaggaggtggaggttgcagggggctgagattgcaccactgcactccagcctgagcaacaagagcaaaactccatctcaaaaaacaaagaattccaaggaaaatgaaggaagaaggagccaacatttgttttcctccgagtactctggagatagggctgctggtggtgaggggagttttttaagagtagcttagatttttcagtcaggtgttcctgattcctgcttgctatttttggcccagttcccaatgtccttcttcaaccgttgggtttttccagcctttccccagtcacactgcttgtggccttttcctgctgttcccctcagtgtgctacaaggcactgcctgcc

SEQ ID NO: 15903 - DNA, 9969 bp, Human
gacctgttggccccagtttgtgagctgacagccacagctgcacacttagcacctatgttcaggcagaaaagggccagccatttctgacccctttcatcaagaagcaaaacttttccataggccgggcacagtggctcacgcctgtaatcacagcactttgggaggctgaggcggctggatcacctaaggtcaagagttcaagaccagcctgacgaacatggtgaaaccccctctctactaaaaatacaaaaattagatgggcttggtggcgcccgcctgtaatcccagctactcaggcggctgaggcaagagaatcgcttgaacccaggaggcagaggttgcagtgagccgagatcaagtcattgtactccagccttggcgacaagagtgaaactccaactcaaagaaaaaaaaaaaaacaacttttccataaagctccagtagacatcccgcaggtcaaaacatcacatggctagcctatctgaagggagactaggaaatgagtatcttgctctaccagccattataacagagggtggcaaaggagaagtagtgttagacaattctacagatgattttctctgaatgggtcctgtccctgcacacgtaacccctgcaagaaacttccattcctcattgatgatttacccttcggagaacaccaagaaggcttctaggccatctctcccagagcagagaaagggagaaaacaggagggtggagggtaggggatgcagggacaggtggtccactgtttggcagtgcttcctgatcatggaggccattgaatttggtaaaatgtgggcatggaggagagtaaagaggtggagagaaactggtctgcaaaagaggataagaaaactgcatctagggggaccagagggcaaaatggaaaggcaaggctctcagaagtgagaaggaaacgagggctttgtaaattccaggaaaagtgggccacacagagagaagctcagtgggggggatgcccagggagggggaagctcaggaagggggaagctcagggaggaggaagctcagagaggaggaagctcagggaaagggaagcccagtgagggggaagcttagggagggagaagctcagggagggggaagctctgggaggaggaagctcagggaaagggaagcccagtgagggggaaggtcagcgagggggaagttcagggagagggatgctgagtgagggggatgccgagtgagggggaggccgagtgagggggatgcccagtgagggggatgcccagtggcaggccaagatgggtggatcacttgagttcaggagttccaagactggcctggccaacatggtgaaaccccgtctctactaaaaatacaaaaaagaaaaaagaagaagaagaagaaaaattagccaggcgtgttggcgcatgccagtagtcccagctactcagaaggctgaagtagaagaatcaaggtggaggttgtagtgagccaagatcgcaccactgcactccagcaaaaaacaaacaaacaaacaaacacaaaaaccctcacatgcctacccaacagccttcacacccacccaaatcctgactccctggagggagtaggaggcagtccacctcagccctctctggagccgctgtcaggttcctcggcgacctgccttccctaccacacccagctggccctggctgtccttgccccccatgtggaacatggaggtgaggctgggacaactgagcccgagttggggctggaaggtggatgtctcttttggggcagacggggcccctgtctcccctctccagcccaggtaacctgagcccagcattgtgtccatcctggaacagctgacaacgctgtggtcagacagctggtggggctgggccaggctggccgggctggctgggctggctggggtgggagtgtaggctgttatatgacacccagagcccatctctctctgccccagaccttggagctgttgtcccacccctgtcactgcagagagctgaggcaccatgcatgggggccaggggccgctgctcctcctgctgctgctggctgtctgcctgggtgggacacaaaggaatctcagcctggggagtcccagagctggggtccacagcctcaggggatggagggtctgaggggtattggggcctgccctggacccagttccctgagtccccacttcacacccccagggcctccccgctctttccacctccaagctcctgctaggctcacgcctgtctattgcaggggcccagggccggaaccaggaggagcgcctgctcgcagacctgatgcaaaactacgaccccaacctgcggcccgcggaacgagactcggatgtggtcaatgtcagcctgaagctaaccctcaccaacctcatctccctggtaagccgcaggacggaggaggggtcagcgcaccacgccctgggacctgctggggatagcatggggtggctccagccaccaagaggttggagggccctaaatcggacaggctggggtctggaaaacccccatggttgtggggggagtactatcaagaggctgggggatgcttggccccattggtggcctgtggggactggcactgaagtcgggggctgagccctccatactacacccttgcacccccagaacgagcgagaggaagccctcaccaccaatgtctggatagagatggtaagaggccaccctgccaccctccttccatcaggggtcccaccccaccaccccaaggcctcctgagagttgcctgccccgttcctgcctcttctgtcctcttgggctggatgcccactcctagggctgtggtgcagcagagggcagaggcctagcaactgcccctccccctgcagcagtggtgcgactatcgcctgcgctgggatccgcgagactacgaaggcctgtgggtgctgagggtgccgtccaccatggtgtggcggccggatatcgtgctggagaacaagtgaggagggggtgcaggcaggggtgtgggggacaaaggacacagggtctgggcccagcagaacaaggcactctgggaaaagagaaagatgagcagagggtgcaaatcgggcacctgtggggctagggaagaactggatggagcaggtgccgagggcagggccctgggtatgccctctgaccccagggccagcagagcagaccctacgccaggctccatctcctctgggctgggccacctgggtgggctgctcccttccctgtaacatggggccgctgacgggtcctatagaagctggcgagagtcaacaagacaggcatgaaaagtgcatcactcgggggctggcacatggtgtgggcttaacacattagtcgctattatgactattattattattattattattatgattaaaacaagagagagtaagataagcagaaattaggaggtggtgcctgaggaagtctgtctggggcggggggtggcaggaggattgctggggggacctagtggtccgggtgggaaccagtcagggggtgacaggctggtagggactggtgtccccaggcccctatccacatggggcacaggggctggtctggggctggggtgtcgggggctgagcccacagcctcgtggcctggcctgttctgtgcatacagcgtggacggtgtcttcgaggtggccctctactgcaatgtgctcgtgtcccctgacggctgtatctactggctgccgcctgccatcttccgttccgcctgctctatctcagtcacctacttccccttcgactggcagaactgctcccttatcttccagtgaggccatttattggggaggattaagagagctgctctcagaggggcctgggcagtggtggggtaaggcctgggcaaggcttctggccttggctctggcagcacctagaggcctggctccatctcccctgggcctctgtgcccatctcaggctaagacacctgaaggtgcccaagctctccctgctaagcccgagtcccctcactcatcctttactgcctcagtttcctcacctgtgctccaaggggagacattcacgcctggggtgcgtgggtgagaaggcacacatgcacacaagatgcgtgtctgcgcacacacgaaaccactgcacactccaggcccacagggaggcagggctgtcctgtgagagaggggccctggcagggaatccagcggaagcatgtatgcaaccaagccacccctgggggtctctgggtctgtttcctcaaacctaagtgtggggaggagggcccgggggagggttctcctgtaccttagaggagcagtctttccatgagcaaacctggcagggagactcccctctgtagacatgggggtcctcctcgggtaggcatgtgttttctacattgccatcatcagcccctcctgccagacagcagtgggagagacaaatgcagagtgaccctgggcccatcagccaggtgagggccctgcagcctcctgggccttcaactccatcttcctgaccccaaagagccctaggtcctcctgctctccatatctcgccagtggggtttgatagagaactcagaagcgtggggctgcattttgttgaagaaaagctgcccacacttgtccccagaaggtcatccccatgcagtcgtggcaggtccacccgctcacatttagcctctttcctcggtgactcccaggtcccagacttacagcaccaatgagattgatctgcagctgagtcaggaagatggccagaccatcgagtggattttcattgaccctgaggccttcacaggtaacccccacccaagggctccccaggcagcctcatccagggctcctgctggacccagctgtggtcaaggctggaccaaggtcaaatccctcccatgtaactcaaaatgaaaactacagcaaaccataaaatatgctttttaaaacgtccaacaaagctctgactttcctcatgataatgtctccaattttagaagaggctcgagcatccaatctcccaccccacttctgtccctcaagggtgcctcccctgctggtgctccttagggcacatgctgcccttgcagctgggtcactcggctgcagggatctgcctagctcacgcttcttgtgcccactcctgcctgcctgcctgcccgcagagaatggggagtgggccatccagcaccgaccagccaagatgctcctggacccagcggcgccagcccaggaagcaggccaccagaaggtggtgttctacctgctcatccagcgcaagcccctcttctacgtcatcaacatcatcgccccctgtgtgctcatctcctctgtcgccatcctcatccacttccttcctgccaagggtacctggagcctatgggaaggagccatccagtagcacaggggacacctgggaggccggggtgggccctgcctggggaacagagtggcattacgacccaggacagaggcagcgggctacttctggggtaaggggttcctctgtgggtgggggaggtaggaacctgctctgagagcctctcggtcatggatagctgggggccagaagtgtaccgtcgccatcaacgtgctcctggcccagactgtcttcctcttccttgtggccaagaaggtgcctgaaacctcccaggcggtgccactcatcagcaagtaaggctggtcttcatgtccacccgcctatgccactctcccttcttgggagcatgatggcctcctgcattgccctcttgccctccatccaccccccccatcctcaattcaggaggcctgaggggggcagccactaagggtgggggtggcatcatggtatgggctgccagctcctgcccaccccaccctgacaggtacctgaccttcctcctggtggtgaccatcctcattgtcgtgaatgctgtggttgtgctcaatgtctccttgcggtctccacacacacactccatggcccgaggggtccgcaaggcaaggaccctccctgcccacttcaacatcccgctgcccactcccctacgcctccctctcgcacgccccggcagtactcacctgtggcattccacagcacacccatcctgggcgtatctggacgcatggaccaaaatcgattacagtaatacaggaatgaaattgcttcctaggtgcccgggatattacaaatgttaatgtatttcatcttcataaaacccatatcacctccaattacagatgaggacgttgaggcgcagagaggttaagtaacctgcccaaggaagtgcactacaaagtcgaaaaagcaggagtctgccagggcagtctgattccagtctgtgtgatctgtagcccacctgcagccttcagcttgggcccttgttgcacatgcagattcccaggcctgtcccaggcattctaggccagaatagcatgagggctgggggcaggaatctgtgtttataacaagtgccctggtgattctgatgtgcactgaagtttggggacccaggctcgtgtccagtatagaaagctttaccaaggccacgtcactgccccggtatgctgcctccatggtccctagcagcacaagcccttcacgccaacctctggcttctgctctgaagctcggcctgctgccctagtgaagccaccccctctctaggtgttcctgaggctcttgccccagctgctgaggatgcacgttcgcccgctggccccggcagctgtgcaggacacccagtcccggctacagaatggctcctcgggatggtcgatcacaactggggaggaggtggccctctgcctgcctcgcagtgaactcctcttccagcagtggcagcggcaagggctggtggcggcagcgctggagaagctaggtgagacacaccaggtgtgcctggggacagtcctcccctgggaccccagctggggagccaggcacagcagatgagtgctggagaagtgcccaggtcagggagagaggagctggggtccctaaggagaggccatcttctctgcctgtttctcctccattctactcccaaaccttaccctttctctttatcagagaaaggcccggagttagggctgagccagttctgtggcagcctgaagcaggctgccccagccatccaggcctgtgtggaagcctgcaacctcattgcctgtgcccggcaccagcagagtcactttgacaatgtaagctgagtcagggtggggtggaggtggagtgagtacctgggcttggaaccgtgatagagacaggatgagtggggttgccaagatagggcagtgggatggaaaaacatgaggccgggtgcagtgggtcacacctgtaatcccagtactttgggaggccgaggcgagtggatcacctgaggtcaggagtttgagaccagcctggccaacatggcaaaaccctatctctaccaaaaataccaaaaataccaaaaattagctgggtgtggtggcgggcacctgtattcccagctactcaggaggctgaggcaggagaattgcttgaacctgggaggcggaggttgcagtgagccaagccaagatcgcaccactgcactctggcctgggtgaaagagtgagacgtgagactccgtctcaaaaaaaaaaaaaaggaaagaaagaaagaaaaaggaacaggggcagggggggcacctcagggccagggggccatggaattagccaccagttgggacccggacataggtaagaagggccccaggaaatggagacatgggcctgctggaagcccaaggatgagaacaggacccagggaagacctggtgccgccgctggttatcccacacctgcctcccaccctcaggggaatgaggagtggttcctggtgggccgagtgctggaccgcgtctgcttcctggccatgctctcgctcttcatctgtggcacagctggcatcttcctcatggcccactacaaccgggtgccggccctgccattccctggagatccacgcccctacctgccctcaccagactgagccaaccaaccactgtggggcatgtgggagtcacacacgtgggtcacactgagtcttatcagccacgttctcctactgaggtcctaagtgtgctctttgggaagtgcccttcaggactgtgtgagccaaacagccctgagaaaagctggggaaacagtctgagctggagtccgagagtggttgggggtgggccgtggctagtgtcctgctgcagtcagcacacacgtgggattggctagctcatcctggcaccagccacccctccactcagtgcactcccctcacttaggcaaagcattattcattcccatcagtctgaagcccgaaggactgttttgtataataccttcggacttgggactggctccccttttacaagttctccctgaaagagggcagtcacaagaggtgtgaagagtagcagccgatgctctctccaaagcagggcagcagcccataccagctggcatctcccccccgtgccttctgggtacaataagcacccaattctcaacagccccagtggcctttccattcatgtgcatttttctgccactgaccacaagacgatttcctgagttttgtaatcctcttttttttttttttttttttagtttttgatgtgttgttgttgttttgtttagttttgagatagagcctcactcttgtcatgcaagttggagtggagtggcatgatcatggctcactgcagcctcaacctccagggctcaagcaatgctcctgcctcagcctcccaagtagctggcaccacaggcatgcaccactacacccagctacttttaaatttttagtagagatgaggttttgctatgttgcctaggttggtcttgaactcctgagctcaagtgatcctcccacttgagtcttgggattacaggcataagccactgtacctggcctcctttttaattaagagctcctcacagcagtatggataagcaagagtcattattccccatgttatataggcaaattgagcctagagtaagcgggactccacacaacagtggtggttaaacaaggtttgaagtccagaattcctgactctgacccaatctgacactctaagattctacggcctgaaaaacaggcccttcttcccaaaggatggttaagacaaggaagagctaggcaagaggaggtgtggagttaacagagagccactgagctcttcattccaggaggagactttgactggcctcccttgaccccactaatcaggtagtaaggcataagctggggtcttcctgggggagaggcaaggtcctgctctgagattacagccggcacacgagtttggctggtaaccaggggacacccttgggcaagtcacctatgctccctgaggctgttccctcatctgtaaataaggtgcaaaaaataatccattcctggccaggtgtggtggctcacacctgcaatcccagcaccttgggaggacaaggtgggtggactgcttgagctcaggagcccacgaacccaggaacccagcctgggcaacatggggacacccggcctctaccaaaaaatacaaaacttagctgggcgtggtgatgcatgcctgtagtcccagttactcgggaggctgaggtgggaggatcgcttgagcccaggaggtctaggctgcagtgagctgtgatcatgtgactgcactccagcctgatgacacagtaagaccctgtctcaaaaaaaataaaaaaattacaaaactgaaaaaagaaaagtgaaagtgccacataaaggcctgacgacaggatatgctggcaggaggggaccttggaaatatgccctccctccaagcacaggattgctgtctttgggattcaatcaccagcaagttcgtattatttactccagtgtgagtctgtgtctgtgcatgcacagtgtgtttgaagcaagagcagagtcagagctatagagaactagaggagttagggagagtgggggagaacttcaatcagggagggaatctgatgacag

SEQ ID NO: 15904 - DNA, 42898 bp, Human
ctccaacaaaagaaaattcagactaactacagtttaaacaataaaatattaaattatttcatgtaatgagaagtctgaatggtggctccaacaacaacatgaagtcccaacgactcagaccttttttttgcttccactctgccatcctcaatttgttgactttttattctcagcctcatatacccaaaatggctgctgcagctccaaccatcacatttgcacacaaggaaagaaaagaatgagtagatggtcattctcttcctgaggaagggaatcttttctagaagaccctagcaggtttcccttatgtctcattggccggaattggatcagaggcacatccccaggtcagtaaatggagaaatcatgagcaccatctcttctggggtcatgtctatagggatcataaacctcttccatgaacacaagcctgctgctacctccaagcagccacacatgcttcagcatcccttgttaataagctacaggaaaagagaagagaaggagtaactgtcatttaaacctcagtgtcgagtattcctactgagacctggagatgctgagaacttgccaaggtgtgagaggagttgcaaggaggccattgtggttgggcatggtgcacgaaagggagagaggaagaagtgtacagggagctggctggcccaggggccacgccaggactggggactctgtgctgtgtgatgggcaggctttggacagttgtatccagaagatgatctatacatgacgctagttcaaggattgctctgagatgtgtggatggtagaaggtgggcagggaggctgggtatcagtcaggaggctgtggcagcggtccccatggggagcacagggctggactaggacagcccatagaagacatcccatctcctttcttgcccaaggaagagactcagtggcagcagtgcaataagggtacaggccaggaaacccaaccccccagggatagcaagcatccagagacacgtggggacagctccagcaccaaacggcttctgaccaatgagcagagacggcaaacagcaaatgcgttaccgtggctttcacgtgtcatgaaggtgatgctgtaacctgagcctcagagctcattttatttgtgaattcctatcatctctagatgggtggactgaaagccacctctttcgcttgcagctaggtagaggggagtgcaagagggcaaatgaaaaccagaagtagggttgggcgcaatgcctcacgcctgtaatcccagcactttgggaggctgatgtgggcggattacctgaggtcaggagtttgagaccagcctggccaacatggtgaaacctcgtctctactaaaaatacaaaaatcagctgggtgtggtggcacatgcctgtaatctcagctattcaggaggctgaggcaggagaattgcttgagcctgggagacagaggttgcagtgagcagagatcgcgccactgcactccagcctggccgacagagcgagactctgtctcaaaaaaaaaaaaaaaaaaaaaaaaaaagaaaagaaaagaaaaagaaaaagaaaaggaaaaagaaaaccagaagtaggagcagcctgaagaaatgacagggagttgatttcccactgggagccctctcaaagcccacacacccgcctgcctggggtaacagtatctcctcggacatcctgcaccctcccatgctcccccctccctacagtagtgaaagacctaggcaggatgaccccagctcctctgtgagaatttcacaccctagtgtgaagtcatagccttgtaactttccctttaagaactgtcagagctggggaggctggccaagctcaggctggaggtggggacagagggaagaaagaaaaaaaaaaaagagagagaggcaggaaaagttttttcagaggaaaatgcagggtttgtccttcaccctgacgtcagatcttgctttaataaaaccccccaagggctgcggaagaggcatatctggtgctcctgatgggccggccagtctgggcccagctcccccgagaggtggtcggatcctctgggctgctcggtcgatgcctgtgccactgacgtccaggcatgaggtggttcctgccctggacgctggcagcagtgacagcagcagccgccagcaccgtcctggccacggtgagtcctgcctggaggggctcagagggagacccagctcccttctctactgggtcctgctacatgggggctggtgggcaggatgaaaagggccaggaaggtttggggctggaaggtggccacttacagggcaaggacagagcccagggtgaggagtcagctgcccaggttggctgaagctggcagggtgaggaggacggtgcgacacttggggaaacaaactgcacaggtccagcctgccctctctccccacctgaaacagtgcagaaagaacggggccctcagcagaactgggagtcaggggcccgggctccagacccgtcttcgcctaacctggctgtgtggcctcgggtgggtcactcaccctccaggagcagcgtaaagcgacgaagttgttaggtgacttctagagtctctgagtttgaaaactccaagactccaagcattggagatgctgcgaagatgggagatggaaaaagccaaaaaaaattggaaagaaaaatgccagctttcaacaaaagctccttattgagcaaacagtgctcagggtgatgtctaaccccaactgctgtcacctccggtctgcacagccctctgcagtctgcagagtgtccatacttgggtcctgcctatgaagcctgctgttccagggtgggggtgatgtgggcaccccagagtctctctctcttccacctgcaccccagggtacaccaaggggaagggacaaaggtctgcacctccaaaagccaggggagtcacatatgtgaccgtgtagagccagcctgctagggccaggcatggtgaggaaaaggcagaggcaggcagtgcaaggagggcaggaggtgggtacctggcagcttctgagccccagattccacagcccagggcaggacctgctcctggcagaacagcctagagacggaggggtgatggcaaaagagtgtttatccccaaatgacactgatggcttccttgggggttaagaagcccccttcacagataaggaaaccgtgtgttggggttaaaccacttgccagaatcagactctaggtctgcttcagccagaactgaggccgagagccgacagcaaactgagacctgggaaataggaattcctctcaatgcctcggtgtgtgtaatgatggcggggagtgggtctgtttcatcttggttaaatcctcacgcctggcatggtgcctgactatagttggttcagaaccaccttaccagaaagttatcagctccatttcacaaatgaaagaaatggaaagtgagagcaagtaaaggacttgcccaggagctcctcattaataagtggccagggcccaaacttagatcttctgatgccaatttctaaccattcctacttaggggaagctgactgtgtcctacaggagtgcccagaaggagctaagtcgctgtttatttcggctctgggtatggctgcgcctttatttgggtatagctttgcaggttgctatgtctgggagggcagggagaggatggagaaaaggtgagcgtttgagagaagccaaagtctgagtgggcagaggaggcgagaggtttaagcatgagtccaagtaatctggagccccagtcagctcccagaacagccggtgctgaggaggagtgaaggacagagccgaggactcagccagaggagaccagcaaaggagcagagcgtgtggagggacccagggagcaggttggagggaaggctcccgggaccagcacaaggtacctctcttttaggcagcccctgcctggggaacccagaccacccaccccatgcttgtttcatgatttagatgcttctgggacagaggtgtgcacggcactggagttctcaggatgtcttgaaagccccgccccctgtgtgggctgtgagactgatagaaacgagctggactccatttggaaaccagccttgtttcatagccaaattccatacatggtcatcctcccgaattaatatgcaaagggagcacatgtccaaccagggtctcagtgagatcttaatggaaaaaattgttgtaaatgttcatattgaagaaaatgcatgtgagaattgccaagaaaactttgaggaagtagagttacaagggggacttctctgggagatatgaaagcactctgtaaagattctgcagtggaaggaggaagatggcagcccagaaggagatcagccaaggaggaaggcactggagtgatctcaggaacagccgagtgtatttgggaatttaatctgtgctaaaggtgtattgcaaatatgacttatgctttcatctctttattcttttcttctgcatttgttgagcatgtccgccatgtgctaagagaaagggactccatttaatgtgcattagcaagcactgagccaacacatgtataagaccaacctcagttcacccaacaaacatttattaggcacattctacaattcccataacaatattatttagcaagtgcaattatcctccttaacagatatgaaaactgagactcggagaggttaagtaatttgtcaaaggtcacacagctggtaatcagggaagctgacatttgaaccttggtccagctcttggtaatgtagcctcctgcctccctggtccaagggcagaaaccaggggcatgtagtccctgcccgacagagtttactggctagtggggcaggtgacaggggtaacgtcagccagagtagaggggctggaatcaggctctgccactggctgtgtcggccgcactaagtcccgttgcacctcagacctcactttcctcgtttgttaattgggactaactgtctcaccacaccaagctccctgctgctgaacgtgaaaatgtgcctgaggaaaacctctcagaagtgtgtaattcagcaaacgaaagctgagtgataaaatcctgggcaagcattaggcctgtggtggtctatgtataggtctacaggtaaaacccacatcctccctcctgtatcagtgcatgtgggatgtgcatagctgcactgtgtgtgtgtggggtggggtgtgtttgtaagagggtgtgtgggggtatgcgtatggtgtgtatgtggggtgtgtctggtgtgtgtgtgtggtgtgtgtgtgtatgtgtgtgcctgtgtggtgtgtgtgggggggtggtggtgtgtgggggtgtgtgtgtggggtgtgtgtgtggtgtgtgggggtgtgtgtggatttgtgtggtgtgtgtgtggtatgtgtgtgtggtgtgtgtgtggtatgtgtgtggggtgtgtgtgtgtgtggtggggggtgtggtgtgtgtggagcatgactgtggtgtgtgtgggggtgtgtgtggtgtgtatgtggtgtgtgtgggggggtggtggtatggaggggtgtgtggggtgtgtggggtgtgtgtgtgtgggtttgtgtagtgtgtatggggtgtgtggggtgtgtgcatgtgtgcgtgtgtggtgggggatgtagtgcctagtatggagtctgtgtggagggtgtgtgtggtatgcgtggggatgtgtgtagtgtgtgtgtggtgtgtttgtggggtatctgcctggagtgtgtccgggggatgtgtggtgtgtgtgtgtggtgtttattgtgtgtggtgtgtgtggtacgtgtgtgtgtggtgtgtggtgtgtgtgttgagtgtgtttgtggtgtgtttttgtgtgtgtatgtgtgtggtgtgtgtactgagtgtgtatatggtgtgtttgtgtgtgtggtgtgtgtgtggtgtctgtgtatgtgtgtggtgtgtgtgttgagtgtgtatgtggtttgtgtgtgtgttgtgtgtgtggtgtgtggtatgcgtgtgtatgcatggtgtgtatgtgtgtggtgtgtattatgtatgtactgtgcttgtgtgtgtgtggtgtgcgtggtgcttgtgcatggtgtgtgtatggtgtgagcatgtttgtggtgtgtgtgtgttgagtgtgtatgtggtgtgtttgtgtatgtggtgtgtgtgtggtgtgtgtatggtgtgtgtatgtgtgtggtgtgtgtcagttgagtgtatatgtggtgtgtttttgtagtgtgtgggtggtgtgtgtgtgttgagtgtgtatgtgttgtgtttgcgtgtgtggtgtgtgtgtgtgtgaaccttgtgtttgggtgtgagatacaaactcattctctgcttccagaagcaactgcagaataatgtgggtcaagtgtatggcaaaatatcccctttagaaaacagagaatgtgaacaatatgtcttttcacacctcctgtttagagttggaatctgagtgaagatttcaaaccccatccaggccccacacccccaactccccacccagagcctctttgggctccctgaagcccctgctgccagctcagggcccctccagccgacagcttatcttggaggctggcacgaggacggcactgaaaggcatttccccctcggcatggcatttggagaaggagtgggcacgggaacaggcctccgcccaaccagctccttgagagacaaaacgctaccttgtgggctgagcagcactcctggctccacagcaagccccaccaaccacccccaggttttagaaaaggctccggccctgtgccagcaaagcacccacatgccaggaggctgcccttggctttgtataaacagcaacccagggatcttcccaggaacctcagccatcctctgggcagcagggaggcaaactccaagggaggtgggctctgatatggaagcaagggtggcgaagcagccatggtccaggtgggttcctgggaggggctgagaagggtgccaaccacaaccaggaagcaaagcgagccagcaagggtcaccgtggaggtttcaaagcaaggcttcagcacagctgtcccctcattcaaggacactgtggtgggccctgcatccctgtgatgtggatggtggcaagggttcacactgagcatgtgcccactctactctgggcacagtgcccttttgcacacacctatgaggcagcggtgttgctgtaatctagaccagccagtcagtagccacgtgtggcaggaggccactcagcacttgaaatgaggctggtcccagctgagatgttccggaagcataagatacaccattgattccagagacatggtatgaatgtgagagcgcaatattcccattaataatttttatattaactccatattgagatgataatattttgaatatactgggttaaacacaatctattattccactaaacttcatctgtttcgtattactttttaataccgctactagaaaatgtaaaatttcatctatggctcttattgtattttactagatggtgtcggcctagaaagacacaagtgtgcctaaggctatgataacaggtagggagggagaaatgccaagggttctaatcccagtgtctccacttacaggctttgtgccctcaggtaagtagcccagcttttctgagccaggatcatctctgtataaaggaatatattaacattagtactattggcttgttaagggtgttgaatggggaatgaagcagagacaaagcccacaaggccccagaacacccaagggaaggattctattgttccaatagcagggcaggggaattccaacttgagtggatgcaccagctgcaggcaaggccctatccaatgagcaggggtttataaagacctcaggctcagcaccagttggctaggaggaggggcaggctgaggggcagactaatgggcaggctgtcctggctcagtgctgggcatgtgttctaaagatcccacagattccatagcctggccagcttacctggcacatttagagggtcagtgaacacttttgggttattgtgtaggagaaagaaatgatgatgatgatgatgatggtggtggtggtggtggtggtggtgcctgtaggtgagatgtgtatcttactaacctgagtcaggatgtccctcaatgccaactgtgagtttctgagcctatttcctttttccatggagcccaacagacccaactatatgcccagccacttccagtttctagaggtgtggtggtgagtggtctctctgtgtttaaactggaggatggttccagtgtggaacagaggtttatattagcagagaggggtatgtttaggactcagagggggaagctcggagaacatgggagatggtgaaaaacatgttctggaaccctgaaccagaattcctagaaagacctcaccctcacacgtctgcacattaaccagcaccctgatgattcttatgtatacttgatttcaaacaccagtgaccgagatagactctagtctcccccccagctctgacattccattaaccagtcagctcccctcctcctcctcctctctatgaaagaaggaagagagacagagtcaagggagaagagactgcctcgcaaatgtgaacgatgggcattccaggggatgcgataaaatctgagcccgcccaccccaccgtctccaatctggaggcaagttcaggcttggggctttgagtgtggatctgctaagtcttgattaggggtagggggtagggtgagagaaaatgaaagcccaggcccaaaggaaaggaagggaggggtccaccctgcagctctaggaatcctgctctgagtctgggagtggagaaaggcatgtgtgctatgagcctgcccatggctgggaggggatgaaggcgggtaattctaagagtaggggaatatcctgagagagcagggactcatacccctgccctcagagcggaacagcagactccttgcctagagagctagaagaccagggggaaatagctcctgctgtgtggctttaggcaagccacttgccttctctgtactcactttctcatcttgaaagtgaggagattggacttgatcccaaagctggcttccagctggagctgccatatattccaagagtccactcattcattcatcgggcagatccatcatttaacaagcagcaggggagctcacgctgctgcttctctagaaaggggttgtcggcacccaaaatgtatgtcccttgctctaggtgtctatttagatgtgctttgtccctcttacagtgtccaaaaatattctcctttcagcccacgtctcttttgtcaatcctcaaagtgtagctgtgtttctggcccacagcagcctcatacaactgaaaatcacatcagcacctggacgtccgaggggtcccaccatctcagtggtttcccaattaggccctctccctgctcttcctacacaagcctgttttcccagtctcttcctttggttcttctcccattcaccttcttttctacttcatgagccttgctgtcaaatactcctgagttccgcctctgtgcacgtggccaagctgttcctttgctctgaaatgccttccccatgcttctctgattcatgaaattgaagccatctgaactggtggcctcctccaaatggagctgcagacatcttccagtgggcacccatgggttcttgttcttgcccacgtggagggaaacacgtcgcccagctgggactctctgctggccttgccctgtgtttgagccaccctccctcctccccctaccctcctgcaaagccaagccctttgtcgcttcctgaccacctgtgccctcaggccccagggcctttgcacatgctgtgccctctaccaggcttgcccatacatcttccctgctctgttgctctgtcactgtctatgcctgcatattgcaggtgctcacagtgtacttcctgataggatgaattaaagcaagaaccagacctggcataggctggggagaatatgtgtataggagatgggggaggctgggagggaacaccactgattttttttgaagtagaagcttcatgctggggaggaaaaggagggaatttggcaagagggcctggactcaactgctaagaggactgagtggcaagcggcagcttacgggcttggttctggagcaaggacagaacgaggagtcaggagactggggtctctgcaggctctgcctgcatctctgagcctcaatgtctttatgtgaaaaaggaaacaagaagaatgcccctctgctcaggcttgtgctctaggcagggtagtgcggtggtgaagaggaggcgggcagcacacagcctgggtcaagagccagctccaccacatcccagccccaagcccttaaatttcctgggtctcagtttctcatctgtaaaatggatgtaaatgcccgtgtcacagagaccttaggactaagaaagaggacttagaaagaggttgggtgtggagcatgtgtcgagaaggggcttggaggagccataattagacagggaatatcaagctgctttgagattagacagtgttgtctcatggtccttttgggagctcatggataacagagctggcaggcgtgcgtggagtgagattgcagccacctgtcttcccagccatgctatttgtatttaaatctgtcgcctacatacacatgcacacacgcacacacaggcacgcatgccagttgacttccttgacagctgtttctggccttgtgctccagtgccaagtcctgatgcttgcaaactttggctcttagatgatcaaagagccagcccttgttgggcccttagtgtgagccaaggcccacggcgagccccttcccacaggtctcatctgatgttcacgagagccctatgtggcaggagctcctatcagcctcattttaaagaggagaaaactgaggcgccgagagttttacgcacttccatggcatgcaaggttcagaacaccaccgtgtgccccaagcaggctgcctagaccagctcctaggggtatccttgtgtgtcagtcccttaggccagttctgtttctccctatctgagccagggatccagtgcaggaggagggaagggagatggagtcacgctctgggcggtggagggaggacagatagactttatcccctgctttatttccctgatccacgaaccattgccagatgtggaaggcccacagtgatcccttcatcccagcctgctcttgttacagagaaagtgacttgtccaaggccaccagcttcagcatggggactggagcccagggcctctcccctccagggaaggagctcaggagactggaagacgatccccactaccccatcgggtagatgcccactctgcccttgtaggtggaacaagcctgagctcaatgacagcaaagagcttcattcttccacccgtgtctgtgttcgctgtggctccagggctggccccctccatggtctccccatagccaccgccaagcccaggcctgggacatgaaaggccctcggttacatatggttatttgaatgaactggacagtgggcaagaacaaggtgccttagaggtagctggaggaggataggacctggagtcaaaacagctgactgtgtcattttcttgttgtgtctcaacctttttgggtctcagtttcccatctgtcaaattggggccatcaatgctgacctcatgggattgttttgatgatcaggaaactgacttcaggaaagaccactgccttccccaggggagggagcacgcatcctctgtcccgggcccctgactgccatctccgtgtccttgaacattaagccctagcaacatggcccactggtcatcacgtgtcatgccacgttgcttctgcctgcacacccctgctcatgtcatccccagcttcagggccctctctgccctccctctcatcaatttccactcatcctttaggattcagtgcaaatgtctgctcctctagggagcattctctgctcctactcccaaccccatgccctttcccctcttcatctcatcctcgtagcccttacttagactatgctaagttaccttacagtgtggcccttaggtgtgaagccttaagaaacggatgctttgagtcccagggctgaggttcaaacctcaacgttgccatttgctagtggctttggaaaaattatctgacctttacctttttgtgactcagtttgctcatctaacaaatgaggaagctaataataacagcagcctgcctcttaggataatcacaaggattaaattacttacttaaaatgtagatgatcttgattcaaagaaaccatctgttaaaaaaaattatttgggagagtgcaatctgaatgtggactgggtattaactagagaaagttacaaaattgtaactaatttattggtgtgataattgcatgggggttacatttttcctaaaaattcctcataatttagagacacactggagaatttcaggtaaaatctcaggctgtctaggattcgctagatttttaagaataaaaaagcatacagccaggtgtggtagctcatgcttgtaatcccagcactttgggaggctgaagtgggtggatcacttgaggtcaagagtttgagaccagcttggccaacatggtgaaaccccatctctactaagaaatgcaaaaattagcagggcctggtgggaggcatctgtaatcccagctactcgggaggctgagggacaagaatcacttgaactctggaggcagatgttgcagtgagccgagatcacgccactgcactccagcctagacgatacactcagattcagtctcaaaaaagaaaagaaaagaaaagaaaagaaaaaaacccatacatgtgtggggaaaatggaaggaacaagaccaactaagtgttgataattatcaaagctgccgatgcgtatgtagggtttgttatattattctctcaacttgggtgaatatttaaatatgtctctagcaaagaacacagtttaaatttgtgtacagtattcagtgttttttgttgtggttttctcactactctctaaaactgtgagaacattcagcattctttcccctgctcagtaagcaggtcttgtgcagttaaatgaaaatgatgtattttacccttgatgttttgttaaaatgactgaaaatgggagaaaaccaaaaggagtagctcccgatgaaaagacccttaagttcttcacctccctggacaaacagggttatcatatagtgggcaggcccttataaaaatgtcatgagccatctatggctcttgggctgtagtttttgacctttataatgcggttgcctgttttacgttcctgtctccttggaggctggacgttctcagaggctttgtctctgacactggccactgcatgtgggacttagtagatgctttatatacagattgacaaatgagtgaatgcatgagtgaacacatggactagggctcgttatctggaaaaaaaacctggcttcttgccccttgtaccctcatcatgtaaagttgactttccccgcctgcatgtttataaaaccaattagtagaaaatctcgaaaaccttctacatcccataacatgcagcctggccaacaactttctggaaaccacccttgggagattctgggcagtgcggtgggggaaggaggaggatgtacctggctcatacacctttcacgggtttggagctaagagctttcaaaggtgatctacccaggaccactgtcccaggccccacttgaaggggagcccccaccagggcccgggatacaggtgcctaggggtgcaagtgccggaggtgttgggaaaagaggtgtttgttacctgtggctgactcagaggcacccgatgcgctttgaaacaagcgtggggaagacatgggcaccggccaggcctgtattctctcacggtccccagggcttctcttttcagcaaagcagtgaacagaagctgcttccagcaggacaaccctgtcctgaaagctcccgggcccagctagggccggctccggccattcctgcctcaaccctgccccctggtggagtatctaggtgcggcctccgaaacagggcaagccaaggcctccgaccgtccacactgctcacggagcacttgcccagggtgtgccaggcgcagtgccgggcacccaggaggcgggaaagggcaacccgtccctgagaatccccacaagggctcctcactcctcttctgggggcccttggcaacctgggctcaattccattgctatcttcccagggggtgaggaccctgccttgttcatctgaacagcaggcacatagtagacgcttggtacatgtgtgtgatgggcgggtggagggaagaacgaatgaatgagggagccgtgcagcaaggtgattacaagtaagggttctgcagggacactctgggtcaatagaccaccttccagctgcgagatcttgagcaagattcttgagctcttggagcctcattttcctcatctgtgaactagggatgacactaataactgctcattaaggctgctggaggatgttgacatcaccatcattttacaaatgatgaaacaagctcagagcaggtgagcacggctccagatcccaaagctgggagtggcaggaggttggggaattgtcaaatggggtcccctcattgcagatgacgtgccctttctgcaaattccatgccctgttcacaataaactgcacacactcttagaagagaaagggatctatctccttcatcaaacgggacgcttcagatatcctgggcagtccaccccaccgctgctagcctcccacgttctgctcctatgcctattgctaagcatttttgtaaaaatgaatactgatatgcaaacgtcaaattatagacttacctcttcccaagtccactttcaaagagctgaaatacaccataataatcagttaccactcacctttaaatattatctcaaaaatacatgtgaaacatttcctccagggctttattttttttccttcccaattttaatcagcttaagtttgtccaataagtatgattgaagggatcacttcatcactgttcacctacctactgataaccctgtttgtccagtggggttaaggacttaggggtcttatcatcgggagatactccttttggttgtctcccatttttcagtcattttaaaatatcaaggataaaatacatcattttcacttaactgcacaagacctgcttacagagcagttgtgtcaccctgatgaatcacagaatgcggtatgttctgcaggtctgcgtgaactgctgtgtgaaagcagcttagcagtgtcggtgggtaatgaacatgggtgtgggttgtacaaaagtcagatgttaaaaaaggaagatggtctaaaatctccacacttttctcttatccctgcccaatgttctaaggcagtggttcctatttctataaaaattcccaagggttgctggtcaaactgctacggattccaggcttcagcctagagaaacttaaggcgaatattcaaagagggatctaggaatctggtttttatcactctgtcacccaggctggagtgcagtggtgcaatctttgctcactacagcctctgactcccaggttcgagcaattctcctgcctcagcctcctgagcagctggaactataggcatgtgccactacatccagctaatgtttgtatttttagtagagacagggttttgccatgttggccaggctggtctcgacctccttgacctcgagtgatccacctgcctcagcctcccaaacagctgggattacaggtgtgaaccacatgcctggctgaggaatctgtattttaacaagtttcacaggccagtgattctgaaactttggggcattcagaaccacctggaaaaaatcccaatgcccaggctcctcccaggccccttaggttgggatctctgagtagagtgtccattaaagccccagggtagttgtactttgcagtaaagtttggaaatcatcatcatactacctgggtagctaggaggggttgctgaggagggaggggtatggcaggaggagtctcagtggggtaggtggggcccggtgggctcaaaggctgcagcaggcagaagtgagcaggaccaggctgtgcctgggcaagccctgggcatcttgccaggcagaagcaccgcagagtggccaccacctctgtcttccccataaacatagtgttatctgcagagtctatttccagaagtacatcatgaaagagacttttatgtgaacatctgcaatttggaaatcccaaggctgttttggtttgttgttgttcttgtttgtttgtttttgtctttgtcttttttttccccctcctctggccttccctagacaacactctccttgacttacgatcttttctcctttttgccttcttggcttctgtggttggacagaatgatgcaggctccatatgacagtgtgtttgcaaagatcattttctccatctgcagaacaggcccaggcaccccagctcaggtagctcatggtgggtaagaagatagccgtcagggctctctggggactctacaggataggatatggggcaggctcctgcctgtggctggggaaaacaggaatagcttccaatccccaaggaaaatgaaagcctggtagaaacctcagagggtcccaggggcccaagcaagcatcctggggtttgaggatgagccccagcccccagaaggaaagcactatttttgagatcctacagaagcctctggaaaatgtgcaggcctttttttgtattgtttagctgcaaaaagattcctctaaatgttcatattctactaattacctctctctcccaaacccaggcaagccaagcaaataggtatttgttttgcacaaatacccattgcttacacagaaatgggtttatcgtttttattttgacaaaggccatactctcattgtccactaaagataagggccaggtgtggcttaggggcccgagctcccgggcttcttcactgcacagcaccacaggtgcggcatgggagtcccaccagcagccaaaccagggtactagaggctgggatgatacagctggtttacctatggagccacagctctgacccagaggcgccacacatttccttcaggatgtgttgatgttctggaccaacagagacacccccagaaaggccccagaccaaccactcaaggtcaacacacatacatgccccagatattcccccagtgactccccatcatgacaggcctgggtgcactgaggaggtccccagacagcaggaaagggtggggctggtggtacctgggcccttggatgactccgcaagcggatgtgcaaggaatgaggagttgagagcccacataggatgcacagacagaaggtggtgtgggaaactctcatctcccttctctggctgagatgcttcccccactcctttttttggggggtggaaaaagagaaccattcagtgaaaagagctgtgaaccaaagcaaaggacaggtagagatgtcatgccatcctggatgttgaaggaggctgatggtgtgtgcgcatgtgtgtgtgtatgacagagacagagagagagaccctacactggccttccaagcagctgaagccccagtgagtagccttcgagggatgctcaggggatgagctgcctcagcctgcctggggccgagggaggctgccagtggatgggcacaaggtgccagggatcacactggaattaaggtcccagaactaactgggaggttctaagatgtgacctcgccacccctacactccaagccactgccagggggttcttggacaggctttttcattagaagctggtatcattcactgtatatgccaccggcccaggaggagtgaaagccgccatggcaccatgcacctccagttgatcagggccccagagcagctttggagtggagcaggaaggcgggggggaaactatggcttcactcagggagaggtggagactgtaagcacaggcttagagtcaagcacttcagactagagtccttctgccgttccctgctcatgcagggacagattgggtaaaggagttctaagatgactcacagcgttaagactcaccggctctccaggagaagttctggccatgaggcccctcccaaccctcactcttcagcaatgagcatcatttgttgtctctggaagctgagtgctcatgcactagaccacccgaatggcagcttaggctggacttcaggggagaagcagggcagtgggccgttatcagctcatttttggcagcaacaagaaccctgaagggacaggtacccccacatggggatccagctatgtcccaggatcccaaagcctctccttgagctcccagcccccatgaaatatttgttttgctcaagatctgatgggagcatgtccccaaaattcacatgtgcacggtgttccctgtgcagtgatcagaggcagaagagttagtggctcgaaaactctggacaaggcagaccttggttccatccctgactacctgacttgtgtggccttgcacaagacattaacctctctgtgcctctgtgttctcactgctcaggggaacattagcagacctgccttgtgatttgttaggggattatatgagatagtgcaaacagagttctccatatagaatgagccctcactcagatcttaggtatgttgattataagggcctgtgagtttgtgcatgcaggggaacagatgggcggcatgtggtttctgccttcaaaggatggcagattggttggggaaatgaacattcactcatgtattcaccctatcaacagatgcttattgacacctactatgtgtcaggctttgtgaggcttgatgtccctctacaactgccagcccaaataattgtctagctgcttcttgattacttccactgatggtgcactcactacctttcagctgttttttttttttttcatcagaaaattctccctcatgtacagtagtgggaaaaacattaactgaaacagttccagattcaaatccaagttctgtcatttactaggtgttgggcataagcaagccactttactgatctgttaaatgggaataataataccagtcactgtgcagaagacaaatgagatcagccagagtcactgagggctagggcaagacagtccccaagtggtcatcagagtgatggtttgcaatggatgtaccagcaggaggaattccagctgtgacctcatatgatgctcacttccagtcacttgcgagctaagcgatggtagcaatgccgttttacagaggagaagacaggctcagaaagtgaactcccagagtaacatgaacagtgacaaagcctggactggatacagtgtggtgtttctaaaacacaaatctaaccctgccgtcctcctgctaaaatccttcaataaaccattcttccagacctcagcccaaaccaaggcattcaaggtcttccttgatgtatgctgtgccttgaacccatcctcatccgtcctagccttcgcctcctcctgcctccaccctgcaccctactccaggctctgcaggccccaggccctggcacatgttgccagctcagtgcctgtgcacttgagggtccttgcgcattgggtaccctctcctgcttcctcactgatctattcccaccccctcttcaaaacccgttcccagtgcctcctgtcttgggaagccctcttcagccccagcacacacacagcccagccactcccctgtcatcccacaggcaggtctgcttggctctcacactgcatccccagcacctagtgctgcacctggcacaaaataaaagctgactacaggtgtgttgaataaataaatgaaagggagaatgaataaatgagtggatgccattgttatagcattgattgcactgaattgcaatcattatttatgtgtctgttggcctcactaggtggggagccagtcaggggctctgtcttaggcaccttcgtctcctcccagcctggcacaaatcctgtgcatagtagggattcaataatcctcggtccctagaatgactcagtcatcgtgcacatccccagctaaactgtcagtgctggagggcggaaaccgcccttgcgccagtcatctgctttccctcgtgctcacacagagaggtgaggattgatcgattatcacgagtcaggactcacttgtggcctgcagacccaaatcctaggtaagcgtctatgctggacataccctaggtatgtgtcagtgctggacaaggcagctggcactcagaggctcacacaccaaacccagcagtcctcatgccctggggtccagagggttttcccctgcacagatcttgtccagcaccttctcctgagtctgggagattttctaccactagatggtgccaattgcaaaggctggctcagccgactgcccacagcccttccctcctctgcccagggatgccataaatggttcccctgtccaagggaggacttctctgcagcttcccctcaccagctgtgtgccctggcacctccaggcacttagaaaggaagcttccttctgggcatctttaacttgggatggagacaggaggatggatagtgatcccaggagtgggatacccacccggttccaacccattccagctcagctcaaagtgtccagatccccaactctgttctgggcacagtggggtcagggaggacacacaaccaaatgggtgtaagaggagacaggcttctgtgtgccatgtgacatgtgccaggccctacctagtgctgccacatccacaatgccccttcacccttccaactgcccccaaagggaggtgagtgtgattgtgcccatatcacagatgggaatgctgaggctcagaaagatgaagatgctgttccaaggccacacggaaagaacgtacgtcggactgtctcaggttgcatgttcttttcttgacactcaaacttagggcccagaggagaggttccagtacatgatgccttaaatatcatagatatccaagcctttttagccgacaatcccccatccatccatttcaccagtcaacacatatgaagccctactgtgtgctctgtgctgtgtttcaggcgcacagagagatgcaaggcccgggccctgccctttccaagttcacattccagtgagcgaggtaagggcagggaagccttcctggaggagagggcatctttatttcctctgccaagagcacgtcctgagtgtggtggctctgagagatggtctgctagtgctcatgaggctctgaggcttctagaatcatggcctaacaaggaaatgtctctccccaaagtcaaaaagaggggtgtgtgtgtgtgtgtgtgtgtgtgtgtgtgtgtgttttactgattcggatatgtagggttttcttgcatcctgttgtgtttttgaggaaatatgaacaagggcaggctaactagtgcctcctcggtgaaccacccagaactgccaaccccaagagctctctgttccctaccagcaaggccttccaaggccacatcgcccacagagccttcctccctgcagggggctgcaggcaagattttttttggccattctggtgtctgtctgggccataacagagaagtcacccatatgtccccagtgaagactggcaatgtgcaggcactctgtgggggcctgccccatcctgccctcaccccatggagttcaccggcattaacctccaaacacacacaaatgtctaatttctgagcctgcctagtggcttaagggaaagccagacacacgcaggtcagcgagtcaggagagtccgcccagagaaaggggccccaggtgaaaaagataggaagggcctctcagccacagggaactgcatcgcagcggccttgaggtagggaaagggtggatttgaccaagttctgaaatcaagcctatgggagatgaaagcttcaagtcgggttttgtctgttgacttgcaagggctttatttattgcatcaatatttactacatttattgtgcgccaggttcagagcctagtcagactaattcagaaattcatctgaaccactttcctcatccctggtccttcaaggtgcaagagtggaccccactctcctgggcagagcagttactgccctggtgttcagagagcttccatgcctccttggaatgcccagcactttgcgtagtaaatccctcgagttgcagtaaatccctcgagttgtagtaaatcacctctaatacttgcctctcccataagctgtgggttccccaatcatagggacttttaacgcttatcttcaaatatctaaaacttaagagagactatgagctaactctgcaaatgtctgttgagtgaatgaaagaacccagaagaggcaaaagtagaagctgttgtaatgagagttaggagattaatttgcatcttggccttgctgtgaactgtgtcatcctgggagtgtccatctgtctcttcgggtcttgccttcctcccctgtaaaggaggaaagaatttgtctgagtagctcagcaccggagcctggtgttccgagtggaaagcagatctgtgatcccacaaagcaggctcctctgcttccagatggagggagcagcccagagcccagccagccccctgtcccagccccacagaagccctggattctcctctgcttacttcagaactcagccgtcaaggacgagaagtgctgggcaggatgatccatggcttgcccaggagagggaggactgactcaaagcctggctcccgtccccgctcctgtgtcctcaggcgattctcttcctcttgcaggcccaggtctctttcgagatagagcaaagggcacagatgggattcaggggggcaaccagatgggacagcaggtgactgggtgctggagatacaggcagcttgaagctcctgcactcagacacccaggcatctccatctgccgctcctcaggcctgggcagctcttagggccttggtttcccttcccagctggcctcttgtgtccatcatatttgccaaaataaagatgaagctgttgactgggggatgggaatggggatgctggggaggagtgcgggttggtagagtggagtgtgtatgtgttgggtggggggtctcattgccctgacagcaaaataaaagggctcctccatgtagggcttgtgctggcaaaggaagcgccaactcactccccaagggctggggcccatgtagctgccaggagctataaagttgaatacctgccgctgcaccacgccagccctttccggatgctcagaggggaaaaaaataataataggtcagcgggccgaaaccggtattaagtaggagtcctctgactcagagaggccttaagaactctcggtgagtgaaggaactggccctgcaggtcgtcacagaagagccatgggatccgagccccgcgcagccacatgactcacagccagcttccacctgctcagggcctcggctttctccctgtaaagtgaggccacctcccttacctcggggctgcagcgacaatcactcaagaaaggaaaggagcagggtctgaggtggaatttgggccccaccgctgaccagcggaaggattcgggcaattggtttaacttcgctgcatgttgggctcctctgttctatttgttttactgagaataaaggagatgtttggctatcaaaagcgtgatagaaaaaataattttatgaaaaccttttgaacagcatgaggacaggaatgcaatggcagggccctttgggcgttgaaacccctgtctcagcagcccccctttccctctgccctccccccgcaggccctctctccagcccctacgaccatggactttaccccagctccactggaggacacctcctcacgcccccaattctgcaagtggccatgtgagtgcccgccatccccaccccgctgcccgctgggggtcagcctcatcacagatggctgtgagtgctgtaagatgtgcgctcagcagcttggggacaactgcacggaggctgccatctgtgacccccaccggggcctctactgtgactacagcggggaccgcccgaggtacgcaataggagtgtgtgcacgtaagtgagtccctccataccttctgaccagcccctgagcacccccagctctggccccaaacccctctcccttggcacccccacagcctttcacctggccaggcttccgttcagcaggagatacaccccatgatcagaggccagaggctgggtccttcctgggaaggggaggcaaggatgcctgcactcttctcgcctccagaactttgcttcttgctttattctcagtcctggaggcacattcatggctgtccccagggaagagggagacgccatgaaatacctaagcctggttttgttctcttagtggtaggatcttttaacaaatgtccatggcctactaggacacaccagcatactgcagaactccagatattttggtaatattgtaaattaaaaaatatggttttaaaaatccagtagccttgaaagaatgaaaatcagcagcctgcagtcatcccttcccaccagctacctacatttctcagttactacagtcacttaaattttctagttatttcttctgaaatataatatagtatattatagaaatatactatatattctatatagtatagaaatataatataaagataatatatacactataaatattatctttctaatgaacttgaagaacagttttcacagggggaaatatactacatatacactatatatagtagttaaatatactatatatacactatatatagtagttaaatatactatacactatatatagtagttaaatatactatacactatatatagtagttatatatactatatatacactatatatagtagttatatatactatatatacactatatatagtgttatatatactatatatacactatatatagttatatatactatatataactatatatagtagttatatatagtatatataactatatatagtatatatacactatatatagtagttatacatactatatatacactatatatagtagttatacatactatatatacactatatatagtagttatacatactatatatacactatatatagtagttatacatactatatatacactatatatagtagttatacatacactatatagtagttatatatactacatatacactatatatagtagttatatatactatatatacactatatatagtagttatatatactatatatacactatatatagtagttatatatactatatatacactatatatagtagttatatatactagatatacactatatatagtttatatatactatatataaactatatatagtagttatatatactactatatatactactatatatactactatatatagtatatactatatatacactatatatagcatatatactatatatacactatatatagtagttatatatactatatatacactatacatacactatatatagtttatatatactatatatagtagttatatatactatatatactatatatagtagttatatatactatatatactatatatagtttatatatatactatatatactatatatagtagttatataaactatatatagtatatatagtagttatatataactactatataacagtagttatatataactactatatatatataattgctactataaaatgtatgtgttctgctatatattaattgccttgatatatcaatttttggataatatattaatattctaagatagctgatgatttagctcctcaataccacctgatatacccctaccttccaaatgacattgccataatttttgattatacaatcatcagtatttataatattatgactatgtaaatattgttcactgcagtatgagatcatgtacttgctttaatttacttccttatgatgctttttgtttttcctggactttctaatggcctttgctttttctttattcttggtgtattctgatatcctcctgtttggaggtggttgttgttgttgttgttgttgttagttgttgttttctttggtcttcaagtgctccatcacgggtattctatccttttttgttccaagacacctcctttatgaaactttctgaccccctgcttctgtccggacttgtattcccttgaattgtgtaagcattacccaaaatatatgactcatcagattaagagagctacctaggtattatgatgcagcagcctaacttctgaaaacttccacaaagtctcataaacccaaaaactcccttcttcccttagtgctgaatcaagccttccccttaactatgactccatatacaccccgtcacatagtcacacacaacgtagtctctcatcctcagctaaccattatattttttgaggtggattgtccatgagggttatgtacatcatttgcagtcagacaattttattttatctgaaccacatggttaatttatgacagtttcttctcttttatcattggttcatgcttcaactttcacacgaatccttgtgtctttggctttctgtgaataaccatcccacttctcccatctttctaatttttcttcttttactgaaactcattagcagccacataaatggtatgttcaaagagaacttgcagcatccgctgcacagaatcatctgatatgttgattataaatgttattcttgagccccaccccagacttgttgaatcagagtctctggaagtgggaatgaggatctagtcctttaacaagactcccaggtgattctcatgcatgctaaagttcaagaattgctgctaatatactcagtcatctgttccctccccataacccaggtagggaaacctggcctggacttcttacactagaaccacctccagttatatgagcttgtctcataatttattcttccagtaaaaactgttcttcaaggtcattaaaaagatacttcttttcactaccattgcattaatctctaaagctgtattgagatcttgtcatctgccaggcaccactcatttatagatgttctgtcatggatccaaagattgtgtgaacccagaaactgcctgtcctgcctgccttccccaccggtggcctggaaaacccccttccctgtcctcctcaccccctatctctgcatcttaggtcctgccttgacccagtacagccacttaacttcccaacaccatgggcttctgtgtacttcctttccttttatttgaaaaaaacaaaaactgtaggctaaaggagattgtaatagattttacgcctaccagtggttccctggtcatgaagttttacaagcattgagataaataaagctaaccaggagctatagaaattctcagaggcttcaaattttcatgtccattgccaaattccaaaagagaggtatcataagcttcataataaattttttagatgtatttaatactaaattttttcagtcagatagttccttacccacccattacactacacacacacacacacacacacacaaacacacagttatacatatacacatcacacacatatgtgcccacacatgcacaaacacaactcactagtgctctattgaacatgttcccggaagtgctaccatagtgtctgaattcatgagaccctaatgcaggaaagaagagagtgtggggtctgcaaaagaatacacctctgggccagagggtaaacagaacaaacggttcctctaagaaacaatctttccacaaatggtcagctaagcaaatggacagttcctaggacaggctaaatctgtccttaaagatttgcatgtaattagaccagaacaaggcaggtaataaaaatgagccattgcaaccctggcttatataactcaaacagagtatgatggggacaatggcaatctggtgtgtgcaagccctggctttcagagatgaccctactgggcccagccactctggccaagcagaaaaaagctaggtcttgttcagcatgcttagttttcaagagaatccaggtacatagatttgtgtatgatttgtaaacattggcaatacattcaaaaatatttttaaaaccactctgtgggccaaactaaatacatctgtgggcagagggtgacctctgagttacatcatttggctatttcagttgcacaaacactactctacgtttaaatgaagctgggtcaggcctgagggcagtgtggtttggtggaaggattatgatatttacaagctgacagacttgagttttagatcctggctctaccacttgctagctacgtgaccatgtgcacatcacttaaggagtgtcataaaaccaacctcacatgcttgttgcaaaataaataaggaaatgtcaaaaaataaaaataaaagtaattggctgctcttggcttgccttgcaaggaaagttacctcagtcttattcacggccacctttagaggagggagcaggtctagctcctggcctagatcccccatactgaagagtgagggagtagtaaattcatgcatgctctttggacctagacaacccagctggaatcccagcatcatcactcactattactatgactttaggcgaactacttagccttttaagtctcagtttcttcttcaaggaaaatgtgacaaagaaagtttatatctctgggtggttagaatgtcaagtgcctgctacatggcaggagctgaataaagagtacagctcaccccagttcccatccatccatccctccattgattcttcacacaataaacataagtgaggcagcaaaaacaaacagagctacaacaaggcatggcccactgtccctgctgacagcgtgagctgacagtccatgggaggtgtgaagggagggaaggccccgatggcagagcaagttgacttgaattcctgaaagtgcttcagtaagaggaaagctaactcgatcacacctgcacttgcagatctgagattagataggaggtagtgaaggaaacccaactgtcttcaccatctcgcctttgattagttagaaacttaatgagtcagctgaagggaccatctgcagccgtcatgcatcccactagcctgtggtgggcaggctggtcagagccagtagcagcatctcacttccccacccaaagccccaaggagagagactggcgcgccttctagttgcactggttttcaaccttagctgcaaacaggattcacctggggaacttttaaaatacggagatcaacaaaagaagaatactgacacccaggttcacccccatattctgaggcctggcatgagcatcacaatttttaaaagctccccaggttcccctggggttcccctgtgcagctggtagggaaagccactgtgctggggactccgggcatctagcactgacctctccctccaaagtctccacatgcagggacagagttccgggcttagcccactcccttctccacacacacacacacacacacacactcttcctggagagacagcgtgcaggcagaggcagggtgactcagaatgcaaagatgagtgattcacccagcgcttcctctgctttttttgccttcctctgtcccctccttcactggtgtctggtggcaggaaatgggctgtggagtcaggtctcctgggtttgagtcccagctgtatcattcaacagtttcgtgaccttgaacaaacgaatcatttaacctctctgagagctttcctgtccatcaaaggagaaaaataaaactcttcatgaagtcattgggagaactgaatgagataatgtatcagatgatacctggcactagatcagagggtcagttgatgttagcatctttcctttctgcacctcctgcacggataaccgcaccccaaaaaaaacaatagccgcagcaaggttcacacaaaccgggattctgcttcccgctgtggtcaccttggacgctatgtgtcttcaccttgctgagactttgttttgctatatataaagacaaagatgataatgtgatagtgtttctgtacagaataaaataagtaatgcaatgcacaatacagaggagacccagtatccaataacagagacagtacttcgaaaaccttcatgcctgctagacattaggattactgctattattaacagccaccttcgggcaaaccctgaaggacagaactgttggcccactgcagattccaaactgcttctccttgggtggccactcatgatgtccggggctctttacctgcatttccagaagctgtcctccagagagagcatggtatcaagggtgatatctggtccagaagtccccaactctccctgactccaaactggcttaactaactccacatggccacttggttgtcaaccagccatctcacgcataatggagaacacttgagtccacccaacccaaaccctgcttgtccaaagaggacagagcatcttcctccttctcgactcctctcctttcccccgcacagcccctctgtcagtaagtcctggcagctctccttccaaatctgtctggaagccgagctcttctctttctggcttcagaccgctctctcccacctgggtctcagggtggtcccccatgctacctttgccctctgactcagcaccgtgagtgttctcatgtcctcaactcagcaccatgagtgttcttgcaaagcatacttttcatcattcattcagcagttgcttactgagcacctactatgtgctaggctctaacagctttgcacttcctctgagcctacaaggaagccttctcggacctcctctccttcccttttccttcttgtctcccctcctcagacctctcccacagcccaggcttgctcccacctgtggtctttttacttaagtgggcccctccctacctggaaagctcctcccccaacccctgggcgggcttccttcctcacctccttcaggctttgctgagcgtcatcacccagtgaggccttccccatccacctgatttaaccctattcccagttgcgctgagaatactcaccagcagcactagaggctgcagcatttaccccaaaataattttgccacaaaatatctcacttttgttactctattcacatcattctagaataccaactttgaaaaacaaaagatatcattctatttacagcattgtgtttttttaggagtggtatttccatttacaaaatatagtaattctcgatcactgaaaatgtcaaatcctagaaaacccagcattcctatgcataattgttcttcaacagttggctgggattcacttgatgaatctgatttttctgaaatagattattctgatgattcagacaattctgatgttagttctgtttagaaagaactccaagaaacagtttttatattttatttttacatggaaaatcagtcagatttgctttaacctcaaaaagtgtgtttatgtaaaattaaatgagctctggcagctagctgaacatttttttctaaacagggaaagggttattaataaatttgcaactgtctccccccgcccaactccccctccctgctccacttttctcccagacacttgtaactgccaacattccatatgacctttccacagcataagctctttgagggcatgtcttttgtctgttttgtccactattgagtccccagcacatagaaggctccatgaatgtgtatggaatgaatggaacacgtgtttcgaagtgttctggctttttttttacaagtcggtcaccttcagaaccatgagccctaatggcaggtctttgtcagtaccaggctttgtgcctggtgctggggaccctgcagggagcaaaccagccaagtccctcgggaggctgcgtccttccactccctgggtgctggctgaagctataaaggaactcctgcactccctttgctgaagttccaccaaacactcagccctgccctgtgcactctcacacctccctgcctttgcctttgtgcctctgttcctcctccatgctgggagccatccccgggattggggcatggtccacatggagcccctataaaggcagctgggccagccaggggcaccaaggccactgggcctgaccggccacctgtgtttgcagaggtggtcggtgtgggctgcgtcctggatggggtgcgctacaacaacggccagtccttccagcctaactgcaagtacaactgcacgtgcatcgacggcgcggtgggctgcacaccactgtgcctccgagtgcgccccccgcgtctctggtgcccccacccgcggcgcgtgagcatacctggccactgctgtgagcagtgggtatgtgaggacgacgccaagaggccacgcaagaccgcaccccgtgacacaggagccttcggtgggtgtgggcccgagtgggctgggggtgggaccctacaaatgggttgtggaccctcctggaactctgaccaccatagaatgactcattccccagtccactacctactagctttgtgaccttgagaaagtcatacctcccctgagaccctatttccccatctgtaaaacagaaataatcccatctgtctagtctgtcctgtgggatcctcccagcataaaatgaggagtgctttgtaaagaacaaagccctaaaagtgcaatccattattatcctactaaagagttagggatgggtggtggaagaagggtaggtatgtgggtacctgaggagaggaggtatgagcaagaggagatgggtctagtagaagcttcatgatgatttggggcttcccccttgctatgaagatgggtgggcaggtgagatttcagccaggtaaaccagataagaggaagccctggaaaagaagagtggggacaggcccaattgtttcactgctgcttactggaatctagcccagtgccatacacttagcaggtatccaattaatgtttgtcatactgatgggtgggcagatggatggatgaagaatagatagatgggcgggtggatggatggatggatggattggtgaagagatggatggataaatagatgaatgtataaatagatgagtggatggatagatgacggatgaataggtggatgatggatggatggaaggatgatgaatgaatgggtggattaatagatggatggataaatggatgtatgaatagatgggtggattgatgagtggatagatgaattgatggataggtgtataaatagatagatgggtgagtagatgggtggatagatgaatagacagatgaatgtatgaatggatggatggatggatatatgtataaataactagatgagtggacaggtggatggatgaatggatggatggatgaattgataaatggacagatggatgaatagatagatggatttataaaaaattggatgattggatggatagatgatggacaaataggtgaatgatggatgggtcaattaatggatggatggaggatggatggatggatggatggatagatgtataaataagtagacgaggggacagatggatggatgaatggatggatggatggatgaatggatgaactgaatggatgggtggatgaataggtagatagatgtataaataaatggatgattggatggatagatgacggacaaataggtgaatgatggatggatcaattaatggatggatggatggaggatggatggatggatgaatgggtgggtaggtggatagatggatgggctaatgaggatctgaactagggcagtgggagtagaggcagtgaagaaggaacagacacaagaggcattgcttgagtaagactgaaggtcttaatgtcaatctaatgcatggggtgaagaagaaagagggacagaggctgactcccagggcttgtcattgcctaggatcaaatacaagagaaggagcacatttgggccaagggagatctactctgtttgaaacagactgagtttaaggcagagtgccctgcccacgggatcttaagagaagcttccagtttctctttatggggaggaaggagacgaaataggagagctctgaagtcatctgcttggagctgctggtggtgatggctgggatggcctgagggtaacatccacagtgagacagagggggcctgaggcagaggtctgggaatgctgacatgtgaagggtgagcagaataagaggaggcatggggaaacagagaggagggttgggatgtatgaagaaaaccaggagcatctgatgccatggcaggcagcagatgaggacatttctagaggaaagtgcttacgaggcaagcagtagagagcagtagaaaaatggcaatagagtgggagttctaagagtattggtagtttttttaaaaaaaattatatatgctaaagattgctcagggacggtgtggggcaggtttctcaagctcggcactgtcaacatcttggatgaaggaattctttgtggtggggttgtcatgtgcactggaggatgtttagtagcaatctaatgcatgactactaaatcccagcaatctaatccctggcctctacccactagatgccagaagcgcccgctccctcagagatgtgacaaccaaaatcatctccagacctttccaaatacaccctaggagacaaaattgctcggtggagaagcagtcctgtgaggataggaggaggcgtggaggaaagctttgtccccagcagccccagggcagcaaggcagctctcccaccaccacctccccaggagggccacacgagggtcacggggggagcagggaggcagaagctgtctgccattgtgtctggcccagtgaccctgttctgaccgagcacaagcggagcccctgcctagccgaggtgacccaaaaaccaaagcctctttatcctcctgggcaattccctccccaccacctcccaagatgcttgcagctccagctcctgtcagccctgcccctcctgtccttggatgcctcccatttcaggtctttccctctctcactcagtgattcctgcattcattcatcaatgttcccagcacacctataagcttagaggaactgacttacctttcctctttatccttctaatcctagttagatttctcttcttttctgtgtttatcttttcgcctctctttccctcccttcattctttttattacttttattaccttcctcctgtttctttctctctctcacacacacacacgctttttctctctcctcctctccttctttctctctcttttctctgagcttccatctgtctttccatcccttccctgtctgcctgttccctcctctcctcatgcacatgtgtgtttggatgggacaggcctcctctccactgcatcttgttccatctttctgtgggcagttctgtcttaacagcttttaacctgctttggtctcgagctcaccaccattttccgtttttcagatagttagagagcacttactatcttctagatgcgggagatacatgcatcaataggaacatccaagagtgggtagttgagttggctgacagtcaaatgaccacacagactcacattaactaagggctttagcttactaaaggccagggacagcctgggtgtttcataggcgtgaagtcatcttttctatcatggcactagaaagagatgctatagccaaccccatgtgcaggtggggatcctgaggcaaggaggtgtgagctagcttattggaagttacatagccagcaagtagcagtgctgccagttgaaccctggtgatttgactctgaagcctgtatgtcctttttttttttttttttttttttttttgagacagaatcctgctttttagaccaggctggagtgcacgggcacgatcttggctcactgcaacctctacctcccagatcaagcaattcttgtgactaaacctcctgagtagctgggattacagcacatgccaccatgcccggttaatttgtgtattttttagtagagatggggtttcaacatgttagctaggctagtctcaaactcctgacctcaagtgatccacctgctttggcctcccaaagaagcctgtgtgccctcttacccactatgccctcggcatcactgcgacaaaatgttaggtgctggcatgtagctacttgcctttgaacttcccccaaataaactttctctctgcagaggcaggagaatgtcttttaccactcttattcctggtcaggcgtggtggcttacgcctgtaatcccaacactttggaaggctgaggcgggtggatcacctgaggtcacgagtttgaaaccagcctgaccaacatggtgaaacctcatctctactaaaaatacaaaattagccgggcatggtggcccatgcctgtaatctcagctacttgggaggctgaggcaggagaataacttaaaacccaggaggcggaggttgcagtgagctgagattgtgccattgcactccagcctaggcaacaagagtgaaactctgtctcaaaaaaaaaaaaaaaagtcccattcccagcacctagcaagatgattgatgcatactcagtaaaaatctaggccttattattgtgttgccagccgcacaggcaggtgttattgttctaatagggagacaggcccagggtgggttatctaagatcacacagcttgtaggtggtagagcagaatttgaactgggatccacctgtctctaaagatgggtttcctcccatgcttccacactgcctctcttgatcagaaacatacaaggagctgagaacatgtcctccactccctgggtacctttgctggttagaagccaacttgctgtcctgtggggaggtacagccaatttctgtgttcctctgagttctggggaccgcagaccttagtgtggtgaaagtgagggttgggggctggtgggagctgtagattcatgcagattctgttccccacacacagatgctgtgggtgaggtggaggcatggcacaggaactgcatagcctacacaagcccctggagcccttgctccaccagctgcggcctgggggtctccactcggatctccaatgttaacgcccagtgctggcctgagcaagagagccgcctctgcaacttgcggccatgcgatgtggacatccatacactcattaaggtgggtccagagcaggtgtggatgtctagacttcacaagcagacaaatatgggtttgagcctggctcctgaacttcctcgtggggagcatttgtaaagtgggaatagttaagctcacctggtaggtctggtgtaacagctatttcggataatgcaggtcaccagattggtgcattgtgaatttcagtcaatggaagctttggtaggtatcatattattagaatcaggatcactccagagaaacctcagagaccctcaggagtggtcttctataatgattctgagggatccttaccaatttccatcctcccttcactcctgtgccagcccacccccacacagcagccacactgggtgatatagagagcactaaatgaggctcaggacccctagagtcaaatgtctgcttgcattaattgcatgtgactgtggccaatctctgctcatcactgagcccccattccctcatcattaacatattggagttgatctctgaaatccctttcagctttaagagtccaagataattaaaataaagcatcaaagaaaattgggccacattagtttgagccccagtctcagagttaaaagtggatctgatttatctaattcaagtcctcctcactcatgccttaggagtggtcagccttttgtcacaggaaaaacaaagcaaaacaaaaaattcaacagttattccatttttggaatgctgatggtttcttagggatgttgaggacagggttgcctcccatgtagaaaagacagcacagcttcctgtgatcctcttcagacatccaacatcactcctcatcccctagacaccttctccagtcatctatatattgatcaactggatccatttttcttcttccttctccttcttctcttctttcttcttcctctctgattatttttccctgtaatactagcttttgtattttctgcacttggtatacagtaagcattccatagacatctcttaactgaaaacgtacatggaaaaggtaccagctgcagaggaatgacagcaaaggtcgttagctgagtgagatggctctaccattactggaccacgtaatgcaagtccaagccaattttgatttccaaccaatttttttccagaattatgtgccctcagagggtttcccaaattgggcaagcttcatgccgccatacagcctagatctagcatactatttacacagtagaccctgagaaccctcaatccaatgggtttagtaagtgcctactctgtactaggcatggaattataccacagaaacacagaaagaacagtaaatctcaagtggcccatagcccagtggaaggtagcgttacctttaatgtcaaccatttgaatacgttgaatactaaaggtatgtgtgaaaggccacgagaggcaaaggcaggaggggcggttagggcaaagcgtgtcccctgagtgtggagtcccgatgccagttctgccactagctagccaggggaacttgcttggatgaaggagctacataggctccccatgttggtgaaaccatgatgaatgactggccataggcaagacaaaaatgcaggacaaaagagaaactgcaggctgtgagatacaacccaaacaaaacatttttctctgtggtcctccatttacccctgtgcggtatgctggatctcactgtgtttgctgttgtccctccttgcttgaggatgctgtgaagctgaaagtaaggtggaatgctcccacatagtgagaagggaaaaactgggggctcaggggaagaaggtggttgtccattctctgagcactcccactgaaagctcctttcctttccttcaggcagggaagaagtgtctggctgtgtaccagccagaggcatccatgaacttcacacttgcgggctgcatcagcacacgctcctatcaacccaagtactgtggagtttgcatggacaataggtgctgcatcccctacaagtctaagactatcgacgtgtccttccagtgtcctgatgggcttggcttctcccgccaggtcctatggattaatgcctgcttctgtaacctgagctgtaggaatcccaatgacatctttgctgacttggaatcctaccctgacttctcagaaattgccaactaggcaggcacaaatcttgggtcttggggactaacccaatgcctgtgaagcagtcagcccttatggccaataacttttcaccaatgagccttagttaccctgatctggacccttggcctccatttctgtctctaaccattcaaatgacgcctgatggtgctgctcaggcccatgctatgagttttctccttgatatcattcagcatctactctaaagaaaaatgcctgtctctagctgttctggactacacccaagcctgatccagcctttccaagtcactagaagtcctgctggatcttgcctaaatcccaagaaatggaatcaggtagacttttaatatcactaatttcttctttagatgccaaaccacaagactctttgggtccattcagatgaatagatggaatttggaacaatagaataatctattatttggagcctgccaagaggtactgtaatgggtaattctgacgtcagcgcaccaaaactatcctgattccaaatatgtatgcacctcaaggtcatcaaacatttgccaagtgagttgaatagttgcttaattttgatttttaatggaaagttgtatccattaacctgggcattgttgaggttaagtttctcttcacccctacactgtgaagggtacagattaggtttgtcccagtcagaaataaaatttgataaacattcctgttgatgggaaaagcccccagttaatactccagagacagggaaaggtcagcccatttcagaaggaccaattgactctcacactgaatcagctgctgactggcagggctttgggcagttggccaggctcttccttgaatcttctcccttgtcctgcttggggttcataggaattggtaaggcctctggactggcctgtctggcccctgagagtggtgccctggaacactcctctactcttacagagccttgagagacccagctgcagaccatgccagacctactgaaatgaccaagacaggttcaggtaggggtgtgggtcaaaccaagaagtgggtgcccttggtagcagcctggggtgacctctagagctggaggctgtgggactccaggggcccccgtgttcaggacacatctattgcagagactcatttcacagcctttcgttctgctgaccaaatggccagttttctggtaggaagatggaggtttaccggttgtttagaaacagaaatagacttaataaaggtttaaagctgaagaggttgaagctaaaaggaaaaggttgttgttaatgaatatcaggctattatttattgtattaggaaaatataatatttactgttagaattcttttatttagggccttttctgtgccagacattgctctcagtgctttgcatgtattagctcactgaatcttcacgacaatgttgagaagttcccattattatttctgttcttacaaatgtgaaacggaagctcatagaggtgagaaaactcaaccagagtcacccagttggtgactgggaaagttaggattcagatcgaaattggactgtctttataacccatattttccccctgtttttagagcttccaaatgtgtcagaataggaaaacattgcaataaatggcttgattttttaatgtcatttttccctcttatagtctttctagctccttttcaaaagacgagaatatctgattttctgataatttaggtgcttaagcatccaaaatacatgggacacacaaaaatccaggaatcccctgtagcttattccctctttcccatcggaaccagctctcatcacacatttaaaagatgattctgtttacccaatgctgcatattgaatgttgtgtagttattcacagggaattctgtgcagtgtgcagagagattcctaaacgggaaaaggactgggaatacatcctccttactgtgacctccccaaaacctagtccagtgcaaggtatacagtggtgctcattaaatacttgatgaatacaggaagctgtgcatgtgttcctacttttattcgaagctctcttcttccaaagctacatgaaaatagaattttaacagtcaaaattttatattaagtgccttagcaaaagagacatttaatatttcaaagaaatgcatatgtatgtatacatatatttgtgtatgcgtatgcaagaattcttgtataaagagaattcactccatgaatgatctcttctgtaagtcagtgtgaatcatgttagattttctgagagtgaaaacacctgccatctacaaattacaaggctggataacagctcactccatttgaaattcagtggaaacccaagagctaggttcttactgaatttgcatctcaatttgggaaactgaacttagctttcaaagatcataggaagtctggttggagaaactagggattattctggcaatgggtggaggaaggtggtcagaataacccagtcgccattggttttgagaaacggaactatcttatgcagagcccggagggcaagtctcagacccatgggttgaagccatggagaaggaaatttggatccaatgtaatgaagctctttctaagtcagaatttccctgcaatggtgtggcctgattcaataaaaattaagaataataaatataatggaaaaaaatctccactgattgagtgtttacttggtgccaagcactatgctaagttgttcattattttatttaattgttacagcaattttgagtatgcatctttcactattttataagtggaaaagagaagtgcccccaaaaagttagagctcaaacagcagcttattctaccagcccctgctcttgcggaggcctctggaaaagacctgaatgacacctattggagaatcacatctacaaggggcttcaaacagaccaaatagatcatcacctctgtggtcccttgttaactatatgttctgagacaaaggaaagctaccctaagggttagttaacctttgctgaggaaatttacattcatacttagagtgaattactcaggtgtgcttaggtgtgcaaaagggaaggagacctgaattcaccaagttaaatcttgctaaaccttatcataagcattttttgagcgcttagcatacaccaagccttgtggaaggtgctttcctgccatatctcatttaatcctcacagcaaacctatagaatatggcattatcatctgagtctcacagaagtttagtcgtgtactcaaggtcttaccagctagtgaacagcagaccaagactggaaacccaggatagtctgatacctgagccatctcttcttgtgctacgcctagttattctgtcccccaaatcaaaaggcatgacctttataagaggcgctttactgacaatagctgcaattttaactttgaaaatgattcagaattatcaaagatagtagattcgaatgacatgattgtctataatctcgctagccttgtactgtgtgtgcatagcaattacagggaagtaatctagctcctgactattatgttgaactatgtcgctgctttttacaaacttgtcttgatccaaagcagtcacaatgataaccctgcatatctgggaatcataagtcaactatgtatctctgtgtgtgtatatatatgtatg

SEQ ID NO: 15905 - DNA, 27455 bp, Human
gcatgaagaaagaagggcccgagcctcaaatttgcaagggcatcctcttttctagtcacaaagatcaacaggatccaaaaaggatgggatttgcgcttcactttaaacatgctgcccgttctagccaacccttctgtggtgcactatgagtttatagcttttgcgagcctggtcattgtcttcggaatattactatgcattagcttgagcagtaagtgacaagttgttcatgtaaatgtctaagatatacggacttttaaacaactctcattttggtgttccttgtttcttaatatagtaggagtctcacctcacaccaccccttcccttaaattatggagaagtgcagacctccctcaacccggggagggccttgctctgagagtgtacttctttccagaacctgtacacatagggcatggagacaggactcaaggccagggtgggagttggatgggctgacttttgtgcccttcataaggtttgatcctgagctgcagacacaggtaggtgggagattagtttccatttgggctggaggccgatggggggaccctgttccgtctcttctctttgaccccacaaagcaggcagagctctatttatgaatgtggccttcctctctgtgcttccaccatccagagggaacgtggcttccctaaaaccctattctctgataatctatgtccctttccaaaatatttgtatgaaggtccagacttggaaattttatcattaaggacaatcagtaaacagagtaataactaacatgtattctatgccacgccacgttcaaagtggttcccatgctttatctcagttaattttgtgaccataacccaacactgttcaattagtgttccccaaaacagtcagaaaaaggttaatgacttggccaggcatggaggcttatgcttgtaatcccaccacattgggaggccaaggcaggtagatcacctgagatcaggagtccaagatcagcctggcaacatggtgaaaccccatctctactaaaaatacaaaaattagctgggtgtggcatgtgtgcctgtaatcccagctacttggaaggctgaggcaggagaatcgcttgaacccgggaggcagggttgcagtgagccgagatcgtgccattgcactccaacctaggcgacagagtgagactgcgtctcaaaaaaacaaaaacagaaaaggttaatgacttgcccgaagtcatctagcttgtaagtacacagccagaatttaagcctgggtggttaacttgaaaaccgttatggagcaacccagagatttagcatcagtgattcaaatctcagttctacaattacttgccatgtgacctcatacaagtcacttaccccttctgagactcagtttccctcactgcacaatgggcttaagcatgatgcaaggactttacaatgatcaaaagtaacagttgatgtgaaagggcttcagcagcatgcagccagtccacagagttgttatgaagttttcctctttcatcctttgttaaagcatgctgacaaactcaaaaggatgacaaaaagtagcagcagaaagtaccttctcctcatgcctttggttgtacagacacacaactcctgtactccaaattcctggcacacagagttgatggtgagggcccctgagtggagatactttctgggccacctgaaatgctgcttggtttctcacacaaaccctgctgtggctgcttaccatcctcagcaagggtgcggaggaatggaaacttttgccaccaacagcatttgctagcaacttccctctctgtggtttttctgtcattcccttgataaaagaacttgagctgcgcaaaagtaaccaatcttcaccaatctcatcttcacatataaacagccgcctttcaagaagcaagctgccagaaaaatgatgcacgatgctctctaaactgggtcattctccacttggagggctcagggcacggttgactttccccgtctgtctcctataccacaggctctgggcatcaccagcggccccagggaaaaagaaagaaatgggaaacagcatgaaatccacccctgcgcctgccgagaggcccctgcccaacccggagggtaagtctggcttctctggtgagatgcttgagtctgtgctacaagagcctgtggtaaagactgggcggtggtggatgccggtaactacttaaatggggcaatgggtaccgaagggctcattatatctgtctctctagttttgtttgtggttcaaatacttcataattaaaagacgaaaagaattgggtgctcggcgcacctgaagggtgtcaaatctttggcattttgagatggatctccaagatcagctggtttaatcactttattttccagatagggagactgagcctcacaaagggaatgggatccacatcactgggcatttgctgttaaatttccaatccaggcccatccaattctgaaacctagactcctgtttaccaaactctggcagcccataatataatatcatccttatacttagccccgcaagagctggatctgtgttacttttctaagctaggcaccatcctgtgacatcttcctgaaaacaaaggaaaccttatgtcccattggtgggattgcaaggtgacaagcattctcgggggaagagcctaatattgcaggttaatcagtgatgaccaaagtcagctttttggagagatgtcaggtttggttagactcccaaagctacaaagagtccctcagcaactggtcagaggcctgggagggaacaccagtgaacaaagggaaaaggctgaacatcaaatccaccatgctgtggactcagctatgctggccccttctaatggcctgacctttatttcctcagattcctagtccataattctcatattgtggggtcttgggaaagggacggttagggaagccagggggcaccttggaacacttctgcttcccaccttacatggtagcatttggggcctggtgtcccatttcctcgcaggggtgaccacacatggttcccagcagcccctgcagcaccgccctgggcggagttcactggcgcagatggctgccctgtctgccgagcctgacagggaagtggactgagccaggttcctgcgctgcctccaggtactgcacatttcatgacttctgtggctccctcacaaaggagccttctcactgcttccaaaatggacaggcccagcttgtgtggtctgatggcctccaatgcccccaagccagcatgccaagacccagccaccccacacccctttcaagtcagatgcagaacaatcctagtgctcttatttatctagtgaagtaactctccttctcaagccaaatgcaagagggataaacaaaaagaatattccccaggaccaaggaggtggaaccagatgacaaggtggaacagagcatgtgctctcaggacagcagccctctatctcccatgcgacactcagaacagcgtgcaacgtgcagggtggctgagctgctgctgctgtcaggagaatgccgggctctttctcaccctctccaaactggctttggccacagcctcctcctctggtcataaccactgctagaaaactgacaccgcagggccctgagcccaggcaggctggggaggcacccacccaccgaacccatcttgggtcgtcacctctcagcctggggcagagggggcagcatgcttgagcgaacctcatgaaaacatcagtctccaaggcttgctcatttgccttcaacttttcaatgcaaattgtcatgaaataagttgattttgttccattatgtgggtgggaggtcacctctagaacagacatagagagaggggtctccccacccctccaccccctggtgaagagaattcccctggtcataccccgtttgtgatccaggcaaccacatcaagcgctggtgggctgctttttcaacccccagccctgaaacgttcccccgatcattggtcctaacgttgtttcctcttttctcttctacctacttgagtaagggaggggaaggcggtgcagtgatgccgtgttaagtagtccccatctgcctcatgcacagggtcagagtttttatggaatgagctgctactcagctcaagctcctatggctgctcatccggttaccctcaaacaagtaacctaggagacggtgcaggtcttgctggttgctttaggccaatgtgcaattagagccagctcccacattagcttcagtgccagagaggcaccacagaccctccacagaccctggccgtgcacaaggatcacccagaggccagcctggacacttttagacaaccatgttttctgagcttttgggagatcattcttctcccaagccaggacagtgaatgccttggaacatggctttacccatctgtttttttgtttttttttttttgttttttgttttgctaaactaagatttccagaatattcttgattagtcaatttctcaggaactaatgtcttaaacctacaaaaggaagcaggacttgagggaaatagagcaagtttcagaggcagaaggccctcactgagcttccagtaatgttccgtggaagctgtgtgactttaggtgagtcactcgggctgccccagagatctggaacaagtccctcctcacagcgacagcatgatgcagggcaggcaccagcaaagaagggtgtggaaacttttaaaaactctgtttggggttacctgactgcaccaggttatatctaaatggccattccccaaaagttttaaagtggtgaaactggtagttctgtaatttgctttcaaatcatcccaaagtgttcattttctctacaattctatacatacttctgtaccagacatgggcagtacaggattttttaatacaacctagggaagtcccgctgtggtcaggaaatggcatatttccaccttaaaatgagcactctgtctctctgctgtgatctttttcccctctttgttccttctcttcttatcaccctgacctgaagaggcaccaacagaggcagcagcacagacccctttctgtccgtgcaagggtagaaataatgctgtttacatagttgcccagtggaaagaagggggcgggtggggctcggggaaggaagaaggaggtagggacctctcaaacccagcttgcagcttctcagtaagtggtcttcgcaccacctgcatcagaatcccctgggaagtaactgaaatgcagattcctgggtcccaccccaggcccacgaatcagaacctggggatggtggaaggtagccgccagctgaatttcctaggagttcctggggactctgtaacccctaaagcttgcagaccacagaccagcttttagtcctgcccctgcactgacacacaacgagagatgagaaagagtttatctccttagtctctctgtcctcctttgtaaaacgggaatgattagagccgcttggtgctcacagcctccagacacagtgcccagtgctttacatatgcagactcgattctcacagccccacgaggcttctgcctattatcatctccgttttgcagttggagaatctgaggtacaagaagcttaaatgacttgccttaggccatacagctcagaggagacagctgggattcaaagccaggtggtctgactccagggtccctctccccacctcagtgtgtgcctggaaaggatagggtttcaagaagcccccatgctctggaagaggatgggctcgtctcgaatgaatgagaatgtgcctggcccccagatttaatgacccagatgatcaagtgccctagcaaggggtcccacagacagtgaatccgtgtcaaatcttggaccagatcccttttttctatttgaatctaacctcgctgctggtacatgagatggtcttaggcagaacttgatcattcaacttttacataattgtacattgatgaacatcataaaatatataactagcccaagaaatccacgatgtcacattgcttagaatagcactcaagtttttttaagtaaattaatttttaaaaagacattatcaagtaactagtgctgtcaactatgtcaaaggagacctgagtggttcaaacacagccatgccctgccctgcccagggagacctggttttgaaacctggcactcagcttcctaggtgtgtgctcttgggcggtctctggacctcactgtgcctctatttcctcatactcaaaataaggtagtttcaatctatcaacctcacagggaggcgtgaggacttcaggggtaacctcggtaccaccacagcccagtgcctgattccccccagagctgtgcgccctgctgctgctgctgctgctgctgctgctgctgctgctgctgctgctggtgatgaggagggggaggaagggaatggtggaatgaaaacaactgaagtctgagaagccctgggtgcccaagtaaagcacattctgagtctatgcagtccaaaatattcattttgactatttcttgcttctgttctgtgctagccctgcctatatccctctagcatctaagagagttgagactgaccctgaaaagactcaaggtctgtttagttccaatctgtccccactaacatacggaaaaaccaaggcttgggcagaaaagagctttgtgggctaccgggtctcaaacacagccctttacatatgactaagagggctcacaagcctggttcatggtgacccgcagaactcggcagaccttctaccaggctagatggtccagctctgtgtgattggttagttgcatgtataatcctgtgtgtgtgtgtgtgtgtgtgtgtgtgtgcgtgcgtgtgtgtgtcctgaagatgacactgaaagtcaggcctgctttgacccctgaggagaccatgagtttaggcatgactccaggaaatgcaaaacaagaggctgcaatccctgggctgtacagctccctacccaccagttgccctgagctgcttatgctaaccctgacaacttacctggagtctgcctttgtctcccctgttaagggtcaagtgtgggctgaggagagcttgaagattaagtgccaaggagagccgtgtggctccgtgaaggaccctgggctttgaaatcttcacactttcccctagataggtgactaaaactctcccagctttggcttcttcacccttaaataatcacgtattttctgtagggctgggcagggcactggaagtgacaaacgactagttttattagacagttataagtgggagtgactgagaatgttctcagcatttaaaaagaaatggtcatgcagcaccaaagaatgacagtttacaaaagggcccgtcctctcttgactaagtcccgtaaggcctgcctgggtccctcccctttgtggattcgtttcctattttacgcttttgtacattttgttcaacttgactcattcttaagttgagctatcagcaaatatttggtcttttgaatttcatcttctgttctcaccaagtggagttcatttttagagagtaagaaattatcaagtttactagtttgcaaattttagaaagttattggctaacactggtcttgagttatggtctggtgaccccgctctccatgaaaataatattagcttccacttactaaggcaggccctaaaatgcaatgcatcctgaatccttcactcaatcctatgaggcagattttggcaatttccctttttattcacgaagaaatcaagctcagattagttaaaaataaatctccccccaaatcgcatcactgtgtagtggcggaggtgggatgtaagccagttctgattggtttcaaagccccattctctttcccgaaaattctctctgggtttcttctttcatgcgcagtgcatatgtcttcacttaatttgtttccttatcttaagtctgcaataattccactgacttcctcaactctcctcttctctgcctcactcatttatctctgcttgaattcaaacgctgagctctccataaagctaaggagttctaggagtagatgataatatgtctcacctttaccaacaaacttaaatttcctacattgcatttatttttctgtagcaaccaaagctcagggaagactttgaagggatcctggcaccaggccttgcttaaaatggccaccctgccccacagaagtacaagccaaactgtaataccttcccagtgactttgtcccgtttggctaatggtgatgataaagagaggtgaaatctcttgcaaaggatcaggcacaggttatctgacccttaagcaaaagcccagatgtaaagtttcctcagtgatgtttaagtgccatagctatcaaaacatcactattacggaaattccacaggaaacttaactttgttattgtgaaattgaaactctccaacactctaagcctccctttccctcattggaacagtggtttttataatgggattttgcttttgtttttgtttctgttggtttttgtttttaatgttaggaaagacaattgttctgttccacagtcttaatcttgaatttgatatcaaacctcaaacccctctgtagacacaccatctacctcaaggttctattattgtcacagagaacacacactgtgcctccccatttcaacacgttttttgcaaggggctggttccacaatggccacctacccagctgcctcccacaaatcaggtttccttctgcctggatctgctttaaaactgtagcttgacagctgtatttaaggggcattgcagcacagggaccgctctgcacattcagtaagcctgctttgagcatcctttgtaaaacaggtgtggcacaggctacagacacagaagacaccagtattctgccctcccggaactcacagccgggggtggggagagatgggcattcccctgacagtcacacaaatgggaaaatgcaacctggggtaaccgcttcagaggaaaatcttaggggccaagaggaagaattagtacagcaggaaggctgagcctcctctggagcctctgcagaggtgagtttagagttgacaaaggtgggaacggtgaaggagggaagagcagggtgtgttccaggcagagggaacagcctatccggaggctctgagaaccagggtgcctggcaagttggagaaaggcccatcacatgtagccgaggcagcacagtgccatgttaataaacggcccattcatatgtgggggccattagtccaggaagatagatttccatcttgaaggtgtttttcaacctctcattttccagactaggaaacccaggcccaagaggagaaggaggcgtcccactcagtgagtggcaaagtcagcctcagcttctgggcagatttgccaggaagccaaacaaatcatacgcctgagacccccttgctggtacagcaccttgctggggtctgtccttcattttgtatttgcaattgtgtatttttttcttaaagaggactgccaaatttgcttaagctttatgccctgccaaatgtgaacctgccctttgtgagaacttgggacttctggcttcaaacttaacacaactgtaatgctgcctctacttactggggtggagtcaaagctacacagggaagaatcccttttttgaattcagcaaagcagaatgtgagggagctgccccaacaggtttggggaaggtctgcagcaggacaggtcagaggtctggctgggccagcccttttacgtcccgacacgactgtttctcaaaagccctgatccctttccatattgtaaagccactaaagatcactcttggtttctgtcttacacccagaaactcttgcttttacatggcttattgtcagggactcagcttccccaaatgaacaatacatttgactgcactgttccaccgtgattacttgtttctaatttatttatcaatcgataagcataacctttgcccaaaacctcactcatctttctcactgattctagtatttaatctctctttagacttagtctgcccaagaggcttatgactcggaggctgcaagacatatgagttgtaagaggcaggatctagaggtgtgtggatcctagaaagtggcttgtttgggccccaaagcccacatgcctgagtactgggatttctccagatcttggggtgagcgaaccagggaacagttcctcccatgactatttatgtatcctgtagaacatgagctccgtgaaagcagcaagaatgggcttgcttttctcacctatgctgcttacgacaggtgctcagtaagtagttgccgaatgaataaacaggtgatgttacccagaattttaagttcaaagtcccagccagcaggtggagtgatgaaagtcatagcaaataataactgtatttgctgatacagaagacatcttgttatttcccccaaaaatgtatccaaatattaccctgcatctaatgcatctgaattacatcaaatcactaaggatagaagcagacgtatcgctcagtgtcaaaaagcaaaatcactgtctctcctctacagtcaggaaccagacagccctctttccttttcaaaacttcaccagaattcctttcaatacactattaggaaaagtactaagtttttcttccaccacccccaccctcaacaaatgtccctattaaatagatgcccagcgtggggccttatattctgcaagaaataagtattttgtttaacctcagagttactgcctcatggtcctaatgggtcctcagaactcattttgcctcacactccttccccaaaagtgtcatagatataacaactctgagtcccagagtggacacccgaggcattggtagtgagaaggggggtttttacagcaacttatgtgaacgtatgtggtgtaacatactctcatctcctctcctaaggaccctggaatgaggtagtattagtcccattttaaagatggagagggtgaggctagtagactcgtaacaggcgctgaagccagaccccatgactcatctcacagcctttggatcccatttctcagatgagaacatgagggccaaggcaggcttaagaataggagcatgtcacctgaccctcagggctcgtacgcacaccctgcagagccatctctgaagagaggaccttgctgtaaattggtggttcaaaacaagaaaggtatttcctgctggaaaatctcatcttcataccctccctcccaagcctacctttaagctccttgtgaataaaaagcaccttgcccccttcccccttgcctttgtttccccaggactggatagcgacttccttgccgtgctaagtgactacccgtctcctgacatcagccccccgatattccgccgaggggagaaactgcgtgtgatttctgagtgagtcagctctccaaaacttgtgcaatcttcaaagcaggataaacttggtttgggagaaaagtatttgattgttagctagagtggtctagttccacatgagtcctggtcctattatgaggtgagaaatttgacccatactgcaaccctcctctttaatgtggccagtgctctagaaccttccatagctccccactgcctggtagatcaaatttaaattccttaacttggcttttgagatcctttatgatccagcctcttctcatattcttcttatctcccaccacatgtgcagtgttgatgctatgtaggaatgaagaccgggaaggcagcccccagggtctggaaatccttcggatgagaaaaaacaaaaatttgccttctctcctcttacctctgcagtctgattcaatatgggctatagaacatgacagaagttctaagccccttttatttagatcttcactgattcagatatatgaaactatctttggctatactgcagagcataaatcaacatagtaaacatttatttttaaaaagcctccaacagttgggaacattagctgctaatccctgaaaagcagctatttctagcacatgggagggtttaccagttggcttgcaatggagggctatccactggacacatatcctttaaaaagaaaattttcagatgacgaaatatgggttaacgtggccagtgacagatcttaaaagaggaatgttccaaactgtcctgggttaaatctgattactctgttcattcatcctttggttttgctatttacctatctctgtgttcttctctgttcttgttcttacagtgaagggggctggtggaaagctatttctcttagcactggtcgagagagttacatccctggaatatgtgtggccagagtttaccatgggtgagtacatttctcaaatggcagcaattaagcatgatgcgtatgctggtgactcataaggtggaacaaagattccagcattcatagtggtaaggaaggcactgggtcaagaagagatagtcctgctcccaacccagtcaataaggaaaggagcaaccttgggctaacttatctcttctgctctctgggactcaacttctccctcagtaaaatgaaggaagttggacctttcagctctaacatggtgctcctggcacagagtggtaaacagctgggaaatgttatgggagggcacagcacagtgcagagactagaagtcagtgtgtctaggttcaaatcctgcctctgtcacttactggctgtgtgccagtgaacaagctttttatgcatcagttccctttcctcacctgtcaagtagagatcataacatagaacgacagggataataatatatgataatatgatcaaagtgtagggttgttaggagaataagatgtaatgatacatgtgtagttcttggagcaatgccaggcattacagtaagcactcgataaatattagctctattctaatcaaatacctatccagaaacacacagaatccttactgccaaaaatgcttatgtgccttccttgaaaaatgggtaagataaacaagagatatcttagaaaactaggctcaacagataagaaaataagcaccctgctttcccctgtagtcgttccagtgaggcctctgcagcctcctgggtggctttggagccctgaacacctgggcacaaatcttggcttccttccttccatgtgagggtcctgtaaaagtcgcttcacctcctggagttacattatcctcatctgtcaagtgtcggaagctggaagttggcaaagaaatgcaaagcacattggaaatggaaaagaaagaaggaggcatccattgataaacactaagttacttcttcatgtccagaggactctacatgccacatgctcatcttgcaaaacagagataaccacctgaatcctttgaagactggaattctgcgagtttaattttagtattcatgatcttaattgtgaataccagatgccacttccatgcttaggatgatgaagctaaacaaaactgaagcaggagctgccgtgggagtcacgttctgaaagagatgggagtcacgtgactctcctacatcagctgcttgccctggagccattcattcactagcaagcatgcatcaatgccttcatgctgaagatgtgaggctgcagctggcacgagctgggggtggtaaggaaccaggaggagtgacataattatgaccctatgaggctaccaatccaacagaggtgatcacatcccttaacatatcaaataggaagagcagggctgagcacggtagctcacgcctgtaatcccagcactttggaagtccgaggcaggtagatggcttgaggtcaagagttcaagaccagcccagccaacatggtgaatccccatttctactaaaaacacaaaaagttgccagacgtggtggtgcatgcctgtaatcccagctacttgggaggctgaggcaggagaatcacttgaacctggaaggtggaggatgcagtgaaccaaggtcacgccactgttctctagtctgggtgatagagcagggatccatttccaaaaaaaaaattacataaataaaaggaagagcagcagtgaagtgaggtggttatggaattggatgtcccagaaaaatgcattctaattttaactctatcaactgctgacatggtttcctgagcaaactacttaatcactggaaccctcagtattctcatctgtggaagagagatgatgcttcctgtctcagtgggttgaggtgaggattaggtttcaggtgcttagtacggtgggtggcgcattcctgcctttcctgggggagggcttgttccggatcctaatggctgtcttcctccttcccagctggctgtttgagggcctgggcagagacaaggccgaggagctgctgcagctgccagacacaaaggtcggctccttcatgatcagagagagtgagaccaagaaaggtgagtggcccccaactcatctttccccatccggggcagacaagcatgttttgctcctggctgactcattacacggcttcattttccttcctcctacgtccatgcaaattgatccaatgtagttaagctccctgcagcccacacgctgctggggaggccagtggggaagcaaggggactagagacaggcagtggggagccggctgggcactgccacgggcctggccaacatcaggcctgatgactcctgctggaaatttttccagcaactgagaacaaaactgaacgcagtgtgtaggcagcatgctgtgcagatagaatgtggcctttggtatgggcctgggctgtgctctcaagctctgtgactgatttgtctgaactcagttttctcatctgtgaaatggagagaacacctctcccttgtaagggtgtggtgagattcaaatgtcatagtatttgtgttgctcttgctgcacagacagtcccgatatcagtttcctctgtgctccgtaactaaatcagacagctccgagaatcacatgtgtcctctcacacagtcaccatcatcactagcattacaatttccttgcatcatatgcattaagtaccacagtaaaaacacaaatagagtgagctctttgtcatgatgcaaagcaagggtcccaagttccaattttagccttacaaattactaatttactgcttctctctctctaagcctcagctccctgatctagaccatgagatttacagtaggagagtaccatgtttatccccaaatacttaacagctagggttttcccagactgaataataataataacttttttaaaattcagaaggtatcttcaagttcttggcttgcttcttgtacattcaatatcaaagaagagaaaacacactatctgagagtacttcccatgcacctaataagtgccaaagccacctggtgctagagcccttcaccaaaatgagcatcagccttgctttcagaaagcagggaccacatatatatgatttaaaaaaaatctgcgatcaacttttctctaaaaaacccaaatatgctggggtacagaaagatcaatgcaaaagcaaaacatcctgtgcctgtcctagaggtccccggaggcaggatgccccgactcagaaagaaactcctaagctggcctggccaaagggaggaagaacccagggtgggtgtcgtaactcatctaaaaataacgatgtcatcaggcagatgtgccattgtgctggggctgggtgggtgtggcaggcccaccttgggtatgcaaagctctgacagtgtttcacttgctaccctcggtctgcttaccacactcccagttctgctgaccttacgggaaggctcatgctgggttgactcacggcaggcctagagcactgtgagggatgtgtgaggacaagggtcacaccccagggtggcatttccaagccccatgcctctggccatatcccataggggctctaggcctctgttttcccatctttaaaataattgggggcaatacctcctatgatctttctgagaattaatagagatttcatggcaattgcttagccctgcccagcagagatagcaaataatcaatcagctccctttctcctctgtctcttgggtgttttctactcctggaaccccagagcaagagaggaccctgaaacatggcctacatccaattctttcattttgcatttgaggaaatcgaggcacatggctgcggttctactcttaccaacccatatcaggtcattgctctaacgaggcttaaggagcaataacccgcctttcacgtggttcttacggatacccagaaagatgactcagcttctccagatttctgagaagactaagcataagtcagagagagtatagacaaaggaaaagggggcataactgcaaggaccccctcaaatgtgtgctgtggcagcattggtgggacaggggctgaaagagcaaaacagtagggatcacatcttggagagtactcgggaaggagtccaaaaacgaccatggatcctggagctacaggttgcaaccaaactacaatcattccatttggcctcaggatgtggaagcaccccaaatgtgtttgcctcaaaaagcaaagaggatgaggcccggcatggtagctcaggcctgtaatcccagcactttgggaggccgaggtgggcggatcacttgagtccaggagttcgagatcagcctgggcaatgtagcaacaccgcacctctacaaaaaataaaagaattaactgggcgtggtggcgcatgcctgtagtcccagctactctggaggctgaggtgggaggatcccttgagcccaggagatggaggttgcagtgagctgagatggcaccactgcactccagtctgggtgacagagcaagacccagactcaaaaaaaaaaaaaaaaaaaaaaagcaaagaggatgaaacctgtgttcctgaaaacctgtaaggaccatgtgatgaacatatctgctttgacacaataatacacttctgcagtctctaacgggaagcaacatctaaacagagaagggtctagtggagggaggggctgcatcctagcatcactgttgtatcccaagggtgggcaggtctccctgcctcagtggtggtgggctggttagctgggtgccttggggtgaggacaggtggagcccactgacttatcctccacctcctgcagggttttactcactgtcggtgagacacaggcaggtaaagcattaccgcattttccgtctgcccaacaactggtactacatttccccgaggctcaccttccagtgcctggaggacctggtgaaccactattctggtaagagacatacaatatggagtgattgtgatggtgggacccctcttagctaattgctctgtggcgccatccgtctggaatgcagaggggtcttgcttactgcctatgctgccttcatgatatgctctctcgttaattcagactgtaaatttcaggctgaaacagactgcctgtgcatgttgccttaataagtcaaatgcagctaatctcaaatttgccctctctcgaagtgtacattaaacaagttagggtgtgcctaaattcacaactgcaaccagcttgcacatccttaagtgggccatacatattcaagcctctggggctttgttgtagagtgccactcatttccccttttctgcttgtcagaatcctcattggccttcaagaccaacatgaaacgcctctgcgatgaagctataggagttagcagtggctacctgtcttcgctgtgctcagagcatgccaagggtttctttcccagcattccgatcatgcttccccgtggcctggttaattgtgtgctaggctgtattcctcaacaggctcctaaagactaagaattacatttaattcatttttgtgcccttcacagacccaggagagaggtctgaattctcccaggctgataagatggggagcatccactgagataaagcaagcatcatgtggtgtggtggctggaagagtgtaggatactgccagagagagaaagttgagttatactgtgaaaggcccaaatgtcagctcaggaatcggaactttaccctacagaaaagggagaaattgtgaacggttggctaaatgctacatttccaaaaacccactcaggaagctctgtttctatcccagatccactcactgttagctaggcagcctgaggttggctgtttgtgtctcactttcttcatctatgccaggcagacactagtagttccccctcccaaggacaccgtgaggatccacagagttagttcatggaaagtggggagggtgcctggcccataatcgtgagctcccattaaatgccagccacttttacccagcggaacattgccatcctccccacttcctctgcatattggagggaggaaagaaagaggttgcttttgctttgacagcatcttcccccttctgggttcaggatgcttgacctcacacactggggcaactttgttggcattctcttgcatatgggctcttgaactgagcaagcaaagtgcatttcaaggagaaatgggtccacagggctttggttatcacagctggcccacgagaagcagtggggcatgaggcaaaaatggctgctcaggagaggcaggtccaagctcagatttgcaccttgtgaggccttgggcaaggtcagctacccctcagaacttggggtccccatttatgggaggtgggtgaatatgggctcctagcaggtgattattaaacacaatcgttcatgtagtgcgttcagcatagcctgtcacatagcagatgcaaaataaatgataacacatattacttgtgatatccgaaaacttagcagccaggtaaaaacgaaagaggaagggagtcctggaaacagccaacttatattggttatgagaaaaggttggttgtggtatttggcttttaataacaaccatcggagggggtgtggagaccataagttttgcatagacaaaagcaaacatgagaaggatgctgtcctagcaaagcttctagggaccatgaggccatgaggctaccaggccagaaataccgaaatctaactgccgctgcttgaccatggggaatatctcaccccagtgcagcactggcgccttcccgcagtatgttcctggtcatcgaaccactcaatggattacagtcatctgttcacctctgtgaataactgaaaagggtaaaaaccggaactgtttcctatgccccttgagaatctccaagtgggagccacatggccacttttatctccactggattcactctaaagacacagatgggccaggcatggtgggtcatgcctgtaattccagcactttgggaggctgaggtgggcggatcgcctgaggtcaggagttcgaggctagtctgaccaacatggtgaaaccctgtctgcactaaaaatacaaaatttagccaggtgtggtggtgggcgcctgtaatcccaactattcggaaggctgaggcaggggaatcacttgaacccaggaggcagaggttgcagtgagctgagatagtgctgctgtactccagcttgtgtggcagagcaagactccatctcacaaaaaaaaaaaaaaaaaaaaaaaaaaaaaaagacacagaatgagaggaattgtgcaccaggggtttgaattgacatctagcaacaggttgcttataattttcatcatgatgcctttaggcaaattacttggcatcttggaagctcaatttttttacttacaacatggggattaaaatgcaataattttcacaggattgccactagtccagttaaaaaaaaaagatgcatgtgaaaaatgtggcacctaaagtataccatgcatggtggttactgagagaacagagtgcatggggcatacatgaattctaaaatatggctgggaaaatcaagggctggggaccttgagggtctaggaacccttcaatatagagctgttggaccctaaaggtgcagaggagtgtgcattctgatgagccatgtagacagaggtgaattagaccagggggtctgaacccaagagacagctggaggatgtctttcttcttcatttaagaggcaatgagttgcttttagaatgagtcaataagattgattttggtcacatttctacggccctgagtaagttacttcatctcgggatgctcagtttttccctccccaaaatgggtataaaaacactgacagccgggtgtggtggctcacacctgtaatcccagcactttgggaggctgaggtgggtggatcatgaggtcaggagattgagaccatcctggccaacatggtgaaactccatctctactaaaaatacaaaaaattagccaggtgtggtggcatgcaactgtaatcccagctactcgggagtctgaggcaagagaatcacttgaacctgggaggcagaggttgcaatgagccaagatcacaccactgcactccagcctggagacagagcaagactccgtctaaaaaaaaaaaaaaaaaaaaaaactgaccacaagctgatcaaggcctcaatgagatccagggtacgaggctagctcagtgctgggctcatgttatgtgcttatgagtggtggttcttttgctctttgtcaaaatgtatttttcaccctgagtattaacctgtctaaggaaggacactcacggagtgtcccctgcctgtgctgcacactgcagctgatctctccagcctttgcatctgacttcatcttcctcgcctcatatcctgggaggtcatttcaatttccaacccatgacaggtcattatttcagattcccacccgattaaatctccctctaaattcatggtctcacctcccatttctccaagggcacctgtgtgggtggacatttgagttcacagttgaagtcggactgaaaaccatgaaacgaggtcttcctggcttgcccgccctgtgacagactgagtgtgcttcttctgctacaaattccttttgttctttggcaaggatgccccagagagcactccataaacccgatgggaagtggggcctgtcagaggtgtgacgtgctgtcgaaaacctggtggtggattggctctgaggccaggggtggcttagccctgccggaggccagtggcacctcacccccttgaccacatcatctccccccagggcacaggagaagcactggggttttcagcctgagtaagactgtgcagaatttcctcaatctctaagatggctgagtacagcagaatcaagtctttctcatgataacatgggctagggagaagccttccaagagacggaagctacatcgtaatgtgcctggaaagatgggggatcctgagagtcagacattttatacagagattttcatgcaagagaaaaaagaaacgggtttatttaacttttattctttttgtgcgtgagcttctagagtgaaagagagattgtcttcattctttgtctgcattctctttgccctctttatctttgttttctcttccctcccttcctgtgtcttctactttttgtgctattttcacctcctcctcttcctccttctccctctcacttttgcttttcctcctcgccctctttcattcctcctctgctccctccctcctttccttccttctttcattgtttcttttatctttcttcctagagatctatttagtccacctgttccattgtaaatgcacaactggggggatcagcgctgtatgcagccccattctcacaccctgtgaggttaatggattgggcatttgcgggaaaccctggaaggctgcggcttctgcaggcactcacttgttgcttcatttctttcattctgcagttgaagaaaggaaagctcagagacgttcttgataatttactatcggggtaaagctaaaattcaaacccaagcttggttgatactggatcttaaacctctctctctgcccatgcctggctaagtgcagagtataccagggcacgcttacatttctcaaacagctgggcgcgtgactttcagcattgtcaccacctaccatgcccctttgaaatctcaggcccagttccccatggcagcagccagggagctgcactggagagtgtctcaggcctgaaccccacactggctgaggcgtccccagggtccctgaccggctgtctgcttccctcctcagaggtggctgatggcctgtgctgtgtgctcaccacgccctgcctgacacaaagcacggctgccccagcagtgagggcctccagctcacctgtcaccttgcgtcagaagactgtggactggaggagagtgtccaggtgagtatggtgtgtgtatgtgtgtgtgtgtgtgtgtgtgtgtgcatgcaagtgctctgtgaacatgtgagcacaaaacggtgtgtgtgccgagcacatgaaaaccatggccagagtcagccagccctgctgaaactggggggtgagcaccccccacaagtgtagaccaagggaatccctgggtgcaggggcagcttcaggcctcacgaggtgtgtggcagctccccctgtttctgcaaacatttactgagtccttattctatgctagcaatatacattctagctgaaatataccacttttccttttctaattgttaggatcctagaaagtaacacatcctgtgtaaatttaatattatttaaaacccactcacaaagcttaaacacatcagcagaatcctacagtgacttctttgttttttctaagagaaaaaaactttcatggatttgttctgtttattccattgtcagcctgtgaattttaaaggatatctgtagtttgggattggtgggttatcttaataattcagtatcaatccagacatcccattggcaaatcaaagaaaatcaggatcaaaattatgcgagacatgaagaaaactgctctttcttgtaaataacaaaaattaatttttactaaaatttacagctggaagtgtcagccatccaagaaaagagcagttcagacgggttaagtgatttgtccaagatcacacagcccacaaatgtaagaaccagaattaaaataatgggttagaataattgcagttagagtagttagagtaataggttagggtaataactagaatagtaagttagggccaggcgcggtggctcacgcctgtaaccccagcactttgggaggctgaggtgggcagatcacctaaggtcaggagtttgagaccagcctggccaacatggtgaaaccctgtctctactcaaaatacaaaaaattagctgggcgtggtggtggatggttgtaatcccagctactcaggaggctaaggagggagaatcgcttgagcctgggaggcagaggttgcagtgagcagagattgcaccactgcactccagcctgggcaacagagcgagactccatcttaaaataaataaagaaaaataataataagttagagaaatagtcaccaggatttttgtttttcttttcctcctgttctcattctcttgccctttatctcctcctctctctatgactctctttttttccctttctctactgccttttcttctggcccacagactgcaggaggaccccgagggaacagagaacccgcttggggtagacgagtcccttttcagctatggccttcgagagagcattgcctcttacctgtccctgaccagtgaggacaacacctcctttgatcgaaagaagaaaagcatctccctgatgtatggtggcagcaagagaaagagctcattcttctcatcaccaccttactttgaggactagccaagaacagacacaatggttcatgcccaaaaggaacagaagttccaactattgcctgggatcttgcgaaaagcgaggttccctgatccctgggagcctcacgtattttagaagccaagagaagccacatggagactcaaattcgcatcttctctatccacatcatgaccaaaggaacccctccctggtgtctgatcagggctgtggcatcacgaaacattggatcatgacatgtcgggcgatgcttggaagagcccagcatgtatgtatgcacacattgtgtgtgtgggaaggacaaagccactctcacaagaaagggcaccaggactgctctccaaggaactggacctgtccagacagttacactccaaggtcattggagagaacttctgtatgggcaagcctgagagggagaggaaacaaaagctgtgtcctggcagaaggtctgggtttgcagatgggtgccctgaatggaactactttaactaatccatagggacttctggtatgctttcctctctttttaaaggaacttcgtgacactaaacattagcccaaaggacttcttagccttcaattgggagatacctttggtctgctcctgcaccaaagccatatgggtggaagtcagttggcctccctggttctgcagagggccagaagaatgagagagaggaagactgctggcagggaaatcgaggaggcgagactagaactgcaccagcttccctgatgtctgcagccatggctttgcagcgcagacagagcttctctgggatgctgggattcttgcctgtatgaatgcatcaagtattcatttattgcccgaataggcattgcattaagtcctctgtaaggtgtcaggcaagccaaaaaaaaaaaaaagatgcgtaagtcctaacccccaacagaggtgttcacagtgtagacagggaaaaaatgtataaacaaatgtgtaaaaagagaaatcagctcatggcttaggatggaattagagacaggtgagggacactcaggagctcattttccagctgctcttcagagtggaagggctggctggatcgggtaggtaagaatagctggattttttagaaaagaaatggatacagtctaaagaattaactcacccggtactttattctaagaagggtctggcatccatatgaggaaaaatgctcagctccaggaaagatggggagtccaagtggattaatgatgtcatgcataattttaagagacaagggagaaaacacaatgtatagccagagaaggagaagctcccatccaaatcctactaggaagagagtgggctgcagatgaatctgtgactcatgtttccctgtttcaaagggatcctggggaaggaggggaacatgcttgcagtatctctccctgtctgtctgctcacataagcattccgtccatctgagctcatcgtgctactggtatgtgtatgtgcagttacacagttttctgtatcatagattctagtgtgtttatacaaggagacatctgtggtttccccaaccgttccaaaaggctatttcaaaggaaccagccaacgtatgagaaatgaatgtaacactgtggacattgacttcccgcataaggcagggtgaccccctgaactccagatgtctgcacagtatcttatgtgttgttttccgttgtgacgaatgtgattggaacatttggggagcacccagagggatttctcagtgggaagcattacactttgctaaatcatgtatttattcctgattaaaacaaacctaataaatatttaacccttggcacacagggagagtttctgggttgaggaggatgggtggttcattcagaagctcagtgggtttcaaattttcaaataaacgtgcaactagagagagaggagtaaagatcacccagagaaacctggtgccagttagcagctcagcatcttctttaggtgtgaccttaagaaaaagcagattgtatgactctggggggtgtcttacgaaacttgaagatgggcctaagggattgaaggaaacaccaaattctgaacgattgttataaaaacgtcctgcctagattttctgcacgttacttgtgatagctgcgctatttgttcttccaagaatttctttctgcagatatttctggacacctactaaatagacactgctcaggtactggggctatagcaatgaaaaccagatgaggtctctgatatcatggagcttgacatcataaataaacaagatgcttggtaatgatggtgatgaggatgagggcaggctccaagcagtcacctggcaggcaggacatccttcaggtccaggcttaggaaaggcctccaagcagaggcaatgtttgggctgaggcctgaaagatgagcagcaaacagccttgtaaagatctaggaagtgtatggagtcagcaggaataatggggcaattcctgcaggcaggaagagcaagactgcatgctgaaggagctaaaaggaggcagggtggccagactgagggagctagggaaggagggagtgtgcttaggaggtatcaggaaggtcctgcagggccctagagggtaggggatggcatagggtccattccaggagacatgaggagccattgaaaggatccaagtagggggtaagaccatttcactgatatgtttaaaagatcatgctgtgtggaggacaaatctttaaaattccagcattgtattgtctattgacacacaaagtttgaaaataaaggggcaaaaaattttaatgcaaaaatgaacaaaaggaaaacctgtggtgcattttgagacaaaatgggatttaaggtgaaataaattgcataatggcaaagagagatgtgcaaaaggaacaaaacattaagaagaaacaatgattgcaacctatgttaatgggatgatatagtttcagaatatattaagcaactgaacagggacaaatagataagtcaataattttatttggagattttaatatacaaatctcagaaattgatacagtaagcaaagataagtaaataaataaataggtagatagattttgataacactatataacttttctgccaacaaatggataatgtattaggtcacagagaaagtactaataaatttcagagtcagaatcttccaattcatgctctatgataataaagcaataaaattggaaatcaaattccaaaatgatgaataaaaatttaaaaattctagggatctaaagtctaaaaaacaaatccttaggttaagaagaaaataatgcaataaataaaatgttataaataaatgacatattgctacttttcaaaatttcatgggtgtagctgatagagggtaaattattgcttgaaataaattgatcaggaaacaaagaatgaaagtaatgagattaactttcaacttaagaagctaaaggaacaatagataaccaaggaaacgggaagaaggtagaagataacaataagacatcagtgaaatagacttctgaaaacacagccatagagaagattttaaaaagcaaaacattgtttaagtagactaatgtgataaaaatatgaacaagcatgatcaagaaagatgatggagaatgaaagcaaatcaaatgcagttctgcttgtaaccatacctaaagagggagtgtgccccttaccagcaaagccctaagacggcaggtatggtcctccttcctctccatcccctccctactatctggaagccctggcagcccaaactcaaccctgcagatgaggaaggccttaagaaatggcagagaaatatccagaagaaacc

SEQ ID NO: 15906 - DNA, 25190 bp, Human
ctggtatttgaagtttgcgtcctccctagactcaagcccatttcaccacctctgaaggtgagtgcaggctgatattaattaacagtgagttgattcactggcatcttccagtcattaaagcaaatatttggcttaaaatagccttcttcccacctcaaatatcaaactttttgcctattcccttactctatcatggttgactcaccagcagttgcatgatggtgtatgtggcctaagaacagagtttgattctaaaagggaagtgaaatactctttaacatctgcaagtgagactgtttgaacagcaggccagccttcagtatgactacattgtttttctgtccattgtggtgctgactcagcatcagttaataaaccctcttgagcaggctggatttctcttgtttaattatcagcttggagctttctgaggactcttaggaattgttcattcagttttccagccccagcagatctgccttctaaaagtcctgcttcctcttggtgctagcgtcccctctggcataacatgcaatcacaggtgggccacgcagcaagcagcgagtgtgtgctaatcatgtcccctagtgggaatttaattgttctgtactgagagagagattgcagcaagactttagacaccatttcctggcaaataatcttttgcctctccccctctcccctaaaaaaaattctagaaaagttttctaaaagtgagaaaagaaattttaaagataaacagacatattttttaggattgagttgggcttttgttttgctttgtttcatttcttcctgtaaacaaatactcagatgtccatttcattgtatgactaagttggtatcattaggttggaactgggtgtgtgtatgtgggtgtgtgtgtgggtggatgtgtgtgcacacgtgtatttaaaatgttagaaaagacattgcaggtcgaaggagaaatgattttaaaaaaacctacctatggtaaggcaagcaggaaaaatggaagacctggatttcaatgatctaaataataattgaaatggggtgtttgctataaacattgtttctctgaattaaaggattccttgctgaaggcacaagaccattgaaggaagtaaagcatctggtttgttttgtaatgagaagcaggaatgcaaggtccacgctcttaataataaacaaacaggacattgtatgccatcatcacaggatgtccttccttcaacagaggactgactgggctggaggaaaagctggccggggctcagaataagccccactaattactgcctccgaccgctttccacttgcagtgatcagttcaatattcctctgaactgtgaaacgactaatgctctacattttacttacactcctgggaagtcagcctgtgggttctgggaggagaggaaaggaaaacaaacaatctgtagaattataacttttgcctatttccctatttactaaatagttaaaagaggaaagttagttctgccaagtttgaacgttagcaggagaaacggaatgttacaacttttggggcggggggcggggaaacgtgcgttacatacacaacagcttgaggaccagacagctccactgtattacactagctgcaaaaacaatttaacttgctcttttgaagtaagatttgtgtcttttgtacctggggatttgagctgagaaatcagaaactgtgtaggtaaattttaagtttccttaatttaaggaacgtgcgccccctaattctgccgcgccaggaaggagggcgatctggagtgtttagaatacaatagagcccaagtaagcgttgaggttaagtgccttcaaagggaagtaagaagattccaagtcaatgttgaaatacacatgcgaagagaggaagctctcggcggctgtgctagcaatctgggggaaagccctgggctcggccaggtggtgttggccacgttggccacgcccccacttcgcgcagccgagtggctaaggaaatcttaagcagggaggggaagccagacggttaacacagacaaagtgctgccgtgacactcggccctccagtgttgcggagaggcaagagcagcgaccgcggcacctgtccgcccggagctgggacgcgggcgcccgggcggccggacgaagcgaggagggaccgccgaggtgcgcgtctgtgcggctcagcctggcgggggacgcggggagaatgtggactgggtagagatgaacgagacttttctcagatgttggatatttgcttggaaaaacgtgtgggtacgaccttggtaaggaacttgaattttttttttttaattctgaaattgatctgaaaactttattttcttttcctttattgttattattattaattttttttggctaatgtcgcagtagaaacatgcttctgctttagtgcacttagtgctgtcaaacatttgtgagactttccttatgaatcattaaccctttcagttctagacataattgccaattcattgaaatttcagtagtggttccagctcacactcgtcaaactattccgggttggctgaagttttctattttattttatttttaacatgtgtttggcgtcatgactctacatgttggaactaaataaaaataagcaggtttgcttaaatcataactgagggaaaaacaactttgcatccaacttttttttttttaagagcatcctatttagagaagtggaagaatgtaaaaacctccttgaaggacttccacagaatgttatgtttacatttgaacaaacacacattcttacatggaaatgatacccatattcctcatttttatcaaacatgtctatatgagaaaacccttacagaagttgtttacctttttttgcctttggaaaacagtttttttctgagtgtgagggaggattttgggggaatatcctcatcaatgtacaagtggaagcagagcttgtcctccaagtcttctaaatttgttataactttagttacagtaaactgtagtacatcagtgacttctgggaattcatacactttcagatttaaatggaaagtgctatttgtagctgagggctcctaaaggaattctctccagggaattttattaaacggttttatgttttgtttttgccttttcaatttggtatgagatgcttgcaagtcagaagacactgcaggctgttttccccttcacccatttttcctcctcttttcctgtggtccaagtgatttctaagaggccgtagctcagtgatgctggcaggatgcaacccttttcagtcttccatgtgagaggatgaaagagagctcgcagcagagggaggaggcagttgttttgaaagttgttttgcgttgggagctggtgggaaagttcggtcttccccatttggaaaaggcaggctgggttccgctcctgcaccacacgcgctttccatttttagcttcattcagaggcagacagagctccttcctcttcctctccttgtttgtgacacttttctgaggcagcttttccacagtgccgagggtctggcggccatgaccccaggcattctgggacactggactgtgtgcccagaacatttttctgccatgagaggtaaagccagggattgttcagaggtgattctttttttttttttccttttccccacagtgaggttgccacattctttttttttttttttttttaactaagagtagcatttaaaaaccttgcttcttttcaaggcagtttactttatacggctttttggctctttctcaactgtaccaagcactctgcatctgcttttaaagtcttcagactactgtattagtcatagcctctcagaaggagccacaggaacggcgggacaatggggattaaaggcctttcctttctcttccaggctgcccccaagtgtaactccagcactgtgaggtttcagggattggcagaggggaccaaggggaccatgaaaatggacatggaggatgcggatatgactctgtggacagaggctgagtttgaagagaagtgtacatacattgtgaacgaccacccctgggattctggtgctgatggcggtacttcggttcaggcggaggcatccttaccaaggaatctgcttttcaagtatgccaccaacagtgaagaggtaagcctctggtttattgacaagaagattggggacctggtgccaaatctccctacttgcccttgaggccttgtatatctctgaaaacctctgagaatctgtaagtatcagtaaataattgattgctctattcaattcttgcattgctttctctttccctaaaccatttccttctcatttcttccagccttcaactgttcctcactaattagtaaacagttaaatattttggcaaattggcatgtcttagaaaagcaacttgcagcatagggtgggtgaaattgtcagtgaacttcaagaaagctctgggcccactggccctagtgtccctgttgtacaatatctcttaagggagaaaactttttcttggaaaaaaaagttttaatatttcttttgtctgtctttggtaattagttggctttactctttttaacaagccagctttattagctgggtttctaaaactatcctcaaaactttgacgtgtttatgaagtgaagtgatggtataagccgagaaagggggtcatgtaaaagtgtcctctgtctggatgacttcagagctaaccactgtttatctgcagcagctcctttgctggggctgggctggcaggccaattccttactggcctctgaagtgggtacactctttgttgtttcaaaggggatgaaaacccaaacttggaatgagcaactgatttgtgtttacctttaatataaagattatagctaggcgtgatgtttagctgtgaaataacttgcagaaccacctcttgttttcagaatttggcttactgtagttgcacttactagtctactactgggttgagttgaatgaaaggacccctcagcagacttcccataccaccattagcacagagcactgtcaattctattacttccttcagaaagtagggaaaggggatggttggccgtagaaatccagaatttgctactgggactattccttacagccgtgtcaaatcactttcccccttccctaaggaacagtatttgaaggaatccgggagactaggaaatgctttgtctctttcctgtttgtgtgtctgagtccagtgtttttggtgagggggagacacagctgtctaaaattaaatagaacaacgatgctcagtctttcttttttcccccactgctgcgtgaatggaggcagattttataaaaaataaaatttaaattctagttgtagttgaatgttaccaaaaaatttaaccccagaggtcagccttaattatacctcttcctgaaagtaatgctcttcttatagaaagtctctcaatatgtggcccttggaatgaatgtaggatttgtttgggtatatgaggtttgactatggctttaaaaagtgtagtgtgttttttccccatatcaagtttgaccaaatattcgtctgttcccaagcttcgtttgtgctgtgttgccctgtccagtcctttgggactgaagtaaaaatctccattctgtgggtcatctttgccttttaattctataatgttcttatcgtcagttcagctcttagcttaagtttttcaatttccgtcattctcctttaaaatcatagctaagtcaagtaatgctcttagatcatttagttcaaggttcagaaagacagtcacttacccaaaggcatataggtaaagccagaccggggacttgaagcaaagcttttctgacttctccaatgagtgcttctcgattatgctacactggcccctcttggtgtcactgtggttttagttatcatcttaatatatttcagaccaatccttaagctattttgtgtttttttccctctgaatgtataacttcctatttcaatatattaagcaaccaaaaaacagacaatgcctgtgttcctgaagaaggtccttcgaaactaacctaagaggtgagggttctcttatcctatttccctatcttgcatttaactgaagctcttgaatagaggatagtatgtctttaaaccctaatcataaagtcaagcaaggagtaaacttgaatgtaatactgtcttaagcttactctggaatttgtacctgtttttctgtttctctcctttgtttttgaactttgggaaaggacagcttcctttagaaggtgaaagaggatggtggagttgagccattaagggtaggatagctgcaaactagttccgggacagcaacattaaggattgatgaaatgtttacattatctttattcagttagttctttaagttccatgagccattgaaataggaagagtctttctacatgtactttttatctgacttattaatcttgcccttctttaaatgttttcgtttaaatagcaaaagatgttacaatatgtactattgtgctgacataccggggaatttttttttttacaagaccatttttcattatgaatttgtaccatgtgtcagcaccttttttttttttttggttaaaacaaaacatacaaatcatatttctgatcttgaccctcatttttagattgggtttagaatcattctgcacctttaatgaaaaactgttcttacttcctatttccagaactgaaatcaaatatagacctactattcaaaactttgaaaatgttttaaactgatgggttattcttttatgggggttttccccttgtcctcctgaaataatctcttatgactacttgactacagaaaaatcagttcaagcatttatattttagaagcgttaccctgtagagtttctgccgtcggttgagactgcttgcactcaagaggcactgtggctctgtgagtctcacctccctgtatcgtggctgataaacatcagacagattgtgaggactcctttggtgtccattctgatcgaaatccattattaactcaagccatctgtaaaaagtatctcaccataacatgcaattctctcttcatgttgccttttatttgagaaatgatgtaccaaggcatcaccatgtctcctttaatagaaagataatgaagaaggaaaccttctccaaacaactttgttcacttcactccttttaaaaatggggtgattgccgggcgcggtggctcacgcctgtaatcccagcactttgggaggctgaggacagcagatcacctgaggtcaggagttcaagaccagcctagccaacatggtgaaaccccatctctactaaaaatacaaaaattagccgggcgtggtggtgggcgcctgtaatcccagctacctgagaggctgaggtaggagaatcgcttgaacctgggaggtggagtgagccgagatcgtgccattgcactccagcccaggcaacgagagtgaaactctgtttcaaaataaataagtaaataaatgccattgcactccagcccaggcaacaagagcaaaaccctgtttctaaataaataaaataaaataaaaatgaggtgattgcaggctgaaggtcttggtcactactgagttctagttctctcaagacaaatattcatatggtcaaaacagaattataatctaacgagtcattcttatagagtgggattcggggagggaaaacagatagctagtaatttaaatgatcttaatgtaatttggggagaggatgatcagatgacatttagacttggatatagtttctgcttcaaacccacgctgtgtgtgtctgtttgcatactctctaaagaaggaatttgaaaaaaaaaaaaaaaaacaaacctatattgtccttgttatcagccttccattaagcgctccaactcaacccatcctaagctgtcaaatctccttcattgtgtaaaattgaaaagaagccctgtgttttgtccggaagctgtggaaactgtggacggcggggtgtgttctgtaactgaggccacagacagaaacaaatctgctcaagtggtggaggggtctgcaccgcacataaagagcttctgtgggagcaggtgaagcaaggaggtattgaagccgggtgtcctcttgctgttgagtttatagaaggcacagagcggcctgtccccagcagtaattctttaggaccctggtcagttccagtgaagtttccttcttgagttaggtgaacacattctttgtctttttagcactgtgaagtttaagctacacaccaagttcctccttagtatttgcttggttcaaagataaactgttacaaactatgggtcagggagatgggtagtctaagatgcacattctggatctttctaggaccagagggagacttagtacttggttttttcacttccctttaaaaacaatcctggttcctgttccccctccaaagttacctggacaagcaccatagtcttagagtttcagcttttatggcgtctgtgtctcagacgtgcatttgagatgaagatgtttactgtatattagaacgctagacttagaatggatataggtggtttgtaagtgccttccagttttgaaattttatgattttgtatctttatctataggtgtgagtttatatgtgccctatagcactgtatgtaattgaaatttaaaatattagggcgctctgtccctttcctaatgataagctaatattgaagctctttaatttgtctggggtttgaggattatcatagacctctcttctaccacagagccttctctttttaattgttctcctgtcttgcctgttgaattgaatttgtaaggttagagatggcaagagctacttccggtgctgctttatagcttactagtgatgagtctatagttgtgctcaaataggtattgggtagcttatgctttctagttgacttctttttgggcacaagaaaatgtgtgtaagatggataactgaaaacctagaggcccattctgtaaaagaatggcaatttggaagaagaaccacgacctcagtgcagtgctccgttttggtaatcaagctctgactcccaagacaccatctgtaagagactataatttaaaacaaagttgatgaaccagttgagtgcctttcttaaaattactgttgtaaagtagatatgttgaaaatatcaactgctaattattggctcaccaacaaatggcatgatttgtttttcctgtttgtcattctaatattatggaataatcactgaaatatgaatgttaaatgatttgcatgtcatagaattcaattccattaattttccaaattaattagattcaataataatatgtccaaaacaatgagcctctgaataagtctactaaagctttaaatatatatatttatatctcaagactgctctgagatactcttgtccccagtagttttactgccaacaaataccaataatgacaaacggtgattaaaagggcagatagatgtaaatgaaggcagaggaggaggatgaaatgaacatctgcttttttcagctctctgacagaaattcttaaaggaccaaaaataacactcttgtttcaacttatgttaggtgtaggaaaattttctttttttctctttccagtctgagtatgcttcattgatttgtatattgaatactaaattgttttagaaaaaaaaatcattggctgataagacacttaaatgagaaaagctagtctgtcacaggcatgtaggtgtgccatatctatttaaatagaggtttaaattattgatgagacttaatgaggaactggtgtatattgtaaccaaaattgtagattccactgtgaacaatctgtgcatggatcgattcacatatttgagtctaccatttcaggtacatgaatgtacaggagctactgggaatataaaaactggaaaataaacattatcatctattaccactccctcctccttggtccattttagtaaagaattcagtaaagtgataggtaggctatcttgaatgagaagaaaataaaactaggaaagtgagagaataaaaaccaaaacaaaactgtaactgcaaactgttgtaaaggactactcacagaggagttctattgaatagtgacgaattgcttcctgattcacggttggtgatttttttaccccttcaaagagaaatttattattaaggaggaactggtatagttaacatgtttctttagcaaggccccacaaagttaaaatgtgtgatgcatccagtctgaggtcatttcctcagatcttagaacctacagctttcctccgtataaacttaatttcaaaggagggcttttggccaggcatggtggctcagcctgtaatctcagcactttgggaggccgaggtgggaggatcgcttgagtccaggagtttgagacaaggctgggcaacatggtgagaccccttctcaacaataacaacaaaaattagctgggcgtgatggtgcatgcctgtagtcccagctactcaggaggctgaggtgggaggatctcttgatcccaggaggtcaaggctgcaatgagctaagatcaagccactgcattccagcctgagtgatagtgggagaccttgtctttaaaacacacacacacacacacacacacacgagggcctttgaccactcttgagtagaagactcgagaagaacaaagtagaaggccagagaagaacaaagttacttgaaagatctcttattaaagagaatgtacaagctatgaaaaaaaaaaaacacacacacacacacaaacctcatctggaatgaaaaaaacataatgcatttggtttctggttccttaggctgttatggaacaaccaaagaacattattttggtttctgaggtcagaactattttattcccctcaagcacactatgcttatggtttgagggagaatgagaaataggaaactaggaacaggctgaaatggtctaatcttgaccatctaattctgcagtgtcttattctcattctaaaagagaatggttatattcgctgttctagcataaaaagtaatgataaaaataaaagatcccgtattaccagacaataatcccctagactgttttaatgcttggttgagtatttgcttatgatctcagactttaaaagatggtctccccctatggtgaagcttgttaattatgtaggcatcattaatgtctgtttacttatcaaaattttatcattgttagttgtattactacttgacagtccaatttatttaattgaaaagattggttaacattttatagtcaaagtaattgtttcctgtgttttttcctgtttaggttattggagtgatgagtaaagaatacataccaaagggcacacgttttggacccctaataggtgaaatctacaccaatgacacagttcctaagaacgccaacaggaaatatttttggagggtaagtaagggaaatttcttcagacccattaaatgttaggaaaaaatggagctaaaagagctgggtggctcacctttctcatcctgtgctgagaaatgctggggctcacccataagtatccagcatccccatggacacagggaattctgaacaaatgtgatgaaaccgatgaaatgtctggcctgtaggtggttagtgatggagatacgggctatatgtgaatcttgatttttgcaattcattagagctttgtaatgaaaggaaacagtttgttgcttgctttaaggataggttcatttgcatttctccgcaaggaagtagtaatgagttaccaagccttagatttcacccctttttgatttcttgctgacttaactttaattgaatggaagagttatcacaaatgaattatctttttggtttttttttttttgagatggagtctcactctgtcaccaggctggagtgcaatggcatgatctcggctcactgcaacctccgcctcccaggttcaagcaattgtcctgcctcagcctcccgagtagctgggactaaggtgcgcgccaccatgcccagttaatttttgtatttttagtagagacggggttccactatgttggccatgatggtctcgatctctggacctcgtgatccgcccaccttggcctcccaaagtgctggaattacaggcaagagccaccgcgcccagccaggaatgacaaatgaattaccttataagtaaatgccattaaggaaggatagctggaagatgggttgaggggaatggaggaccacagaactagtcctatttaaatacatgtgcatggtaaaatgattccatttgacaataggttaattatctcatagcataaggaaaatgcttaacagtcatatgcaagatgataagctttcctatagcatccaaccaaaagatctagccagtacaatttcctttgctatattagggttagaaaggcccccagaggtgaaccaattagatggaatccttgaataaaacactggattagcagtgaacagaaaaaagtcagattgctttccttcttcccatagatgtctcagggatatttagtttcctcagaagataaagaatttagtaagcgtttttttgtgcatacttacatgaaatgtacattatttgaattctttaaaaagaaacagctgcatgataacaaaaattgtgttatgcttgctttagctggtatttttgcctagaacgattatatcgttcggacaagaagctattcctaagaaacaatatttttaatccaggaagtttttcatttttagaaatttatcttactatttcccaagcaaaagagggtagttacagattcactaagaatcatgtgctcacaatttttatttaataattattcctccttaaaatatattaatcacctgacttacaatggtggaaccatgagtgcatttttgcctttattgtcaataacgtcttctcagaagtgagccacaaaggtgcatagttcttggagttaaaggtctgaattaagacaatccagcataagtctcattaatgtgtgattattttgagaaaaggcaagaagtacctaagaatctccccctcactgtccagttccctgtttcatttaaagattcactgtaagtaactgaaaggctttccttgggaggatttatttgaatcagtctttcacatgcaaaggatattgtagaacatctcgtttttgctggcaggaatatgaacatctgttgtgaggaaagaaaaagtttcatgcaaattacactgccaaagaagggatgttcaagttgagaaaccagtgacatttcttgtaactgtactatgaatcagcgcattttaatcttctagataatatatggaagtgcaggaaggtggtaggaaacggtgttcattttacatatgcgttattttattctgtgtgagtgacttcatggcaccgacattgctgtttttaaatgaggatacagtaaattgcagtccgaggaaggctaactggaatcaacatacccgtagctttagaaagcagtttccgcaccagcgaagagtacaagagcgatggaaccccatgttcctggaagtttgcacatcagagtaaacaaacttgaaaacccctcttgatagcagaattcacccagccttgttccattttctcttaacaaaacacaccgcaaaagctctcacaagctgctttgatgaagccacatgtatttcccccttcacaatttacaggaagttactcttaaaagaaagtgattctggtgtttaccgcctgtgttaaagggacagagttcctttttatttctgataacgtttgagcgaaatacagaaactatctgtagactagcatagtcggtacgtgagtaaggaaaagcaataacctgctgtccggtgagcacaaaattcctgctacgaacagtgccttactgctgcttggagactgcaagtcgcagatcacactaggtattgactgattgtataaggaaatttcttaaagtctaaagtaaaggtggtacctcctaaaaagaggggaagagagaaaactttgtgtggaaggataaggagtgtgtttatagtttcagtaagagtgtacgttttaatttttcttcttcctctgcctctttgccaagtagcctgagtgcatctgttatccagaagtagtattactctaggacaaacttcaaattcttcattctgcgttgcctttaaggaacaacatactttcttcctgttctttttccaaaaacacacgcctatggctctgtgtgtggtgttttagccagcctcctcccagataaggggttcccttccctcctttgcattgaaaggaaagtgcaagtctggacatgtttatcaagaggaaaagtgacttctcagtaatagactgtcaaattcgggctgctgcccgagtgttcgctttgttatggcaggtgaagttcacctttgccccacccagtgtttccacaaaaaggcaaggttccaagtattcatatgaacaagtgttactttaggacttggagggttgggggtggaggatgtttgcatagttgaagccttgggcgggggtgtaggaaacggcgagtacagaggccatagaaaaagctaagactcagtttgacgtcgtcagccggcttggtcttctacccagtgactcaaagcactaaaagtcagcataatcggaactgaagtcagtagcatcgcccatttgccattcactgcagtagcaaaagtagtactctgtggtgggttaatcggtttgaggcagctccttaaatgaacatttgtgtttcatttttctgttattttcccgaacatgaaaagacgataaaactgaaatggaaaaggtaactgacaaaagtgtgccttacctgtttccgccctgatttctgctgattcaagactattctggctaaactgattggattctttttctaactaggcagtaggggatcagaaatcacacacggtaccggctgtgtttattctgagaggtgctggggagctttgggtctgacttccttttacatgcctgtcttctcttttggacagatctattccagaggggagcttcaccacttcattgacggctttaatgaagagaaaagcaactggatgcgctatgtgaatccagcacactctccccgggagcaaaacctggctgcgtgtcagaacgggatgaacatctacttctacaccattaagcccatccctgccaaccaggaacttcttgtgtggtattgtcgggactttgcagaaaggcttcactacccttatcccggagagctgacaatgatgaatctcagtaagtggattacagaacaaaaaaataaaaaatgccagtaatgtcggttctgcccctttgaactaataacatgttgtttaattatacggctttgtcatgtgttggatgaagtaggtggcttaagctagggactaggaagaggaaaaacattttttgagtccctattaactattaggaaacttgatcatttaaaagtatatatatatatgaggagctaccttgagttttgaattcaggatgttacaggaagaaatatatgtccaattctaatttatccaaaagcagttgggagaattacagggattggtccagacatgctgcgtatgcaaggtatagccctcatctgtggtactttggcagggcttagactgcatcaaaatatttatagatgtacatttgagtgtacagttaggatctgatgtggaacattgtaagatcattgctagaaaaactttgtcataatttttcaatattattctaagtgaataaccgtaaagattttacatcttagcttccttccttacagtaaaaaaactatctgatctcttgatcagtattatagtagccacctatcactttatcttaacaaattctcaattccttaggtttatgtgcttttacttcttttatttgattaaaattgctgtcatgacctctctctgcagagggctgcatcattttggtcattctcaagtgatctctttgagcaatttaagaattgccataagattctaacctctgctgtaactatggttgtgtgttcttggttagaccactaaatcttattagcagttttaaaaattattccttttggtttagaagttaagactaaatgctgaagtttttgtaacttttggttttgatatcatttcaaacttaagaaaacatttgaagaaaaggacaaagaatttccacttaccctttacccaggtttaccagttattgataagtatatccatttgctttaccagaaggctaacttgttttagttctcattttcacctttgagacatttggaataaatatcaatgttaacataaattggaattttgactttgattttaggaccaatgaacaagccaagtacttaccctagtcatatataatccaactgtatggttatttggtattcattccacacttcattttacttgatctcccttaagattgcaagattgtgtttgcagtttttctgaaaatctggggctataaaagcatcaggacctcccccgtaggggaggtcgtgtgtttggggtccttacacaacaggttacccttgagcttcaggaaaagaactggctctcagttccccagttccagcttaatgggtctaattaggtcctgaccaaaaaggtggcagttcttttccctcatgtctcttcagcgctccccgagactctggagactctgtcatatccctagggctgagcctcccaggaaccattcggctgttgtggcatctgtgtatgccatgcccagtgctgaggacctagtaacaaacgacaaatgcacaggcacagtggcatttttgtggaactcgtattccagctgtgcgtctcagaagaagcgcacagctccctcctggctttcttaacatagtgagccacttccacttaagggtctccttacattccttgagtttaatcattcatggattcagaggaaagtcttttgatttttgcttttctttaaacagttcatttgaggtgacctaccccagtgactttgcaccaaccaccaagaaacttttttgcatgcttcccgcaccctgtgccaatcaagggaagggtttaaaggcctggcgtttttattcctcaaagaaaggttttgcacagtattttaaggttcaagtgcttctactttgtgttcagaagcaactgtcatatatactgtgaaatgacaccttttatttatccctttttatttatgcagtatgtccccttttattttggcagaattttttctaaatggtggtttaacattttcaagcacatttcattgtccaatattcatagtaaagaatgagagttaacaataaccagtcacattaaaacaagattcctgctgccagttgtgaaaccggttgtcttaggcgtggcagctgatgattgagactgtgatcaggaaaatttccactatttcatcaggcctaataggtagattgtgtctccaaatgaactgtgttgggtttccatgcttaaagcacaatagaggtggtgcaagaatctccatgagggcttaaatggcagtgatggttcaggcggtagagtttggagaagaagggatttgaaacaaaccaaaggaaagaaaagtaagtagccagaaatcacaaaatggcatttttctaaaaacaaaggaaaaggaataaaagaactaataagtttgaaacccctacccctcccaaatttggcagggggggaggtattttttttctatctatctaactaacccatctagaaaacagttgaccaaattatagacttctaaatgttaatctgctttctcagtttcagttgaaaagagactttgttttgcctactgcagaacttctaggttctttcttatagtcttggggttcttattatagatcgaaaatgtgagtcggcataattaagccattcggagtcttcagaagcagttcactcttgaaatgactccgtccgcctacagccatttaagatttcagaacaaaaacagatcttgattttctttttcatgttaactcaagctgttgctgagtgggagagtcagaaatgacaccagctccactgattactcagctgctgaaggatgattttttaaaatgcacctttactgtatatggacttcctaatttccacctgtagagcatcttagggaggctaacatgtcactctggatgttcttttagaataagatgcaaatctatttttctgaaggcattagagatagcaaacatttattgtgagtttactatatactaggcactgtgctaagtgttttgcatagaaagtttaaaattctggcttttttgttggcccaatcataagtttcatatcagttcaacattcaaattatattaaggtacttaagaagaatccctggctaaatgtgaggggcagtgccacagatggactgaaactttatgcttattgcacatttatgctattattatttgttgaattatagaaccaagggagtgtggaagccactggaaaaaatatgagacttagatacataatttgagtaaaaatggctcaaagtcatgagggtaaagttttttgtatttccattttattcgagcggcatcgtttttaaaaatcattatgaatttgaccctatatagatgtttccaaataattctttttcaccttcataaaattccttcctgtggctgtgagatgccttgcctatcagttttcaagcttagttgtctttctcatcctttaccattttagctttaaaaaacaaaagtgacaattagaacttcctgcctgctgggcctcactgaaagaccgatattggcctgataaggagatatttattttgttttagtggcttcagaaatccctctccctcagcaagctttccatcacggcccccccgtcagcatcttccctgatagcgttcttctctgtgtttattctggggcttcaggctcgcccaggaggaactgataaccgctggcaggagataacattctctaaggggctctcaaattggaatcgaatccctcaagccagtcagcctagagaatacatttaaagggttcagttctggagtttcacagagttcatttctagacctatcagatagcaagtgtggagttctttctcaactaaattcaagcagagacattttttagacgatgaaggatatttgcacaaaggcttcagcatgatcccccaaacctgctgcctctgaaggcatctccacacattgacagccaatgccttcagtgcgttcctagggcaggtgtcctggcttgagtgactgccctccaataatcagagctcaaactaaacatcgtatgttttacttttggtttccaggcaaggctgagcagggaattttcagttttccctgcccagatgggtgttttttcctgaaggcatcatttattgtgtagcgaggagacagggctggctgtggcagggatagtctagaactgtcctcattgctgctgttcctaaatagtatctttaccaagtaataacgtgccgtctttgggaataagtgctttcctcttagcctgttctgttttcttgggtgcgctaagtaattgaactggctcaggaagtacctattgtggtttggcagaggtgactgtcacgccttgtgactccaggggccagcactgctgggatcctggctagaccagacagagccttggtgaagtgcttaggctgtctgcacatcgcgaggaaggtggtattcacttcgctaagctccttggcataggcagtttgaacagggctttatcaaattcgtattcaacaagagtagaagcgaaaattgatgactgtgtattacttgaaatgagtcttaatctttcacatttagttctcagggtatgctgatttcctttaggtaaaccatgaacatcagaaagacttttattaacctatgacagggtccccaccccagtatttttccactccattaaaatggaagttttttttttttttttcttttttgagacagagttttgctcttgttgcccagtctggagtgcaatggcacaatctcggctcaccacaacctccacctcccagattcaagcgattcttctgcctcagcctcccaagtagctgggattacaggtgtgcgccaccacgcccagctaattttgtatttttagtagagatggggtttctccatgttggtcaggctggtctcgaacttccgacctcaggtgatccgcccacctcggcctcccaaagtgctgggattacaggcaagagccactgcatccagcttaggctatcttactccagcctaaacagcaattttctatcataaggtctgtactaatgaaaacagaatcacccaaggctgctgtttgttctgtctgtgctgccattgtccgcattttgctgaggaggaaacggaactgcacttttgagtgagtggcccagagccttctagaatgagagtgcgttggaagccagatatgtggcgattgtgtcgccagctgttactcaggttttctcaagaaggaggagcaactttggcagttttgcttcagttctctctagccctctgtgtaatcgcccctttttctttatttcagcacaaacacagagcagtctaaagcaaccgagcactgagaaaaatgaactctgcccaaagaatgtcccaaagagagagtacagcgtgaaagaaatcctaaaattggactccaacccctccaaaggaaaggacctctaccgttctaacatttcacccctcacatcagaaaaggacctcgatgactttagaagacgtgggagccccgaaatgcccttctaccctcgggtcgtttaccccatccgggcccctctgccagaagactttttgaaagcttccctggcctacgggatcgagagacccacgtacatcactcgctcccccattccatcctccaccactccaagcccctctgcaagaagcagccccgaccaaagcctcaagagctccagccctcacagcagccctgggaatacggtgtcccctgtgggccccggctctcaagagcaccgggactcctacgcttacttgaacgcgtcctacggcacggaaggtttgggctcctaccctggctacgcacccctgccccacctcccgccagctttcatcccctcgtacaacgctcactaccccaagttcctcttgcccccctacggcatgaattgtaatggcctgagcgctgtgagcagcatgaatggcatcaacaactttggcctcttcccgaggctgtgccctgtctacagcaatctcctcggtgggggcagcctgccccaccccatgctcaaccccacttctctcccgagctcgctgccctcagatggagcccggaggttgctccagccggagcatcccagggaggtgcttgtcccggcgccccacagtgccttctcctttaccggggccgccgccagcatgaaggacaaggcctgtagccccacaagcgggtctcccacggcgggaacagccgccacggcagaacatgtggtgcagcccaaagctacctcagcagcgatggcagcccccagcagcgacgaagccatgaatctcattaaaaacaaaagaaacatgaccggctacaagacccttccctacccgctgaagaagcagaacggcaagatcaagtacgaatgcaacgtttgcgccaagactttcggccagctctccaatctgaaggtaggccttgagagagagcagtccaaggggctgtgagtgcatgcttgtgtttgtatttagcttgctttccatggggtatcgattgcatttgcagtagtatgagcccccggttggggatagtgggtatggattccgcctggcttttgccacttctagctctttgactttggacaagtgacttcccttctcctgattttcttctgaataataaaaaaattaggggtttggactagaagattaggtgaaactccctgctagcctgtgatttttgtgcttttaagaaaaacaccattctgaaaacatgaagatttcttctttttaagactgtcttgatgcttttcttaagatatttgcatcaacacttgagtcttggagcagaaatgttaggtctcagagccagcttgagagcagagctaacacatgtggcttcttcccaggtccacctgagagtgcacagtggagaacggcctttcaaatgtcagacttgcaacaagggctttactcagctcgcccacctgcagaaacactacctggtacacacgggagaaaagccacatgaatgccaggtgcgcagtattttctgggtagaccttctgacctttgtagaaaatgtctgtgagtcaccctcccatgtcctatatagcccgtagttaaagccaacaccagattctgcgttgtcccatcctggactgatggcactatggtccttcccagtactttgtatctgctgatgacttgagatggcacagccagcttccagtgggtgggaaaatggtaggggaaataaacagcccctcgtgtgctgtgtgcccacatccccccgtttgcttaataccacactggaggtgccacaaggaggcttctcacctcctaggttgctgggcgttggccggtaagcctgcccctcccgttggcaactcttaatcttctggccttcctgtctcccttccctgctgtctctctcccctacactgtaggtctgccacaagagatttagcagcaccagcaatctcaagacccacctgcgactccattctggagagaaaccataccaatgcaaggtgtgccctgccaagttcacccagtttgtgcacctgaaactgcacaagcgtctgcacacccgggagcggccccacaagtgctcccagtgccacaagaactacatccatctctgtagcctcaaggttcacctgaaagggaactgcgctgcggccccggcgcctgggctgcccttggaagatctgacccgaatcaatgaagaaatcgagaagtttgacatcagtgacaatgctgaccggctcgaggacgtggaggatgacatcagtgtgatctctgtagtggagaaggaaattctggccgtggtcagaaaagagaaagaagaaactggcctgaaagtgtctttgcaaagaaacatggggaatggactcctctcctcagggtgcagcctttatgagtcatcagatctacccctcatgaagttgcctcccagcaacccactacctctggtacctgtaaaggtcaaacaagaaacagttgaaccaatggatccttaagattttcagaaaacacttattttgtttcttaagttatgacttggtgagtcagggtgcctgtaggaagtggcttgtacataatcccagctctgcaaagctctctcgacagcaaatggtttcccctcacctctggaattaaagaaggaactccaaagttactgaaatctcagggcatgaacaaggcaaaggccatatatatatatatatatatatctgtatacatattatatatacttatttacacctgtgtctatatatttgcccctgtgtattttgaatatttgtgtggacatgtttgcatagccttcccattactaagactattacctagtcataattattttttcaatgataatccttcataatttattatacaatttatcattcagaaagcaataattaaaaaagtttacaatgactggaaagattccttgtaatttgagtataaatgtatttttgtcttgtggccattctttgtagataatttctgcacatctgtataagtacctaagatttagttaaacaaatatatgacttcagtcaacctctctctctaataatggtttgaaaatgaggtttgggtaattgccaatgttggacagttgatgtgttcattcctgggatcctatcatttgaacagcattgtacataacttgggggtatgtgtgcaggattacccaagaataacttaagtagaagaaacaagaaagggaatcttgtatatttttgttgatagttcatgtttttcccccagccacaattttaccggaagggtgacaggaaggctttaccaacctgtctctccctccaaaagagcagaatcctcccaccgccctgccctccccaccgagtcctgtggccattcagagcggccacatgacttttgcatccattgtattatcagaaaatgtgaagaagaaaaaaatgccatgttttaaaaccactgcgaaaatttccccaaagcataggtggctttgtgtgtgtgcgatttgggggcttgagtctgggtggtgttttgttgttggtttttgttgcttttttttttttttttttttttaatgtcaaaattgcacaaacatggtgctctaccaggaaggattcgaggtagataggctcaggccacactttaaaaacaaacacacaaacaacaaaaaacgggtattctagtcatcttggggtaaaagcgggtaatgaacattcctatccccaacacatcaattgtattttttctgtaaaactcagattttcctcagtatttgtgtttttacattttatggttaatttaatggaagatgaaagggcattgcaaagttgttcaacaacagttacctcattgagtgtgtccagtagtgcaggaaatgatgtcttatctaatgatttgcttctctagaggagaaaccgagtaaatgtgctccagcaagatagactttgtgttattctatcttttattctgctaagcccaaagattacatgttggtgttcaaagtgtagcaaaaaatgatgtatatttataaatctatttataccactatatcatatgtatatatatttataaccacttaaattgtgagccaagccatgtaaaagatctactttttctaagggcaaaaaaaaaaaaaaaaaaaaaaagaacactcctttctgagactttgcttaatacttggtgacctcacaatcacgtcggtatgattgggcacccttgcctactgtaagagaccctaaaaccttggtgcagtggtggggaccacaaaacaaccagggaggaagagatacatcattttttagtattaaggaccatctaagacagctctattttttttttgccactttatgattatgtggtcacacccaagtcacagaaataaaaaactgactttaccgctgcaatttttctgttttcctccttactaaatactgatacattactccaatctattttataattatatttgacattttgttcacatcaactaatgttcacctgtagaagagaacaaatttcgaataatccagggaaacccaa

SEQ ID NO: 15907 - DNA, 108169 bp, Human; identical to SEQ ID NO: 12898

SEQ ID NO: 15908 - DNA, 14554 bp, Human
gggatgatcagttgcctgccaatggaacacttgcctactgacagagcctgggaacggaatgcagagaggctgggaacccgggagggatggagcccaggccagtctgtggacctttttcttttgattttcacttagctcactcactgaggatagtattattgtatttggttggctaccaaactattaatgatcttaaaattgactttttttctcttagacccagacacatgcatgaaaatactcttcagatccaagagtactcagtcatgcaatgtgagtgtgtaatcacttaagaatatattgaacaccaagcacagtggctcatgcctgtaatcccagcactttgggaggccacggctcacttgaggtcagaagttcaagaccagcctggccaacatggtgaaaactcatctctactaaaaatacaaaattagccagacgtggtggtgcatgcctgtgatgtcagctactccacaggcggagacaggagaatcacttgagccgggaaggcagaggttgcagtgagcccagattacgccattgcactccagtctgggtgacagagcaagactctgtctcaaaaaaaaaaaaaaaaaaaaaagaagaagaagaatgtattgaatcagcagatactcagacacaagtgtatgttttcaactttatcaatatcaatatatcaatatcaacaccatgttgacatggaacactaaagacccaacagggaggcaattaacaagcatttgaggaggaatagacctcacctattccaaccacacggccaactctggcagccaaaacgtgggcaacagcatcctaccagcttctatttattgttgcattgctatggtgctgatcccctttgtatccatggtatttagaacctcggggattgggctggtgaccattctttagatctgagaacagaaggagcagaggaacgttgagcaactctagaggggtgtgtatgtggcagtttagggacagtttgagctttcaggtagaggcagcctagggaaactggcataaagcagtttctttctctattccatggaagttgcatgcttgtgaaaagggccagctatcttctgtcttgccatacaagtgggcagagctgcctgggaataccaggtgggttaaggatactgcccttaaccttaaggtggagggcagcagagggggagagagagacagagagagagagagattggggaggaggggagagagagagggatgggaaggggaggagaagagagaaggggagtggaggggaggggagggtaggggagtggagaggaggggaagggaggggagaggaggggagaggaggggaagggaggggagaggaggggagaggaggggagaggaggggaggagatctgcaagaaagaggcaaggtccagaaaaagagagagagatctgcaaggaggcaaggttccaaaatctatgggctgggacagcaaagatgtggcctacgaagagaaaggtctggagaatcagaaggccttcaaatggtggttccaaatccctccagcaaagcccatccatctttagagctcacccgtctccagctacaccccccacccctcccggcccagatcaggcagcggggtcgccctctccaggactctcaaggcagctaaggctggaggcgccggcgagcctggagagggaggagttcactaaattgtgttggatggaaggcgtcgaggaccggaggaattaatccgatgtggggaaggcggacggggctacgaggaaaaaagagggggcaatgtacactcagccttttcatcactcggcggggagatggatggttttccggaccgggcgtcccagcgccccggttagctatagggagacgtcagagcgctctggtccgcgatagaagagccccccagcccccccgcccgggcttccatataaagtaggggccctagtggaggccgcagcagtagcaccagcggctgcggcggcggagctcctccgaggtccgggtcaccagtctctgctcttcccagcctctccggcgcgctccaagggcttcccgtcgggaccatgcgcggccgtgagctcccgctggtcctgctggcgctggtcctctgcctggcgccccgggggcgagcggtcccgctgcctgcgggcggagggaccgtgctgaccaagatgtacccgcgcggcaaccactgggcggtgggtgagtgtcctggccgcgggagccgcgcgcttgtcctcctctggatcagccagccggaggggacctgtctccccatttctttgcgtttccctggcccagctttgggagctgggtttgttgtgacctttctatcggcaaacaccttccccgttctcctaaaactccaccccacctttccccattctagggagcccatgagtccctagtcagccgcaggctggtccgctgatcctttcccgctcgcttccagcctgtcttccccagggcacccgagctcccaacagccaaccccggtgcagatcaccttccctctgcgcccatcctacatctccttttgtccgcctagtctcaacctgtctggcacggtactctcctagaataatcttggggagcgttgtcccttgaaagcatctcagaaccctggtccagctcggtggcctcaacagcgactggcatgggctgaaatctaagctgcgcctatgctccccgcaaagccacaggtgtggggacctagggtgcagcgctcccgccccgggtttcacatctgttcagtgcgcagtgccctgaatcccgcctgtctgtgactctctggagtttcctcagtccttctcttcgctttgcagcgatattcttttccctgcccttttgccctccctctttccagccagcaggctctgagcttggggaatctcgcctgctctccaagctcatcccgatctctctgcccctctgagctccgctctttctccgcccttcttgacccacgacttcgccctttcccctcgctcctttcccattccctctgcaacaggtcctgctctctaggcaccggcttggaggctccctcgccatggcccctagaacccaggcggagaggacggccgcgctgcgggtgcggagggcgcctgcgggtggggtcaggattccgccctgcgcgcactcgctgctttcgctcagctgggaggcaggaagcgcctggcagcctcggctcacccagcatcaccccagggctctcggcgtcgccgagcatagcttccagcaaacgcagagcgtccaacttcctcactcccccacctacccgccccacaaaagccaactacaacaaccccaaccagcttcttgggaagctggttaatccctgaagagatttaagagtgtgtatgtgtgtgtgtctctgtgtgtgtgtgtctctgtgtgtgtgtgtgtgtgtgtatttccttagccatctacttagaacgggcgctggggaacggtgtgttgaacaagtacttgctaattcatatatcggctgattcacaaatcttgatagaagataaataatttgggggaaggagtgggactggaactgttgcttcctcagctcgtctgtgtcgtgtgtgcttttgtgagggaagtcgagatctttgggctgcaatagagtggtttccactgttgctaaaataatcatttgccaagtcttgacagttccagagatgagaggatgtgtgatcgctgagggacaggaggaacccagcagtctggtgtggagaggagaggttggaatgggtgaagctgaaaaaccctccatttcaagaatgaaggatgcttagcaggtgttgaagaatccaaacttagaattgatgcttcttaaagagggcttctgggagcttagatcaagtggccattatctggcccagccaccagccaatggggctggaaagatggaatgaaagttctggattcccaatctctttgtactcatctatattattgcactaataaagcttattattaggtaacgcttgcaggcccaaaggaggacaatagagttaactggggagtggcatcgtgttatttctggtgcaagtcaagccaatcttgatttgctgtagttccgcagaacatctgtctccaggtatttagggtgtctgccgtttaattgcccttcatagtggtacttgagcattcctaacccaaaagaataccaaccagtggtgaccccaaataccattttcatatttattctcaaatgcacttttttctctccctttgataactgtgcagagttgaggaggagcaagggaaagagggaggtgaagtagaaactcacattttagcctaaaattaccttgcggttgagaaaacgtttgctttgagtaacatgccctctgttggaatatgagcattgacaaggatgaatgatgttacacttcaaatttagctttcagttatctcaagaaaatgcttatcctcttcaatcaccaaagacatgtagtttagttttaattatataaaaccaaagctacatgctgctgtccatgaggatgctgtcagcacacatttacaggcttggtaagtaaattgcttcttctagctgagagaagcatggtgcagcaatggaaaaaaggttaacagcttgaaaacttaacaaatttttatctggcttgatgttcgtggaaatgttttgtttgtgtgatgaaaatatatgacaacacttatactggctactattccctgtgcacccatgaaatgctcctaactgtggttctaacttggacgtgagacatatcccagaaggttgaatttggaaataccagtattccactgcagaatggcttgttatggccccagaaactgtggaatagaatttaagtgtgggtccaaaaatactacttcttagtagtactcaacactttcatctatgtcttattcatttctgtttcaaaccttccctttagtagtatctttaaatgattaataaaaagaacaaaagctctttttttctctgatcaaggttttattttttcaagtgcctgtcttttgtctatggtgaggtttccattattatgatatgggcacttgacagatgatgttgggagaagaggtggaagtgggcgtatcatccatgttgccatggagatgacgatttggttgacagtcactagctcaaaagcaaaactggacccagggaatgtgtacttccctgggatgttacagatagcgtgctctccttagcaaccagtctatggaactagagataaagaactgatccccacacattccccatatatgcaagtactgaaagttagtacaatcacagaatggagaataactttctcctcccattttagaaaagtccacaaaattattcaggcatgacaaaaatgaggttcttatgtgtgatatctgcatcacttctctgttttactggcaataactctttctcatttccagcattctaactagatgatagtcagttagaagggcaaggtgatctaggtcatcactgggagtatcaggattctaatcctgccttccaaccatcatgatttaatttcctccatataaataaagtcaaatgcatcactacttcctgggaagttgcacaacataatcaccgttatggctgaatgcaaggttattgagtggctatctgagcaccatgtgaccaagctgatacgtgaggagccagtcattcaggattccaggtcttcacttgggacagtatccccagttaggatcctgaaattgtgtgaagtctcatgtcataagcaatttggcaaatgctcacactgcaatgcagtaaacctgattttaatgctccttaatactcatagaattaatttttctcaattacataatgcatcatgatatattggcatataatccctatttttataacattagaaagccttttgtagaccttatccttatttccagatcccagaatgattttagctaccttatattcttagcaagttagaagacattgccaagcagtgtaataatgtagtctagattgtgaactgattttaatcctaaaatagttgcttacatctatgtgacctctggcaagtctcattttcaccaaaccaattagcatatggatcaaatgaaatccagcacatttaaacatcccataaactgcaaatcgcaatacacataaaagcaataaagttaaagtgagggcttctctgttggtggatagaacttctgggaaggggcctctttccattttaagactgaagatctttcaaattttatgtttgccttaaatacttctaatgccagtcagtgttggaaccacaaagacctttttccttgcacactttagatcaaaagcaccatagttttgttgacgttagaaatttcaaagtgctacaaagtccaactacagagagaggaaaaatcaactgtaagaaatagagaacatgagaatattcaagcaagggtctaaagtgttaagaatgcagaccttgaattctgtacccacttctgactccaagttatcctctcttgcatacataaattttcatgtttttgatggtttggcctccttaacagcagctttttaaaaaaattatttacaaggctagtacacattcctggagccactgatagactttcagacacccaagagaaaattctgcatttatgcggctgtaaagtgttactcagggcttgttttcaacttgtttttcactacactcttaacaaacagtaaatctgggtagttttctcagttcagtctcaactaaaactctgagaaagtttaaatgaaaaattcctttggtattttttttattacgataaaaggaaagaaatatttttaaaaaaccacacaaagaaaagcatggagacttttattttcagcagcaattcaaaattggctggggaagatgtttaaactccatctttcagctggaaatagaatttggtgcacacagaattgatgatagaattttagatatggaagcctccttagatttaatctagtctaccctgttcattttatagttgagaaaattgaagactaggggtgctaaacgacttggcagaggtgacctaactagttaggagaggtgctggaaccaaacccagggttcctgggttgcagttctgaatgctgtctagctcattgcacattttgaacagagagcaaaatctatctgtcgtttatgaactaactcttaataaaacatgatttattctgcatttaggaggaagcagcacaaacacaattagctttaaatttcttttaaatttctcattcattccctttggttaaatttgtggcattctgagtgtttttgtttttgtttttacagggcacttaatggggaaaaagagcacaggggagtcttcttctgtttctgagagagggagcctgaagcagcagctgagagagtacatcaggtgggaagaagctgcaaggaatttgctgggtctcatagaagcaaaggagaacagaaaccaccagccacctcaacccaaggccctgggcaatcagcagccttcgtgggattcagaggatagcagcaacttcaaagatgtaggttcaaaaggcaaaggtaaaagaaacatacatgcaagatggggtgggaggtatctggggagaggtggaaagagggcaagttcaaaggaggaagaatagaattgcttatgatataaaccttcacagtcactacattaggctaacacatgctaagcacattgacagacaatttctacattctcttctttttgacatatagtcaaaaggatattgattccaaactccaatttaggagtttttttcagcaattttgtctatttgccattacgcattgatgggattttttttttaacacacaggccctacaagaatgttttgatagtgagtctgcaaactatttgagtaaatccttgtggatctacagattttattttatttctggtgaacactagtggaagttcctgtttttagaagacagcattcttgtttgctacctttgacacaaagtagcacttcttcatatttgttccaggagtacctagttcaggtttcatcctaatattttaaaactcagtgaacatgtctgagatcaacaaatccatcctgtatatgattttatagaggataggggaaaataattatactaaactggcaatgcttaaagacagtgagcaagataagagagaataaaatttacaggaagaaagcaaggcaactgaaaatgaggtgattatcactaacttttaagtttccatgaaatgtataataaaatacaaaataataattacaataacaacggtggctagttttactgaatatttacgataatccaagtattgggctaagcagtttacctccattttctcggcttatgctcacagaagtcttagacggaagattctattattctctccattttagaggtaaggaaactagtcccatagcttttcactgataaaatcagggtaagggcctgtgttcagtcggcctcagacagtctgtaccatgccagacatcttccagaaatggtcctcattgatcttaatataaaggatccaggctgaaggccttgctacttgctgcttctgacaataaataatattgctttccactcacagtactggagagcttccttcttcactctttcatggtgaagactgatggcccctttaggggctcagagctgcctttgccaagcctcggctggctttctggagggaagctttctatttcactgccctttgggtctattctggtctttctctttctttttttttcttttttctttcttccttcctttcttacaagttctggctatgtggtttcttttcttcctttctttctttctttctttctttctttctttctttctttctttctttctttctttctttcttcctttctttcttttctttcctttctctcttgctctctctctctctttttttttttgacaaggactggctatgttgcccatgcttgtctcaaactcctgggctcaagtgatttccctcagccttggcctcccaaatgtgggtttctatgctaaatggaaactgaagttcacttgttgcactaagcacctagagggaaagtctttgtagcttttattcagaaaaaaaacaaaaaccaaaaacaatcctagattaaataaaccaatacagaaataaataccaactttgtacaaaaccccaagcgattgtctggtccatacctgtgtcataggtgttatgtcatcagcccccttctttactgattgatcccatactctgagggttctgtgaacttgcaggtgacttctcagattctagctgccatgcctttttcatggtcaggtgctttgccagagttcctgtaggtggatatccaacagcagtacccttctcatttgtctgaacagtaataaaaattgccaccacaaaacccttgaaaataatttttgcaaacattgaactggacttgccctcatagctcgttcatgaaatactcccctctactaacacacaatcatgttactattctatagtgcctcatttttgaaacaaacagcagtgtccagtttgttattttatttcctcaacctggctctgcatatctttggaatcttttggcaaattcaactccttccttaaggatcaaaaattttccaccacattcagaagaatattctgtaagcttcaaaggcaacagcaaaaagaatagctccacaaaggtgtctgagtagcagtataataggatgggttgagtgggcagctgccgagagtgactgcttaaagggggcagtccttatcccaagtgaactgaaaaaggtcatcaaaaagatgataaaaaaaatcaggctttgcttttctattatttttatgcattgtttttctttttacaggtttagaaagcccatctcatttaattccacctccagttgaataattagttatcgcacacattggtactattcttttggctatatttcctagtaacacaaaaacaagttccacagttagtgtttgcagagaccaaaatattttattgcttctcttgcactggaaattccacctcaatgaaagtatgctgttatgaaaattgaaaacaccttacaatgatcttattcaaaaagaaggggtgccaagagagtagttctattagaacccatatatctcccatatcttagagttatgggagtgttagagggaaacttaataacttagctaagcattgccagaattagcagcaggagttttcagaggctgaaggactgttcttaaaattaaaaactatctacatatgctctcctctctcattttagtaataaaacatcaagtactgttgccaactctcttggagctgtggttagaaactccaagcatttcctatgttttgatgacaaagatatttacttaattcataaaggatgtgtgtaatgtgcactgaaactagattgctcgaccatggaaacagctccagaactttcagagcaattatgcccagcaatgttcaaggttaaccttaatccttttaactgtgcccttctcacaaatcttttaattctattctgcaattaatggaacttttcccccatggtttctgcaacatgaaactctgttctgtttctgcaacatgaaactcatccccatggatgaagctccagggcctcatccatgatcctggatgtggttgttcactgtcctgggtttcaatggaggttttagttggcctttggtctacctttataatttggacttagtcccttattctttgcagcttaggtctctccttttatttagtggacatgaagagggcaaggaagtgagctacaaaggctgttatggaaagaaagtaaatgtgttcgttcttcacttttaagggactgctctcactgtctcatcaaatcagtacagagaataggaaggtcttttttctgaatatttgaaatgctccaaaggaagtgccaaatatagaaaaagcaacataaaatcaagaatcactcataaccttctgattaccctggcactttctatgaaggagtagagtaaagttggcccccacctggaatatagctcctccctacccccaacaatggaccctgcccattgcctcccagttccttgatcttcctaggttccacaactctctttttccttttagttttattccctccagccaaacctctcttattcaatattttgagccaatgggggagttatgtagatttttttccctacacattagctggccccttttatgaccaatgactcataaggcaagatgtgtggtggcatcttcggacaggcggcaggctttaatagggcagcctgggttggtggaggcaagcaaagctaattggcatgcgtgggaatcaaaccccaggccctgggctcattagcccatggtcaaaacaactgagccagaggaggtaataatttgcccaagaatatcagtagttcctttattagaagaaaatggctgatatggaagttggggaatctgaattgccagagaatcttgggaagagtaataagctcttagtctcaacaaaaagtgttttttcatctcagcgcgtaaagggtgctatatgggaacaaagaagtattttaaaattataactactcattctttctttagccttagttaatttgagcagaagccacaacaagcaaaccacaataaatttagaattggcagaaatccacattaactcctcttcccaagtttccacactactaccatttacagttgtaggtttgtaatgtataattatgtaatgcagaaactagctttgacttgtgtaacgatgcactgtcaaagtaagcaaagtaagaattgaaattccacattcccagaatttaacactcagctgctcctctagtaataagttcctggggataatacattaaccaacattggttgaaacatacctgagtaatcatatcaggatgcatgttaagctgataaaacaataagatcccaaaatgcagtagctcaaaaaaaagtagaagttaatttatctcctgggggacagctctggttctcaaattttacaggctcagaatcacctgcagggcttgtgaaagtacagattgctgcgctccgcccccagagtttctgatttagtaggtgttaggctgaaccaagaatttgcctttctaacaagctcccaagtgatgctgatgacttgtaggaatggatttacttctaggattagacttcagctcactctgtttgctgaactctttctaatatttcttaagttggtagactctctgctccaggttctcaacgtgaaggaaggaacccccagctgaaccagcaatgataatgatggcctctctcaaaagagaaaaacaaaacccctaagagactgcgttctgcaagcatcagttctacggatcatcaacaagatttccttgtgcaaaatatttgactattctgtatctttcatccttgactaaattcgtgattttcaagcagcatcttctggtttaaacttgtttgctgtgaacaattgtcgaaaagagtcttccaattaatgcttttttatatctaggctacctgttggttagattcaaggccccgagctgttaccattcacaataaaagcttaaacacattgtccaaagggcaggctgttctcttatttcaatcccaaatgagaggatagtgtggcagagatgaacaaacagcttgaggacgtactcgtgtgctcactgatcaagtcaggctgaagctctcccctctgaatccttgtagtgacttagagcctttccagaggctccctcactttctcattcccatcaggtgagccaggttgaagatggaggctagccctattcatcacttaagaattccctaatcttcagcccctaccatgaccaggtattttgctgatattactgagggacgcctcctaatagtcctttaagctgagaattatcatttccatttaacagatgaggaaacagaggattaaagagatcaagtgccttgcccaagtcacatagtaaatggaactgggatctagacatccacagtcaccagatttcctgcattactcattttaaacgtccctttcagtatatttatgcctagcaagtagcactgttttttcaaaatttcatcgccagtctgggaggagtcgtccccagtgccagatttagttagttccacagctaaagaataagatgaattcagttccttccattttcagagaatgtggcctggcagttcgttaacactcactagttctatttttttttttaaccgattccttttttatcatgacatttgcacattaacagattttgaagcttcttgccatatgtttagaatttcttcatttaggaaaatcacattagcaaccttaaagagatttgcttgctcttgttttgattacctagaaccacataagagatgatgagttcttcctaatttcttttaaaaccatgttgattcacaacatatacacagctagacctggggaaatgtgtgaactgtgttttcagtgttaccacgttcctctacagggcccctgttctctatcatgagactatcttcagcctctttcccaaggacttgatcctgacctatgtcaactaaagcccccatgccgctgatgatgaaggtgtaagccctctcaaggatttgccttccaataggacactcatagagaaaaaaaaaaacaccaaaaaaaacaccccccaaaaacaaaccaaaaaaccaaaaaacaaacaaacaacaccttccagacccaggggaagctttctctaatggtgggatttcaggcaaaaagaaaaggtttcctggacataggccagtgctcctagaataaccccatccagactatcacttgtttggctgtttcacaagagtaaacctacatgatcccatgttttggcagccatcacttttttccatgagttctgattgcgatgtaagaacagctctctcaaatctcctctcccttgcagtgctcctctgtgccaaacccggtcaaggttagaatctttctgagaggtatactcttccctgcaaaattaaaaaagaaattatttgcaaggggagttatatcacaccacacatgtgtgtgcctattgggtcaggtaatttttagctaaagataatagcatccaccttgggtagtttaagtagaaaaggagaaaaccgatgggtagatattagtcagggaagaccagagaaccgggctcaagcctaaacttgcaggctcaatgcccaaagccatgtctctaattgtattgatgaggtggctacccctagaagcatgctgcagaactgcctgagtctgcgctctcttcctctgcctctgctaccacctgtgcctgcagtaggatttcccccgccccgccctccccagagactcccaaatcagtcttgaatgagtgtctgattggtggaacctacattatattcctgtacctagctgcaagggctgctgggaaatggagtttttaggattctactttgggctcttgggactaaaataatgggaccctatcaaaatggagagagggtgttcagagatgtggttgactacaaacaatatatgccccttccctttttccccaaaaagaattttccctttgattcctgcccat

SEQ ID NO: 15909 - DNA, 24924 bp, Human
tggcacttttatattaacttaaattgcactgggaaaaaagcataatagtagttgagaagcaactaattataagcaattataagccaaattatgtttataccacaattagtgtttgaggtggtttagtaggcagattcttcagtaagaaccatcaaataattgaacagcttgtaaaacacagaaatacttcttttatctttattccaagtagagtaaccacattcttttatcattataaaataagcaacatttattatcttttgtcccaatccgcagtttgagttggatgcttataaaacatggcaagagggctgggtgcggtggcctcccagcactttgggaggccgaagtgggcagatcacctgaggtcaggagttcaagacaagcctggcaaacatggtgaaacctcgtctctactaaaatacaaaaattggccgggtgtgttggcatgcacctgtaatcccagctactcgggaggctgaggcaggagaatcgcttgaacccaggaggcagaggttgcagtgagccgagatcacgccactgaactccagcctgggcaacagagcgagactccgtctcagacaaacaaaacaaagcaagagtagtttatgtacctagctcacaacatagcttctttcaacaggtttcacggagacacgtgaaccacgttcttgtaagacaagagctattctacagggtatctagagtgcaaaccgaaaccatgtctttttcagtggatttttcatgttgacatcatcttatttcactttggggaaagtttttttctaaggatgatagcgaaaagtccttttgtcttgtgacaatagcaatttttatgtcagcttgggtttttttcctcccatattcccaagtaaaagtaataactttgttaccagttttgccatctgaggttaaactgtttgaccatggcttgacgactattttatacttaacacttataaaatattagactgatagttatttaagttaccaccagtgatagctctggaatccctgttttattaatttccaggtaaatccttcttaagcacatgggaagatagcactgtaaattttggggggtaaggagaacctccatcaattaatacatcagcttgataaaattcaaagaaaaacatgatcaaataagttcagattatatttaacacattcagtttctagaagtagttttgctgaataaattcccaccagttgagctaatggagcaacggagctgccagtgcttcccggaggctgctgtgctcagccaattcggaggcatggcgagccacacggtgggaggtgggtaaagccggggccctccaaggctgggcgccacgttgcttttctcttctgaaataggaagacaatgcttctggctattgtataaaccagccgaggactgctttcattcgcacatcagccaaggcgtgagcagaattaaagcgccttctaattcgacccctggcaacgtgcgcgtcacggacaaatgtttagttttaacgcctggctgcgttcgccttgggaaaacacacttttaagaatggccaagtacctcagcagtcgcggtgaactgcacaagatcaaaaccaccacgccaacccagcgctggccaccgtccccgctgaaccccgccaacacccctaaggacccacccatgttttctgctaatcattttttttttctaaacagctctgcacagcctttcctcattccgttcccgctctccccacccactctgcattcgatccgaggtttctagtccccagctggacatcacagcaccaactcccactcaggagccggccagagcccgagccgcagcgcagtgggcagctccccgcgctctccgccaggccctcggccagccagccgccactcggccgcgagtgattgacaggcggcagcagctataggccgtggaggtgggacgatgcgtcacttcctggtcttttggggggagccgggatatataagggcggtgctcacgcagcgctctcgcttacacagtatggccggcgacattagctagcgctcgctctactctctctaacgggaaagcagcggaatacaagagactgaactgtatctgcctctatttccaaaagactcacgttcaactttcgctcacacaaagccgggaaaattttattagtcctttttttaaaaaaagttaatataaaattatagcaaaaaaaaaaaggaacctgaactttagtaacacagctggaacaatccgcagcggcggcggcagcggcgggagaagaggtttaatttagttgattttctgtggttgttggttgttcgctagtctcacggtgatggaagctgcacattttttcgaagggaccgagaagctgctggaggtttggttctcccggcagcagcccgacgcaaaccaaggatctggggatcttcgcactatcccaaggtgggtccccggggcgctcgctgacatccgggcctgggggctgtcgccgccgccgaggcaccagccacgggtggagcccgagttccctcagctttcagttgggggcaagtctgcggcctggggtcgcttcggcggccttggaaggtgcgcggtttgggggagagcggccatgtccacgcgggccggagccggcttctcccgccgtggttgccgcgcctggcattgccctgggggaggggaggaggccggcgcggccgcgtgctcaggtaacgtcccgcgctgggcggcgggcggcgcggcccggggtggttttgcggcccgcgcctcccgacatttccctccgtagtagttggcggcaggggccccaggtgggggtcgggggcgcctgcgcgggttgcctccggcaggtgtggctcggcgggcttagtcaggcgctaattcgggcgtgcccgcttcggggaatggagggcgggagcggcgcttgttcttgcctcgggcgcggataggaggggccctcccggccttgtctgaggggctggcgaagaggcctcccacccgcggcggccgcgggcagcatgtggcgttcgggcggcggggattgggcgggagcagttatgtcgcagtggcggggccccaccgctcccctaacatgctctgcgccagagccttttcggggcggctgggcagacggcgcagtccccggggccgccctcgacacggccgctgaggccgctgggggctgctccccaatctcttgaccttgggttgtgtaacctgctacggagccggcggagcggggcgggagaggtgcgggtggagggaggcccgcctgccccaggacataatgcctctaatgccttaagcttgagcaaaggaatctggggcccactcccactgcgggccgtcacgcgagagatacttgggctgaccgcgccgaagaggcgttttagttggtattgctgtggaaatccatgcttatataaaagcccagagatcccgtggatgcttaggccttgttcctggcggcggtcgcaccggtggccaccaatggccttcctaggccctgccaccggatccctggctcctctgcgcacgagtgcggctagggtggcggtgcagcggagtaactggcgtggccagcttcattgagaggcggcgaccaatgggctcctgggccgcactcagagcctggccccagggtgtggaccaatgggcgttttaggagtgttagctgttcttggagctgtcccttgacaaaaagcaactggaaaagggaatccaggcagacacgtgctaccgagactttaaggcacgacgggaaacccggtttctagcagtgtatcttgaacgattccattgtagaaaaaaatactagtcatagctaaaatgtcacacgtctcatttttttcaagcttcgtgtgacacttaaaatgtctatagcgcttactacgtgccaggctcacgtgagattataggaagcggactttggtcatggagaagcttagtatttccttcatttcacagatgagaaagatggtatttgtgatagacgtttggtaaaacgattgtgatcaggataattaacctagaaaatcttggcaagaacctagaaaatcttgggtaagaacagtcctagaaaacgaataacagaagttgtcactttggctttttaaatgtttgagcccttaaataatagtaagtacatgttcttaataaagggaagaagattttgttctccccaagttcttggcggtttggctgtttagagcttcctgagtcaaagtggagagaggaggaagaggctttttacaaagcagcctgctttctttaaatgtttaagaaccctttttactttgtactttaatcagcccaaattgttttactgctccagtgtggcttttaaaatcatggccaaagttaaactttgaaggacaaaatattcccttgtgtagatgatttagtgccatccattttgtggacatgtaacattcattgaacaactattggtagtacactgccacattgtaactgttgtagataaagcaagttaagcaagaactgaaaaatatgttgatttaactaaggtcccgtgataaccttcgttggaacatttttcagtgaccactcaagtggttaggttatttaccaggatgtttaaaaaagcctgaaatagtaggtgttccttgaatcacctaaaatcaacagcctagcaaagagagtatcatggacggagtccggtcggtggggacatggggccagccccagagaccccagggaaggataatcggtcatctagaagaataaagcgtgacatgttttactcaaatgacgtgattaagtgcatagcctctggaataacaagatttgaattcaaacagcatttaatagctgtgtgagctgtttcctcatctgtaaaatggagacaataatggtacatagctcatggaagttgtgaagaataaataagttaatatgttatatgtagtacgtaaactgttatctttaacactttaaagacaggatccctctatagcccaggctggagtgcagtggcaggatcatggctcactgcagccttgacctcctgggctctattaagatgtgaataaactaaaagtaggttaaaagatgaacagatggaattaaacaaatctgtttataaagcataataaacatagggacataaaaacgattaagagaatgaaaggcttaaatgtccaaagagagcattagtattgatgctaaagacaaggataacaagataaggatatgagggagaaaaaaatcctggaaaaatagctttccaaaactaatgcaagaagaaatggagaacccaaaacagtcctagaacacctaaataacttgaatcagtcaatcatctaggcccagatgatttcactggagtgttctgtataattcaagggagaaaatatccaacttttttcacgcattcttctgggaaacaacatacttccctcggttttctcatcccaaagtctgaaatatttttttctcctacacgatatttacctttcatatttagatctgcaatccatctggaattgattttgtgtgtggtgtgagggaatacactttaaacaaacttggctcatcagtccaagctttaatgcttggaatcttttctgaatgtacacctttttactaaacactgcttccctcttgtagaccatttaagatattttatcttaagtgaacaaattatgtaatactgagaaatttaacaaagaaaaatcttttatgatatagcttgggttaaacaatactgttggagaaaagcagcagtccaggtatatccagatgaataaaggacaattaagggagaggcggtttcttaggggtaacctgcagttttctctgatttttcagattttacggatgttgaataaaaatcagtgaccatttaaaaaatggtttagttgttggatcaaagtgctgtaacaaacaaaagctttttataagacatggcagctttagggagggtgagagtagtaagaaggaaatctgttagaaaatagaaaattttgctgagaaaagaatgatttttcaggactggaaatcctattactgtgctttactcagattttataaactaaaacataatttttagtaaaggattggggcagttgtaaagatagtcatacctcagcttaactttccccaaactcatgacttatttgactacatcattatgcagcattattgcaatatcaataatttacattgaaggaatttacaacccgttgccaaaaaaccttttagtgtaatgtttcagagtagaaatgcttcctactaaagaataaagcttctcgttacattcctcccagcagtttcaaaaaggtttcatggctgggcttggtggctcatgtctaatcccagcactctgagagaccaaggagtttgagagcccagtctgggcaacatagtgaaatcctgactctacaaaaaaaattgaaaaattatctgtgcgtgctggtccatcctggtgcgtgtctgcatcccagccactcgggaagctgaggtgggaggatttttttgagccattgggggatcgaggctgcagcgaaatgagattgcaccagtgcgctccatctggtggcagagtgaaaccctctcaacaacaacgaaaatatttcaactgttgtttacaaaccatgtatctttaagaagcacatgttgaaagtagcagaaaactgagaggagtatcccgatttggggtaaaaatttgagatagagaaacaataatgtgatgataataggttcatatctttgaacaaaagggaggaggcttatttctcaggttatctgaattcactgccgcaggaaggcaccctcagaatctaacttctggtcagtctagctttactcaagaatgatctggttttaggatgccttttacctaaagactgcttactacctggggtagaggcaccctgatgaatgtactgtaatgagagcctctaaaacagacctaaaaatatgaggtaagagcagaattgagaagctgcagtgactttggataaattacctgaactctgaaaccagctggttttacattaggaagtaatgagtaatctaatgacctggaagcttttcaaataaaaatttgcaggcatcatcctcagaaagtgtctgacctaactgggtatgggaatagcatctatgtattgagttttcaggtgattagagcataaccctgcactaatgggatccttctgtatttaagttcttggtcttttttttttttggacagtctcagtcacccaggttcgagtgcagtggtgccatctcagctcactgcaacctccgcctcccaggttcaaatgattctcctgcctcagcctccctaatagtgggtactacaggtatgcaccacgatgcctggctaatttttgtatttttagtaaaagacagggtttcgccatgttggctaggctggtcttgaactcctgacttcaagtgattgagccatcgcccctggtccctttgtgcattttttaatcactttttgttgagttgtgtgtaggtgtgtcttttactttggatattgaccccttatgaggtgacttgcaagtattttattctgtaggttgtcttttcactcgtttcttttgatgtatagaaatgtttacattttaggttttcaagttccatttgtctgtttttgattttattgtatgtcatatccaagaaatcattgccaaatgtaatgccctgaagcatttaccctatgtattcttctaggagttttattcgctgttaatgtttaggttgttgatccattttgagttaatttttgtttatgatgtaaggtaaaagtccaacttaattttgtttgcatgtggacatccattttttcccagcactatttgtggaagcgatgtttttccctgttatgtaggcttgggactcttgttcaagatagttgagctcagtcatttacttctttttttgagacacgcttgtcttgctctgtctcccaggctgaagtgcagtggtgtgatttttggtgcactgtagcctccgcctcctgggttcaagtgattctcctgcctcagcctcacgagtagctgggactacaagcctgcgccaccacacctggctaattttggtatttttactagaggcgggtttcgctatgttggtcaggctggtcttgaactcctgacctcaagtgatccgcctgcctcgggctcccaaaatgcatttaatcaggcgacatagagaagtcttgttataatataattatcttgtccctgtagacatttctaaattctatttttattagacctcagcctctaagaaaatgttttaaatataaaatgtggcatgccactaaagtgttgtttttcagacatacaatttgtgtgctgttattaatatagaacatctatttttctttgggatcatttatcatgatctctgattatatttaatattttagtatctagtctttaagtgaaattagggtatctcaacctcagcattcttgacattttgattcagataattcactgttgtcaatgactatcctgttaattataccgtgtgtagcagtgtccctggcctctatccactgcatgctggcaacaccaccaccaccccagttgtgataaaaaatgtctccaaatgttgccacatgtcttctgggtggcaaaattactacaagttgagaaccactgagttagatcagagaggtggcatttaagatgagaaaaaggaattcaaatcaggaaatactcaatctacatatttctttgtgttttataaccacctaagaattgtgtgcttcgggccaggcatggtggtgcatgcctgtaatcccaaatcccagcactttgggaggccgaggcgggtggattgcttgaggtcaggagttcgagaccagcctggccagcatggtgaaacaccttctctactaaaaatacaaaaaaaaaattagcctgacatggtggcagatgcctgtaatcagtcccaactactcgggaggctggggcaggagacttgcttgaacctgggaggcggagtttgcagtgagctgatagcataccactgcactccagcctaggtgacagaacaagactgcatctcaaaaaaaaaaaaaattgtgtgcttgaatagctttataataatttctaatgactagatcagtattacgtgagctgtaatgtgaacaaatcccaaaatcatcttgctatcttgcttctcttgattctgctttatatccatcaatttgatttattgactctttaaatagcaaggattgccaaatagatcagttttataaatagtttataatagactagtgcttcaaagtctcagtttgtagtgtacttgggagtgaagcagagacaagaccactatcactactgagcctgataaaacattctagcttaatactatcttttctatttttgacacacagtctcactctgtcgcccaggctggtgtgcagtggcacgatcttggctcactgcaacctgattttaaaaatggctctgtcgactgtataaagcactttgtcttttccatcattaatttgatcagaaagcagaccactgaaaacctttcctccaaaacaagagtcagcaaactttctgtaaaggactagggagtaaattttaaattttgcaaggcagacagtctgttgcaattactcagctctgcccttatagggagaaaataaccatagtcaatgtataaatgaatgggtgtggctaggttccagtagagctttatttacaaaagcaggccattttttcccacagaaatgtgatagaaataatttgtgctgaaattttcagctgttgcagagtttttcacctcttttatgtacatgtatagcattgtattgactacttttttctttcgtctattttgccctctgatttatttttcttgagcttagtagctctggtaaatgcctttatcatcactaggttgatagacagtttaactgtttgtcctaggttgcttaaagtaattgctttcttttgatactatgattgaaaaattctgattaccggagcattactattagttgaggaaaggtttgaatggagaattttattaactgatgatgagtgagtataagagcattttgaagccagtgggttggcacgtgcctataatcctagcactttgggaagctgagatgggaggatctcattagcccaggagtttgagaccaacctgggcaacatagggagacctcatctctacaaaacaattaaaaatatattagtaaggtgtagtgatacatgccctgtggtcccagctacttgggaggctgaggtgggaggatctctttgagcatgggaggccaaggctgcagtgagctgtgattgtgccattgttctccagcctgggtgacagtgagactggctcagaaaacaaaaggttatttctctgccattacagaagaagcatggtacactgtcttctcttattaaaatgcaattaataaaccctggacagaatgcattgttgagcagctatccaaggactctgagaagtaaattttagcaggtgaaatggagaagaaagccagaactttaaattccactgaaccagcagtgaatttcctgttttttttcccctgtggtatctcctcgctgatttctcctgggcttgccagaaacccagaactgaaaagtaggggcaggcaaaaatagttccaagaaaggctctctagttctcctctgcaaagaaagaatgagaggcccctttgaatcagagtggaagaaatctcttttttgcttttgttttgttctattctgccccaatcctcttgtaggcctttagcagctgtggcagttaggcagatgtctaaaacaacgagagaagggaatcattttttgtttgttgtttgtttttgagacagagtcttgctctgtagccagggctggagtgcagtgacacgatctcggctcactgcaagctccgccttccgggttcatgccattctcccgccgcagcctcccaagtagctgggactacaggtgcccgccaccacgcccagctaattttttttttttttatttttagtagagacggggtttcaccttgttagccaggatggtcttgatctcctgaccttgtgatcctcctgcctcccagagtgctgggattacaggcgtgagccactgcgcccggccaaagccctatttttataggtagtggatgaagaagagtccttcccctatcccctatgtgagtcaggcattgtcagagagattatggaaggttgaagaaagtaaacctataaagttttatatgaacactccttagccattttgcatggatctgaccctaaacagcacatcagaggctttgaaaactagaatacacaatagactgcctctccagggccagcctggccattgggtggcaaataagtggggcagatgcaaatagcatagcaaaggagttcataacaaacctgacactggaaccataacacaacctacaaacattgagtaaaaacttgaagcctaaaccaaaccagattgtctgctgaaagtttttaaaaatcaagacctagaatgatgtaacatgtcaaaatatccaggatgccatcctaaattagtcaacatactcaaaaccaggaaaatcttaacatctcaaaggaaaagacagcagacaccaacctcaaggtgacatggaccaagactttaaagtatctgtgctacaagttgtaagggtgaatactttgttttaagagagggtcttgctctgttaccctggctggagtgtagcggtgtgatcatggttcactgcaccctccatctcctgggctcaagcaaacttcccacatcagcctaccgagtagctgggactacagacctgcaccaccactcccagctgccttttttctttttaagagactggctattgctatgttgcccaggctggtcttgaacttctggtctcgtgatccttccttcttggcctctgaaccacagtgcctggccacaacagcctttaaaaaaagagaaaacaaaaataagaaaggaaaagactgttacactgtttagttcagccatggaacgtgtttaaaagtcttaatagaaatggtgaatataactgagaaagggagggtgggatttgttagtgcgtccagtgggtaaaaaggagtatgtgcaagaataagttatagtgggaagtcagtaggtgatgacttaagcaggtagcattattgatggacctgaattagataagctctttaaaaatctgaaattgtaatgtttctaatacttaaatcatagtggatatttttatttaccttcatattcaggaatgggagtcttaatagtagataatttttgcaaggattttgtaaatttatcttagtcaagtgaagcaggatttcattcccacgagtagtttgtttatttttttgagatggagattcacttttgtcgcccaggctggaatgcagtggtgcgatctcggctcactgcaatctccatctcccgcattcagtctcctgcctcagcctccagagtagctgggattatagacgcccaccactacgcccagctaattttttgtgtttttagtagagatggggtttcaccatgttggccaggctggtctcaaactcctgacctcaggtgatccatgcgcctcggctgcccaaagtggtgggattacaggcatgagccattgtgcctggccaagtttttgttgttgtttttgttttgtttgtttgtttttgagacggagtctccctctgttgcccaggctggtatgcagtggcaagatctcagctcactgcaacctccaccttcagggttcaagtgattcttctgtctcagcctcccgagtagctgggattacaggcgtgtgccaccacacaagccaggggtaatttcaagggttgtcacagtatatatcccacatatgtattctttccatatatgaacaaattgttagcaccctttttaaagaaccttaaaactttttagtagctcttttaaaaaagttgcttagtcatgttatagtctaatacaggaactcagctctgtaatcattagcaagcctttcacattaaagatttttggatgggtattggtacgcagatgggtcagtaacagtttcttgtagcaaaatggtgagacaggcacaaaattctaccaggcatgtttggtgttgtgtttgctttttaatacaaacgaataaaaacattttgctgttggatttcgctcaaaaggtcttatctggttaacaaaagatttgccggctgggcacggtggctcatgcctgtaatcccagcactttgggaggccgaggcaggcggatcacctgaggtcagtagtatgagaccagcctggccaacatggtgaaaccctgtcgccactaaaaatacaaaaattagccaggtgtggtggcacgtgcctgtaatcccagctgcttgggaggtggaggttgcagtgagcagagatcatgccactggactccagcctgggtgacagagcaagactcagtctcaaaaaaaaaaaaaaaaagatttgccatttttatgagtgtagagcaatggcctgtcagatatcataaggcttaaaaatttttcttctttttttaaagaccagggtattactctatcgcccagcctggtctcaaactcctgagcttaagccatcccaatcccaaagtgctaggattacaggcgattctcctgcctcagcctcagcctcctgagtagctgagattataagcacctgccaccacgcccggctaatttttgtatttttagtagaaacagggtttcaccatgttggtcaggctggtctcaaactcctgacctcaagtgatccaccgccttggcctcccaaagtgctgggattacaggcgtgaaccaccacgcctgacctaaaaaatatttctggcaaacagctgggcatggtggcacatgcctgtggttctagctacctgagagactaaggcaagagaattgcttgagcctgggaggtcaaggccgaagtgagctgtgattgcaccactgcactccaacctgggcgacagagtgagaccctgtctcaaaaaataatatctgtcatgttaagctgttccatggaattacattgtctttttataatgggcacactaatgaaagaatgaacactttcctaattctattctcaggcaaattaagactagtttcttcatgtccatatgaccttcattgctatggttgcttgtactgcacatttcctgttaaacgggctttctcattgcatttggagagctgcgtagtattcccaaaatcttctaggtatgcttgtaattggcagtcattccagttttttgtgagtgctataagagtaacatcactcactgtgtcccgacagacaggcttttaaatttctatgccaattagattggtaaaattatgctcttctttttttttaagtgtttcttaaggttaaaaatctgcacattttatagacaaagtatcccattgaatttctgtaatcattgattagttaatggtttaccttggtttatggacctttgaacatttttttgcctatttttctttaagtaatttgtaaatacatagtataatgaccaatttttgtttcatatatagcataatatacctatcatttatctgggtatgtcaatatagattattttgaaagaaactaaaagttggtgtacaatattaattaaaaatgtggtcttcatgagaaaaagtgtgagctttgtaatttttatgagtaggtgggtactattgtggattaatcgtaacttttttgttaaatgatagatctgagtgggacatacttttgaaggatgtgcaatgttcaatcataagtgtgacaaaaactgacaagcaggaagcttatgtactcaggtaagtcctgtaaaacaagtgttaggtagctaatttcagtcctaatcataatgtgaaacagttaagttcctctcagttgtagttctgggggtttttttgttttgttttgtttttttgagacggagtttcagtcacccaggctggagtgcaatggcgccatgtcagctcactgcaacctccgcctccttggttcaagcaattctccggcctaagcctcctgaggagctgggattacaggcaccttccatcatgcccggctaatttttgtatttttagtagagacggggtttcaccatgttggccaggctggtcttgaactcctgacctcaggtgatccatccacctcggcctcccaaagtgctgggattatacacgtgagccaccgcgcccagccttttttttacattattcttaaaaatatggtataaaaggaaacatttagtgtaacgtggatgtttctaggacataggttttgaagcctcaccggacagttcaaggtgtttgccgtcttttcctcccaattggtaaagaaggacctcttaattagaagttcaggcaaagggaaagttagcttctctatacaaatacagttgtctaattggtatataaaagctcatcaccttttttgtagttgcagagttaatttattccataaatacttttaatgcttatagtatatattgtgatgggccttgctgggggatactggactaaacagcccctccccccctttttttttctgaggcggagtctcagtctgtccaggctggagtgcattggcgcaatctcctctcactgcaacctctgccgcccaggttcaagcgattttcttgcctcagcctcccaagtagctggtattacaggcgcctgccactgtgcccggctaatttttgtatttttagtagagacggggtttcatcatcttggccaggctggtcttgaactcctgacgtggtgatccacctcggccgcctaaagtgctgggattacaggtgtgagccactgtgcctggcctctctcttttttttttttaaactaagtttatattatgaatatacgaatgtttatcaaaatgcttaccatgtgccaagccctggggatgttttgtatactagaaaaggaaaagaataatgtgttacttgcttccttgagatcctaatatttaaaagtactagccaaaattgtaaatgataattaaattggttgattgcaccctcagtagtacattagtattgttataatattgtgacttttttcaactgcagtgagagtagcatgtttgtctccaagagacgtttcattttgaagacatgtggtaccaccctcttgctgaaagcactggttcccctgttgaagcttgctagggattacagtgggtttgactcaattcaagtaagtaagcaaacatttaaatatttttcaggcataaatgttagcgttcttatcctgtaatatgcgaagtaaataaatttatatacttactgcctttgttacaatgcatgcaaacacgtggtaaggtgttcataccttaggaagagatctgattctcaagaacagcagaaaataggaagcagagaatgagttaggatgaaattcaaatgggagaaagaaatgaagaagccagatacttccagtagttaatttcttaacatggctacttataataatagagaaatggtaagaaaagaaggaaaagcaagaaaaatgtcgttactgaaattgtccagtctttataatgaagagttaggatgaagagcaacagtcagtattgagttaaattcttatacttttcaagaactaaggtgtttttacctagggtataattttctgattagcagttgttacattttatttattttctatttttttgagatggagtttcgctcttgtttcccaggctggaatgcaatagcacgatctcagctcactgcaatctgcacctcccaggttcaagtgattctcctgcctcagcctcccaagtagctgggatcacaggtgcccaccaccatgcctggctaattttttttgtatttttagtagagacggtgtttcaccatgttggccaggctggtctcttaactcctgacctcaggtgatccacccacctcagtctcctaaagtgctgggattgcaggcgtgagccactgcacccggcctgaattttaatctttaacttcataaggaaaggatggattgtcattagtactcaatacagtttttgttgttatgaattgatccttgtaagaaatctaaagcaatgtgtgcttaaccgatgcttaaaactaatatgttattccccccaaatttttgcttatatgactattaataagctcagtttagaaactactgttctagaaaggaatatacttggtgttaatagttgttatgacccatcatcactagactgggctttttaaaaaaaagagagagagagagagatggggcctcagtatgttgcccaggctggactcctgggccaagtgatcctcctgcctcctaatagcgagactacaggcatatgctaccatgccaagctaaaatatttgagttttgattttgccgagtttttgatatgtggacaatagttgattagcttcgaaaagtgatagaattctacatctaaagtcatctttttttttctttcttttcttttttaataaagagcttcttttattctcgtaagaatttcatgaagccttctcaccaagggtacccacaccggaatttccaggaagaaatagagtttcttaatgcaattttcccaagtaagtttaaataaaatataaacctgttgtcttcttaaagatagaaagtgcaacctcagagatctttctatatgagagcatacttatgcatatatagcattctacacacactaatacttgcttttcttgtgggttttttggtttgttttagacaggggtctcattctgtcacccatgctggtgcagtggtgtgatcacagctcactgcagcctcaacatcccaggcttaagtgatcctcccaccttagcctcccaagtagctggggctacagatgtttgccaccccacctggctaatttttttttaatttttagtaaagacaaggttttgccatattgcccaggccggtcttgaacgcctgggctcaagggatccacctgccttggcctcccaaagtgctaggattacaagtgtgagttactgcacctggtccatatttactttgacttagatgttttgggagtacagtagtgatctttatatagcttgtaattcaaaatatgcagaatttataaagaacattaaaatatcagataaaatatttttagttaagattaatagcttattgcaaattatgtatacacatgtaaaaataattgtgtatcataaatcagtgctgtttaaatgatggaattttaaaatgtagaattgatcacctgccacctctgatttttcatacagcatagagagagttcatcttcatctggccattcactctactttgtgtctcactcagtggttctttttgcgtttttgtttgagacaagtttcactttgtctcccaggctggagagcagtggcatcattatagctcactgcattgtcaaactcttgagttcaagcacccagctaatttttattttatttttagtagagatggaatcttgctgtgttgcccaggctggtcttgaactcctgccctctagcagtcctccagcctcagtggttcttaacatacagatcataatgtcctttgacaatatgaagaaggatatgattcccttcagaaaaatgcctagtgctctgctccagcattttatataataattgacctggctttttaaaattgcacagtgtaaattagtgtttcttgaatgaaattcgtaagggtttctttcatccatttactaagcttttatttatagaggtcagggaacaaaggttatctgataacatccttacttcctagataaggctgaaaacctaagataatttagtaactttgcacaaagtcgctcataagcatgaaaattgaacttagcacatctactaatatgaaaccaaaccaggctaatcagagtgttgggtatttactgcaaatacccgccaagtcagtcgatcctgcttatctgggaatttacctactgtttccattcctttcactgatgacatttcttttttcttgagatggcgtctcgctttgtcacccaggctggagtggagtggcgtgatcttggctcactgcaacctccgcctcccgggttcaagcagttctcctgcctcagcctcccaagtagctgggattataggcatgtgccaacacgcccagctactttttgtatttttagtagcgatggggtttcatcatgttggccaggctcgaactcttgacctcaagcccacctctgcctccctgccaaaaggggtgggattataggcatgagctactatgcccagtccactgatggatgacatttctaataagtggcaaatagtatcattctgcttattgtggaagggtagtaacaaaccatcctattaaatggatgtgttatatttattttgcgttctcttccctcaacagatggagcagcatattgtatgggacgtatgaattctgactgttggtatgtttaatgcaattttgtggatttttgttgtcctatgtaagatttaaactgccaattgtcatttttaggaactatttttaatttttatttaggtacttatatactctggatttcccagagagtcgggtaatcagtcagccagatcaaaccttggaaattctgatgagtgagcttgacccagcagttatggaccagttctacatgaaagatggtgttactgcaaaggatgtcactcgtgtaagcatttttagtaataattgttgctggactcttctgcgtggggactaaattttatttttcattctgtaacttttaagttcagggtaacaagtgctagtttgttacataggtaaacttgtgtcatgggggtttgtcgtacacagtatttcgtcacccaggtgttaagcctagtacccattagttatttttcctggtcctctcccttctcccaccctgggactaaattttggactcaattgaagtttatttgtcaaacccttgttaaactcggtctttttcccccccccaggagagtggaattcgtgacctgataccaggttctgtcattgatgccacaatgttcaatccttgtgggtattcgatgaatggaatgaaatcggatgtgagtagttatatattgcttcaataattatttaaatgtgaatagtctttccattcttaacactgtgaactttttctctcagggaacttattggactattcacatcactccagaaccagaattttcttatgttagctttgaaacaaacttaagtcagacctcctatgatgacctgatcaggaaagttgtagaagtcttcaagccaggaaaatttgtgaccaccttgtttgttaatcaggtaattttatattttattattaatcaggttatttgatttttaaaatcttaaaggaaatgagacagtgaggcctaagatgtattctgagatagcacatataccagccactcagatatccagaagtaatattgtttgaggttactggtagctgagaagctttgtttcattagacctgtgtcagtccttgttttctgtctagccaaactgatgggttcctcctgtcttgctattgacaggcctctggtgggaggaaccataagatgccctggcccctccagcacataagaaggcagctaaaataactcagatgtcttagtttcattaagataaaagtctgtcacttaactgttttggttgaaaatacttctctggattgcaaacactaacggttatttaattttttcccccagagttctaaatgtcgcacagtgcttgcttcgccccagaagattgaaggttttaagcgtcttgattgccagagtgctatgttcaatgattacaattttgtttttaccagttttgctaagaagcagcaacaacagcagagttgattaagaaaaatgaagaaaaaacgcaaaaagagaacacatgtagaaggtggtggatgctttctagatgtcgatgctgggggcagtgctttccataaccaccactgtgtagttgcagaaagccctagatgtaatgatagtgtaatcattttgaattgtatgcattattatatcaaggagttagatatcttgcatgaatgctctcttctgtgtttaggtattctctgccactcttgctgtgaaattgaagtgcatgtagaaaaaaccttttactatatgaaactttacaacacttgtgaaagcaactcaatttggtttatgcacagtgtaatatttctccaagtatcatccaaaattccccacagacaaggctttcgtcctcattaggtgttggcctcagcctaaccctctaggactgttctattaaattgctgccagaattttacatccagttacctccactttctagaacatattctttactaatgttattgaaaccaatttctacttcatactgatgtttttggaaacagcaattaaagtttttcttccatgagttgagtccttaagaaaatgattccagttactcattttgcatatttgctattttaacattattggaccctgcatttatagtcctttgatttcttccctctccctggtgtctcccccaagaccccaaataaagcaatacactgttaacactgtgggtttatatactaattctataccccagatggggaatgggggagatggtccctgggcttaatattctttaaagggcatgggaatttagcctctcttttattgtaatgtgctcttttggaaaatagttggttagcagggaagacccagagttgtagattgagattagggtgtactggctgaactgtggaaaacatacaattctgtgttcctcagtaaatgagattagcgtctaatgagtagcacccctttactaacttagtagtagtataaaatcatttttatttagttaattaccagagagatttagcataattttgttctggattcagtaaatcaagtcagcttggatcattcaccttaacttttcctttagcagccatttccactagtttccattaagtagtgttctataaactttgatccaaagcagaatcaatgtcttttccatctcgtgacttaaagttctgtgactgtgatgcatgtgagtgttccgacttcatctgttcctcttaactacggtgtttcccttaccatggcattcataggatgaaatgaatgactgcccagaatgagaatttgtccagattattcagataaacatcataaagcagaatacattataaataagtagaatatgaataaatagaataataaaattccaaaatactcaatgggaaatgactagtaatataggctttcaagagttggtaccttttagctatatttgcagattctctgggattttaaggaactgagaaaacagcaaagttgactaaattttatatttcttgtcctctaaatattttgataatttctggattgatgcagtgatgtttttgttccttccgtatttataaatgaaacacctttttttagtgtttctaaacctaaaatctacttggtttgaaatcaagtggttggaacactgtttgacttttatttgaagcatgttgttgattgaaaatttcattgaggaagttttcaatcagtgtgatcagtttgattctgtaatgagcacagcacctaatattttgaggagctctgttttgaggaccaatgcttaaggtggactttgttcgtaaacaatatcccaatagatttgttgacttgaggtctggtttggttttgtttttgttttgttttgttttgttttgtttccaatagaattaagaattctaatgttgaaaaactgcacaaatttttatgggacaaagcctagaaaagagaaatgtagtttgaatcataatctaaatcatcgtatgatagaagagggaaagttttggtgccataatttctcctttcactggtgttggacttaaatcagttgaaatgtatttctgtaccacaatttacgcttcaataaaagtttaattgtctagtgacattcagaaacttttctgttgccctgttttttaagtagcctacttgaccaaatactacatgtctgaagtttaaaatcaatacaacaatgtgtatttatgagtttggagttagacagaagtttaaaagtgttaggtcccaacctttattatagactagactcttaaaacattggttgaggatgatcaaactcaaataagtttccttatttcattcatggttatttctattaagtagaaaaaaatttataaccttgatcattttctttattttttttaatttaggatcttgttctgttgtctaggctggagtgccgtggctgttaacaggtgcgatcatagcatactgcttccttgaactcctaggctcaagcagtcttgctgcagcttcccaagtagctgggaatgcagggttctgccatcacacttggctttgtcattttctttatttggcaacattttagttccacagtcaaatatgtaataagctgaaaaatcttatgaaaatgtatattctgatctttctcagaatatgcttccgttagaaaatatttcctcaattttcattaaaaacagatggtgttcctagaaaagcaaaatattacatatctgtgcaatatgtaattcacaagattcatttgccaaaaacaggtgagtgaatttgggggttcattagtaagcagtcaccaagtttctgtcacagacacataactggaaatgtgattttattctcctggatggacaattgtgatggattttttgggttccgggcttcaggctttgcaatctcatcttctttgcccttcctcttgtcataatggaagaggtgctgctaatttgggttccatcctttcctgctttcagagactgtcctgtgatttcctaaaacatttccattagtttgtttgaattttctgattttcttcccttagggccctccacaggcctctgtgctagtgccttgaatgatggcaagtgtacaaaaaaaattttttttctttttaagacgtttttgttctgtcacccaggctggagtgcaatggcgtgatctcggctcactgcaacctccacctcccaggttcaagtgattctcatgcctcagtcacccaagtaactgggactacagggatgtgccaccacacccggctaatttttgtatttttagtagagacaaagtttcaccatgttggccaggctggtcttgaacttctgtcctcaagcaatacgcccacctttgcctcccagcatgttggaattacaggcatgagccactgcacctggtcaagtgtccaaattcttactccaaaactgaactttgggctgggcgccatggctcacacctgtaatctcaaaagtttgggagtctgaggtgggaggattgcttgagcctaggagtttgaggccagtctgagcaacatagtgagaccctgtctctacaataaataaaaggaaattgaggctgtaatgagctgtgattgtaccactgtactctagcccgagcaaaagtgaaaccctgtctcaaaaacaaaaatcttgacttgtgcaatagccacagttttcctggattctcaatagaaccctatggtgacatttgaaacacaaagctagaggtatgtgacttcaagatggtaagaaaaccatgaaacagacttgtcaagggatgtctgataaattgttggatatctggcctaggggcccagacaatagattttagatttgtaaacatcttaatatggagggttttgtgtgtgtgtgtatgtttgagacggagtctcgctgtgtcaccaggctggagtgcagaggcgccatcttggctcactgtaacctctacctcctgggttcaagtgattctcctgcgtcaacctcctaagtagctgggataacaggcacgcaccaccacgcctggatgattttttgtaattttagtaaagatggggtttcatcatgttggccaggctagtctggaactcctgacctcagatgatccgcccacctcggcctccc

SEQ ID NO: 15910 - DNA, 8961 bp, Human
gtccagtggagaatgccacctccagccactggggcgcctgggggcagggcggagacacagcgggcgtcccttcgccgctgcataggagggcgaccgctgggcagcgggtgttggcgcggtatccccgccctgcccagcatctgccccacgtttcttcaggctaaactaccgggatcccgggcttcttcctaaagtaaaactcgctccggaaaggccaacagtccagcggccagacgggcacctgggaacgcgggcctaacgcgtactggagacggagtggcgcccggcactgcgcgcctcctccccgccgggagactgcgtgctaagctcagcaaagccccgctgtggagacggagccatgtcgcccattacctaatgaaactgagaagggagactcagtctctcttctagccccgagcgcaagctctgctggacttggcatcgtccgccctccacgatcccacactccgggttttccccattcccagctcggctgcaaccgagagacagacggaagaaactgccaatggaaggacgcaaagcgtcaactttgtgttcgcccgccactctcggccaatgtgcgctcgtgtctccggagtcccgccttccgtgtcgggcgcccccttttggcagcacagggacgaaccctacgtctcgccatcttgtgtgtggcacaggtaaatttctggactatctttccacctattctggtcctttttcccacacaaccgatttcttagttcgacagctaagtgcggtggcgataaggccagcgtagcctgttgttctcggatcgcccacgtgagctagatcgctacgtcacgccacgcttgccgagcccggcgccatcttgagtgtggcgttttgatgctcccctttctcggggctccgcatggttctctaaatggtcccccaaatttcaggtagtccccaaagattagcccaactggctccagagacgatgatttttcccgaggaactctgtaatgttcatgtgcccatcgcagtccagcagtggggtgggagaagggtagactcgatggcccggcaggcccctggaggaggctgccctgaggctgtcgcgacggcagtgaccgctcgggacagaccctaactagaaacctagaatgaggggaccgctatgccgtgcggggcccgcgggctgtcccactcgagggctggagccggcatcgcgcatcgagtccgcttgatacatgaatccgtgtgtgcttgggacggtgcccgcttgtcgactgacttggccgacggacgccggacctgatggtgggcaatcgaggtcgcctgcccacaggactaggggtgccctgccctgggagggcgcgagggcatggcagagggacggggcggcccaggtgcccgggtctcggcctcgtgacctcgttgctcgtcgtggggctgccgtccacttgcactgggacaatccttggtccaaggcgcccaggcgcggggggcgggcacctccgcgggcactgcgctgggcaccgcccggggcgagcgcggcccagcaccccgccttcccctcccccgcgctggcagccgtcgtgtgcccgccgccccctcttccctccccctccttccgagcagccgcggggagggcgggagagggagggaagggggttgggcgggcagctttgccgcgctttggctttctgcgtcagcagccccagcaaaacagctgcgggagcgcgcgtccggaacgcgctcgcgcacccctcccccgcgccctcggccctgctgagacccggcaaactccggccttgaatgacagtgcgatcggcgactgcgcagcgcgggacgcgccggggcactgccgctttaagcacgcttgtccattgttcggaatcgagccaatgagcgagcgcccgctccctgcgctcagccaatagcggccgggcatgggaagccgagcgccgcccactaatctatattaaagcttctggcgccgcgtgagtcccccactggctgctctgaaaagccatctttgcattgttcctcatccgcctccttgctcgccgcagccgcctccgccgcgcgcctcctccgccgccgcggactccggcagctttatcgccagagtccctgaactctcgctttctttttaatcccctgcatcggatcaccggcgtgccccaccatgtcagacgcagccgtagacaccagctccgaaatcaccaccaaggtgaggctggacgccgcccgccccctcggggtccgcgcgccgccgctcgggcggtgtttggcgcgcagcagctggactgtctcaagcccgctgttgctccctctcgcggggaaacggcccgcccccggcgcggtgccctcaggcagcccactctttgtgtggtgcgggggagggggcgggaaccgccgcgggcagacgtgatgcccgtcggggagtgggccgggcgccctcgggggccgagggctaggcgcggaggccggctcacggccctcgaaactcgtctgtggccggtatgagtggcggcgggaggagaagagcctggctgggggtcgtcggcccgccgggcgcacggaaataactttgaaactcaagcgcgttgggaatcggaagtgctggggggcgcgtgttggggcgcgggccggccgcgggaagtggcggcgagcgcccgccggccgcgctgctctttgttcggcgccaggccggcggtttcgcgccctgcagcggacctgaggtggtttgtctagactaagtcccgataaggcggatggggcgacgggctggctggccgcgacgtcggccgtcccggcggaggtgtgacgggcttatccgctttgggcgctctgggaggcgggggtgggcgcccttcgaggtgagtgcgccgggagcggccgcccagcttcagtcatgcacccgcggtgccgggcttggctgaggaggcgagagcccacgcgccgcagggaggaaagagaaagtgaagcgcggcgctggggcgacgatgggcgccccccgcggctgcccgggagcaccgtgtgcgccgcagctcggggcgacgcgggccaacacggcggccgcgacaggccaatggtagggtcgaactgggggggcgcccgggccccgtggcgggttcactgccctcggctatgaggtcctgcgcggctggtgcggctccgctcctgttgtcggcgccgcctcggtcccactgcccgccctgggtagcgtctccgcccttggcgggagcggggcgctctcagactgactggctttttcttaatatttcggccctcgtccgcgcccgtcgtgcccctgcagggattggcgcgagtcaccttggcgtctccttaacccttgtgtccctggcgtcatctctgactctcccaggggcgacttcttggcagagcggagctcggggcccggatctccacaggggctctcagtgaccccttctggactcagtccgggaatgagtttgtggggtgagaacaccgtccccagtgcggggcctggctgttcgattttctccgaagcaccaaaaggtgacttcccgcgagggcgatgagtagtagcccgagaggcgcatccccgacagtctcggacctacgcagcccggtggactttggggcgacctcccgtgggacttggcccgccgaatgcagacattcgggcctgccggggtggcggcagtggggcgtcgagtcgagagcccggccgaccgacgcgcgacccgcgcgcgtgccactgcaagctctgcctgccggccgggagtctccaaggcaagggacgcactcggcggccccgggccacgtgctccctgcgcgcggtgcgtgccgaggcccgcgcgcaaagcccgccgggcgggggatgcgcgcctgcgcgccgcgacctccctgcccccactgctccccggggcttcggccgccagggggcgagagcgggcggagccggggtccgcggagcggagcggggcgggccggactgagagggccgacaggtggcccggagccgctcgccggacagcggccgaggggttcccgcaggcccggacgccggacctctgttggtattggtggccgtgtcgtgtggaaaaagttaccgggcgcccggggccgcgctgccttttggatcccgggcggagtcccacccccgaggtgctgtcgggatccctagccgccgcggggaggccgggagttggtggctccggcggcaggccccggcctggggcaccgccaagcagcggtttgcggcctctaggaacagcggtcggatttggggggtcggtgtgctttggcttttttagatacctgtcctggccggggcggtgcggcctcgcgggccttccaggctggcgcgcctgtggggctctccccgagcgcaggcccctctctctttgccttatttatttttggaacataacctgccgcctttctagacggctcgaggggcgggctctttgcacttggaagcaggctgatgggcgtgagtgtccggggctcgtccacccggccggacgggctgggggctgtggcgccacatggctcctttttcctgggaagcgccagggggcagtgggaaccgccaccggggccgctgtagcgggccttaaaggatgggaaaccttgatcacagatgccccccgccggccttccttccaccagaccagtgggagagggaccgcaggggcatcaggcctttctcaacatgcgactcttaatttgggacggacagaacagccgtacagaccagtagttctcagcgcctttgcttaccctgggttgctcagaagacttactggttactggttccttcttcccttttgaaggacttaaaggagaagaaggaagttgtggaagaggcagaaaatggaagagacgcccctgctaacgggaatgctgtgagtgtctgctttgctcctgagccctggcagctaccgccccacaaaatttttcctgttctactttaaacatacctatatatgtgtgtgtatgtgtatatgtatagctttgcacagtggcagtatcgtagccaatgagctttacccgaggcgcgattattgctagttaaatatttataaaaacctttcgagcagcgcctgaacaagaataggttcagaggagactccggtagtctgagtttgggcttggcccagggtggggaaaagcccttgtcctggggcagttaatgtgcaggtttcatgatggagcctggagggtgttgactggagaagggtctctggggtgggcttggcttggctgggctgtagatgcagccgccagcctctggtgggaggccgggcatcaggagcaacgctctgtccagcctggggccagctggtaatgacatggcctgttttctgtcgaggagaatgaggaaaatggggagcaggaggctgacaatgaggtagacgaagaagaggaagaaggtggggaggaagaggaggaggaagaagaaggtgatggtgagtagccttgtctatcttccccttttcaggtactttttcctggccttgtctggcagaaggggaaggaaggaattggggctcctgggagtgggacaatggtacttggggccagtggaccacatggccctgggcacccacctgtagagtcagggaaggtctccctgacatggagttgtgcccatgcccactcacactcactcgcacacctgaaagtttctttcgtgcagctctgaaagccactgatctattgggctggccttttggggtgcagctgcttgggcctctctcctctggagagtcccacctgtgtagtgggcgtgggtgccctgattgggcccagttgcaggcagtagaggcagggcagggaccttgcagtccactacatgttcctcgggatttccccaggagccacagtaggagggaagtgtggtttacctggcctttgattctctccaggtgaggaagaggatggagatgaagatgaggaagctgagtcagctacgggcaagcgggcagctgaagatgatgaggtgggttctggcttgagaagaaggggggtttggcatctgggtctccccacctgcctttagctgaggtgctcaagctgcggagggactgtttctgactttgtaggtggccactgtgtggtcctgaatcttaagaacaggaaggaaacagggctgggctcaacttcccagaggccttgggctgtggagctgggggtccctggttcttgctctgccagcaggagctgaggcagtgggctggatagggctcctggggttggaggggcctttgacagtctttctctgcttaggatgacgatgtcgataccaagaagcagaagaccgacgaggatgactagacagcaaaaaaggaaaagttaaactaaaaaaaaaaaggccgccgtgacctattcaccctccacttcccgtctcagaatctaaacgtggtcaccttcgagtagagaggcccgcccgcccaccgtgggcagtgccacccgcagatgacacgcgctctccaccacccaacccaaaccatgagaatttgcaacaggggaggaaaaaagaaccaaaacttccaaggccctgctttttttcttaaaagtactttaaaaaggaaatttgtttgtattttttatttacattttatatttttgtacatattgttagggtcagccatttttaatgatctcggatgaccaaaccagccttcggagcgttctctgtcctacttctgactttacttgtggtgtgaccatgttcattataatctcaaaggagaaaaaaaaccttgtaaaaaaagcaaaaatgacaacagaaaaacaatcttattccgagcattccagtaacttttttgtgtatgtacttagctgtactataagtagttggtttgtatgagatggttaaaaaggccaaagataaaaggtttctttttttttccttttttgtctatgaagttgctgtttattttttttggcctgtttgatgtatgtgtgaaacaatgttgtccaacaataaacaggaattttattttgctgagttgttctaacaaagctgtctcaagcctggtttttctgtttcagtttcttcagaccttccagggcacaaggataggagggggaggatcctggggacagtgggttgacattttgggaggcagttggatgtgtcctgtgatgggcagcagagtctggtgggtgggcagggactgagctgcagttggctgggggggctgctcactggggcagtcagtgattgccccaagaagccttaactggggaggaggacttcatcactgggtgccacatggggaccctggtgccctgggggtgggggtttgcagtcctagacactggaaacgggccacacgggactgccattatgtggagcgcagggtgctggtggtataggccaagagggaacttgccaagcctcccaggatgagcgtccaagtggtggctgcctctgcaggcctcacaggtttagctccatgacgtggctccccctgctggtggcacgtggtaccccccggcctcttagaatgccggggttttggtttggcactggtgcagcctggcagtcatccaacctttggtctccaggtcccttaggttagttgggcaggcccaccctgccccttgaacacagttggagaagttactgtgccgtttggatattcatacacgggctgtgagcagtgggtcaggatagccaactggaggaagtgccaccagctcgtgccctcagaggtggaggtaaggattagagctcacctagaaccttctgggatcctccaatgagagctgcaggggcaggggccggtataggcactgctagtgggcctgttgcccaggtaggacctgaggaagccatccagtggtatctgcaggaaaactcccaggagcagactgaagtgtctgcagaggcctggcctgggttaaggggagatgctgggaaggagggaaatgtgtgcattgaagagagcaagagagaccagttccctctacctgccccttgacaccgtgtccaccccattccatgcccccccgacctttgtgtttcacaccaggcaccagagttctggggggacctttcccttctctggctggagcttagtcactctcatggggctgctcaggccgcttgttcagcatgtccccaggcagctgccaccaggatcgggggcaggttgaggccttggtaggagggaccctctgacctgtatctaccccacaccccctgcacagcctgggtatctgcatcctggctcatccagggaagaaagggagggtctggagccaaaacgctggctcctctctgttctgccgcccaaggcgactcagtactgcagtgttcccaagctcggcgcccaggagggtgtctctaaggcaggagtgcaggcgaaggccgtgaaggaaggccacacagggcaggtagcgcttggagctgagagcagatctaacccagctccctcaggctgcagtcctgctcgggaccactaccgcaaggcccctgaaaggggagaagctgtgccctggtccgcacacagacacggcaggcatgttagcatgaggcaagtaactgaaccttgtgggcttcaatcccctcctctgcaaaatgggaacaataggatgaggcatgagccagggcccagggctgccttgctagggtccccctgagacacccatatcagcagagcttactgcctctgctgtctgagctgcctcatcccaccaaaggtttggcctggaacagcatttgctggttctagcagaacacacttacccctagtcctgagcctagcacacaattaaccactgcctgaggatatacctcagggcccagagtcaccttgataccactcccaaagtccccgaatgacctcccactggagcccaggttaaaagattatcaaggaatgggcgccccctggtggacacagaggaactgtaaagcgtgccgctgaattctgtccaggaaagacccttcagtgggccctggtcccaaggtaggcaacgccagtc

SEQ ID NO: 15911 - DNA, 13489 bp, Human
atatagctggggatgtcaaggctgcagtgagccatgatcctgccactgcactccagcctgggtgacagagtgagattctgtctcaaaaaaaagaaactgggatgacacagcagtgtcttcacttatatcctacgcctccactgctagctatgcgaccctggacaagttaatttacctctatgtcccagtttctgtaaaacagtggtaactttttggaaaggttattttgaagagtaagttaattaatatgtaaagagctggaagagcgcctggcactgaatcagcattatgaagtgttagatattgctattttgctgccccagaccaactccaaagcaacgccacttgagccatgccggctctccctgctgctgcttctacctaaatacttcattcatttaacaaataattttattttctttcttttttttttttttttgagatggggtttcgctcttgttcctcaggctggagttcaatgacgcgatctcggctcactgcaacctccgcctcctgggctcaagcgatcctctcacctcagcctcccgagtagctgggactccaggcgagcgccaccatgcccgctaattattttttgtgtggagacagggtcgcattatattacccaggccggtctcaagttcctggactcaagcgatcctcctgcatcagcctcccaaagtactgggattacaggcatgagccatcgcacccggccttaacaaatgcttttctttctgagacggagtctcgctctgtcgcccaggctggagtgcagtgggcgatctcggctcactgcaacctccgcctccccggttcatgcgcctcggcctcccaaaatgctgggattgcggatctgagccaccgcgcccggcctgaggtgatttttaacaagtacagccgtagctgcagatatcctggttctgtaggaacaatgaggtatggatggatccatagctggacctatggatgggatggatccccggcaggccctggacggagggaaatgctctggtttgctaagcccggcatcgagtgagacccacccacaaagctaaccgtggaagtcactggcggcctccttcgccctgccgccggggaaccctgccggtggctctcgacctgctcccgggccatctggtgacactgacttcgcagccaccaccttaattggcgcattcgacccaaataataaccagggaacctgtgggcggtcaaaggcccggctctgcggtcggccctcccaggcccctctccctgccctgtgaggccagaaagttacttctccgaggccgttccccatgtcgagaaatatctcccgcttgaggttctgtggggtaggggaggttcgtgcatttctcacagaaaacctcgcacagacccgcgactgcctttattaacagctctcaggagactgcctgcagccggggggtgcctccggccccatgctcgcgggcaagcagggataagctgtgcctccaaaagggccaacgggaactccgcggtccctgaacttccggtgctggcggactcctcgctccagggccaccaggagccgcggcgtgagtgcgtgccgggaccgagcgcggggtctctgaggaactccaaggctgcccgagcctacggacccagccacattggcgaaccggagaccgcccgattccaccacccccgcgctcccctcacagccggcgccaaaaacgccagtcccacgacgcaggccgggacccgcgcgcccacggcccaatcagcgcggaccttgcacaaagcgagccccgcccccacggcgccgttgccagcccctccccctcccgtggccgcctcggcccgcctactccccgccccgcgccgttcacggttagaggctcgcgattggctcatggggacggccgcgagctttggttggtcggcgcggagtcacgagggcgccgtcgtcgcctttccacaggcgattactgggcaggctcagtctttcgcctcagtctcgagctctcgctggccttcgggtgtacgtgctccgggatcttcagcacccgcggccgccatcgccgtcgcttggcttcttctggactcatctgcgccacttgtccgcttcacactccgccgccatcatggtgaagctcgcgaaggtaaacggccttgagcgcgagcgcagacgtgtaggcctgctttccgaggggcgagcgcggcgccgcggggaggagggcctgcgcgcagtcccgggcgcgttctagggcgccatgctgcgggaagtctcgcgcgattagtggggaggtctcgcgcttctggctacttggtggcgaggtgaagagcttctgcaggtgctgggggagggggcgctgggcctcggggtggagagatgagaccaaacttttgcgacgcgtacgagctgggactgactctgacgcacgtgcccgggagcgtgcctgccacgtgggccggcgtaggtctggaatctccagagggaccgggtgccttgggccgggaaatggcggtatcggccctagtcggagtcccggctgcgctcggatgtctccgccccggcctggcaagccgatacgtggtgggccccggaaggtggctctgccgcgtgccttttgcgctgtgtttcgggcaagaggtggtcctgccaggtacccccacgtggccgcacccgcctctttaaggggcggggtagtgctggggaaaggcataagcttcatgagaaaataaggtagtatttttaagtgccttaatgatcttcaccgttaatttgattcaaataagggtggtagataaagtaccgggatttgtagtataaaaacacggttgtgcttaactaaggtaacgggaggagaaatcatttcctcaggttgactttttaccttagggcaggttttctgttggtaaagcctgggaggaaaaatgtgggcggttgagaagtagtccctcttgcattgccatcaggagtagtttctatgttagttgtggtgtttggcactatgagaaatggatctgaggacggagatgatggcgtatgaacactaatggcaaaatatgaatggcctgaaatgtcgaggtggaggtgtaatgatctatttgtgtccattttaggcaggtaaaaatcaaggtgaccccaagaaaatggctcctcctccaaaggaggtagaagaagatagtgaagatgaggaaatgtcagaagatgaagaagatgatagcagtggagaagaggtaattttatccaacttaatgcagaattatgttaaaactacaaaatggagagttaagacatgaaattggatatctgtggcaaaaataagattttattcaggtatgtcttattgtagtggttgagtgtttcacaagctcttcattgacatgtcaagatgtcatttggctaagtatttgaatgtgagtgtaagacgagatctggggatttcttttacatgtgcctctgcagggcttggagtgtgatttgttgtgttaaatcattacatttttccagtttcaacatgttagcctcacccccacatgtattcagatcctgaggataaccttaccagattcctttcctagcctccaattaaaattaattggtctccattccattatatataaactttgtaatactactcactgtgttttatagttatctctggtgtagactgagggctgccacctctctttgtgttaccattgaccctctttagcactcctggccttttatttgctcactataaagacagctgagcactgaattgtgctcaggtttctcgttgagaactgaatgaaagttttactcttccacacattgcctgataaaactacgggattttaatgtagctaaatgatgacttttatcaaactaccatgcacactctttgatgtgtgatagttttgtaaggaatatttatatttagcctattcattttttgtctcaggtcctaagaattgagcttcactgggcttggtaccgccacccactgtaggagccccaaatgatttaataagttaatgcttggagcctcctatgtgtaaggttctgaataatttacacatagcaattcatgatccttaaacatgtaaggatgatactattaccattttcagatgagaaagttggggcttgggaaagtatgaggtgtaagaattcagagggtctggttcagaggtatttttaagtgttcaaaagagttccttatgtctgggtattcaccttatgataggggctctgacttaagacaacataacagaagcctggagtttaacatgctaatgtgtctagtgcatgtggtcttgaaccagaggcattgccagagtctaacaactcattgggaccatggttatctttttgggtgtggggctggacttactggtttggttttcatttattctcaaggtcgtcatacctcagaagaaaggcaagaaggctgctgcaacctcagcaaagaaggtggtcgtttccccaacaaaaaaggttgcagttgccacaccagccaagaaagcagctgtcactccaggcaaaaaggcagcagcaacacctgccaagaagacagttacaccagccaaagcagttaccacacctggcaagaagggagccacaccaggcaaagcattggtagcaactcctggtaagaagggtgctgccatcccagccaagggggcaaagaatggcaagaatgccaagaaggaagacagtgatgaagaggaggatgatgacagtgaggaggatgaggaggatgacgaggacgaggatgaggatgaagatgaaattgaaccagcagcgatgaaagcagcagctgctgcccctgcctcagaggatgaggacgatgaggatgacgaagatgatgaggatgacgatgacgatgaggaagatggtaaggagttgtcttggtagttactgggcttctgattacaaggtatcttgagattctgggatcaacatattccttccacgacaacctggagatgagattagaatccttgtgggaattctctgggttgttgtggtgtgctagacttaattacccatgaatgatttttgtgcctcttgagaaaatttcaatagcacattctattagtgttttttataatgtaggattttgtttctaagtgattttttttttttttaaatttttttgagatggagcttttgctgtttcccaggctggagtgcaatggcgcgctatctcggctcactgcagcctccatctcctgggttcaagcagttctgcctcagcctcccgagtagctgggattacaggtgcccaccaccacaccctactaatttttgtatttttagtagagacgacatttcaccatgttggccaggctggtctcgaacttttgacctcaggtgatccacccaccttggtctcccaaagtgctaggattacaggcgtgagccactgcgcccggccccaagtgatctattcgtgccatgactgttaactaaacatggtgacaggattgcattttctttacattagatttgaaaaccgatgttggttttgggagattgctgcaatttttaggtgacttctctttcagactctgaagaagaagctatggagactacaccagccaaaggaaagaaagctgcaaaagttgttcctgtgaaagccaagaacgtggctgaggatgaagatgaagaagaggatgatgaggacgaggatgacgacgacgacgaagatgatgaagatgatgatgatgaagatgatgaggaggaggaagaagaggaggaggaaggtacttaaattagattctgacatacgacatgagttatgtttaaaggaggcacttaagtgtttgtggctactgatgtgtgatacattgtttgacatcttgtccagagcctgtcaaagaagcacctggaaaacgaaagaaggaaatggccaaacagaaagcagctcctgaagccaagaaacagaaagtggaaggtaacttgcagaattaggggatatgggggagataaacagcacaaatgatgaataacaaagggacttaatactgaaacctgatgttacattgtagtgtgctgatgtgctgtgtatagaaattttgctttggaaactaactttttaccacactacaagtagactgagttgagctttttttgtgcaggcacagaaccgactacggctttcaatctctttgttggaaacctaaactttaacaaatctgctcctgaattaaaaactggtatcagcgatgtttttgctaaaaatgatcttgctgttgtggatgtcagaattggtatgactaggtaagtgcttcactgcacgttacatacacgtgggtctgttaatgcttttccttcccctgttagcacagttactttagcctgccactgttaaacatgaatactgtaaacatcttcaaggattagcattagtgaactaagttagaattaaactgtagatcccctaagttgcaatttccataatcagtcgtaacttggtatagcacagaataatttttagttaagtttttttgttgtttttgttatgtattgagacggacgctggcttttgctcaggctggagtacagtggcgcaatcttggctcactgcaacctctgcctcccgggttcaagcgattctcctgcctaagcctcccgagtagctgggattacgggtgcacttcaccatgcctggctaatttttgtatttttagttgagatggcatttcaccatgttggtcaggctggttttgaactcctgacctcaagtgatccacccacctcggcctctcgaagtgctgggattacaggcgtgagccaccctgccagtaagttttaataatttggtgttaggtgggagaatcgcttgaacctgggaggcagaggttgcagtgagccaagttcgcgccactgtactccagcctgggcaacagattgagacaccgtctcaatttaaaataatgtttattttcttggaagtacctgaaactattagacctgtctagtcatcatagtgaatacttttatccagacaggattctcctgtattagtgcttataggtgttcttttgtcagctgctactgtgaattcttataagcaatttagctccatgatgaagacctcaaacgtgaatgtgcatgtcatatcttcatgctgagaccttgttctgtagctgcagtttgcagagccttgactttgttttgctaatactaggggtgctttttaaaatgtgatctttgtttgcaccatcacatttgtctagaatacatattgtggattttgatttgtgttttcacctgttgtaattttgccctcctctccaccttgaaggaaatttggttatgtggattttgaatctgctgaagacctggagaaagcgttggaactcactggtttgaaagtctttggcaatgaaattaaactagagaaaccaaaaggaaaagacagtaagaaaggtatgtaaggctttatgagattatgcaatgaactcaggagctagactgctagggaaaatgctttgtaacccatttcccttggtttcctcttatttttttaaatcatttttttcctttggtttcctcttaatgtgggaattaaatgagctacagtgtttacaagagtacttggcactgcttgtcagtgttatagtgtaaattcctgagttaggcaagcaagagcacttttatacagaacaagaattattagatgcacctaaattaacgtaaagggatctttcttcactgaaactagattaggtccctaattactccctatatacagttgtaatgttttgaattggtacattcactttttttgttatgcgcgtctactctaggttgaactccagtgtacctaacagagagtttgacatcagctgtgacaacatggagggaccacttgtgtgttgacactgctatatctccatatttagcaccgagccttgtacattataggatctcaaattatttgttgaatagagctatgtgtgtttttcccctctttttgttgttgccccccacctttggtttttcaggccacagagctcatttttgtttttttaatctagagcgagatgcgagaacacttttggctaaaaatctcccttacaaagtcactcaggatgaattgaaagaagtgtttgaagatgctgcggagatcagattagtcagcaaggatgggaaaagtaaagggtatgttctgtctattgaaatgtaagggttttattaacattaatgcactttcctgctttataaaagaaatattggtttgatttccttaggcgtgtaatcttggacagtttaacctgtaagtttgtgcctcagtaacccatctgtaccatggggataatgtactcatagggtgattttaaaagacaagctaatacttataaagaagcaagaaatgtgcctatcttacaataaatactttgtaagtagtagcagttctttcagtgaggtgaggttactatgaaaaaattccaagtatttgtaaaactagtgggaagtaagagggaagctcgagttttgattgaaaagtggcataaaactaagggcatttattgtactcagatctgaagcaagttctgtgttgctgaggtaaaagcatttgtgttaatatggttttaaaaaccatgagttcttctccctccattgcaggattgcttatattgaatttaagacagaagctgatgcagagaaaacctttgaagaaaagcagggaacagagatcgatgggcgatctatttccctgtactatactggagagaaaggtcaaaatcaagactatagaggtggaaagaatagcacttggagtggtaagaaattaggcttgttacaaggtttcagaattggtggagggaactcctttgtgtctttgtatttcataagtttataaatactttttaatcaaagttactcaaatgtaggtgaagatcaaggacatgataccccaagtcatactcttatttggaatagtaatttccaatcttgaatgagagctctaaaatcattttgcattggaatacagtaggcaaatcaagcttcctttgtaggcatgttttatactttaaatgacttgaccatgtgcgttttgaactcagatgattctaggaaaacagaccagtcatcagcctatgtaagaacaaccagcaggacattgcaacacgtactaggtacttaatatgttgagtaacagaaatggatttagcttacatcatgagtatttgtatattaactcaagcactgaaattcttaggaataagatattactgttgtgaccgaagctgggaaccactgtttcagagtcttaggaatgtggcatctctatttgcaggtgaatcaaaaactctggttttaagcaacctctcctacagtgcaacagaagaaactcttcaggaagtatttgagaaagcaacttttatcaaagtaccccagaaccaaaatggcaaatctaaagggtaagataatacctttgtatcatcagttataggctatatatgtcttagaggtctaaaggaacgtaaggtcatgtgatcctgtcagaaaagccaaataattttagctacgtaaatgagtgtaaaataaagatcatcatttaggtaccaacttgagagaaggggcttggcagcatcatgtgacagtgaaggagcatgtgcctggtaacttactctaagcattaactgttcatcctcaggtatgcatttatagagtttgcttcattcgaagacgctaaagaagctttaaattcctgtaataaaagggaaattgagggcagagcaatcaggctggagttgcaaggacccaggggatcacctaatgccagaagccgtaagttcacctggttagggtgctgtggttgggggtagcactctcggtgctttgtttattttttgcacaaattctgtgtttcctgttgctactgagtgaacaataactggatatgatgactgattacctgagaaataattgatgaaatctcaagaaaattcctctagatagtcaagttctgatccagctgtgtcaactcagagtagcaagtttgcccatgatttcctgccccatccactgggccccacctgcttgggttgcttctcccactttccatagaagatctggggcaggatatcaactatgcaatggcaattaaaaaatgtaaacccagaatagcctttactttaattaaggactagttggcttagttgcttttaactgctttttcactataacaagtattcttggctagtagtcatactaggcattgtgcaaattcagtgttacgaactgtgacttcacataaagtcacatttttttttccttcccagagccatccaaaactctgtttgtcaaaggcctgtctgaggataccactgaagagacattaaaggagtcatttgacggctccgttcgggcaaggatagttactgaccgggaaactgggtcctccaaagggtaagggaaggaagcgtgagtgctgcttccacttgaaggggtttttgttctgtgcagaccttgagtctaatgtgtcttctcattgagctcctttctgtctatcagtggcagtttatggattcgcacgagaagaagagagcattcacagaactagcattattttaccttctgtctttacagaggtatatttagctgtattgtgagacattctggggttcaagctgtcacaccagttagttttccatagagagctactctgtcactggtatcttttcccaaataaacaaggctactttctgtgggatggctccccagcatgtacagttaacttgggacatgtgtagtaggtgctttttataatgggcaatttcatttggtgttctaggtttggttttgtagacttcaacagtgaggaggatgccaaagctgccaaggaggccatggaagacggtgaaattgatggaaataaagttaccttggactgggccaaacctaagggtgaaggtggcttcgggggtcgtggtggaggcagaggcggctttggaggacgaggtggtggtagaggaggccgaggaggatttggtggcagaggccggggaggctttggaggtaaggcacgcagagataatgacaccacatagcatgtgctcttcagaccctgtgccctgtcacggttcctaatcactggggaggaggagctttgtacccattcttttaacagtgtcttgccttcctcctgtagggcgaggaggcttccgaggaggcagaggaggaggaggtgaccacaagccacaaggaaagaagacgaagtttgaatagcttctgtccctctgctttcccttttccatttgaaagaaaggactctggggtttttactgttacctgatcaatgacagagccttctgaggacattccaagacagtatacagtcctgtggtctccttggaaatccgtctagttaacatttcaagggcaataccgtgttggttttgactggatattcatataaactttttaaagagttgagtgatagagctaacccttatctgtaagttttgaatttatattgtttcatcccatgtacaaaaccattttttcctacaaatagtttgggttttgttgttgtttcttttttttgttttgttttttttttttttttttttgcgttcgtggggttgtaaaagaaaagaaagcagaatgttttatcatggtttttgcttcagcggctttaggacaaattaaaagtcaactctggtgccagacgtgttacttcctaaagagtgtttcccctggaatgtcactggagagcatggcaaagccagctctgccacttgcttcacccatcccaatggaaatggcttagtgcgtgtttccagtatcccagccctaactaacttggttgaaatgctggtgaggggacctgctcctgcagccctggtgctgacttgaaggctgctgcagcttctcctacttttagcaggtctgaggattatgtcctgaagaccactctggaaagaggtgcaggaacagattagtcaggtttcctaggacaaggaagagcttcagggaagagcagtggctaactcctgtaatcccaacacttggggaggccgaggcaggcagatcaactgaggtcaggagttgaagaccagcctggccaacatggtgaaagcccatctctactaaaaatacaaaaattagctgggcatggtggtgtactcctgtagtcccagctactcaggaggctgaagcgggagagtcacgtgaacccgggaagcagagtgagctgagcacacactactatactccaggctgggtaacaaagcgagactcccatctcccaaaaagcagttctggaatagaactcacgctagatggatagaccagtggacactttggaaccttggggctggggaggaaactgcccatccagtaaacccccaaaaagccatttgttctgcactacgtatattgcttattctttctggtcttaagtacttgcctctcaacctccctttttagtaaaagacaaggccacgtgagaggcgggactatcaacattgtgatgaatttacttgaaacccagtgcccaaaatcaatgtaggtagccaagtccaaaaacctgttctagtccaactagtgaaatcaaactgtgatacttggataagcttagaaggaaacgtgaagaatacgtagctgctttgggtttactctggttcagttgggctgttgaaatcttaacatccttgggcttatcacctactgcttgtcagccctgttccatgtccaggggatgggggtggtgacaatccagttccaagaccctcatgctctagagaggaaggtggccagccagggttgtaactacgatgaaaaagcagtgggagggtctcctatgaggcaagcctaaggacaaaaaggaaggccttgcagcctgtattctggataaggaattaaaagctcagttaattgaagcccatcaggcgtgttgtggattaggtctgttagctcttaaattgcagcaaaacacatagtatgaacataagtatgaatttatctccagtggctttcaagaaagatcccgtgaggccgggcaccgtgggtcatacctgtaatcccaacaccttgggaagcctgggtgtggagatggcttgagaccagcctagacaacagtgagactcccatctctacaagaaaaattaggtggccgtgatggcataagcctgcagttctcaggaagctgaggtgggaggattgcttgagcccgacactgcactccagcctgggtgacaaacagcttgaaaaaccttgtgacttggtgtctaggtcttctggaatctatgaaatgatgcctccagggctctcctcggttccctgcagccttcatccaggtgagaatgtgctgcagctggtttctttgggaggcctgtgggttaaagtaagcgatagtctatatgccgtgtggccatctacgaataagggctgggattgctggtggctctggtgcagcacagtcactgctttttccatacttggagagcctatgggagtgcgattttgatagggcttgaattgcaggaagagcccatggctcccaaggtg

SEQ ID NO: 15912 - DNA, 4825 bp, Human
gttccagatggtaacatccttctttgcacagcaggcaaaaagcagagggaactttcacagcccacctggatacccctccctatactgctttctagttcctcttcctttctcctcaaatgaaagagtggtgccactctatgggtgttagcacggagaggaattggggggctgcgtggaggtggtgactcaattcaccagaatccacagaaggtgccctgttgatgtctggatcttcctggagatcaggaaactttgctgccccaaactcagacctcaggtgttagctgtttcctaagcaaagtgacctgtgtagtggttgctccaatgttgtgagtcagggtatgagagtgggaaggggtagcctgagaaaggtgccgacagagcagaccatgatgcggccgccttagcagctctgggaccaggctcactaccacggagggaagagggaggcttggagggaacctggttctccaagcccctcttcactccagttgccttcctgcctcaggcacagcttcctctccctggaaaatctcgtctgggctactgtctccccagaatcgccttcacgcctggggacagccactgcactcctgcggcaacatttgttctctctccagcctgcgtcctgctcagcagcagccagtcatagattcctgctcttcaatcaattcgggggatctgggctctccgcctctgcggcccacaccgcagtgcccaaatgcccaccacactccttagtgtccaagggaccgagaagcccagtgcaaggagagcaagttcgtgagtggtagggatatgtggccatgtcccgagagccacggggacctctctacagtcaaaaacgggaagttgaccacctgtcacggctggcagaggctggactgggccgctggctaggaagctctctccccagcctgtgaaagtgcacaggatactggagcgggcttcccccagcagcggatcctcgcgtgggtgcaggcaaggtcaggtgcgcattgttcccacagagggagttcaccagcggagtcagaccccgggacgttctgtgtggccgaaaccggctgaacgtgaacctagagcagtaactggcgagcatacgatgccgcggagcacacgcatgagcatgaatatcttggttccgcgctcgcagtcccctcgttcccgccttgcgctcaaacactcaggctggcgacacccctgcactctccagtgtggaagacttgcgctcccccctgcggcccaggcgaaccccgctctccctgcgcctcccaccccagtcctccaaccccatcctctgcctccccaacctaacgacgtcgctgtggtctgcgctcccgccctgaccggcaggtgaaaggcggagctgcaatgccatcccgcggctgtcaggtgcccagggaagagtttggcgacaagcagggctgcgtggatttcgggcagcgccaactttctgcctgtatgactttgggcaagtgacttcattcctctgagcctgtctttgcacctgcaaagagggctacgtatcccttccaggtagagtgagtgcgatgaggacctagtgggtgcacagggcaccaggcgcaccgatgctcggcaggccagggcgcgcgctcgctgcaaatggagttcccctgtgcgctcagctctgcagctccaagtgcagcctggagcgagcccgccgagccgcgggatccctccggggtgggataagggaggggagcccccgcggccccctcccggccctcggcgcggccgcgtgcgtggtgtcattggcccgggcggcccggtgggcgggaggatgacatcagcggcaggttggattataaaggcgcgagcagagtcacgggctcagagcgcacccagccggcgccgcgcagcactgggaccctgctcgccctgcagcccagccagcctgctccgcatccccctgctggtctgcccgccgacctgcgcgccctcgctgccgcccgtgtgcgcccctcgaccccagcggcaccatgcatctctcccagctgctggcctgcgccctgctgctcacgctgctctccctccggccctccgaagccaagcccggggcgccgccgaaggtgggtgctgtcgtggggacgccgagcctgggagaggcgtgggaggctgggggcttggagaatgcggcgcgcaggacccaggagagagggaaggcaggcggctgtctcctccgagatgcgcgtgggcgagagccggggagccctcgaagcgcggattcgggggtccacttctccagcctccggagaacatcggcccatgcgcagccccctaccccagtgtggcctgcccggcgagcagcaaagggagggcagggggcttccggagggagcggcgaaggcggccgcgtggcaggtggatgcggggccaagctggccggcatcggtgggggcggctctgggcttgggagggacaccccgcgccggcgggcgcgtggggctggagcatcagagtcccccgtgctgcagccgcgtgtcccttcacctgcccgctctttcctcggacaggtcccgcgaaccccgccggcagaggagctggccgagccgcaggctgcgggcggcggtcagaagaagggcgacaaggctcccgggggcgggggcgccaatctcaagggcgaccggtcgcgactgctccgggacctgcgcgtggacaccaagtcgcgggcagcgtgggctcgccttctgcaagagcaccccaacgcgcgcaaatacaaaggagccaacaagaagggcttgtccaagggctgcttcggcctcaagctggaccgaatcggctccatgagcggcctgggatgttagtgcggcgccccctggcggcggtgagtacggcccacccgacgcccagccccagcccggcccgggaccgcccgccgcccagccagccttcggaggcgcgcgagccgcctttgctcaagttgtgctaggcgtttgccagccgccccctttattatcccactttacagacaaagaaagcgaaggataacgtgatcggggaactttggcaaggtcagaaacggctcagcctggttgaacccacctggcttcttctggagaagcagaaacaggcttggtggtgtctcacccacccctgaaccgtagctgaactagcagcactggcccctattggccagctggtggggggattgagaggagatcatgggtttgtgggagcagagaaggaaggttacacccacaagtccaggggacatcgatcatctgctggccaccatgccccctgtagtgagagtagccctctgctggcactgtcagagcgcccttctgcctgggacactccgattcctgtcccttctctaaacccaggcagtgggcaaactggtctgtccagggtcctgaggcagctgcagcctggtggcttcgggggtgaatctcagtgcttgtggcactatttcagggaataggaaagacactaaagtaaatattatttgccccagcctcgaactcaacacgtcccagagtccctcaccaaccctgtcccgacccaaccggtgctctgggctccgtttctggtgtggggtctcaccccgcactagggctggaaacctctgccctaccgccaccccctgccgggtgccgcgtggtggtaatttactgctgcagagagcctcacctctcctctttccctcctctctattcctgccgcctgcccgtgcccactgaataacatcccagcctctgacattgacagtcatgtgcgttaggatcaggcttacctggctttctcgctttcttgcctccagctcagcagctgccactgcctgtcccacaccttgactgtcccatcccaggctacgggcaagctgctgtctcctccccagaaacccttgtcagtgtcggatcttctcccggagggaaacaagagcgcctgtccagcacactgtctcttttttacagtacagaacactttttcacagtttgtgaacccattcacctctccatattgaacagcttaagggcgaagtgctggcctaaggcactctaggacccactgcaccccgaacagactcgtggaaatatttgtcaatgaccagagaaaccagcacaccctggcccatggccactcccacctgcccgaggttttaaccagtgcccttcctctctttgcagccagacctcactcggctgtgggcctctccccagttctgcaaaggctgtagttgtctgtgatcttgactctcccctgcacagggagaagaatgattctgacacttggggaccagccttcagtagctacccttggaatgcctttgctctcttctctcctgtctaaacaacaaagagacggagtctgaggcctcaaattttcagtttgatttaagcatcaagttcaaactttagaacctgagcaaatgttagtgactctccattggttcgtacctggaatgcgcatccccacaggggctttgttcttgggcctggctgtctgtggtcaccaagtgatggccaaacgggtggtgaaagatgctgtgtaggaggaatccacattgttaagaattctcgacccctttgatcaggggggttcaataatctcctaccagctctcttagcatagatgaacacttaccgtcgacaccttcaacaccggcttacacccaacaccagctgttttattattatttgggaagggcggtgtggatttattatttgggattttttaaatgaaaaataaaaaccccaccctcactgccccccattcccagtgagagagcagaacatcattcctgcaggctcctggtgacgatgcccaggatatatcactgggcgtaaagagaaagacagct

SEQ ID NO: 15913 - DNA, 25278 bp, Human
ccacaatcccccaatctcgtcccaattcgaaaaaccgaggaggagggaataaactgagagataaagatccccccatcttgctctttccccgggaccccagccttggtcgcggcgccccactaaggaggacacaggctctggtgtgtgtggtgtgcgagaccccgagctcgaggccgagccaaggctgggcagaaagttgcaatcacgtgctgtcggagcccactggagcgcacagcccgctccccctgggacgcccaggcggaggacctgctgcgccctcccagggctcgggggactccagcattcacttgcacgcacaggcgaactctgattgaaagcccgggatgacaccgagtctggagaaagagggaccggggggtgggctggcggaattgcagagcgccggccacagctcccctccccgcgaacgtcgagcggagggcgggaggtgtaacctctgacctctggccgggtccacgccctgaggagggactggcaagctcttgttcgacaagttcaagctgccgagagagcttaaatagaattaatctcttagagatcggggatcatcgctccctcggcatgcgctctcccagcgccgcgcacagagcaaggcgcgagagagctcaggaatcgcgggaaggcaagcggaatggggagggggtaggggatgagggcctctcttcactattcctccgcccggagagcgggagcccgcaacgcccgccgaggacgagcggcgggagggaacgctctgccctccagccgccccggtgcagataatggaggcgacaagagattcgctcagcgtcggatgggccagctctgcttggggaagctggcggcatcctcccctcggctggtgcccaaacccactgcgcgaaggccgaaggaacgcggaacctccagaagaccccatcctcagccctgactttccgtagatatgtgcaaaatgagtaaattactcacctcgggccagatccaagttttacccaacagaaggggcaccggaccaagaatgaaccaactcacatggccatgtccggcgcgcacaatcacacgccagcacacagccacccaatttcttccgcgaatctatctggcactctggagagagggggaaaagcgttttgagaaagccccgtcacccctccccttccttcttgccgtgaaatatacgaattcatttttattacgagccgcaccgtcctcaccatcacgcacgcacagagccacactcccatattcacactttctaactcgtaagctccgacagcgcctgcattttctttgggagccgcttggaggttcattaatatcattagcatttaaccccctccctcttcccatcccctccccgcacatggctgacgtcagaccccgccaggagttgggggaaaagctaagtgggccagggacgccctattcccctccccgcggctgcctgtcagagcgcttctggagatattacaggggacccagcccgcagcgacaggcacaaagtcacggggtaatgaacttcggggacccttcgccgctgcgtgcgcggctctccccggaaacccggacctggccgcctcttccctcggaagatttcccagcaatctagttttcccactctgcgcttgggttccggcagcgcggagcccgtctgcctctgagactgcggtagtgttttccttctttccttgggagaccagcggtcggcagagattgcccacactctgcatgcctatgtagagggagagatcgaagactgagtgacaggaatggggaaaaagagggatttcgctccgtaggaaggccattttcgtgtctccatctctgtctttcaacatccctctcttgctgttcttccttcttcctcagtcttcctgtccatctctccatctgtctgtccatgtgtgtgtccatatcaagcagcattcccagcagctgcggttttgcaagagccgggaagaaacttaaggatgcttaaatttccactgttggacgaattctgagcgcccagggagcagcgcagcgcgcgactgacacccacctgtcccgcccaggagccttgcaggctggagggcggctggagagcggcggcgcccggcggcgaggcgggcgctgccggccgggactcgggcagcgcccaccaaccgctccgccccgggacagccagcatgagcaagccagccggatcaacaagtgggtacctctcgggccgccgtggggcctaggcgcgcagcctggggcgagcgagcggggaggctgggggaggtcctgcctggagcgctgcgaatctgagcccctgagagggattccagcgggcgtgtgcgttcggcccagacctgtagaccgtgagttggagcatttcgtggagaggggagagccgtttcgttgcctctggattgcttgatcccccctgtctggtgcggtgagaaggttacgacccgcgcagcccaccagtcggatgagttgtctccatttagccgccaggtgctggatgggggggccatgggggcgggaactgggccgcagctccaggcggtagcacaataacacactcgctcaaaactccgagctccagcgcgcaaaagcaactctgtgcaaagcggattttgaatggaatgctttgcaccccgtttctagctatttcaaataatcctgcaaactgggaagcagaaacaatttaaaagtcacattttccttaatcctaaatccgcgtaggtcataactggggaatttaaagtatggcgaaccactctagcaaagagaggaccaaatccctaatcccaaggacttttcgagccggagcccagcagaggcaggagtgcgcggcctgctccctccgtgcgcttctctccttcctcgaacttccttagctgccggctctccgaacgccaggccgcagctgacctctcaccaccccgagactcacgagcgcagggctaagtgtgtgtgcgagggcatttgcttgcaccctgcctgcggaacccaagaatgtgcaggcccgagccagcgttgagcaggcgcggtcacggtgctcagatctcccgggggcatttcagttcccgccatccagtggcccacggctgcgggctccagggtctgaggctggggactaccgttgccgccgcagtccccatatcccgaagttgccttgctgcttgtgttgttttcgcagatagcatttttggcgctctgtgcgttccttccctccccctccccctttcactcgccctcattgtcctgagtctttgaaagttgggagaatcggagatacttctgaggactggtaatgaagtctcacttaagtgggatgcaattcccgccctcctacccccctccaagaaggaggttgtgttttcattttgttttgctttgggtgctgacctttaaaaaattagagcaaaatgaacgtgaacaaaaagaaaaggagaaatgtttcgagctggggcagagggagcagagaaggagccctcaccgcggccggaatgcagagcggaccctggcccaggactgggtttccctttaggctcgggcctaccctggccctcgctgttggaatctccaggaggtaaagcgacctcgatttttgttgcccgcattcccgggcgtgagtgtccttcccaggaggctcaggaggccgtttctgttgcattctgagcctccgttgcaaaaactgaagcccgtgggtctcggcaggcctcctagctcgctcgccccgggacaggccctcgcctacacccctggaagtaaggagccccgggctctttcgtccttttcggggtgtggagcccctggggccctagaaaggtgaggcctcagaggcgagggaggggtgagcggggagctctgcccgcctgcggctgcgcccccgctgtggactaggaggcaggccaaccctccggactttgggggaaaaaccacagcgggctccttgcggaaactttggccgttctaacttgccaagagcctgagtgaggccttggaagcctccagccccggctcaggtcgggacgcggctgctgagctttctcaggcccgcaggacagcggcccccgccggtggcgccgctgcatttaggccctttccagaccggtggcggcagccaacccgagacctgcgtccctcgggcccggggcagctaggaggtcggcgcgcagcgggccgggtcaggactgggtcgagcagacagagctgcagcccccgccttgcccggcttctcgcggctggagagcagagcgatgtcacccggagccccgcctgggtggtaacgagaccctggccagtcacccctgcagcccagactaacttctttcaacagcctctgatggtaattacagtaatcgaagctgccatatatctttaggcaattatgacacacaaaaagccccgaggggaccccctggcgagggaagttaagaacggttttccagcttcaggaaactccggctcgcctcacgtcggagctcgctcggcttgctaaatgagaggagctttgcaacggggtcaaccagcttgtctcgtgaccccaagtcaccttaacgtggctgggtggcggagtctgaggcacaggcccgctatgccccggaattttcgcgtccctccctcctgggccccgccccagcccggttgcctgtttctaatctgccccgggagccgcggctcagaggtctgctcagaggcaggactcgcactggtggtggcctagagggcaacagtccggaagctcgggcgggggaatccgaggaggggcccccaccctgcactggtcttccctccaccctcatcgggttctccagagatgttgtcatgggcctcctgtccggatgggaagtggggaaaaagagaccccaccactgctcctcccactcactcatcttggcatcttcaacagtgccacagggaagaggacagctggggtgacagtactgctgggccccaaacgtggaccctggagcggtcagagggcgcgtgttaagcagaggatggttgtaagatatggaaaccaagtttaccgcttccagagtgagtgcagtgcagcggagctccagacccggttcctgagcgaccaggaactcccttgggcgcagtgacaggcccgaaggagtggaggacaagacccgctgtgcccttgcctggccctctccagcccctccctcccacagcacaatctcccctcccgccctgtgggaggggggcgccgagccggtggccgccgcgccgcgcgcctcccctgcccgcctttgtcgccgtccgaattcccatgctactctttttgacgggtcactggtggctctataggcaggtgctgccgcggggttgtaattacccggccgagcctggtcgttaccgaacaccccctcacccccaagcacggtcccccgcgctctccttcccccaccccctccacctgagacgagtctgggacccacggtgcaagctcgcccggacgcctcgggttccaggagcaagtttacacctgcggtgcctcgaggccctccccgcgccacgccctcacctcccctactcccctcgcccagacgttccactgccgccccttcccacctcaatcccatcgtagtccccaacccaagcgctttcggcagcagctgtcgaatttcagggaggcctgaggccgctggggcccaaactggaggccttcggataggtagaagaagagaaaagcaagtgttaataagtcaattgttatcaactattgttatttttaaaattaaagtgttaattaagttaacagtttaatactccctttgttttgcgggaggaagcatttctaagtccctataaaccgcttcaggcacttgttggactcttgaaccttagaggaaaagaatccctccctttctaaacggccaaatattaccctctccctgacactcctccagggtcggtggccaccccaggcttgaggggattccagggaaagttctcttgaggtggggtccatggggggtggggggatacagcctagagaaatcagtcagattcttaatttaaaaaaaaatcaggctcaaagagcactggaaaaaaccgggaggaagagatccacacaggaccaagtgtgtggaggccagtcttctagggagaaagggcttaggaaatggagggagcctgtcccaagctaacccgacagggaaccgacaacttgcgtcgctcccctctcccttgcctagtcccgaaccactttgcggagaaaataattttttcctaaaagaaataatttctctaaagcgactcaccaagcattttttaaataggtaaagcgaaagttggccaattaccactacccttattatcattaataatccaagtattagcattacaataataatcctaataataacaccgcccggcggagctcagagaaaactcgattgccttccagctgccatccctggttccagccgtgtttgtttttcttcttttcccttttacatttcaagtttgtctcctcgcgcgctcactaacaactttctctgttaaatgcaaaagcgaaggagggaggcggccaaactttccgcggagcagaaaggcagtggagggccgcactgccgcccgggcctgctgtcatcttttattccaaaatgggtctcggcgattagaagagaaccaaatacatgtagcggtgcatgaataatgctcattgtaggaaactgacacttgctcaaggaaaaaaagtttgggtataaaatcacttcattatttgcttttaccgcagcttcggtgctaatcccttcagaggtcagattgcttagcatctctctctccctctccccttttctccctcttctccgccctcctttccctctcgccccttccccccttccccgtctttcctgcgatttcaggccgcattttagatatcccctgcaaagtgtgtggcgaccgcagctcggggaagcactacggggtctacgcctgcgacggctgctcaggttttttcaaacggagcatccgaaggaataggacctatgtctgcaaatctggaaaccaggtaccttagccagggctgcactgctgggctccgctctgctgcctcctcactcttttgtttgtgccaaggcctcctctgagtttccacgcagttgaggagagacccggccctgacctctcccttcctctcccctccttcttgcctcaactcttggaggccctttggctggggaaaggcgggaagaggtaagggaagatatgagtttacaggagggagtctgaagtcctagagcctccctacacttttttaaattattattattctgaaagattttgacactgggtaaggcccacaccctgtggctctaaagccggcccaagggacctaaagaatttagcatctaaaccacaagtagcaagcaggagaaagagctttgttattgtgcctgcccaccccacactcactcctagcagcatcaagctcagtcccctgatcacttgcctgggatgcagaagtaagcggcacacagacatctgagtcaaggtcaccaccacctttagctgagaccaccaagtgagtgctagccacttggaagagaggcagtgctttctgaagggttgtgcattttcaactctggagaagcagggctgctctggaagtgggcagtgggaatccagcacccatgtgaccttagctatgccttgtcagaaaagggcagggtgaggaagaagagaagattcaaaaggaaggtgcaactgggaccctcctcaagcttccatatccctgtcctccttctctgcttagaatttgggcccagtcggttgttttggtcttgagtaggcagaactgtctcaaagagacagaggaatctggcatgggctgaatatgagccaaagcttctagaaagagtgagcagaacctcttgactcagtttccagctcaataataggctgattttaactaaggagatcaaccttctggtcctacactttgccctctccttatcagcgactcagaccctcagtacagagtcctccatttcacttgtggaaagatccctgagggtgcattagtcagcagtcatcctttggtaacaaaatagtaaaacacttttcactaattgatatatatagggtacatgtatacacatgcatatattgtctgctgctagtgaattgttctgacatctttttctgaagtcatgtctgctcatattgttttctaatagttttggattaaccacaaaaacagaagatatttgcattgagataaattttgagctctctagccctgttacctgtttaattggctactgtatcagtttctagcttcaccatatggacacatcacattttacacgcataggactgtatcccaataactccacaggattgtgcgattactgcgggttgtcagatttgaaccaacttctacttagattgtcttttgcttttatgcagtgaacagaattggaaaatcaagatctctgatgttgtgcttgatcttttagaaggggatggctatcaattcaagcatattgatatcagtccaagtgcttgtaaaggactgataatagactcatcaggcctggtgttcttcttgcaaggagagtaaatgatcagagctgaggcgtttatccttctctctggcgctagatatttatatacatttgatctgatttgaagacacacttaagaacttatgaaggtttccattttgcatttgcatacttataagaatactggaaagataccatctgaggatagatatataattacatttaataacaagttttaaaaaacctgtttacaatgaactattacattggccagcaaagatgccctaaataattcactttggacccaaaaattatctcctttctctcttattctaggattaaattatattccaatttattattaacagtaatgaggacatttagaaatggatatgaacatctgtcccacctttattttaaataaatcatcataatttaaattggagaagtgtgaactcataaaactgcattcgaatgtgtaattttcccctaaagggcttcagggggaagaaaaacatacttactccaactccagagtatatgaatttttgagattatgaagcaaaataaaaatacatttattatctttcttctcactacaaatctaacagtagcaacttctataaatataggagagcacacaatgtcttaaatattttctgtgtataaaactcatgcacatgactctttatgtatctatgcatatgtcccctcggtaatgacatctaacactgaataaattccaaaggaaactttatctgtagatttcctctttcaatggctaatgtttttacagaaaattgcattaggtaaacatctaatttctcatgcatctcagataaatatttctaaagaagtgactacctttattttttcagttactatgctaacagtctgagcccatattatcatttagtctgacagtccatcacattaccttcctggtcctgtttacatggtgagcatttctatattttgctcaagacttgagctcttcctttttcaccctcatcttctctaggccttgccctcctaaactctcaccttccaggaagggctgtgtttctatgcacctgggccgaggctagtctttaaggcaactctcaacttgctgataataaggttggcttcatacaaaagcaaaagtgaggtaataggagagtgaagaataaatgggagagatttatctgatagataaacgggctctcccagaaagtggcagaaagaggtagactcaagtactgaaagcagaaagaatcgttggtgggagggcggtatggtgtgaatcctgacccaaaagccagctcttaacggaaggaacttagtggcctctttctctggggccaagtcgctgtcttcggtcctgaagtctcgtccctgttccaccactccgcgactggcggaagttcccctagcgagagccccgcaggcctgcggggtctgccaaacccggctctctaagcttcacctgcttggagaaggacgtttcccccttgtccgctttcttggggtccgggactggccctcttgaagtagcctgggacgtcccagccccttctcgatctggccctgctcatgcccaaggccctcgcgttttgcaggcccaggctcggggctccagggcctgcggccgggcaaggtcgcgcctccacaccgtttccccgcccgggtgccggctccgggtctccagcctaaaggccctggggaccgctgacctcctgctctctgttccagggaggctgtccggtggacaagacgcacagaaaccagtgcagggcgtgtcggctgaagaagtgtttggaagtcaacatgaacaaagacggtaatcagtgcatccctttattccaatgttgattgagtagtaagtaaattatatgtacagaaaatacatggcactcctatgcatgtaaatcaaccccggagcgcttctttccagatgctgggaattggcctcgggctttcagtcgtatccttcccgtctttcagcaggagccgctggcgacccctagaattccccagggcaagacccatgcccacatcaggaacttgcgccccacagtcatctccacacaggcagcgcttggggggaccccactctccaggggaccggcgcgcattttctgcctccggtcctaatccctctttgcagcccttcgtggccacccttaagcctgctagcctgccccaggatcttaaaatctggatagtctcacggggaggagatcatacaggctggaagttcgcggtgtgttgaaaaagggagggcagagacgcgaaaacgcggaatttccagcccgtgtgcaaattctccaagatgccaaaatcagtacggccattgggccgatgtgagtccagggccttctctctgttctacagaaaagagggaaagggggctggagaggcagggtaacgcccgtgggtgcctcggacacccagctctcccaaggctcttaagcgcgcaacagcaagaaccaggacgtcagagtgcttcctgggcctggagcacggtccgagctgcgtcccccgctgcagcctgtcgagggcgccccaggcccaggcagggggcgagggtaatgggctggaggacaccgtggggcctgggaacagggtgcgagtgggttttgctgtgaggcggcccgggccgggtggcagctccaggaggagagagagccccttcctctgcggcgcaggaagccggagggagcgtccaacctgttgaacttgtgtattgacaagttgtcaagctcggcaggccgaagattgccctgaattaatttgtttgtttaaactgttggtggtaattgtcacatctcccctgcctttctccagcatactcggagacgggttctccctcgttccattccctagcaatcccggggctcgggtcctttcctcctgcggccctcggaggccaaaagctatttctgtgggggcggggcctgcgggtagggaggcttgttcttggacggagctggaaaagtctgcgcagaaacgaggtgtctggcgtgcgcgacgctccctctcttttggatgggggcgaggatacctggctactccagcccagagggtctctggtttccctgcgaacccccttccctggtggggaggagccctggaccgaaggagaacacacctggtcttacttgaggctctgccattatcgtggcactttgagcacgggcccctcttctaagcctcagcttccgaatctattcagtgtagtggttagacgatctcagaatcccttcctccctcagattccctctcccttcttcttttcacctcttgggcgattttgcccgcccagacttgacattggggcggggctggggggagagccgcagcggctgtgtctcgacgtctctaatcgccggcatgcgtttctctgtttgcctctgcagccgtgcagcacgagcgggggcctcggacgtccaccatccgcaagcaagtggccctctacttccgtggacacaaggaggagaacggggccgccgcgcactttccctcggcggcgctccctgcgccggccttcttcaccgcggtcacgcagctggagccgcacggcctggagctggccgcggtgtccaccactccagagcggcagaccctcgtgagcctggctcagcccacgcccaaggtcagcggccttgctgggcccaaagagactcgtgccagcgaatggagagggacgcacccagttcttctgagctgtgattggggtcaggcaaactggggagagaactccagggtgcttggcgggtctctgcatggagctccagcccttctgctctcccttgttcagccaggggtgctcaaacttgagtgtacagtagagtcaacctccgagtggctacaagtgtgcactccggatcttatccccccagaaatttcatttcagcaagtttggggtggaggccaggaacctgcacctttaggaaacacccactggtaatgggtggtgggtggagacctcgtctaaacccagagggcagcctcaggtgttcctaaagaccagaagaaccaacgttcatttttagaggagaggaattggctacagctggaggaagggctccagaattccaaatcttggcatgtatgatcttgggcaaagccatgagtttctaacgcaagtgcgaaatgtggagatcacactgttagaacagtttgaggaatctgagttcatttcccatgctcccctcacctacttctgaggcaggtggatttacagcagggttgattccataggagcagggccacagcctgaaccacctggaaaggctgccacctaaggcctaccctccaggcctacagctgatacctactaacacccccactccaggctgatgagggcctaggatctccctcagaggagggccagctgcagccccacactgcagggaagccagacacctgggcacatgcacacgcacaatatttaatatggctttcttacccttgatgtgtataataagctctggaaagtagtgttatgaatatgttgtcagttatgaatgggaatgctctgtgaatgattaagatgtctaattgaaatatttccataatatactaatcctttctaaaaatactcatatgcatatttgtgtttgggatgcctattaatttatactttttcacatctatttttatttacacaaatgcaagcagctcttgtctaaattgggagccaggcttggcacttggctcagcccaaggaaaatttgctgcaggggatagaaaagccagagggccttctggaagggagaggctcccaaagagtggaaatggacctcccccaaccagtattacttttcaaactctatagacagcgatgtttgatttttttacccaccaatgtcaactgcatgtttaaacaaaacatccaaattcttttttatccccttccttgctttaattagaaattaaaagtttggttcttcttgcaaagctgtggtttcctcacttccaggtgtctttctttcttccctacccagtacccccatgaagtgaatgggaccccaatgtatctctatgaagtggccacggagtcggtgtgtgaatcagctgccagacttctcttcatgagcatcaagtgggctaagagtgtgccagccttctccacgctgtctttgcaagaccaggtatgaccacactgaggccttgggagaaagagagctgggaaagaagcagtagcactcagccttataaaacttcctctatccctgggtaaaccacccaaggcaggcatccattcttaatagcagtgaggaaactacttgtttttacttgcttcttcctgtgggttcaaaatatctacctatatgatccttagtaagaaacgtaattacattatttcagaaaggatgggtccagtctgtgaaaacacacatacaagaacattacctctttttgtttgattgaaacagcaaatataatctcaaattttaaaattgtaatgattttctaaaactgttgatgaaacaatgttttactaagaacattggaactgagagaagtagaaggtggtaagagtatgccctcatgagatttttcagaactgatgttattattttatattcccagctttatattctccattgcgatgctcccagttttggtcattaattgataagcatgtaagaccaaagggcacagtgcacacctcctgtaggctaggttcttccttgattcttcatgtacttttagacattttgtaaacaaataggcattttgcttaattccgtggttgtaaatgacattcaggggaagaaaaagtgtgtgcagtgaaacattgtattgtactgagacccagaaattttgttgataggaatattagaaatgctaacatttttctaaccttaaaggaaagaaagaaaataaagtgttcccaaccattggctgttaccagtgcattcacaggaattaatgacaaattttccaaaggctaataagtagttctaaaagcaaaggatttatttcttcaattcatttcatacctaattaaagcataatagtgcccctttatatgaagtatgtttcctacggaaagatcgggcaatgtgctaaaagcatttcattttctagcatgagatgttcttgttttcatggcctgccctttcaaatatggccagaattaaatattgtttaccttgcattttataattatttcctgtacttgatggaataaaactaaaaataaaacattaaaaaaattaaaccctttggtctaattgtgattttggttacaagccttcatgattcagctcttagctcccaaaagaaatccttttacataaatcatttagagttgactggcttttgagttttgagatttttaaaggtagttaggtcctatctttgaccaggtttactggttagctctaaccacttcctgtgtgtgtgtgtgtgtgtgtgtgtgtgtgtgtgtgtgtgtagactggctattttttttcaaaataagtatttgtatactctcacccaaacaaaatttacttactgtctgccacttagccctttggtagaaatccttcgacaacaagcaacctgcagtgaagtggaatctggtatattaatttggaaaaagagacagattttcattttaaatattcagtagcacattttattagaataaaaatgacaagcaccttgatgctgtccatttatgggtctcagaaaaatcaagcagtgagacgaggaaaactcagcaaaacccgattaacataattacaccctgatttcccccagtgcctcttgggaattagtgatctctgtctctctcccagcccagccccctcaaccctccaggaagatggggacccagctctgcaagcgtctgaggaatcctcaaccctgctaatagcagcattctctgtgaggggaatccacctgctgagctgctggcatttcataaagcctcgctctctagaggagcttctaggtggtcaggaatgggtggatacaaggacaagaggggcaaatccttttctgagagaaggaaactttggagaattggaatggctgactctcaaatccatatgcatatctataggcaccttttcaaaaggaaaatatgggaaaataagggaaagctagaatattcagaaaaaattaccaagacaggcatttaaaacactttttaaaataatggaaatttacatagtgaaattgtttataaatttataaattacacactatattatattatacatctattgtatgacagctgatgcttttggaagatgcttggagagaactgtttgttctaggaatagcacaatgggccattccggttgatgctaacactctactggctgtatctggtaagaattgcacaatttaatgactttgttgtagaaattaccataaaaatacattactgaaaaaagaacaacatgtaaagaataacaaattcctgctgaacaatagagtatacctgtcatttataaatctatatttaaatgcaaataatgttgttttgttgtattcatgactgcttgcattgttatttaaatgcaaattactgtgtttgttatcatccaagagaagattttatattaactttcatacaatatagccggtttacatggaatcagatatcttagagtgacaattgaatagatattgatatgcaggattttgtcaaaaatcaatattaaatcatgaaaatgccttcatattagagtatttatcccatatttttattctaggcatgaacggtgacaacacagattcccagaagctgaacaagatcatatctgaaatacaggctttacaagaggtggtggctcgatttagacaactccggttagatgctactgaatttgcctgtctaaaatgcatcgtcactttcaaagccggtaagcagacacagacccctgtttcttctccttccccagttttgccacctcactaattcagccacctcgaagtctgaactgacctttgcaaaaagaggtgatggttttcaagggagctgatactcttaatctggccccattttttattgctatgggaacctgcatgttctgctgggcatcaacttccagagaggtgcattcccagacccaatttctttttttctttctttttttttattttttaaatttttgtggagatggtgtcttgctcttgtcacccaggctggagtccaatggcaccatctcagctcactgcaacctctgcctcctgggtttaagcaattctcctgcctcagcctcccaagtagctgggattacagacacatgccaccatgcctggctaatttttgtatttttagtagaaacagggtttcaccatgttggccaggttggtctcgaactgctgacctcaagtgatccgcctgcctcggcctcccaaagtgctgggattacaggcgtgagcactgcgctcggctcccagatgcaatttctatgctgtctatcacagtttcctggtcttcatttctagttcctacacatagtggttctgaactgagaagtttccggaatgctgccgccattgcagcccttcaagatgaggctcagctaacgctcaacagctacatccataccaggtgacccttgtttgccttgaacatgtacttaagaaaattgcctccattgtgaatgcctgagcaggcggtaataagccagttcaaacattgtgactaattatcttgttgccagccagttaatttagggagaatccatgtccttacctatctctcagggtgggtgagaggagcaaatctaattagatgatcaaagtgaaagcactgccagacatattacagttgtcctggcggaacaaattgatccatcaaaataatggaacaacatttgtgtgaatgggtatggaggggtcaaaaatgaagcctaggctgggcacagtggctcacgcctgtaatcccagcactttgggaggccgaggtgggtggatcacgaggtcagaagatcgagaccatcctggctaacacagtgaaaccccgtctctactaaataatacaaaaaaattagctgggtgtggtggtgggcacctgtagtcccagcagctactcggaaggctgaggcaggagaatgtcgtgaacctgggaggtggaacttgcagtgagccgatattgtgccactgcactccagcctgggcgacagagcgagactccgtctcaaaaaaaaaaaaaaaaaaaaagaagctcaaagtgtaatggttggtatgtgagagagtggccacatcatccttgagaaaacacaggtgactttcttcagatgccaatctcaaataaaaggatgagagaactttccagagaggctatctttttttttgagacagggtcttgctctgttgcccaggctggaaggctgaagtgcagtggcatgtgagcatggctcactgcagccttgaactcatgggctcatgtgatcctcccacctcagcctattgagtagctgagactataggtgcatgccaccacacccagctaatttttttttttttttttttttgagacagagtttcactctttcacccaggctggagtgtagcggtgcaatctcggctcactgcaaccttcgccttccgggttcaagtgattctcctgcctcagcctcccaagtagctgggattacaggtgcctgccaccacgcccagctaatttttgtattttcagtagagacggggtttcaccgtgttggccaggcaggtctcgaactcctgaacttgtgatctgcctgccttgacctcccaaagtgctgggattacaggtgtgagccaccatgcccggcacacccagctaatttttaaactttttatagagacaaggtcttgctatgttgcccaggctggtctcgaactcctggcctcaagtgatcctcccacctaagtctcccaaagtgctgggattacaggcctgggccactgtgcccagcctaaagaagccatcttttcacctatcataactgttgtttggccttggtgactggtatctgttattttgtgtcataacatctaccaggttacttctggccatgcagggcccacaggcagaggctgtttttggctgtttgtaggaactctcagagactggggctccaacaaagctcctcctggcccagcactgggcaagcccattaagaagtatagactgggggctgaggtggctccacacctgtaatcccagcattttgggaggccaaggcaggcagttcacttgagctcaagagttcgagaccagcctgggcacaacatggcaagaccccatctccaccaaaaatttaaaaaaaaaaaaaagaagaagtgtaaattttattatgccatttaaaaaaaaagccaggcttttaaagagaaatggaaactttctagtttcctgagttaggactggtagatttgaagttagaatagagttactcttctctaggctgatttgaaaggaatctgtgaaagctcagctccataatctcaacatcagctatagacactgtggggggaataaatacatcaaatgggtagaggctgttaatgcctccctcaactaatgggtcagagaaatcccaagtcaactctgtccatttggggtgataccacttctgctagagtctctctatttctatcgtaaacctcttttgaatactaaatgaataaaactgttccctgtctatggaatatcactgaaactatgttgacagatagtgcacctgtatatgttttttcaaattaaaatgccaggatttgaattttaaatgcatattgaattacagaatatatatagtaggcagttaatatttgttcaaatttattaaatggagcagtacataatctgggtacttctactgacttgtaggccgggcacagtggctcacacctgtaatcccaagcactttgggagttcaaggagggcggattacctgaggtcaggagttcaacaccagcctggccaacatggtgaaacccgtctctaccaaaaatagaaaagttagctgggcgtcatgacgtgcacctgtagtcccagctactcaggaggctgaggcaggagaactgcttgaagctgggaagtggaggttgcagtgagccgagattgtgccactgcactccagccccaggtaacagagtgagtgagactccgtctaaaaaacaaacaaaaaaattaaaaagacaaaaaaacaaaaacaaactaacttgtatgtcctaactgacctttgacatttagagccattatggtattaagaacttaaaaatgagaaggacgtggtatccagttattgatccagtcaagcctttgccgagtactggccacatgcagggctgcaggtgggcgatatgggataccagaaggagcaagacactgccccttatcattgcaagaagtgggcagcagtgtcactccaatccaaactagagaagagaggaaagcaatgtggggagtgtgacagatgaatcctagtcagagggagtgagggacaatcagaaaagctcaaagtctgatgggtggaggaaagaacatgtgaattggtccttcaatgggaggaggatttcagcaggggagaagatgtgtcctgagagtggtggaggagctggtaggggtcctgtgggaagtgccagagaggtgagtgaggaggggagcctggtgtgccaggagctgctgatagggtggcccgagagaattcaaccatgggttaacaacagcctattttagagaaatggcaagtaaagtacatctccccaacaccgcaaaagaagaaaattatgtgtggaaaaaacacatctgctttgccatggaattcttattatttctattaaatattagaatagtaaatatcaaataagtatcttatttcttattaaataatggaattatggaatttcttatttcatggaattcttatttcattctgatatcagctacagctgtaatttaatatttatatctagggtcatacatgtgacaaaaatgactatgccttatttcttagcccttcaaatcagtgaacactttttcctccagcactttcctgtctagaaaaataaaacctgaacttgaaatgaaaacttaacatgcaaactgaaactgagcctaattgtatattacagctctctaagctatttctctaattatcgaggacgtaaggagaaggctaggaattgacattccacacaaactatattctataactgaagatcaaatatgcaaatctgtaatagacctaaaacacttaaacctaaaagaaaatccaattattgatgctaatggatgaagacaagggcatagatattctaaaaaataattttgattagtcagaccttctctctctaacacacacacacacacacgcacacacacatacacacacacacacacacacacattgtttttgttttggatgcccaggctgcattgcagtggtgcaatcatggctcactgcaacctctgcctctgaggctcaagcaattctcccacctctgccttctgagtatctgggactacaggtgcccagcgaatttttgtagagatgagcccttgctatgttgcccaggctcatcttgaactcctgggctcaagcgatgctcttgcctcagcctcccaaagtgctgggattacaggtatgagccaccacacctgacctcatacattgctattgtttctggtagtagtacagtatgctatatgtaatagacaattaatttttgttgactgactaaccaaccctttcccaactaaagaataaaataagtgggagagtagatgagtgggtaatctaatcgcagaaaatcaggagttggttgtctatagattcccccaaattcatcctttctgaaggtgattatttctcacagtggtttctcaccacgggaaatgttcagcatgttgggtggatgctgcagatggcagaggtcgtccaggcagccactgcctccgacttgctgaagaattatctctactatgcctggtcctgggaagggaaatagagctgttgaaaagaagtggccaaggtgaaagggagacacggatttggggattactttccaagaaacattagaaatacattaaacaaggagaacaagtggtaggatttaagtatttttttttaatgcaggtaagcttcaccatttccacaccacactactagatgtggtctggtggcccctatctgcaggtggtcatgaagctgggcagtgaaagagccagctgaggtcctgagaggcccagatgaactataagccttgtattctgtggaagtgaaggactcttatgtgcccagagctaaatagacaagcatgaaagttgctcccctgaactttatttgcagggtggagttatcaggcagttaaacacagccacctgactccttcgaaggaattttgatatcccttagcttctagcaccttgtggcctgggttgaacccagcttagtcacagatgtgtatcccggaagttcaggttttaggtgtttcatttcagtggagggagctctccttatgtatattgatatctaattctaactattggctgaagaagtatcagggctgcagtgaggaggtggcttgcaggcatctaaaggcagcagaagattgaacttgcacatctgagcacagatatatgttggacatcaaaagaggaaattgttaagcaatttctcacatctttaattacatgccaatttcattgacatgagagttgggtggcactgccacccaacagaacttagtctttaatttgcagtgtaataaggatggaattattcctgagagagactaagtataatgcctgaataataatttggagaattgcttagaaaaagaagccattttatttgagggaaatagccttgaggagtccttagaattagaaaacatgggttctgttgctagccttatcctcaatgccctggtcgttttctataatggaaaccttaaatttattatttggcttaaaattagtattatgcttcttaaatttctttttttttcccaaacaaaatgcaatccatttgttaatgtagagagggtgtccgtgtgattttggcagcatcatttatggtctccctgcctcaagtagtctacctgcaaaacggggacaacagtgcctgtccagaactttgctgcagggatactgtgttattcaagagacctagatcagcaatgctggagatgatgtgtgttcaagtgtaagacgttagtttccataagtaatggcctctgaccttgttttcatggcttctcacattccagatatcccactcaaccctgtcgctttggaaaactcctgttgcttttgccagctttacgttctattagcccatcaactatagaagaagtgtttttcaaaaaaaccatcggcaatgtgccaattacaagactgctttcagatatgtacaaatccagtgatatctaagctcacaagatacccacttttcaggatgggacagtatcagatgaacttcaacccatggagaacaagcctcaactaacaaacccttcaggaagcatataccggggaatgtgtagccttcaggaaaaaaatgccaattgacacaaagcattccagtagctatgacctgccgccctgaccaggatagggcgggtgggaaggagaggggtgcaacaggaccgcctgcactgaaaactcactgctgccatgccctgggagggggcaaactgggggttgccacaggccgtgccattctgcctcttacctggaagatcaggctgaacgatcaaaagctgaaacataagtagtgctttctcttcctttttagcatacaaagtttggtaaccaaatatagctctgtgtataacatcgtactgcggccttcaaaactacgttatgttggagcatttattttaaaaataatggtaggttttaaattaaaagtgttatcaaaagtttcccctctattgtaatacattattaagtggccttcagaactgagttaataagtgaaaagtagcttatgccatgtgatttgctttttctctatcttcttttttcttttctttctctttcttttgttctttcttcttcttttttaataccataggccaggcaaccttgtcaaaggaattgatggacaaaatgagattctcaccaggacttcaggttggataacatgtcaaaaagagaagagctttactaaaagaacataagtcaagggaggatgaataaaaacagcaaaaccaaataaagtggagatgagtgattgagtgaggtagattgctgtcccgttaacatagtgctgaaaccaaaggcagtgggggtccaaactcgtggtgcagcaagtcacaccagacaggaaacgaatatggacgtaattgcagaaggaacttcaaggagatgaatgaatgctaaaagggttcttgactgatccattgctaacagcctgagactcttcaatgcctttccgaaaactggtttctagtaaagccttgaatgaacacacacacacacacacacacacacacacacacacacacacacacacaccgtcctacactttaagctgctcctttggtatgactctatacttatggaaatgtagaaacaaacatttttaaatagctgctgtacttttcacattttgatttattaggtactagcactgaggaaaaaaaattcagcacttggactatcataggatgagtaaaacttttcttgtacaaagtgaattaactgatttgtgaagttaaaaggttgtactcattgtatttacaaagaataaaaatatattgaatttaaatgaactctttctgatttcttaccctccctccctggctggttctcacccaccagaaacaaggtaggggcagcagctggtgttaaaactgaagctcggagcactccagcacagagcctgcagaactgaactacaaaggcaatttccttcttacagtgaataccatttggaaaatgatgaataaagaaataaaacgtaagattctgttctctacagctctcaaatgtaattgcatctgttagaaaaattgctgtgtgaggaggaaggaggccgattaacagagtcttcattccttcctctgtttctaactctcttgccaacatttcaatcctgaccagtcacttgaaatcatttaatgatcaaaaagataaagtatgataaagttcatatggtgagtaagatgtggagggagcagtagaaatgtcatccagatgttcccagcaagtcttaaggcaccggtcccacaagcaaaggccatcagaggtgcccaaggccacaggcactgtagactccttttgggtggcagctccagcaagagatgcttgtgcctctgctcttgctaaaatggtcttgcggaccgtatatgtgaaatttcaatcagctgtgcacttcttgtctacttattctacggagaatgagaattggtcttaaagaaaagcacagtactcaaagactgtgtaagaatgtcccttgcaacactgttcgtatttaacaactttagtatccattgacagataataggtacattgtggtgaatacagacaatgttaccgtaggcaaagtgaatggctagagctaatgtatcaacatgggtaaatctgaaatacagtgtgtttgtgtgtgttatggggaaagtaaattgcagagggcacatacagcttggtatcatttatataaagttttacaacctacagaacaatactagacaatgtttatgggcatataaatgtataggaaacatttaaaacaggcatgagtattataaacactaactgctggatagtggctacttccaagaagagatgggatgggtgaagggtataacaggaccctcaaatgtttctgtaatggttaatttc

SEQ ID NO: 15914 - DNA, 21002 bp, Human
aactaggaattacatggtaagttgaaagaggaagttaggggtaagatgctgcaccaaatgcaggagattggaaggtttttctggaagaagtgatgtttagggggagtttcagaggtaaatttctggtttggttaacagaagatagtttcactgctcactgagattacagaagaaacaggctggaagagtttggtttcaatatgtcaaatttgatgtgcttataggaaattttatttatttgagacagtttctctctgtcgctcaggctggagtgcagtggtgtgatctcggctcactgaaacctctgcctcctaggttcaagcgattttcccatgtcagcctccccagtagctgggattacaggcgcacggcaccacgcccggctaatttttctattttatggtagaaacgggatatcaccatgttggccaggctggtgtcaaactgctgacctcaaatgatccgccctcctcggcctcccaaagtgctgggattacaggtgtgagccaaggtgcccgacctgatgtgcttgtaagaatttaaatgaagagggtcagtcagcttaggagacgaggttagatgtaaggatttcagacttgtcagtatacaggtggtgattgatgccgtaggaatgactggtattacccagggagctggtgcaaagtaggagccttggggaacatgttaaggggatgtgagagtaagcccacaaagactcagaagtggccagggagtaaggggaaaatgggatagaatagagcaaaagccacgggaggcattccttgaattccttggactcagatatgttaggggacaggaaacacattgaagacaactgaagagacttcagtgtgctgctgagttcttagcagagtagacagctgatttcaccactattccagaccctaaagatttctcctgaaattgcactgttatgcaatttttttccttctctattgccccacctctggggcctacactctttaccttctctgatttatctgacccatccgcatatctctgcaaagtcttaatgtaggtttccaggatttaatgattctttcaatcaactttaaagttcttcaggaagattctccaggtccgtcaacagttttccccttcatgactttgtgacaaagctttcttgttccactatccaggtgttcccaacaagttgctgtaacggtggcccctcataagcttgcctggaaaccctagaaagctcagaaaaattatgaactttgcccagtaagaggctgggaagtcagaaagggttttaaacaaaactgaccccacttgttacatgctcctttcactgtccaaacgtcaaccaaaggaacttttgtgacgctaagacgctcccggcgtcctcacccgttcacagccagagttgatcttagaaggcagggggctcgcaccgagacgctcctagcaagcccctcacgcgagcgaatgactggcgccaggagaaacgcataggacctcccgaagccgccgagagcaaaaggacccatcagagctgtgctgagacccgccgcgggccgggctcgcactcgagattctcgcccgtgggattccagtcctgagctgaacgagagataagtctttgtcaccccccagtctttactgtttcgagaaaccctaagattttttaaaaaaaagcccaagacgtcaagtcggggaactccaacattggggtgtccagaaacactggggtttcaggcgctctgtaaatgcgtccgaggtccgcggttctgcccgcaagcccagaccccggcctcacttccgccccgcgccccgcgccccggcctcacttccgccccgcgccccgcgccccgcgccccgcgcgcctccgcccgcccctgctccggccttgcgcctgcgcacagtgggatgcgcggggaggtggtgcgcggggaggtggagggcgaggggcggggctacctcaggtcccgcccgcggcaggcctgtgggctgcgaggaggagctttgcctagcttgcaggcagcgcagggcagacggcggcaggagaagcaagatgaatgcaggctcagatcctgtggtcatcgtctcggcggcgcggaccatcataggtgagtggccggcgggagccgcgcagagtccgaggcgcctgctgcttcggcaggagcgccgagggccggacttgtgtaggagaggggcgtatgtggaggaagccggtcaggccaagccgcgaggagccgcgggatccctggaaccctgcggctcccgcgttccctgacctggtgctacagccccaccctctcctctcccgatgtgcgcactccgtccctcgtgcttggattggctcccggggtagagccatcgcgtggcctgcctctcccattggttggcgtagggaggtgttctcctccggggcccctgattggccggctccgggaggcgccatcggtaatgcctgcggcaggggcggaactgctaggtggtctgagcccggctttgggctggggtcgggctgtcacacaatggctagaagtcgtgacttcgtctccttcgtgccgcatggttttcaacgcccttgacccgccggttccttttgtttgggaagcatggggtcgcatccagtccttcggatttggggaaatagaagggctacagcggcgtccctaggccgttctggaggtcgcctgtccagccctcggctgctgcgagttgtggcacccaccttgacctttgctcagaccagcaggtgtaggaacgtgtgggaggagagggcactgcctcctcgcgtggccttgccaaacagggtcatgaggctcccctgctcgtaggtggttcccgtattacccgcaggcttgtgatgtccacgctctccgcctttctattgtaggttccttcaatggtgccttagctgctgttcctgtccaggacctgggctccactgtcatcaaagaagtcttgaagagggccactgtggctccggaagatgtgtctgaggtcatctttggacatgtcttggcagcaggtaagtctcagtgattccaggagaagtcaggcttattagaaacagcccataaacacacacacacacacacactctcacacactcacacactctctcactcactcaagttcttgcctccttgcttttgctcagagttccctctgttatgattcctcctgttggcccccttcttccagccctgtcagtagcttctatccagcttgagactcagcttcttggccaggcagggtggctcccgcctgtaatcccagcactttgggaggcggaggaggaaggatcacttgagtccagaagtttgagactagcctgggcaacaaagcaagaccccgtctctacaaaaaataaaatagccaggtatgatggcctgtgcctcccagctactggagaggctgaggtgggaggatcacttgagcccaggagtttgagactgcagtgattgtgtcactgcactccgtcatgggtgacagagtgagaccccttctctaaacaaacaaaaagacttagcttcattaatatgctttttgtgaatgaacttagaccactgacctacaccacctacactgccttttcttttccttttttttttttttttttttttttttttgagacggagtctctctctgtggcccaggctggagtgcagtggcgtgatctcggctcactgcaagctccgtctcccggtttcacgccattctcctgcctcagcctcccgagtagctgggactacaggcggcccactgccttttcattcttacgaagcagggccggccgggcccggtggctcacgcctgtaatcccagcactctgggaggccgaggtgggcggatcatgaggtcaggagatcaagaccatcctggctgacacggtgaaaccccgtttctactaaaaatacaaaaaattagccgggtgtggtggcgggcgcctgtattcccagctacttgggaggctgagacaggagaatggcgtgaacccgggaggcggagcttgcagtgagctgagattgtgccactgcactccattcagcctgggcaacagagtgagactccttttaaaaagaagaagaagaagcagcagcagggccagcctgacgcataggaaagtatgcctgctcctccttactacctcaaagtgtcactcattcaacaaaaatgtattcagttcctcctatgtgccccatactgtgcttagtgctgggagtatggttccaacaatacaggtaagttccctgccctcttagggctcagttctgagcttggaaaataggtgccacatcatgccccttgcaaatggggcatatcactccccagaggaatatagctgagtcctgagagtgcccccatcttctgattctttgggtttgaacactcgtaattaattaattaattattattattattatttaaagagacagggtctcactctgttgtccaggctggaatgcagtggtgtaatcaatcgtagcccactataacctcaaactcctgggctccacggtatcctcccacctcagcctctggagtagctgggattacaggagcaggccaccacacctggctaattttttaaatttttttgtagaagtggagtctgtctgttgcctgggcgtgagtgcaatggctgttcacaggcacaatcatggtgcaccatgcccttgaacttctgagctagctgggactaccggtgcatgtctactaagtttaaggcttttaaagcactgtgctaaatgctttcctttcattacctcatttaatcttcctcacaagtctgttatatcctattatcttcattttacaaatgaataaatgagagtttaagaggttaaatgacttaccagggtcacagtttgaagtggagctagcacttgaacttagatctgtcctattccttgagccagataccttctacaatcatgtaacaaatgtttattgagcacctactttgtgccaggcactattttagcagctggagataagcaatgttcatatcagatagaaattctcattctcatgaagctcgtagtatgctaaatgctagcattattaattgtgttagcacctcatttctttctttttctttttttgagatggagtcccactctgttgcccaggctggagtgcagtgacgcaatcttggctcactgcaacctctgcctcccgggttccagtgattcttctgcctcagcctcccaagtgactgggattacaggtgcctgccactgtgcccagctaatttttgtatttttagtagagatggggtttcaacatgttggccaggctggtctcgaacttctgacctcaagttatccacccgcctcggcctcccaaagtgctgggattacaggcatgagccaccatgcccagccctgtacctcatttcttctttttcttttttttgagatggagtctcactctgtcgcccaggctggtggagtgcagccgtacaatctcggctcactgcaacctctgtctcaggttcaagcaattctcctgcctcaacctcctgagtagctgggattacaggcgtgcaccaccatgcccagctaatttttgtatttttagtagagagggggggtttcaccatattgtccaggctggtctcaaactcctgacctcaagtaatgcgcccccctcccccggcctcccaaagtgctgggattacaggtgtgagccactgctcacagcctgaggcaccgcactgggcctgtctttttaatatgtatatgatcctgcatatgttttcagtctcaagtaaccttacccgtttttagtttccagcctaatcccagattgataacattgtgatgaatataatctctaagtttttatcagcgacttatttgctagttcttccccacaaactctccaaggaagggtggtaggtttgagtatatctgaaactgggaatagagtaaccactttataaacatttaccattgactctgataacagacaatggcgattgagaatatttgaaacttttaactccattctcttctgtgctactttaagtaaattatgtatttcttcccaactaaaggaagtcccatagttgaattatgaaaagatatttgtgtttcagtactcagaatgagaaaaaaaggtatttgtgaattctgagtttgtatatattttgttatataaccatttaagcatagtgtaatgaatactaagcaagaacagaactgcttattatcaaaggttttcctttttaagtaaccctttttcttctcaagtgtcttaagccatgatcttgggagcaaatggccctagttagaaacactgataatgcctaggttatatcctgtgtttattagacataggtttgataatgcttatttaagcacccccccgcacttttttttttttgagacggagtttcgcccttgttgcccaggctggagtgtaatggtgtgatctcagctcaccgcaacctccgcttcccaggttcaagcaattctcctgcctcagcctccctagtaactaggattacactcatgcgccaccacgcctagctaattttgtatttttagtacagacagagtttctccatgttggtcaggctggtctcaaactcccgacctcaggtgatctgccctccttggcctcccaaagtgctgggattacaggcatgagccaccgcgcccaactatttaagccatatcaaaagatgaggatgacacttctttcttaatgtattaatgacttatttatggaggagaaagcttatatctatgaaatacctacagagcagcacaaggcagtatatattcaagggctagactgtgacaggtggagagtgtatacaggcctttttgcctccagtgggcacttacttgacctgtaggctttcagaagtggcaggtaacccaactggcaattttccacacactttcactgtgacattttgtctttctccttgattgctaagagtcctctgtgttcctctttctaggctgtgggcagaatcctgttagacaagccagtgtgggtgcaggaattccctactctgttccagcatggagctgccagatgatctgtgggtcaggcctaaaagctgtgtgccttgcagtccagtcaatagggataggagactccagcattgtggttgcaggaggcatggaaaatatgagcaaggtaaggcctctctgatgaggtggctttcactgacctcacactgagaaactcatgtctatgccagaacagagtaaacagatgcatagcagagctggaaccaaacagtgaacaaataaacagaaatgacaaccttgatccctacttgaatgtgaagtattcttcagtttgggtgggaaatccgggttgataagaagtttatcaaccagtgtgattggaaccgaatatactttttctaaactattaatgaagcatgtaatattttctgaattaaattcatattagttgcttgatgtccttggttttaaatttctttcccattgtgagtaaaaggcaaaaaacagatgttgccacttaccttcctgcacatgacaaggagatcctggggaccagactttttgaccttttcagggtatagaacatgtaaaagaggaccaccaagtggtgcccttctccagtaggtttgccaggcatgatttgtttcaccaagttccatacctcaaactggcatagtggttgaaagaaaaactataccccctgcttcctactgatgcagctcaggggctgaggtgcagattccctagatagaagctgattcagcccagccattgctgaggttcaggaggaggcaggctaaaggtaacaaaaataatcggagtgattttgatgggatgacactgacatctgtgtagtactttaccaggtgcttttgtacatgtgttcacaacagccccatatagggtagatgataccattcccagtttacaggtaaggaaactgaggaccagagccagcattcaaatacaactcttccgactctaagtccaatcaatgactctttccattctaatatacctgctgttgagttggtgagagttaagactggccgctactcagaaatccctccccatcatttagttagcctgattattctcactgtagacattatgtcatccattgaaataggtaacacattgttagctttacttaagcccttagaggatttcttcatttaacagataattaattgcctcgatggaaagaataaatggaattcttaaggaaacaggacacagaatgggtaggtttgagggagaattgaaaatgggtaggtaggagagtaatcgttcccaacaataggaaagatgaagtctgctaattccaggggtctttagaccttggcctggctgaggacctagaactggggagaagggctgcaaaggggcctagatgaagacttaggaaatactagatagttttgagttgtattctggggagaagactaattgcaactaagcctaaatccatttttatttctgacttctaggctcctcacttggcttacttgagaacaggagtaaagataggtgagatgccactgactgacagtatactctgtgatggtcttacagatgcatttcacaactgtcatatgggtattacaggtaaggcagacatggctgaaactgtattagctttaaaaaggttaaaaagaccatatactaatctgcttcttaggtgctttcgtccttatggccagagactgtcttaaggatttttatatctcttctttgattaactgaagtgaagtaagtattctcttctttgtgaactcttgattatcagagaatgttagaagtgggaagtacctcagagttcttctggatcaacccctcattttaccaaatgaagaaacagggcccacaaatagtgcttctgtggcagaggtagtgacagagataaaccagttgtttttttggtacctagctgtactttttgtactacacaattgggttattggtcattcatgctgaagggtcctgtggtctaagtttaatggcaaagcaactgggaaatcaaaagcactcttgtctttagtatacatgtaaaacttaagaaacagaatagacattttagagttaaagaatcaaaccctgagaagttaagcaccttgctcaaatgcatgcagcaatggctctggttttatgtaacacataaatatgtgaaaaaggtaatggggaaaagtacaagattccaagagggaactgtgtgcatgaatgctaggaaggaaggaagggcttagggatatgggaagcaatgagaagctcaaggcatcttgaccacttctcgacttacagccacaacagagaaggctataaaaacacaggcagacaatggaagacactgtgtgaccaactgcctcaaccataactagaggtggtcattaaaaattcagatcccgagccctttccaaggtgtactgtggattgaatggtactcttccagcctccagaactgtaagaaaataaattgctcttctttagaaaaaaagaaaagaaaaaaggctcaggtcatgatggagtaattgacaaagattagatttcctactataaacaagcataaaacttgtgaaaatatataaagccactgttttatgtatgtcaggttttgactaatactcatgtaagactgagatccttgagagaagggaaaaccccactgtcactgtctctacccagggcacttcccaaactgtgttatggagaggcagagcctaagctggaaacagtggtctcagtgatctgaagaagcagagaatttggggcttctgagatggctggagtttgtggggcagaataagggggagaagaaaaaaagagctccagaaatctgcaaaaggttccccttaagtctttgatcaaatactaagcttgtagataacagcttacaaggcctagtagaaaagagctgcaaaggagaggtgaactggagattttatagattactaggagataaaagttctggacaagcgagtggaaaccttactgaactccttggacactccattgacatctcagaaagaccacagtttaggggtagggccaaagccatagagtaaaagctactctagacccaaactaataagcttaaaaacaagcctcaaaaggatcaaggtgatttgccagtattttgactgcttgtggaaacaaaactcaatatattctctaaagataataaaatctctatgtccagttatgtagcaactataatgttcagcatgcaatgagaactttctagatacacaaagaattaggaaaatatagcttacaaccagggtggaaaaaaaccacaacagtcaacagaccctgcaatactagaattatcagatgaggatcttaaaggctctattttacatatgtttaaagatacaaaggaaaatataatcttcatagaggaatagatgtggacatctcaggagtaaaaggaaaaaatataaacaagaaccaaatagaaattctagaacttgcaaagtacacaatctgaaattaagaattcactgggatggggccgggcatggtggctcgcacctgtaatcccagcaccttgggaggctgaggtgggaggatcacttgaggctgggggtttgagactaggctgagcaacatagttagacctcatctctaaaaaaaaagaaaaaaaaattctgaatggccttaacagcatcttggagacagaagaaaaagggtcaggaagtttgaagatagatcatatacacgacctgaagaacacagagaaaaataatgaagaataaatgaacaggccaggcacggtagctcacgcttgtaatcccagcactttgggaggccaagccgggtagatcatctgaggtcaggagttcaagaccagcctggccaacatggggaaaccctgtctctactaaaaatacaaaaatgagctggatgtggtggcccatgcctgtaatcccaactacttgggaggctgaggcagaagaatagcttgaacccaggaggtggaggttgcagcaagctgagatcacaccattgcgctccagcctgggtaacaaacaaaactctgtctcaaaaaattaaattaaattaaattaaattaaaaaataggccaggtgtggtggctcatgcctgtaatcccagcactttgggaggtcaacgcaggcagatcacctgaggtcgggagtttgagacccacatgaccaacatggagaaactccatctctactaaaaatacaaaattagccaggctggtggcgcatgcctgtaatcccagctactcgggaggctgaggcaggagaatcgcttgaacctgggaggcggaggttgcgttgagctgagatcacgccattgcactccagcctgagcaacaagaatgaaactccgtctcaaaaaaataaaatataaatgaacagagccttggtggtctgcaggacaaaataaataggactagcatgcatggaataggaatctcatacataaggaagagagagaatggggcagaaaaaaactgaagaaaatttccacatttggtgtgaaaagaagttcaaagaccaagatagacaagggaaaaattacaccttagcaaattgtagcaaaaagttaaaaaaagatcatgccactgcactccagtctgggcaacagagtgagactctgtctcaaaaaaaaaaaaaacaagagtgaaagtgaagagccatttttagatgaaggaaaatgaattgcctgcacacctacactacaagaaatactaaaggagccaggcatggtggtatgtgcctgtagtcccacctactcaagagctgaggcaagagattgcttgagtccaagagtttgagtctagcctgggcaatgctatcatagtctactatgattgcacctgtgagtatctactgcattccagtctggttaacatagtgacacaacaacaacaacaacaacaaaagaatagcttccagccgggcgcggtggctcacgcctgtaatcctagcactttgggaggccgaggcgggcggatcatgaggtcaggagattgagaccatcctggctaacacggtgaaaccccatctctactaaaactacaaaaaattagccaggtgttgcagcaggtgcctgtagtcccagctactctggaggccaagggaggagacttgcttgaacctaagaggcggaggttgcagtaagctgagatattgcaccattgcactccagcctgggcaacaagaatgaaactccatctctaaataaataaataaatagtgtaaataaatactgtataaaatgcaaagcactcagaatagccaaaacaattttgaagtcagaaaatagcacttacatgctctgattttaacattacctataaagctgttgtaaacaagacaatgtggttttggcataaggacagagaaagagaacagagttcagaaatagacccagacttatgctcgttttcaacaaaggcatcaatggaatgaaatggagaaattaaagtcttttcaacaaatggtgctggaataacagattactcacatgggaaagatgaacctagatccctacctcacaccctatataaaagctaatttgagataaatcatggatttaaaaataaaagcaaaaaatgtaaagcttctagaagtatatataagagaatagcttttacagggtgcagtggcaggtgcctatagtcccagctactagggaggctgtggtgggaggatcacttgaggccagcagtttgaggttgtatagtatactatggttgattttgcctgttagtagctgctgcactccagcctggtcaacatagtgagacatcatccaacaaaaaaaaaaaaaaagaaagaaaaacagcttgataagtaaagacaagacatagaaagcaaagcaataacttttttgtgtgtgtgtgtggagacgggtctcactctggcacccagattggagtgcagtggctcaatcttggctcactgcaacccccacctcagcctcctgagtagctgggaccacaggtactcaccaccatgcctggctaattttttgtattttttgtagaaatggggtttcaccatgttgcccaggctggcctcaaactcctgagctcaagggatcctcccacctcagcctcccaaagtgctgggattacaggtgtgacccaccaaacctggccaattctcacatttgtagaagagagttacaaatacggaaagggagaagaatgtagcttgtggtgttaggttgcattttggagaactcaaaatgcagtatgaactcaaggtgttaccatgagtgtgtgtgtatatgtaaaattataaataatacatatggaagtttctactgaacagacctagaaacaatgacaaaccagtaacaacaagcagtcctgacacccagatcttctaaatacatttatccactaaaaggaactaaggttgtttggagaaatggccctttccaaggctagggaaaaaatgctaaaaaattaaggacatgctcagggacatgttgaaagcacacaggaggcagcctacggggcttccactttcctgtagtggaattttgaacaatttgagcatcagagtcagtaatgatagtaatgggttgtaactgcccaaattttgaacaatttcagcgtgcaaataagttatgatagtaatgggttgtaactgcctaaattttgaacaatttcagcgtgcaaataagtaatgatagtaatgggttataactgcccaagtattgaaaaatttcagcatcaaagtaagtaatgaaagtaatgagttataacttattcaataaaatgaaaatgtatgagtccatcctgatataaataactgaataaatgggagaaaaggaaaaggttttctttatggtaaaatgccaattaatatcttaccaatagaaggaatgttggagttagaaagtcatgaatgaatgctaaaactagtgggtgaaaatatgatggggaagaagatatttggataatccaaaaagaacctctgataaattattgattacttataaatgaaaaaatggtacctttaaaagctagaaacctggtgaataccaaaccattttaaccaagtgatcaaagataacatcacctgggataaactgattgtcatttgtgtcctaataagactcactgagaaaaatcatactatcattcagtggtatacctgccttttggcagaatcttaatctaattctgaggaaacatcagacaaatcaaaattgatgacccttaacaaaagaactcgcccatgttcttcaaaaatatcaagcttaagaagcatagtctgaagaactgttacagacaaaagcaaactagagagattgatagttgtacaatgcatgcttctttattggctcaaataaaggagctagaaggacattactgaaatataggtgaaatttgaatgtggaccaaggattagataatagtgtttgattcatgttaaatttcctgatttttgttttgttttgtgagacagggtcacccaggctggagtgcagaggcacaatcatggctcactgcagccttgaactcctaggctcaagtgatccttctgcctcagcctcccaagcagctaggactactagctacatggcacacacaccatgcccggctaaatttatttttaatggagacagggtctcgctgtgcccaggctggtctcaaactcctgggctcaagtgatcctcccacctcggcctcccaaaatgctgggattacaggtgtgagccgccacacttggcccaatttcttgagttttataactgtgcttatgtaagaaagtggccttgttttggggaagtatacactgaaattaaaatttaagagtaagaaggcattgtatctccaactttctctcagatggttcagaaagaaaatattaaagcaaatggagggaaaatataaatggtgactctgggtgaaggaaatttctgtaagtttacaattatatagaaagggaaggagagaagtatgactcctgagagtcactgcaacatttccaaaccaactgccagtggcaggcagggccaccccacacagagcattgcacaggccaccatgagcctgctagcatatgtggtcagtcagtgcttggtcaaatgtggacgacttgagctatcaaatgccagttcatgaaaatgttagttttttgctgtttttctcctttcccagctgaaaatgtagccaaaaaatggcaagtgagtagagaagatcaggacaaggttgcagttctgtcccagaacaggacagagaatgcacagaaagctggccattttgacaaagagattgtaccagttttggtgtcaactagaaaaggtgagtatatcatagtggtttaaacatcaacctatttataggtaagagtaacatctaaaagagtaatacataggaatctttagaaattatatcttagttatgtttttcaggttgcaaatatatgtcctggatacatgaatgtggggagggggtatgctgggtttacaggacacggtaacatgggacctatgtcagcactcaagcactcttggttccagagcgtccatgaccactgtgcacacacagcaggtttcatgagaagctggagcactggctcatggttgttaggaggcaccagctgacctgtttcctgtataggctcaacctcctcagaagtggacacccattacttctcgctgtttctgtgtgatctccatttcacatttctaaagggtggatcttttggggtcactcgctattttctaatacagaatgctcccgtcaagctcccttattgataactgatatctcttatgtcctgccagcagtgcacgattggctttgagactgcctgatccactcactcgtaaccagccaagtactatgacccaaactatagcagaatttggcacaaacaggtccctggtagctactttcctcaggaaggcctatggatttggaaaacacaggtgtctcataaggacatactcataaattgttttcatgtacaataattcttgtgtgtactttcctcctgttgtcatcaaagtggtcacatattaaaacttttctgctaaatatgaatcctcatgtttaatggcagagaacccaccattcccagcacacttacttctgtctctggactaatcttgagtaattggttttcctttgcttaggtcttattgaagttaaaacagatgagtttcctcgccatgggagcaacatagaagccatgtccaagctaaagccttactttcttactgatggaacgggaacagtcaccccagccaatgcttcaggttagattttctgaaggacatctgggggaatactatgttctataatgtctaccgagtgaatatttttctctttatttatatacaaaagtactattttttgggacagggactcactctgccagccaggttcgtgtgcagcaatatgatcattgctcacttgcagcctcaaactcctgggctcaagtgagccccctgccttaacctcccaagtagctgggggactacaggcatgagccaccacacccaactcaatatttatgtacaaaattattcttaaaacagtttaaggaaacatgtcatttctctgtatttgatcattgacttaacctatactgaaagaattaatttggtttcttgacatcccaactagacatacaaatgaagaagtaaattagggaacttcagtttatctacctttgtatttttccagtaccagaaactcccaatacctccttgtgaagcccaggcttattcttccatttcctgtcagagatctcccctccccaactgctgtaatcctttttttttctttttgagacggagcctcactctgtcgcccaggctggagtgcagtggtgcaatcttggctcactgcaatctccgcctcccaggttcaagcaattctcctgtctcagcctcctgagtggctgggactacaggcgcacaccaccacaccggctgatttttctattttaagtagagatggctttcaccctattggtcaggctggtctcaaactcctgacctcaggtgattcaccctcctccacctcccaaagtgctgggattacaggcgtgagccaccacgcccagccccgactactgtaatcctaccactttctctagttggaaagttttgtggtcaatatattgccaaacataatttctatgtaaagtctgttgaattatagtaaatgccttagccaacaggtaaaatcatttaactcatgtcttcaggtggtaaagaagccacagatatgtaactgaggttaataagcatggtagaaattaagtcactcatattttacaggaataaatgatggtgctgcagctgtcgttcttatgaagaagtcagaagctgataaacgtgggcttacacctttagcacggatagtttcctggtcccaagtgggtgtggagccttccattatgggaataggaccaattccagccataaagcaagctgtgagtataaccctattcccttttatgaaatttgtcttcctgttagccttaagtgagcttattcatgtagttagctctagtctttccctaccagaagagtaaccaagagcatttatttctatttttgagataaggtcttgctctgttgtccaggctggagtgcagtggcaccatcatagctcactgcagcctcaaaactcctaggctcaaatattcctcctgccttagcctcccattacctcgaactacaggtgcaccacgccttcttcatttcgtagagacaaggtctatgtcgcccaggctggttttgaactcctgagttcaattgatcctcttgccttaggctccccaagtgttgagatttcaggtgtgagccactacccccagccactgagagcatttggatcacatgctttctaggggaactgattctgttacattagccttaggtacacataacagatgctactggttcaaaattttaagacaatttagaatttctaagggatcttttagatcacacccttaaccttttggatggaatggatgtcactaaggcaaaaatgtgtgagaatgtcactgtattaacctaagaacaaaccaaagtagcagttaccagtatcatgcagcatatatttatgttgacaaagaatggtttaactttagcctttccacccaagtttagacctcttttctatgaatctttcctctaggttacaaaagcaggttggtcactggaagatgttgacatatttgaaatcaatgaagcctttgcagctgtctctgctgcaatagttaaagaacttggattaaacccagagaaggtaaagatgcacaagtaaccctgagagcttaccagtgaatttcacaatccaattttaagatagtatcttctaggtgttggccatgtgggtaatagttaaagaaatactagttactaggactgagttcattacttcccaaggtaaaaaaaaaaaaaaaaaaaaaaagacattggcttacttggcataaaaggaacgaggtaagataggcagggatgaattttcacaaaggtgtaaatttattcctaagcagttaaaatgaaaatttgagtttgaaagggtagcatgctgatacattaagaggaaaaagacaagtttaagattttaaactgtgtccacagaagaataaacaatctaaatcttttctcccccgctaggtcaatattgaaggaggggctatagccttgggccaccctcttggagcatctggctgtcgaattcttgtgaccctgttacacacactggagagaatgggcagaagtcgtggtgttgcagccctgtgcattgggggtgggatgggaatagcaatgtgtgttcagagagaatgaattgcttaaactttgaacaacctcaatttctttttaaactaataaagtactaggttgcaatatgtgaaatcagaggaccaaagtacagatggaaaccatttcctacatcacaaaaacccaagtttacagcttgtactttactttaatgtgtaatactcaactcaaggtacaagacaattgcatttaacattgttataaataaaaggaacatcagatcaatcattaagggctccagagtgaacagcatcttcataacttccatgtttatcatctttactttctggatgtaatttaataagatcatcaattcgaagaatggtgattgcagcttctgttgcaaatttcaaactcttaactttaactatggttggttcaaacacccctgcttgtttgttgtctcgaggtttaccattgctcaaatcaagaccaatcctgcaattaagaaagaattatttaacggccgcttacaatttcattaggtggcctattaactccagcatttcattcaagtattaaggttgatttttaaatcagactagagatcttgtaggtagtctttctaccaaaagaagcagggagagattagcaatcacagttaacgaagacacaccagtgctaataattagtcattatcccttgaattacagtgactgaacaacaaatgcttgctgtgaagtttttcatgttaagtatttgacaagtctgttacttatgtttgctgacatgtaattgactactatcctttttaatgcaacctgttctgcagaggttaacaaagagcgggaaaccatgcttaccattttagatttttacgttctgggttaacctgggcctcattatgaaaagctcttaattttgcaaccagatctgtggagtcctgggcagcattaactgctagtgtattgggaataacaagaagtgatcttgcaaactctgcaatcgcaagctgttcccgagacccctaggaaaagaagaaaattaggtgacttcacaaaagggaaaaaaaaaattgaagtccacagctactgctctcaggcctctaagacaagaaatgactgttcttaccatgctggttgcatagttttcaaggtatatggaaagggctgcttctacagcacccccaccgggaaccacagattttgactccaaaactctcttcactacacaaagtgcatcatgtaaagagcgctccatctcatcacacatgaaatcatttgccccacgtaagataatcgatgcagacgtacgagccttagtactgttcaaaacaaaagtacaattcttgtaatagcatttttaaaaatttttttttgccaagaccatcaatttctcaaaaaaaatggcattttaataaaataagtctacataaagttcccttaagtcctgcctacacaggatatttagatatactatacagaaacaatgtctagtccctgcagaagagatgaaaatggttacttcatctcaatttacagtggcccaatgttattttatcccatgcgtataactgctcgtatcactgtgagactacaagcagcaaataaatgggaagaaaacctacttttacttaacaaaatcggtataactttacaattttagaaagtggctcttactttttgattaagatcagctcatcatcacaaattctctcctgtaccacttcttctgcctgtcccaacattgcagcttcaaaagtttcttcaccttccaaattggccagggttgacagaatagttgctaataagagagttacaaaggatctgtgaatattgctctttcatgattttaatatccttggactcagtagcatttgtggtaaaagtgctatattacaagtttagaatttagttaggcagcacacggtaactccttttatcctaagatggaactgtcattttagaaatgaacaaattcagttcacaaatttccaacaaaatttctccagttacatgaaaaatggctctataaatgtgttggtagcacaaagcattaagagaatataaatgtttttgagctgttttctgtcaatattccaatgtaaaaagacctttgataggatcagggataataaaagtattttatgtgacagccagcacaagacatacctccagaagctttggcaatgcgtttaaggtccctttttaaaactcttctaactgccatagcaccagcctccacaaaatacttcagacacatatcatcaattccaccagtggttagaataac

SEQ ID NO: 15915 - DNA, 21002 bp, Human; identical to SEQ ID NO: 15914

SEQ ID NO: 15916 - DNA, 15033 bp, Human
aatcctgtggattcatccttcaaaatgcccttttcttccagttctcatagctagtgccctaaaagtgacctgcagtacctcctgctgagacgaatgtaccagcttcctaactagcctgcactcccttcatccccccaagtcagtgccagaccaccttgcctgaaaaaccactttcagtgtgtctcacctcagcagaaatgtttctcagcttccaattaacaatcacatcaaacccctgctcttgtctgcgttttaagggtatctataggccgggcgccgtggctcctacctgtaatcccagcactttggaaggccgaggcgggcagatcacttgaggtcaggcgttcgagaccatcctgaccaacatagtgaaaccccgtctctaccaaaaatacaaaaaaaaaaaaaaatagtggggcgtggaggtgcacgcctgtaattccagctactcgggaggctgaggcaggagaatcgcttgaacccgggaggcagaggttccagtgagccgacatcgcgacacagtactccagcctgagcgacagagcgaggctgtgtctcaaaaataaataaataataaattaaaaaaataagagtatctataacctggtcccagcctgaatttcctttttcaccccaacacgtagccctagttacattcttctgacgtctgtaaacaagcccagcccttcctgttgtgaagccaagttcaggtggttcctcttcgcctgactgttttcccattccacttaccggaagcctagtcatccttcggagggctgtacgggggttgcaagaagcaacggaaacggttcagcacctgctaccttccatcatattcttttcaataaaggggcaactcccgccaatggcagtgtagatttcctaacctctacacatggaagattcacaccattcaggattgttgtttaactgttgagagagcacttgatacttaacagcttactaggctacaagacagcgcaggaaagaatcctctgttgtccttttatgttatcctgaacagttggttcacagagttactgtaaacacacaaaacatgactgccagggcttagtagtgaggaaggtgggaactagtcctgactcagttaactgtgcccaggagaagctgcttaacctcaaaggatttcactattactagaatcaataataccaaccctaggggtaaaaataaagataaatgtgtgcaaatcctgcctgcagtctcgggcacgtcgtgggtgtccaagaactgttcttaggcagccggtggggacaaagtctgtgtgcctcctgtcctggaataggtcccaaggtcggcttacttgcaaagcaagggtacggcgcaagagtactgaatacgggttggaagggcgctggctctaccctcagctcataggccggctgggcggcgctgaccagcagctaggccccgtcttccctaggaacggccacgggggccctgggagggtatgaatgtctttttgcagtgaggcctctggaccccgcggccccccggcagcgcaaccaaaactcaggggcaggcgccgcagccgcctagtgcagccagatccccgccggcaccctcaggggcggagccggaggcagggccttcgggccgtaccaactccacgggggcaggggccgcctcccttcggccgcgcgccactcaagtacggcagacaggcagcgaggttgccgaggccgaggctagcctgcagcctcctttctcccgtgccctgggcgcggggtgtacggcaagcgcgggcgggcgggacaggcacgcagggcacccccggggttgggcgcggcgggcgcggggcggggcccgcggggggggggggcggggcggcggtgcccttgcggcgcagctggggtcgcggccctgctccccgcgctttcttaaggcccgcgggcggcgcaggagcggcactcgtggctgtggtggcttcggcagcggcttcagcagatcggcggcatcagcggtagcaccagcactagcagcatgttgagccgggcagtgtgcgggtgagaagaaaggggacccggtcacggccccaagggcgaaggggctcgcggcgggcagggcctccgcggcaatggcgacagtggccgcaccgggcctggcgggaccggggcacctgcaggcggttctcccgggagtgcccggcgcggcggctggagcggggatccgcagggaggggacgcggggactcgggggacgccgcgcgctgccgttcctcggcagcccagcctgcgtagacggtcccgcggcgctgactgaccgggctgtgctttctcgtcttcagcaccagcaggcagctggctccggttttggggtatctgggctccaggcagaagcacagcctccccgacctgccctacgactacggcgccctggaacctcacatcaacgcgcagatcatgcagctgcaccacagcaagcaccacgcggcctacgtgaacaacctgaacgtcaccgaggagaagtaccaggaggcgttggccaagggtaggttccaggctgagcggcgggaggcagtccccggcagaggcgaccccagggagccaggccccatacggacgggcctctccgtggaggagaactcgcttcgtatttgtaccggttccgagttttccaggcacgatagtctctcttttaaacacatggtctacctcattgtagaaggagtgcctcgatgggtttgaacacacttctgtcatctcagggaacttggggtcctgcgaaggagcttgccttactgttgtgagccacattccgttacacatattgccagcactggtgaattgtagggcctgaaaagaaagctctactgtgtcactcgttttttttgcaaattgaaattgttcttgttgtataatatgctttggggaaatgtttggtctctcaggtaggtgtgccagccgtttgcaggagggctgagagcgcctgtccactggtggccagacatcatcgggtccgcaggtgtctctgagtgtcagggtcacctcctgatagaagtgggagtggtgtcttactgccaggtcacactgaaggtgggagacaggaggacactactccgtgctaggaaccatggtccttgtcatcttcctgagagcaaacggggtcgggactccagcctaggacttggagactccctgcatccccagctaccctgcaggtgaaacttcactgagcccacttgacttcaggtgggagaggaggaggcacaccgttgtggtgtgcgttaccaaaaaagcagtaacctaactgtggaacagttcaggatctttagacttgatacttttcttgatttcccttaggggtcaaagttcacaaggaaaatagccctttagtgggaaactgaaacaggcttgtttttatttactatttactcatatttgtaatgcaattaaaatatatgttgttaactttttttttttttctcaagagctcggttgataaaaccaggggtatgtggactttttgagtctgtgccttttgggggtgtgtatgggaatgttatgttttaacgttttttacaaaatagtattgtctttttaatttattcgttagtggtttgcacaaggaagataatcgatagtcatgttttttagactctctgtattgcttggtaagctacgtagtaaaaaatgtttacttttccttaaatgttttgaatttcggggttatgaaatttgttgagtaatttttagacagtcacatcttgttgactggaggcatctagtggaaaaatgcagtatttcagcctgattgtgtttgaagtaaatgattaaaagaggaggaagttaccacattctggaagatttacttgagacagacgaaccttgaattacgggaaaaggccccgtgatttaggaaataacaaatttgggaaacatgtaatggggagagactggggaataccccagttgtgaaagtacttcctgtaaggcaacatctgacaccaggaacctttctcttcagtattttaaaaacaacttaatttcagtcctttacttgtggaatcagagccttacttatgtaatacaacccactggaaaaaagctttttattgtattgtactatattgtttataagtgattgagtacctgcagagctttcttttacttaaacatattttaaaaattattaaaaagattttcatgtttgaaaacttggggaaaaaagataaaacaatgtcataatctcatcacatttaactgactaatatgaatatttttcaacaaaaagcatttgacttttattattatttgaggcaaaaactaaactgaaaccaaataaaatgttgaatttcagaaaagtgttcttaaaagcagatattaagccctcaatttttattaattttaaaatgagtaagcaaactgtaagatgttaagattattaaattatctctcattaagcatgtatctttcccattttaaaaattcagttactattgatttattaaaaaacaatagaaaagttacatctatttttagagtgactctcaagaaaatttaataagggaaacacagatctataaaaaactgtttgtaaacctaacaaaggaaaaaaaaagttggtgtctttaaaaaaccctttgagattagctgtgtattcagatatcagttggttctctcctttctgaatcgctaaacaactggagcttgtttcagaaagcagcattgtctacgtatgttccttttaaaaattttttttttaattctatctaaaaaaaacagacggggtcacactatgttgcccaggctgctcttgaattcctgggctcccctatccacgcacctcggccttccagagtgctgggattacaggtgtgagccaccgtgcctagtcagacatacttttttttttttttttttttttgacggaatctcagtctgtcccgcaggttggagtgcagtgatgtgatctcggctcactacaacctccgtctcctgggttcaagtaattctcctgcctcagcctcctgagtagctgggattacaggcgtacgccaccacgcctggctactttttgtgggttttttagtagagacagggtttttccatgtcgtccaggctggtctggaactcctgacctcaagtgatccgcccatctcggcctcctaaagtgctgggattacaggcgtgagccacctcacctggccttgtatgtatgtttttttctttttctttctttttttttttctgtgacggagtattgccctgtcgcccaggctggactgcagtggcgtgttcttggttcactgcaacctctgcctcctgggttcaagccattctcctgcctcatgctcctgagtagctgggattataggcacgcgccaccatacctggctaatttctgtatttttagtgaagacagggtttcaccatgttggccaggccggtcttgaaatcctgacctgaagagagctgcccgcctcggcttcccaaagtgctgagattacaggcgtgagccaccgcacccggcccagacatatgttcttaacgtacactttcagaacagcagttgagaactttttccaaaatgtaagctccttgagagcaaagctctcagtgggtctctgtgtcctttactttgcttctcttggtatcttgtggataatatgcacaaaatatttattaaacaagaggatttccatttttttctaatattaatagttcatttagtctgtagcttcttgaaggcatagaaaagactattttattttgcctacttatttggcaaggtacccatgcagtatgccaggagttacagggcctattgagaaggagtaaagggtctgggaggggtggcagggagttgctaattcatgtatggtggctagagaaggcttcactgatggggttgatgtttcagtggagacttgaaggaggaacaggaacgcagcatgagactgtcttggggaagagtgttcagcagaggcagcagtgctcagctagccttgaggggaacatccaagttggtcatgtgagtgcaaaaaggccagtgaggctgcagctgcgtgagcacgtgctcaatgacggggtcaagtgcagcgcctcttggtagtaagagtagctgagtgtaaacacctagggttcgctccagtgagaaggggagcctttggagggggcaaggcccacccccaccccccaaaactgaggggatagtggcaccagtgcagtgagaaatactggtcctctgtcccaatgaggtggcagtagagttagggagaagggattaggttctgcttgtgttttatttttttcttttatttttctctgtgtgcttttatatagattggatgtattttaaaggtagagctggctttgctaatggatatgctggtggattggatgtggggtgaagggagaggagtcaaaaatgacatcaggttcccaaggatgtcctgagggacagagctggcatttactgagacgtggaggacaataggaggagtaagtttggggtagaacatcaggagttcaattttgagtatgttgagtttcttgttaatgtgacttggagatatttcccaatgaatcgtcgtctgtcttgaaagtgagagttgaaggttttctgtacagtctgtatgttgagccatacattttagcattctattattttgattgtcctctttggtgtttcatttcctaaaatctcttctatctaagagatccctgagcctagcagccaggagtgaattttctagcttttccacctctgctaggtccttcatcagttgttcagcatgtctgggacaaataattttggggcgggggggtgctgaattttaggacaaacggatgttatagataagctggtcccattatctaatagcttacaaagaaaaaaatataatgtatacagtggttgaaaaagtaggagttacaaaaaaatgtgtttgcattttaacttttcaggagatgttacagcccagatagctcttcagcctgcactgaagttcaatggtggtggtcatatcaatcatagcattttctggacaaacctcagccctaacggtggtggagaacccaaaggttggtatatattggtgcacccttatctacattttgtgcacagtaggaatcgattgttgatttactgaagttaccttatacttgttttttgttttttttgttgttgtttttttgagacaagagttttgctcttgttgcccaggctggagtacagtggcgcagtcttggctcactgcaacctccgcttcctgggttcaagtgattctcctgcctcagcctcccaagtagctgggattacaggcgcccgccaccacgcctggctaatttttgcatttttagtagagatgaggtttcattcaccatgttggccaggctggtcttgaactcctgacctcatgatctgcccaccttggcctcccaaagtgctgggattacaggcatgagccaccgtgcctggcctaagttaccttattcttaccagaggtatcatagtggcatatttttcataacaacgagtatgataaaagttgtaactttcaaaaggacacaagtaggaatggagaatgctttcatggggttatgtcataagattttatgttcacgccaacatagaatatcacatcaactccaccttctggtttctggatggtacttcatattagggaaagactgagagacttcattttatgaactttttttttttgagacggagtcttacagtcgcccaggctggagcgcagtggtgcaatgtcggctcattgcaacctccgcctttcaggttcatgcaattctcgtgtctcagccacccaagtagctgggattacaggcatgtggcatcactcccggctaatttttatatttttggtagagacagggtttcaccatgttggcggggctggtctcgaactcctggcctcaagtgatccacccaccttggcctcccaaagtgctgtggtatggatgtgagccaccgcgccagtctagaaaagatgaactttctgtctactagtttctagggcctggattagatagttaaccgtctgtaccttttttcatctatgtgatacagggataacaatggtgttgttttgagaattaaattatagtgtcatttgctatttttcactctttcctaactgataaaaagtcagttgttccaggaaattaggttttctgggtatttttaaaaagtgttcagggaatgaggagagtacagggctagatggtcttgttcgctatcactgtttccttgacttcctgtgtagcttgtggaggcccagatgactttaattatcttcttcacccagggagggcatgaggcgtaaatgtagttcttgtctcttgtttctgggctccggatatgcaccctaagtttctgtggttttattgttcatttttaatcagtgttatggaaggcagcctatcttatgcacttgaaataagcaatttcattttaaggtaatgatgaatgaggagagtaagcttgggaaactgggcaactttttctttatttttgtttttatttattattattttggagatggagtttagctctttcgcccaggctacagtgaagtggcttgatcttggctcactgcagcctctgcccatcccgggttcaagtgattctctgcctcagcctcccgagtagctgggattataggtgcctgccaccatgcccggctaatttttttgtatttttagtagagaggagtttctccatgttggtcaggctggttttgaactcctgacctcaggtgatccacctgtcttggcctcccaaagtactaagattacaggtgtgagccaccgtgcctggccaacttattttttttctgagttcagtcttctagactatcggttaatacttttgaagttttgtcagttaccagaatatcagatatattcatatgcaaccagtggttttggtatgctgccatttttgtttaatctgtaccacattccatcatttgtgcttataaagatgattacttttaaacccgtagaataagagaagtgagattttgacccagttgatttagttgatgtgactaatctagaattatattctgtattactacagaataaaaggattacagctcttaaagtatacccttagttcagtcgtagagaaaactgcccatcaagacaggaagagctgggctgccttggagaagaacaatgactttattcccaaatggaggcgtagaagaaggagggtagaagtcaaaggaaaattttctattcagggaaaagaaaaagctaacagaaagtagtatttctttcctaacaaagatagtacagtgagtggggaaatccctctaacacgattcattaaaaaatgtgaactacgcagctggaggccattatcctaagcgaattaacccaggaacagaaaaccaaataccacatgtctcacttgcaagtggaagctaaacatggagtacttatggatataaaaatggcagcaacagacactgaggacagagcagggagggagaaagaaggggacggggggtgaaaactgttgtatactaagctcgctacctgggtgatggcatcaattgcaccccagacctcagcatcatatgatacccgtgtaacaaacctgtgcgtgtaccctctgaatttaaaataaaatttgaaccgggcacggtggctcacgcctgtattcccagcactttgggaggccaaggcgggtggatcacctgaggttgggagtttgagaccagcctgaccaacatggagaaaccctgtctctactaaaaacacaaaattagccgggcgtgatggcacgtgcctgtaatcgcagctgctcgggaggctaaggcaggagaattgcttgaacctgggaggcagaggttgcagtgacccgagatcatggcattgcactccagcctgggcaacaagagtgaaactccgtctcaaaaggtaaaaaatgaaaaaaaaaaaaaaaaaaaaaaaaagttgaagttataaaaaacaaaaacgtgaattaaaattgtgaaacttagatccaggtgtcgcattctgatgttgtctaatttcttgggccctatgacaaaaatattttaatacatgtaatataacatgttactgtaattattgaaatctgttcatttgtgggtgtttttggattttttttttaataggggagttgctggaagccatcaaacgtgactttggttcctttgacaagtttaaggagaagctgacggctgcatctgttggtgtccaaggctcaggttggggttggcttggtttcaataaggaacggggacacttacaaattgctgcttgtccaaatcaggatccactgcaaggaacaacaggttagatttaaaaattgtgatttcatttgggagagatgctctactgtaaagcattcaactagaaataaggaaaactaacagtgttttaagaacatgtaataatttgcaaatcttaacagataacacccagagtcttgtgtaagtaaaaatgttttagaagtcctgatatttcataaaattaagtacacgtaattttataggtacattaacaaacatgttttatttttatttattttttttgagacagatctcactgttgcccaggctggagtgcagtggtgcgatctcggttcactgcaacctccgcctcctgggttcaagtgattctcctgcctcagcctcccaaatagctgggattacaggcacataccaccatgcccagctaatttttgtgtttttagtacagacagggtttcaccatgttggccaggctggtcttgaactcctgacctcaggtatctgcctgcctcggcctcctgaagtgctgggattacaggcatgagccaccatgcccagccaaatgttttacttattaaccctgcttcattctacagagaattaatatcagcttagataattatatgtactaaaataaaaaaaaaattagctatagaacaagagtgaggaaaagaaatacaagcagagactgatttcagagcttgtactgttacctcctctgctgagcatttgaggttaaactgggactagatctcaggtttccagaccttctgcctttctggggctctttggtagagtatatgaaaatattcggcttggaagtgccaggctgggctcaccaaatactttgctgttgagcctaattggatttaaaaaatgtcactgaagagtatgggaaatagagccatgagttgtctggcagagggttgggactttgaacttaaagtgataccttcacatcaacaacagtcattctctgccccttcttctacccctgacattggaatactcttgatctgtggctcacttcacaggatagacccagattttggcagaatctgaacagctcttttgggacagtgacatggcataacaatttgtaaaagccacaaaaaatttgtaagcaccgatctgtagagtcaggttatttgtagagctgcatgaccagaaaggctgatatttgtaagtgagtcccagctacactccttcctctccctgtggaaagcacattagaaggaaaatgagggaatgtcatggccttttgtttataaaaatcattaataaattttgctacttgaaattattaataataaattactagtgacctccctcacaactgatcaagacatactggttaagaattgtttttgtagagagagctataatttattttgagtgtttttgtgtgtgcgtgatggagtctcactctgttgcccaggctggagtgcagtggcgcaatcttggctcactacaacttccgcctcccaggttcaagcaattctcctgcgtcagcttcctgagtagctgggattacaggcgcctgccacctcgccaggctaattttttgtatttttagtagaggcggggtttcaccatgttggccaggctggtctcgaacgcctgacctcaagagatctgcctgcctcggcctcccaaagtgctgggattacaggcctgagccactgcgcccagaccaaaagtttttttaaatggatgttttacagatagaactaaattcttcatttacctcacttaatttctgaaaacactgtgtcctccaactgctctgtattcccaaagattaaaattagccttggggagcagagctggttcctcgtaaacccctgtgagtgcccagaccctttggaggaggttctcagtgggcttttgcctgctcccacagatgtaacccacccttcctgctgctcctaagaccaccatgaggaaggctgggaattggctcttgaattaatttgttggtatttttaagaatagctattaaagtactgttgttaattttcccaagtctattttattgttagtatttgtcacattttctttgtaaacagtgaattaaaaatattttataggaatattcattcttatctagatttcctacttatataaaaaaacaagtgaatgagattgttacaaagggtaattttgtgtgagtagaataataaaagttgaaattgagaagatgcaatgttttagactgaaactgatggttggtttgttttccccttctttctaacaggccttattccactgctggggattgatgtgtgggagcacgcttactaccttcagtataaaaatgtcaggcctgattatctaaaagctatttggaatgtaatcaactgggagaatgtaactgaaagatacatggcttgcaaaaagtaaaccacgatcgttatgctgagtatgttaagctctttatgactgtttttgtagtggtatagagtactgcagaatacagtaagctgctctattgtagcatttcttgatgttgcttagtcacttatttcataaacaacttaatgttctgaataatttcttactaaacattttgttattgggcaagtgattgaaaatagtaaatgctttgtgtgattgaatctgattggacattttcttcagagagctaaattacaattgtcatttataaaaccatcaaaaatattccatccatatactttggggacttgtagggatgcctttctagtcctattctattgcagttatagaaaatctagtcttttgccccagttacttaaaaataaaatattaacactttcccaagggaaacactcggctttctatagaaaattgcactttttgtcgagtaatcctctgcagtgatacttctggtagatgtcacccagtggtttttgttaggtcaaatgttcctgtatagtttttgcaaatagagctgtatactgtttaaatgtagcaggtgaactgaactggggtttgctcacctgcacagtaaaggcaaacttcaacagcaaaactgcaaaaaggtggtttttgcagtaggagaaaggaggatgtttatttgcagggcgccaagcaaggagaattgggcagctcatgcttgagacccaatctccatgatgacctacaagctagagtatttaaaggcagtggtaaatttcaggaaagcagaagttaaaggcaaaattgtaaatcagtcgagatcgggtgccttcagggtggtatggctgtataccaaaattgtaaatcactacatgaagcttatatattggtttggcctgaaaggtgaagtggggtaggcagggggcgggcttacaggttatggtggattcaaagactccctgatttgtgattggttaaggaagcaaagctttgtctaaaaacttggggtccgcagaaaggaacattaaggtctggccaggcccctcaggaagaaactgagagcaaagaatggaggtcagagtttagtccctggtgttcccccttatctgacgtctgtgtgaatccatttggtgggggtctgggtttctgaaaagtagctcaggggcacgtgttaaggatgtctctaggtgactctaacttccctggctattgtttgaaactgttatgaccttcttgcttatcagcttgctggtttccttctcggggcgagctgggtgcctggagttttcggtgaaggaaactcaagattctcctttatttctgtgcttgtgggaatccccctggcacaccccaaagaggggtccctgctccgtctcacagggatctttttgtatatttggcttagcatcatacatttgccatgttgtttcatcatctgcctaatttactgtttttgaatatttcatttgtttctaattgttactacagataatgctggggtgagcaactctgtgtacataggtttatctcctattggaatattttctttatataggcgttttttttttttctttttttttggagacagagtcttgctctgttgcccaggctggagtgcagtggcgcgaccggagctcactgcaacctccacttcccgggttcaagtgattgtcccacctcagcctcctgaatagctgggattacaggtgcatgctaccatgcctggctactttttgtatttttagcagagacagggtttcaccatgttggccagggtggtctcgaactcctgacctcaagtgatccgtctggctcagcctcccaaagtgctgggattacaggtgtgagccactgcacctggcctatataggcttttttcttaaacctatttagtaatgttttcccaagtttattttttatttttaattttttccccaagtttatttttctatttttttttcatggaaaaatggggtaacttagcagtttcaatattgaagactgaagtttaaaaaaaatttaaattcaaggtacttttaaaattcagttagaaaagtaggctttaaaaattattagagacaagagtaccaaagcggtgtgtgtatgtgtgtgtgtgtatgcatgcttgtggattggaaaaactttggagactgattacttttcattatatatgtgtcacagtgaaacagcttttatgtgtcatgtaagattactgcttgcctctctaaggaaggtcgtgactgtttaaatagacgggcaaggtggaaccttttgaaagatgagcttttgaatataagttgtctgctagatcatggtttgtattgaactaacaaggtttgcagatctgctgacttatataaagctttttgattcctact

SEQ ID NO: 15917 - DNA, 14781 bp, Human
ccctccatgttcatcttgggccattcatcctctgcccattgagcttcagatccacaagcccttcagttcctcaccccagcagtttcctttgctaggactgctctttctggcagatgactaggcttcttcctctttcagatctcaccttcttaaatgtcacctcagacaggcaggtatcctgtccgctactgtaacatcctctttaaatagcccccatcacacctatttgttgtttgttccagcccctccgcgaaccctgcctctacccgccgcatggcagctacctgggagagtgcctggagttgaatgaatgaaaatagtctgtagggtgcactgcccttgtcaatcacaagcagatttaattacctgtgccagaactcacgggagggaaacaccgtccgccagccccgctctttcctggctacagataaaagctccaggttccgggggttccggttggtgaattctggggcgacagcttcattttccacagggtccacttcaggtttcgctgccggctcggagctggttgacagggctgcgaacctgcaccctgggcaacgggaaaaaccgcacagggcttaaaaatgacggatatggacagcgcacgaacccgctctaacgtctatccgcttttacacccccaatctttaggcccgaggggacgaaaaatacgtatgcccacagggtggagtcagcactgaccccgtccttaacttcctactgtggtcttcgcagtgccgcgagctctatttcgatccggcacgtcgaatacaaaatagaacccgcacgttccaatgtactgtgcaagcccaggcgagtgagctgggagaaggggggcaagactaattaccagggttcctgcaaaccgagaacccccaaaactgcgaccgaagcgccatcgctgagacgatctcggaaaagcctcgcctctttttcctcacggacgactcagtcgctcgccaggcgcagccatataaagtcagggacaagcctttggctgctgtagatccccaaactctccacgccagacgccgccgacccggaagtagcaagtcccctgccactgagtggccaagaaggcgatctgttatcctgcaccgccaatcatcgctcacgtcgaggggcacgcaggccctggagcccaccaaccacctcgtagctacgcccaagaccacgcttgttgcttaagtccggggtcaaaggcacacaccccacaaaaccatgtttgggttttctactcggagagcttgggcggtcattgactggtccacacacaccccacctgggcaccgcgtaggaataaggcagggcaagatgcagttttctccttaaaaagggtggttgtcttcctcgaaccaaaaattttcccgtatggcccgctggaaaaactgccccgtcccacccaggttcgcgcccttaaacttacactcctgaggcctggagcaaagccggccgatctgcctcacgctccccgagcagggacaaggaaaagacactaaacctaaaacgcacgactcgctcagaaccccaactctaacttggagaagggcccgcccctccagttacaccccagctccaagctccacccttcttacaaccttttctagaaggcactagaatggcccactgcgtctgcgcaacatcgtttgaggcgaaggttcaacctcttcccagcggtccaacatccgacttccgttctccgctttcgcgcccttcccatcggctatctaattggacaaaaatgccgaccccgccccttccccggagcctcacttccgtcacagtcctgtttctctccctgttgtccctgcctctttttccttcccgccgtgccccgcggccgggccggggcagccgggaagcgggtggggtggtgtgttacccagtagctcctgggacatcgctcgggtacgctccacgccgtcgcagccactgctgtggtcgccggtcggccgaggggccgcgatactggttgcccgcggtgtaagcagaattcgacgtgtatcgctgccgtcaagatggaggggcctttgtccgtgttcggtgaccgcagcactggggaaacgatccgctcccaaaacggtaagggcgggccgggcctgggtcgggtttgcggccggggagggccgagtcccaccgcgaccggaccccggctgccctcgtttctctcctttacctccgcagaaagggcctcggggccccgcagccggacccagcccacccgccgttctctggggcagggcgctgtggccccacttttcccacagcgaggaggagccccgccgcgcgcggcagggttttgagaccggcaacgcgtggatgtggtgtccggggcggcgttggaaacgcgccctccgcgggaaagcgggcctcccgggctcgcacgtgcgggccacgcctcgcacccccttttgtttcagggcgaccccctgagtgtccatgttaaacgccaggttttattttaggaccatttaccagaaaaagagtaggtccatccgcgcgccctcggatgagcccggtgccctgtccgcccgcagctgcagtcgaggtcgggcgtccggcgtccagccgtatccgggttgacagcttcttacagtagagttagcccaggaaacgccactcgagtgcattgaccccaggagacggcagcgctaacttagcagagcgtttgctgtcaggcctttggatacctacagagcttactgtttcttgatagattcctaatttttttcgtaaacaaatctgaaagtcaccaccttccccgttgactaccgatttctctcctcacagataaagagagttttaatgagcaaaaaacttgcagaatctgaaggaaaaggctggtatagctgtacgaagtggcagagcatgaaattggtggttattactttttttttttttccccgccatcagattccaccccgcatcaaagctgtgccaaataggctcgctttgtttagggacagggtcccacctgtcgcccagacgagagtgccatcatagctcactgcattctccaagcacaggtccgcgccgccgcatccggctttgtttttattttttgtagaaatgggtttcgctatgttgcccaaaggggtctcaaactcctggcatcaagcgatcctcctgcctcggcctcgcagtgttgggattacacctgtgagccacagtgtctggccccatttacactcttagtaggtggtttttaaataattaacacagatttgtagatttgggaaatacgggggctgttggatgtcatttacctttaggctgaaattactgtctttcagagttgtggcttatcctcatttcttttttatttttaattgattgtctacagttatggctgcagcttcgattgccaatattgtaaaaagttctcttggtccagttggcttggataaaatgttggtggatgatattggtgtaagtacacataactgttgtgttagtttccttaaagtaaaactatcttcagtgttttgctatgttctttctttgactttatcagaatccacgtactggaaggtgatattaaaggtgaacgtgtattataatggggctgtgttgatttctataagtggttcatattttttcctgcgaatttcttaggatgtaaccattactaacgatggtgcaaccatcctgaagttactggaggtagaacatcctgcagctaaagttctttgtgagctggctgatctgcaagacaaagaagttggagatggaactacttcagtggtaggtagactggctaaagaatgatcatttttctaaaaacgaccgactttcagaaagttgaagccataagtgggtcatttgtgctgtgtcagaaataagttacatattctgaatgcccagaagattgagcaagaagaaaaaacaaaagaagttacacatttaagaggggaaataagcttcttaggtacagattcagaaacaaaatttgtaagttgatagttacagctagtttgtacagtttaagtaggaaagaatttgagttcatttgacatagccccattgttttaaatgttggtattcacaagttttgagggcttatttttccttttatggcagtattcagacatcacacagatttttttatggtctctcaaaagtcttgtttcctcccccatcaccccttgagacttggaaagctctcaacttttctgattatttggaggataaaatgttaccaatctgggggagaaacaatgtttttatattattatttttaagagaccatctgtagcacagtctgaagtgctgcagtgctgtcatatctcactgcagcctggaactcctgggttcaagcaatcctcctgccttagcctcccagagtgcttgggattgcaggcatgtgccaccacaagcaactaattaaaaacctcttttttttttttttaagagacagggtctcgctatgttgcccaggctggtcttgaactcctggcctcaagtgatcctcccttctcggcctctgtagtgctgggattacacgcatgagctgcactcagcctgttctattttttaaatcctgacaggtaatctcaggaattcaaaatgggagtgtgagaaattaataaatacatcatgatatgacagtgtgatcttaccgagtcagtaaatgtgatacacagtataaactcttcatagatcatccagcatgctggtatagtagaaacactattgtttggtgagaaagatgttaattctggagaaactagatagtttgtggggaaaatgtatttctagattaaactttagccatgaaagaatggaatctactcctaaaatatgaatatgatctttgtctaacttacgataatgtgatttaacaaatgtagttttccttccataagaagctgacagtctttttgctttaaaaatatttcttagtgttttatcaacttgaagaactatcttttttaaataaaataatagcctaatataggtcatatgaatagtcacactcggtttagcttctgttgagcattttttctaaaggtaatagatgtgttgtcttttacggttgtattgatgaactagtttcttattgctgaactagtttcttagaacatttttctggctcctacccagttttggccatttgcatttataatacaataagacctcactgaacatccacagtggcttcatggaaactgactttaagaggaaagatgatgtataaaaaaacaagttttcctccccccatcagcgttacaataaacaactgtatttgagaaattgctgtccattgttttgcttaaagtggcagtttccaagaatttatgagtaacgtggaggacttggagtgttttgtagcgttcttctcccttcacgcccaggtttctaataaccagttaattcatttcatcactaccattttggttaataatatatggccattttagtgtcattccatatgtattgcacatgttgaatatccggcacactcagaccggtgaatgttttctcaacaggttattattgcagcagaactcctaaaaaatgcagatgaattagtcaaacagaaaattcatcccacatcagttattagtggctatcgacttgcttgcaagtaagattgtttgcattcagagaaattttttttgatgtaatagttgtaaactgtgttgtcttaacgttttgattaataactaaattttaatttgaaaaccttcaatttaaatgttttagcatttaagtagtaatatttgaagttaaaaacttggaccagtatcttttttctcatttgactaccacattttctcctaataatagattttagtggctatgcttatgggatagattaaacttgccatgatctgaagagggagggttttttcatgtcctcctcctatatgaaatggctgaacgggtattattacttacgacattttggctctgtgttaagcatgatgaatgcaaagagtttgagtagtgactttataagcgtttttctcccccacacttttaaacagggaagcagtgcgttatatcaatgaaaacctaattgttaacacagatgaactgggaagagattgcctgattaatgctgctaagacatccatgtcttccaaaatcattggaatgtatccttgtggttgtcagataaaatttagactttttaaagcataagactttgagatgggcatggtggtatgtgcctgtagtcccagctactaaggaggctgaggtaggagtattaattgaacccaggagtgccagtccaatgtgggcaacatagcaagaccctgtctcgggagtgggtgcgtgtgtgcgcatgtgttgcgcgcacgcgtgcgtagtagcagcagtatcaattttgtgcaataaaattttgaataaccaattttatgcaaattgatatcaatagagaggagtaatgctgtattgaaattacctgttgccttccctgcttttttagggtgaaaaggtaataaaaagcatgtctaaaagtgatatgaattgcagatagtgataatgttgtaacattttggtgacaagtaatgcttgctgctttaatagattagattactaaaaggaagtcccttgaaattacccttgatttttcacgtgtgtaccctttgtccattccaaacctgttactgtccttaacttttggcgtagaaatggtgatttctttgctaacatggtagtagatgctgtacttgctattaaatacacagacataagaggccagccacgctatccagtcaactctgttaatattttgaaagcccatgggagaagtcaaatggagagtatgctcatcagtggctatgcactcaactgtgtggtgggatcccagggtaaggtttgggatttggtttatagaatgagattgctacagattaaaactagcttttcttttggctgggcgcggtggctcatgcctgtaatcccagcactttgggaggctgagtcaggtggatcacgagggcaggagtttgagagcagcctgtccaatatggtgaaacctcatctctactaaaaaatacaaaaattagctgggcatggtggcacctgcctgtagtcccagctacttgggaggctgaggaaggagaatcactggaacctgggaggcggagattgcagtgagccaagatcacaccactgcactccagcctgggctacagagtgagactccgtctcaaaaaaaaaaaaaaataaaaaatgtttttttgtggattatgtgcagtacatctttttgtaatttaaagcacatacaacatggtagaaggaatgtgaattaaaagaaattacgtgcatttaatgccataaaatttttctaagataaaatgcaatgaattagtctaaatttgtgtgtttacatacaatcgattataggtactctttattatgcttttaaggatagacgtattaacttaatcttatgttcaattgtaggcatgcccaagagaatcgtaaatgcaaaaattgcttgccttgacttcagcctgcaaaaaacaaaaatgaagcttggtgtacaggtggtcattacagaccctgaaaaactggaccaaattagacagaggtatgttgagagattatttttggccttttaagtgtgagtgtcttggaggactttaacatttttagccaagtcaaactattttacttccagaaaaattagcctggtggtgtttttagagggatttggggttatacaacctatatgaaaatcggcctttttgtggaattttgattgtatgagtctattaatattaaagatgtaaaagacaggaatctaatttcctcaaagcagtacagaactcagcagtatagtattgactgtaacctactgtttgctagatactggaggtgcaggtgatattagtggttggcatgccagaagagctaatggtggaggtagtgtgaccattgctatagatttgactgcctgacagtcacttaaaacaataaattgtttaggctgggcacagtggctcatgcctgtaatcgcaacactttgagaggctgaggtggcaagaatctgaagcccaggaggttgaggctgcagtgagctgtgattgtaccactgcactccaacctgggtgacagcgagaccctgtctcaaaaaaaaaaaaaaaaaaaaaatagtttaaacagtagttaaaccagacctacaagaaagctttgccaagagtaagaaatgtgctgtcatcttttaaatcagtctgcacgggtattcttttttccttccttcctcatacaacaaagtgtcctttcttccatcaaagccagtccctctacagtaagtgttctagagtctgtttccttctgctctagagccttttctttgattcttgtttcatacttgcatcttcaactaattatgctctttcctggattcttcctgtggctcttttgtccttcaagcttcttcgtacatccttgtgctataggtactccctatcgtacatctttacaggcagatgtcatgagtggtttactacacaaaacttctctggtgcttttcttctcatcccttttcagccctgttctccatttgagggactgcatgttaaggtctctagcgtgaaattcggaagacattttcagccttcctcttacttgacctttagcaaccctttgattatgtccttcttgaaatgctttcggggatggaaggctttgtgatgctgctttgtctggaccatgtcataatactctccaggatagcccctttgttcccatgacttcatgtattatctctctatgccagagactctttcagctgtttctctaagctccaaacacacatacctctatctagtagaatgcttttcaagcatctcaaagtgaacatgtctaaaactgaacttgtgataataccgcaaatctgcttttgaccattttagtgatggggagtccttcacacaggcagaaaactaggaaatgtccttaactcctcctttttaccaacactttttctcctaatctgtcaccaagaccgcttgatttctacctccaaattaaatttacctacttttcattttcttgcctagactgttgtagaaacacacccaagctagtctcttagagaagcttttctttcttcttcaatctaaattatattctgttgtaacttcctgtattttttcttcctggggcttattacagtttttaccatgagtttatataacagtgtgtagcacacagtacttgtttagtagacaagctgcttttgaggttgatctgtaattcattttactttaaaaattcttcgaatgatctattcacatggcttcactcatattgactcttcaaatctggatctcccatagtttatggtttccatgatgtaagtgactgcctcctgggagcttcacctgagtaacagcagagacttcaaacttaatcttgtcctcaactaaactctcatttcccatcctgcccccaaaactcttgttatttattttactccaggagtcacccaagccataaaatttgacttttctgtttaggttgtctttcagcttatatctcatgttattatcttcttgtcttcagccattcagtgcagtttccacattgataatcagggaatccttttgaaaacacagatgatatactagtcttgcttagagatattaagcttagtatctagattgtttggtgtaacctgcaaggtttttcacttttctggttctgccttcttttgtgctttcaactctggactcctgtttttgtttgtttgtttgtttttgagacggagttttgctcttgttgcccaggctggagtgcagtggcacggtctcggctcactgcgacctccgccttccgggtttaagtgatactcctgcctcagtctcctgagtatctgggattacaggcgcccaccaccaggcccaactaattttttgtatttttagtagaggcggtttcaccgtgttggccaggttggtctcgaactcctgacctcaggtgatctgcccgcctcagcctcccaaagtgctgggattacaggcgtgagccactgcacttggcctggactcatcttcattgtccacctcctaggctaaatttatgtcttttatgtgcttgtaatctctgcataccactttagtgacacttgccctggagtgtgattggtaatccctctccccactagatccttgaaggcaggacctgtgttccctgtttaaccatagttctcaattagtaattcaaatttgggttggggagagctaagtggtaatttttaattccttcaaattttccatgaattggactaatttaaattctggtcagagataacaaaggataatacaatttgatctatgattatcttgtgataaatacttaatggaagttaaattatttttaaaaatcacagaaggtaactcaggttacaaaaatactttgcagagaatcagatatcaccaaggagagaattcagaagatcctggcaactggtgccaatgttattctaaccactggtggaattgatgatatgtgtctgaagtattttgtggaggctggtgctatggcagttagaagagttttaaaaagggaccttaaacgcattgccaaagcttctggaggtatgtcttgtgctggctgtcacataaaatacttttattatccctgatcctatcaaaggtctttttacattggaatattgacagaaaacagctcaaaaacatttatattctcttaatgctttgtgctaccaacacatttatagagccatttttcatgtaactggagaaattttgttggaaatttgtgaactgaatttgttcatttctaaaatgacagttccatcttaggataaaaggagttaccgtgtgctgcctaactaaattctaaacttgtaatatagcacttttaccacaaatgctactgagtccaaggatattaaaatcatgaaagagcaatattcacagatcctttgtaactctcttattagcaactattctgtcaaccctggccaatttggaaggtgaagaaacttttgaagctgcaatgttgggacaggcagaagaagtggtacaggagagaatttgtgatgatgagctgatcttaatcaaaaagtaagagccactttctaaaattgtaaagttataccgattttgttaagtaaaagtaggttttcttcccatttatttgctgcttgtagtctcacagtgatacgagcagttatacgcatgggataaaataacattgggccactgtaaattgagatgaagtaaccattttcatctcttctgcagggactagacattgtttctgtatagtatatctaaatatcctgtgtaggcaggacttaagggaactttatgtagacttattttattaaaatgccattttttttgagaaattgatggtcttggcaaaaaaaaatttttaaaaatgctattacaagaattgtacttttgttttgaacagtactaaggctcgtacgtctgcatcgattatcttacgtggggcaaatgatttcatgtgtgatgagatggagcgctctttacatgatgcactttgtgtagtgaagagagttttggagtcaaaatctgtggttcccggtgggggtgctgtagaagcagccctttccatataccttgaaaactatgcaaccagcatggtaagaacagtcatttcttgtcttagaggcctgagagcagtagctgtggacttcaattttttttttcccttttgtgaagtcacctaattttcttcttttcctaggggtctcgggaacagcttgcgattgcagagtttgcaagatcacttcttgttattcccaatacactagcagttaatgctgcccaggactccacagatctggttgcaaaattaagagcttttcataatgaggcccaggttaacccagaacgtaaaaatctaaaatggtaagcatggtttcccgctctttgttaacctctgcagaacaggttgcattaaaaaggatagtagtcaattacatgtcagcaaacataagtaacagacttgtcaaatacttaacatgaaaaacttcacagcaagcatttgttgttcagtcactgtaattcaagggataatgactaattattagcactggtgtgtcttcgttaactgtgattgctaatctctccctgcttcttttggtagaaagactacctacaagatctctagtctgatttaaaaatcaaccttaatacttgaatgaaatgctggagttaataggccacctaatgaaattgtaagcggccgttaaataattctttcttaattgcaggattggtcttgatttgagcaatggtaaacctcgagacaacaaacaagcaggggtgtttgaaccaaccatagttaaagttaagagtttgaaatttgcaacagaagctgcaatcaccattcttcgaattgatgatcttattaaattacatccagaaagtaaagatgataaacatggaagttatgaagatgctgttcactctggagcccttaatgattgatctgatgttccttttatttataacaatgttaaatgcaattgtcttgtaccttgagttgagtattacacattaaagtaaagtacaagctgtaaacttgggtttttgtgatgtaggaaatggtttccatctgtactttggtcctctgatttcacatattgcaacctagtactttattagtttaaaaagaaattgaggttgttcaaagtttaagcaattcattctctctgaacacacattgctattcccatcccacccccaatgcacagggctgcaacaccacgacttctgcccattctctccagtgtgtgtaacagggtcacaagaattcgacagccagatgctccaagagggtggcccaaggctatagcccctccttcaatattgacctagcgggggagaaaagatttagattgtttattcttctgtggacacagtttaaaatcttaaacttgtctttttcctcttaatgtatcagcatgctaccctttcaaactcaaattttcattttaactgcttaggaataaatttacacctttgtgaaaattcatccctgcctatcttacctcgttccttttatgccaagtaagccaatgtctttttttttttttttttttttttaccttgggaagtaatgaactcagtcctagtaactagtatttctttaactattacccacatggccaacacctagaagatactatcttaaaattggattgtgaaattcactggtaagctctcagggttacttgtgcatctttaccttctctgggtttaatccaagttctttaactattgcagcagagacagctgcaaaggcttcattgatttcaaatatgtcaacatcttccagtgaccaacctgcttttgtaacctagaggaaagattcatagaaaagaggtctaaacttgggtggaaaggctaaagttaaaccattctttgtcaacataaatatatgctgcatgatactggtaactgctactttggtttgttcttaggttaatacagtgacattctcacacatttttgccttagtgacatccattccatccaaaaggttaagggtgtgatctaaaagatcccttagaaattctaaattgtcttaaaattttgaaccagtagcatctgttatgtgtacctaaggctaatgtaacagaatcagttcccctagaaagcatgtgatccaaatgctctcagtggctgggggtagtggctcacacctgaaatctcaacacttggggagcctaaggcaagaggatcaattgaactcaggagttcaaaaccagcctgggcgacatagaccttgtctctacgaaatgaagaaggcgtggtgcacctgtagttcgaggtaatgggaggctaaggcaggaggaatatttgagcctaggagttttgaggctgcagtgagctatgatggtgccactgcactccagcctggacaacagagcaagaccttatctcaaaaatagaaataaatgctcttggttactcttctggtagggaaagactagagctaactacatgaataagctcacttaaggctaacaggaagacaaatttcataaaagggaatagggttatactcacagcttgctttatggctggaattggtcctattcccataatggaaggctccacacccacttgggaccaggaaactatccgtgctaaaggtgtaagcccacgtttatcagcttctgacttcttcataagaacgacagctgcagcaccatcatttattcctgtaaaatatgagtgacttaatttctaccatgcttattaacctcagttacatatctgtggcttctttaccacctgaagacatgagttaaatgattttacctgttggctaaggcatttactataattcaacagactttacatagaaattatgtttggcaatatattgaccacaaaactttccaactagagaaagtggtaggattacagtagtcggggctgggcgtggtggctcacgcctgtaatcccagcactttgggaggtggaggagggtgaatcacctgaggtcaggagtttgagaccagcctgaccaatagggtgaaagccatctctacttaaaatagaaaaatcagccggtgtggtggtgtgcgcctgtagtcccagccactcaggaggctgagacaggagaattgcttgaacctgggaggcggagattgcagtgagccaagattgcaccactgcactccagcctgggcgacagagtgaggctccgtctcaaaaagaaaaaaaaaggattacagcagttggggaggggagatctctgacaggaaatggaagaataagcctgggcttcacaaggaggtattgggag

SEQ ID NO: 15918 - DNA, 14781 bp, Human; identical to SEQ ID NO: 15917

SEQ ID NO: 15919 - DNA, 40655 bp, Human; identical to SEQ ID NO: 12032

SEQ ID NO: 15920 - DNA, 19943 bp, Human
ggttttctagtcttaaaacaagagcgtgaaatgtccctttatcaggactgaggaatatctgaggactagagttaaacatccaggtgacaaattgttaaacaatggtctgcacagaggagtgtgtttatcctagggtggaaagaagataacacaccaagctctgagaacagagcttctatttacatttttttttttttttttttgagacgagtctggctctgttccccaatctggagtgcagtggtgtgatctcggctcactgcaacctccgcctcccggatacaagcgatcctcctgcctcagccctgctagtagctgggattacaggcacgtgccaccatgcccggctaatttttgtatttttaggagagacggggtttacaccatgttggccaagctggtctcaaactccggacctcaggtgatccacccgccttggcctcccaaagtgctggcattacaggcgtgagccaccgcgtccggcccctatttacattcttaaccttaaaaaaaaattaaagttgccttgcgctttcatttggtctgggtgccagatagtcaagtgttaaatatagagagaggcctcctgagagaagagcagacacttctctgaagggcttatggtgggagctcacttccctgacagcattctcatgcttctgggctggatcagtcaaaactatcagctttttgtttacatccaagcaacactactccaactagcgtagtcattggaacaaatgttcatagtcctgagggtacagaaggacgacactgaaaagatcccaaggggaaataaaatctttctatttgagcaaaaaggtaaaagcactatgtagtcatcttttttggcacatcaaaaaagtcatcgtggcacatcaagacagacctcacgaaagcaattaatattcctatattattaggataactttgcataattaaaattacataagtgtacaacagctgaaaacacagcattaaatacaacttttaaagtctaatttttaccatgtgataaccgtatcaaattttgcgaatattttgtgagacttggcagtagatggcgctcacctttactaaaagtctgagcagcgccttaacactaacaggaacttaagaatccagctctgatgtcaggcaatcccgtgtccaggtcaggtcacttttttaagtctcagtttcctcactggtaatgtgggggtgggggccgccccaatggcctcgcaactcagaccgcttttgattctctgactacagtggtggagttgagacaggtcggctgctgcaaccgccgtctgaaatagcaatccggaaaagtcaggttgggaaagtgacagagtagacgccctgcggctctgatccgggcggcgcctcagctgcccacactatgtgggcggcaacgcacaaactccttaaccacgtggtgcctccattcccctagggagtcccatcacaggataacttctagcaaaatcaatcttcaagaaaaaaagaaggggtcctgccgaagatataaggaagctccctggggatcccgcagcacagcacaaacttagttcttgagagccgcacaaaaccaacttccgccccagtggagttgcgtccggaaggcgcggccccggaggtcacgtgggcccgcggaattacagcctggcggggcgctcaggtggaagcagtaggccacattatgtcgactgttccatgcaagtcagggtgggggccgtccctatcgcaggcatgagacaagtccagctgcgtcgtgtctggtaatctgagggcaagaagaacgatttgcagaagctcccagttttcttggctgtggcacagtcgctttgagggccaggttccttcggcttcctcccgactcccctgcttccccccgtaggattcccgttggtatcgtccgagccccacctccctcctcttcgcccccgcacgccgaaaacaggggcctctcacgtgacccctgcgcgctcccgcgggggagcgtagtctcggaggcggcgccgcaggggattgaggggttgactgagcgttgcgagccttagctttctcccgaacgccagcgctgaggacacgatgtcgcggctctcccgctcactgctttgggccgccacctgcctgggcgtgctctgcgtgctgtccgcggacaagaacacgacccagcacccgaacgtgacgactttagcgcccatctccaacgtaacctcggcgccggtgacgtccctcccgctggtcaccactccggcaccaggtgggcgcgggccctatgggcttcccgccctcccctgcccagccgagccgcactgcctcctcgccgtgcgggcggggcccgggttcgggccacggtcgggcgggcgggccgcgctcggggtgcggcggcgactccggcaacatggcggccagcctggagtccactcgtggccgggccgggtggggagcgcgctggggggaagcggacgcgcggttcccagtggctgcggggctggggcccccctcgaagtgttgcaagtcgaggtgccttttaaaaggcatcgtaattcctagcctcacttggggtcggaaatggggacgtggcttccttccgcgggggcagcggtggggttgaggatggggccgggcgtcgcgcctctgaggttggcggtggggccgagctgcctctccctgccactggttgttcaccctcccggcgcctctctccggaggtagccttctccggaagtccgggaaagagaaacttaaagacggtaatgctcgttcgtgtctcagacttgagtctgagaaggtcgcttgagatttaattacattggttttgcagataggaatagaatgtagctgacgtttgagcacgtagttagtgaaaacttcacacttcaaagtatgcgaaaaggaagaaaagtacccatgtatgtaccgggtgttttgcgtacgtatcctaaggctaaactggaaggtaggtagtgaaacctaggaggtagatgcagagacggagatgagtaaactctcctgacattgtatgtttattcttttttcaattgtttttaaaattttcttaactatgtcctgtgctcagatagcgtatgtttagtaggtcgtggaacgggggtttgtgcccaggtctgtgggttttctaaaacccgatcaggagcgtgtcttttgttatgtgcagtcgcatagggctggttaaggcatacatacattttaaagcagaaattgccatataccgtgacaacacaaaagagagaaggaagataagtttgaggtaataagcgggagaaacactagaggtttaaaacctgcagtctcgtatgattggttattctagttaacattagttaaggagtaatgtttacgtagttaacattggcttcttgaccgaagaatgccgaagtgtaatgatttttatcacggcattcatattctacaaattctcctctagttttagtattttataaaagtttaataaagtatatagtaaacttaatgttttgtttttagtttaaggaagatgtaatggtaacatttcaaaacgagggaagtaaattgcagtataatactgggaattctaaccgcactattttaagatgatagagcagaatatgtttgtctcagtcttaatttgacagtttcctttcagaattgtagtgtgtgtgtaagagaaggttggaagtatcaaattaatttgtctttgtgtaattgaagtgcgtgcaaaggaggtatgtattttctggaaatcataagtggatgtagtgtggtctgaaaggtagcaagtttagttcattgtaaagaacatttcagacatttcactttgctacacccgtcaagcacaaaggtttttaaacagcatgttttatctatacaaacttcagaaaatttatttttactttatgaacccttccccaccccaccgtacatgtcccagtctttaataagtactaatgatgaagtattgaaagcagtgcctctgcagaactattttttaggcaggagcaaagcaaaggagaatgtttggaggcatctagtttctaggaaaatgaatggagcccaattcttttttttcttttattttgctgctttttctcactggaaaatagagcccaattttatagtccgttcttctccagaaattgaattatggtgatgagtacttgtttctggattgtttggcctaggatgaactattgacaaataccttgttaacctgaattgtatgcacttgaatatgggcttttagatgttgtctccagttgtggaggatcctgtcgagagtggatcatttatgaatcgagaatccctgggaaattatctttgtttgcagcagaatgggcatcatcagtgcttgggttcaacctgttaaactactactgttactactaaaaatctcagggttttatctgatgtttgggggtagtggttttcctatgtgtagtgttggtattatatcaaagcctttttctcgatatttttatgtattaaggatgctttgaaatgcctaaatccttagtggctgtgggtgtcttccaatagttgtcctgtgaaaaaggattggttagacagataccatcaggcactgtactgagagtgaccactagcttgtttttctaatgcgtttacttacagctttgtaatgattggaatttcttagtaaaccagtataaagttttatcatttatctgaattagtaattttgatgctgtatgtaatgcttattgttcaaaaagataagtaatacagattcaaataagatactaataaaatcattgatttcatgcatctctccccccaactccccagaaacctgtgaaggtcgaaacagctgcgtttcctgttttaatgttagcgttgttaatactacctgcttttggatagaatgtaaaggtaagaaactttggggatgcaaaactgttttgttatagcattttaaaatacagtaattcttgaacacttgaaagttatgtaggacatttaggatattgtgcactatttattttgcaaatccagtactcctttaaagtgccagttgcctcgcactccccctgaaaatctctttttgtctcccatcctccctttagattccttaagacttgataattaaagctcagtcgtttgttttttatgagatggagtctcctgtgttacccaggttggtcttgaaatcctaggctcaagcaatcctccaaccttggcctccctagtagccaagactacagatgcgtgcttcctcacctggctttttttaaagcctgttctaaggattgagagtactttaatacactggaattagctgtgagtgaaggttgtgttgaaaactgtgtcctgcaacatgaaatataaagagaccttatgaaactgttggatgcttaggtgtagagaagaaagaggtagggagagttgacttcctgtgcttttgttaatacaagaggtagagcgctaaagggacgtacattgaaattcaataagattcttattagaaccatattactgcatacattattttaattgttttttaatgtaaagtggttgcacttatcagtaaaacaatctagttgttttggcggttttttttttaagtaaaaacaaaccataagtttttttatttggtaaaaattttaatagttctagaaattatatcactacataaatttcaaaaagctctttaaggtattaactaaattgggccaaattaacttttttgttatagaagtgtctcttttttttaggtcataaaatgggatttaagggcgtactctttcccctttatatgggagtatgtaagagttggtgaattttggagatggaatgctctactttaagatttgttgggaaaggttctccccttactcttgttccaagtctacctatccaggaaagttgttttagaaagtatagaagactaaagcagtgagatttggaatagagtttctacagtgttatggggtgcctcatctgtttactaacctcttaatacagaccctgaccacttcaacttactgtctccgcctttttttttttccctgagacagagttctgtatttttggtagaggcagggtctcaccatattggtcaggctgatctcgaactcctgacctcaggtgatcttcccaccctggcctcccaaagtgctgagattataggcgtgagccacctgcccactttttagatgatggctgcctttcttgattgtacagtagtcttcccacaattctgagatctaagtgttgcagatttattttttcagtatattaatgtggatttttaatggataaaagttagaaggatcctgcgtaatctctaagtcagtgggaaaaggagaatgacagggtttggtctgtgggtttaactttaggtcaaaacacctaaagtggttccccctgcccacttctaaagtgtttgggtttgatttcatagagcttagtagcagagtcaaagataatacaaatgggtggttgatgctgtttgtctcttttcccctgccccccaacagatgagagctattgttcacataactcaacagttagtgattgtcaagtggggaacacgacagacttctgttccggtaagtattcatattggctgcttggaagctgaccgcagagaggtgaggaagatcattgcctcagaaagccttgtttcagtgctttgtttgaagcattgccataattctcatcttgttagaattggaatatgaatagtatattcatattgattgattaaaggatgatatttgaagcttggtttagtgatttagctatagtgtggatgctgtaagtgtggatgcgttgtctgcccccacacttttttttttttttttaaacttttctaggaattcatcacagtttagccgctatgtttgcatcttgcaggtctgggaaacctcattctggcacttttggtgttgcgatactggggattgttgattgataaatttattctgcagcatagttggtgctgtggttaaatgagcttttctatacccatccattttctgtattttaatctgagtaacttgattaatttttaacctttactattcgtccagcaaaacgttaaaattctacttgaagctgctgatttttccaatgagattgtaaatcagtgggaaaggcatattcctaatttgatgcatagataataattgaataggaaaaagatttttgtgcagtgtgtctaaccttgaaagactacctttgactctttaattttggtaggggttgccccatcccaatgtgaattttgtaactgaacatttcattagtattagatcagttttacttcacacagggtgcataatatagttaggtggtacacgaacaaactttttttgagacagtctctttgttgcccaggctggagtgcagtggcacaatcataactcattgccacctcatattcctgggcttaagcaatccttctgcctcagcctccccagaagctgggattacaggtgcatgccaccatagctggctaatttaaaaatttttttgtagagatggtgtctcactatgttgcccaggctggtcttgaactcctgggcttaagcagtcttcccactttggcttcccagagtgctggaattacatgcttgagctactggacctggctgaaacattttaagtaattactttaatatgtgttagataaactaataactgtcagacctgtggttttgtaatattgcttagagacaagattaatgaagatttcattagtattagaacgtttttgaaaactgatttaaaggaaaactgtatttgtactgctgcatatttgatgatgtaccagttagaattagtttcagctatgaaggacataaacccccaaattacaatggcttaagcagtggactgatttacttttctctcatgtaaaggaagtctggactagagttcagctctgcaaccattagggactgaggcttctttaggtttttactctttcacctctcaaaaatggctttgaccctactgtccaaggtgggtccttatgttccagccatcacattgattattttcctgccagcaggatgaagaagggaatgaaagaggcttgtatcttactttaaggatgcttcctagaggttatgcgtgatggcctggaagcactggagactaggaaatgtcttttcaggaggaagggaggtgttgataaaaattggtgattctatttctaaagaagagactggtatttgggggcaactgtcagtctcttccacaggtagtatttaagtgttgtaaaaattgtgaaaagtactcaaatgattgcaggtcaggaactagcgttatagattgtgatattttaaatagctttgatgtatatggtttttcttttttctttttttaatagtttccacggccactccagtgccaacagccaattctacaggtaattcaagatgactgttttcttccttttccttcagtatttttaagctttcttgatggattagttttaaataattatgtaaaagttgttagtataattttaaagatgagtaaaaacttaaaagtcttggaccacagcaattaacgttaatctctaccttttgtgacagtgacacatagctccagtgttttatagtcggtgaatgtgagcagatttgctgaggctgtgtacattgagtctataaagtactttttatagatttagtggaaatcttgggaaatatagaagcctaaagcaaattataattctcatcatccagagcaaccaaaatgttttcagtgattaatttcttctagtcttttttatgtgtatctaaataaatacactttttatgaaattgtacgataacgttcatgcacctttgtatttctttttttcttttctttttttttttttggaagcgaagtcttgctctgccgctcaggctggagtgcagtggtacgatctcggttcactgcaaccttcccctcccaagttcaagcgattctcctgcctcagcctcctgagtcgctgggattacaggcacctgccatcatgcccaactaatttttgtttttttagtagagtcacggtttcaccacattggccaggctggtcttgaaatcctgacttaaagtgatccgcctacctcagactcccaaagagccgggattacaggtgtgagccaccgagcccagcctgtattttctctcttaatgtaagcattatggtatacactttacccatcctgctcttgattagagaattaggccgtctctcattctccatgcagtgaacatcttacatggaattgcatttgtatttatctctgataggtttgagtcaaacagaatttctaggtcagagggtatgattattttaaggctctccagaaagatttattattttcattcccatcaacctggaaagtttttaccgtgccctcaacagcatggataagaactccttaaaatttactaacttgagaggaagagtaaatattaaatacttaacattttaccaatattaaatgcgtctattccaagacaagtactagggtaaatggtagggttaagccagcattttgtctactgtaggaacaatgaaagatctcagtgagcacagcgtattgggaaatttgtaagaaggaatgtgtattgggtgggatgcagatgtggtgatagcttggtagtgaaactgcactggaaaacttggagagagcctctgaagtggagcagcgggtcagcacatgcggaggagatgtgaagtagtacggtgagttcaaagagtgtcccatcctgtacaaggtgagaaggagttaagctggtccatcaccagttgctcaccaggtgagcagaattgggaaacacctttgtatgccttgctggtagacttagatgttatcctgaaagattttaaagtttataggtcatatgatcagacttgcattttaataaaacaacttattctggcattgtggagagtagattggaacgatgccagaaggaactcaggagattagatagcctgttacaataattctagagaacagatagaggtgggctgcagatgtttgcaaataagtttaggaagtagaaggggtaggacttcatgactgagaggaggagaggtagagtgatagggagaaggggaggaattttcaccaaagtaagcaagaaagaggaagagcagtctattgatggttgggcctgtcatttgggattttagtttaagatacctagaatccatttaagtgggatctgttcagtattcaggaaactgcaagtcaggcaagagctcttggctaaaaatataaataggcataggcagtagtagaggcactggaggagcatatagaaagaagggatggggcttgaagaccagactctaggaaacagtaatgtctaagggctaggaagaagacgggaggaaatagggatgggggtagggtagtaaaaaagcccagagaagtatgtgcaagaaactaacagtatgtggttgtgggcgtagtttttcaaaggaagaagtagtcaaatgctgtaacaaggacaactcatcttgaaacacttacgcagtggtgtgtggagctggcttggaccagcttttgctagccagttattgtgtagtagctcttcccagcccatgttcagtgataccatgttggtaacttgaaactggttaccatggaaatagtcatgccatggaagtctgcaaatgatacaaaacttattttgagctgatgattatatggtgatgtggtcgtaaatatttaacactcattagaagacattgactaagtaggatgttgaaggttgctgaaaccagaggtgtttggagaaaagtaattttcagaaggttggttatgaaaagaaaatggggtgcagggagtgggggaacaatttattcagaactgttgttcatttcttgagaactgggttcactcttgatgtagttctctgcagctttctccaccctgggtcctcctgtgaattgccatgagtcttttgtgctatagctctctttggtgctgtaaagggggaaagcagcaagggcttatctgcagaaaatgcatcagttgactgacactagttgaagaacaaacctttaggcggtttcttttccgggcatgtgtaccgtctgccgaagagagcaagtgagaagtgaaggggtagttaaacaatgcaaagagaatctaatttatatagaagggtgtataatgaggttaattataatggccctccttcagtacaaataatagaatagccaaaatatgtcagatacagtggaaaatgttcatatgaagtggaagatgaactgtattaagcaattgtaatacaattttagctcttgttatatacatgcctagaaaaatggcaagaagtaacctgttactctgatgggactaattcagtattttttttggcattttctagattttcttaccactaatagcaacttttataacttatgattattattatttttttttaacctttcctaatgaatctttttttttcagtaaaagaaacagtaggtcaacagaggtatattccctaagtggtgcttttattttgaaaatattgtcaatgcaatacttttttcaaaatcgaaaataaaatattttgcctacttattaaaaagaaatagtttttaccttgttctgaggctgggtaatgagaaccaaattgcaaatttgcagaatttttttcctaacattgtcaaacaattggtaatagtgttttgagattgaacagaatttgatgtgtttaatttgtaaagtgtatttttttgtggttacacagaagcagtaaaaaccttgacagaaataatgagctttaacataaccacagcctctaatctaagaattctgtgtaaggaccagtcttaccagagataaggtcaaatattttcctgtaagattttctcagcatggagagttgagagaactgtttaatcaagagcaggatggatggaagtatgtacaacaatgcttgaagtaagagggaaaaaagaaagcaaatgggtctgaacatatccatcagtattatttgtatatcacctattagcttctaagtagtatcaatattaataaaagaagtcttaagctctctgtgactcatggtcatgtgaaaattagaataccttagtttcctaggattcagtcaaccttgggattatgggtagtcagcctgttacgagagtcctggtctttaaagatctacttttagcaacaattcaggtatttagcaatatctgaaaactgtcaagccctgctcttttagtgtatatttactgttaaagcacagaacttcctcttttatattagtagaatttgggaggatgctgattcctattgaggtttttgttcgattgtttgaaagtctaatgcagtgaaaagattactcatttctgtgcttcatcaacagttatttggcaccctttccctgtctctcgtgggttaagcatatcactttgaagtctgttcagttatgtactttaaacagaagtaacatttgttttccaaattctctttagccttcaaacccttttttctgaaatagtacaaaaatgaatgtttgcatagcaccttacatttttataaaaatataaatctcatatgattaatcttcctcatctttccccagatcatccctagcggcccaccagcataagcatatcctcatattgaagcccttgcactctgaagcctgacttacctaatgatttcctgagacaaaataagctctcttagctagtgactcctatagtgcactttccaaaaatttgaaccctacccttaggacaacctcttaatgaaacctttctcaaatgctccagcaaactttgaatttatttggtagccatttggatgttagaaaaaatgttaatttgtagaaactatattcacatccttcctttctgaaagccttggtcagacttctattagtattcatactaccaatagaaacttaataggtgatatactggctggacgaggtgagtcatgcttataatcccagcactttgggaggccaaggcggcagatcacttgaggtcaggagttcaagatgagcctggtcaacatggtgaaaccctgtctctcctaaaaataaaaaattagctgggtgtggtggcacatgcctgtaatcccagctacacaggaggctgagggaggagaatcgtttgaacctgggaggcggaggttgcagtgagctgagaatgcaccattgcactccagtctgggtgacagagcgagactccatctcaaaaaaaaaaaaagagtgctttagtccctaaaatgattttacattcaaactaatccttctcagagtgtacatttctttagcagtatcatcagctattaggttggtgcaaaagtaattgcagttcttgcctttagtaatggcaactcaaatagtattttggcctcatgcagtgtggtggactagagcttacttaaccttgggctcttagaatcttacgttggggaactgtgggcccagggcccctgttcttataaagctttattggaacataccatgcccattcgtctgcatgttgactttggctgcttttgcatcacacagtgcccaaagagtaaaatatttgctttcaacccatttaagaaaagtttgccaactcctgaagtgaagaagataggcaaatctcaatacccttgtaagagagaacttacgactttaatagtttttgtcttaggagaaagattatgaagaacctatagtttcctcacctaaatgttcttgcccttggcagtgagcaagataagagtttttgcaaattttatccagatgtatacatagattttatacaagatagatacatagatattaacaattttatgattgcttattgttttaaaatacacttaaatcctagtattcttgggtgcatagctatgttagtgaaccattaactgaaatttggcttttggtctctaaaaaattgaaagcatgttgaagttggcaggattattttttaaagctgttagataactgggaagctagaaatttaaggttttttaaaaagacattttgttttcattccagctaaacccacagttcagccctccccttctacaacttccaagacagttactacatcaggtaattgaggctttttagattagcaatgatgcaggatgtgtgcacgatgttgccctttacaatttctgccatcattttccagctttcttcgttaatggttatggaactgaaattcttctcttactcttaggggggatcaaggtagtgctttgttaacacaataatgatagctttgctgagattcctcttctcatttttaaatgtgtaatcacatttgacgtgacactttagaattaagtaataatgtttttccaaacatttcagtacaacttgtatgtaaaatctaatttgtaacttctgattaccgttagggattggttgtgtgctgtatgagagagcatggcgatttgagggaagataatatatccgtccttttcactgagaaaggtctaaaaagccagaatcactaccagatgtgcacctcactttcttaaccatttcttaacattgctcagtaatgtgaaaattagcttgttattaaatgatgatttgacataatctaatttaattcatagttaggttacgccacaggatactgtaggtacacaggttaggaatcctttcctccctccatatttttaaaaaactgatgctaatgaatcttctacctgctttttgtgatttctttttcttcatgcttatgccacctttttctcagtttcagtgaagccattctgtcttcacgagaaggaatacaaaacagttgtcattaaagttaccaacttgtacagccaccagaaccagtgttctttgataactgttacttttttcttagattattttaaatggaaatcgctttttctgtttcctcttgaaacattttactgcctgaaaagaattcagatatttgttttttccttattacttgataatactttctcatgtgaaatttgttggcaggatatgcctttaaaaacagttattttacttgttgaaattataaattgcatattattaagattatttttgtaacatgaaaaattgcaaccaaatattttaccttatactagtaaattcaaaagtcatgtgaattctcagcactattgacgtttacactcacaattaactaaaagtacatagtctgaagaaattgttgcatattttagaagtgtttgatacattcccagggcacaatttatgtactaggagaatttttcccattgtttttatatttgtactagtacagtagcattgaccactttgtatccttgggtggaatgaaaaatgggatatggttgtcttcctcaattagggataaattctagctgtaaagacttgaggaaatactttatagaatttaacacatggcaaaatagaggctcaggtgcatctttaaattacaatagaggaccatgaaacttaggattgttgtttcttttgtcttatctaacaggtacaacaaataacactgtgactccaacctcacaacctgtgcgaaagtctacctttgatgcagccagtttcattggaggaattgtcctggtcttgggtgtgcaggctgtaattttctttctttataaattctgcaaatctaaagaacgaaattaccacactctgtaaacagacccattgaattaataaggactggtgattcatttgtgtaactcactgaagccaaaatactatcttttaagatgtcccacatggaagacgctattccaggatctttaaatttccatggatgcatataggatgtttgggagcatcatccgtgaagaaaaaatcaattaaatcattgtgttcaacaggaatatttaaaatattctgcatgaatcctgtggctgtcttattttaaatagctgctgctgtgggattatattttttttccttaacatgccaaatataactttctgaaagtgatggaaaatgttgtcttgtgcagacaacatcatggctcttggcagtttaaatttagtaattttaatttagtgaacagaattgagaagaacgtgccaaatgagaatcaattaggtggatttttggctgtcatttcaaaagtggaataaatttattaatttagtagtactaaatggtatccttagattaaaattttgtgcttgataacagctgttttttctacattagaaataagatgccacacaaggaactacattccagatttaaagaaatgaaaggataccattagtgtgtataacagattattgttcatacttgtaaagcatcttatgtcattgagaatataaagaacagtgccttagaagacagtgaaaggtaagctctagcttaatgtctatgatttgttctttgacattaaggaaggtaaggattggtcagaggatgtaacttgatgtgagcagtagtaaacctgttttagatatcatactgttaatattttattgaaaatttatttcagagcggagaaacttaagctaaagtctgttatacagaattgaaagccttcgtatcttgaacctcccaacatttttcttatggctgttgaaaagtatagagctaaattgatttaattacactttcctttgtactttaaaaaaaagtatgctagcactattgtaccttgaaaggatttccaccagactgtcttgagtagtgacttctttggtgaggcaagaaggatatacattattttagaatcatttactatttaaatgagacaatcatattattttagaatcatttattttaaatgagacaatcattttaagttttaagataacagaagtgaccaatgtaatttcacaacacctaaggattttttggttgatcaggttactgtagatttttactgattgtcctggatgaatagactgtgctttttctttttctctcccttccttcttggtttcccatagtataataagcatgcatactttaacttctatagttttctcctttagagggtcgtcttcagttttagaggtttacttctcccttgcctttgactcattggactagtgcagaggctttaagtagtttaaaatgggcttttgcttttctaggtcattaacgttttttatttagtttctttagccaatagtggctgagtttcgcacttgattttcaatattttatagtaagaaatgacaaactgctttgtttcatttcataaacaaactctgcatttagataactattaaaggttgttaagatgaagatttactgtttctttgttactcgttggtacagctgtttgttttacttgcacatttgtacatatacttaatgttttcaagtgccttaattgtttaaaatctctggcttcaaagtttcttggggaaaggtcggtttacctcacattttttgtttccattagtaatattctaggtacctcacaaaatgtattatggtgccatggctgttagtttttagtgagtgctgtaggattaattcgaaaataggcagaattccattcctcccaaggtggcaaaaattagctatactgatgtaattgtcatttacctgggtatgaattccctgacacacattcatgtcaacatatgtagcaaattttgtgaaaacataacaatttgaagcttctgtaattttgagcactgctctaacaacaagcataatataaaattagttagattttgcaagtctacaaatgagctcttgcaacagaactcacagcctttttacttttttcccctaactttagcaatgtagtatcttgagccattaatttttgggtttttttaaaatccagaaggtatatagaaaccttttcagatttttcatctgatttgttcttgcagatgttcttctatcaaataccttattttaccttacagatatttgttgcacaggcagatactgctgtatttagacatttctatttcagttcattaaaaactgcaaaaccaatctgtatcatgtaccaaactgacttaaaataaatctacatgtttattgaattaatagtgtgttactgcgttttgcttataaaatttaatgcttagtggatttatcttagtccgcttggggtgggctttctactcattttattgcacctctagaccagccgatagtaactaaggcacatgttcatatcaatagaaagcagagccttggaagtaataggtggagggaggacttggtacacttgtgggagtgatttgcaagttgatcttccacaaatcaatagaaattatgctgtagttttccaataatttttgagaggaatactatcttggttttataatctgaaagctagtttgtgactttctgcctttttagttcatattgcatataaagtaaaaaccaagaactatttggtataaattactatcaagccacatgctgtgactttgaagtgtggttcttgttattttgtgggcaaaattatgttctattttatatcagtggacttgaactaagaatttactcctctgtaagccttaaaacctgtaagggtggactgaataattcactttagaaatcatgaattttgggttttgtattagccttaaatatagtcacatttggtttaagtaatacaaaacttgatgctaagcttagtgactctggtaaacattagaaacaattttttttttgagatggagtctcactctgtcgcccaggctggagtgcagtggcgcgatctcagctcactgcagcctccacctcccaggttcaagcgattctcttgcctcagcctcctgggtggctgggattacaggcacccgccaccatggccagctaatttttgtaatttttaatagagatggggtttcgccatgttggccaggctggtctcgaactcctggcctcaggtgatccacatgtcttggcctcccaaagtgctgggattacaggcatgagccactgtgcctggccttgtccagtgttttttagtcattcaagaatccagcctcatttcatcccagctggaagaaaaagttcaacatagtgtttataatgtattatttttaaaattttcaattagtacatagattttcttaaatatacttcttagaaaagaaattgcatttaaatattatagatgtggtgtcagtctgctttgaccatccccagcccttttctcctcttgccttcctccgcttaccagagtggtgatacagaggtaatcactgtaactggtttacaattaatggatttataatcacataattgtatgtacctttggaaaataatgtcatgtaggttttttttttaatcctgtaatgttcattcactttttggagatctttcaaaggtagtgtatgtggctataccaagttgtttttttttattttttaagttctagggtacatgtgtacaacatgcaggtttgttacataggtatatgtgtgctgtgttggtttgctgcacccatcaacttgtcatttacattaggtgtttctcctaatgctatccctcccccagcccccaatagaccccagtgtgtgatgttcccctccctgtgtccatgtgttctcattgttcaacttatgagaacatggggtgtttggttttattttcttgttttctgttttgctgagaatgatggtttccaacttcgtgtccctgcaaaggacatgaactcatccttttttaatggctgcgtagtattccatggtgtatatgtgccacattttctttatccagtctgttattgatggacatttgggttggttccaagtctttgctattgtgaatagtgccacaataaacatacgtgtgcatgttctttatagtagcatgatttataatcctttgggtatatacccagtgatagggtggctgggtcaaatggtatttctagttctagatccttgatgaatcgccacactgacttccacaacggttgaactagtttacagtcccaccaacagtgtgaaagtgttcctatttctccacatcctctccagcacctgttgtttcctgactttttaatgattgccattctaactggtgtg

SEQ ID NO: 15921 - DNA, 124480 bp, Human
cccttgaaccctcccaccgccagcgcgcgaaggattggtttctagtgcgccctctccctttttccctctcctctctctccttccttagaattttactcgattgtttattatttgctggggggcgggggcgggggggcggagaggggcgtctggggcctggagactggtggccgcggccagtcagcgcgcggcgtgccttgacgagtaagcggcgcagcgaatggcgacgcggcggagagctccggggtcacgcgcgtgtggatacgatgacatcatctgtttgtacgcgtcgaactagcttggtgcaggggcggggccgcgcgtcacttgagtgacgggcgctgcgcaaagcccggagcccggaggcggctgggcgggctggctcttgcgtacgctgggctggacctttttgtgtatggggtcgttgaggagcccgcttctacactctgagctatctccggtgacttacaaggattttttaaaaaatatatttatgaactagtgtgtagacttttggtgtgcatgtcgcgtgtggtgcattcgtagagtacaaataaacgatttggggcacggatcgtagaataaggacttgtgcagatgtttttcgtttaacctaaaggatacgtctttttttaaaagtcaaaaatgcccacgtagcggttttgtcgtcatttacaaattagattaaaattatttccccttctcagttgttcggaatctgctcttgaatgtaggacgggggtaaatttgcatttcttccggagttagttacacctctcccccgtttgccatgaaacccatgaaaagtgaaacacgactgtggtccaccgtccgaggtgagagactcagtgcaaaccttttggtgcctgatcgaatctgtgagcatcagcttatcgaagttgtgcaggcaccaacatcttcgccgttcagtatttccacaccgcgataaccctgcccatcttgcggccagcatcttatctcgggtgttacctggtgtcgcgttctaacagggaaccggacaccggggctggcccagagcccggcgggcggacgcgcaggccagggaccccctggtaccaggcgccctgcccggagtcagggaggccacgccgctgcgctccttggagcgtcgggggctgtgcgctcctgccgctcccccttctccctcctctccccacttcttcctcctctcctcccttctccccccttctccctcctctcccgggccagcgccgcgctttgttgtcgttgagactctcgggagggaggaggagcccagcggggacagcagcgggagcccgccgagtcccggcccacggcgcgcgcccggacacccacgcccgcagccccgcggagccgggccgcgcaggcgcgcgcgagctcacacacgcgcactcacacacgcacgcccgccgcgcgcccggcccgccgcccagcccgccgcccagccctccccctgggcggggacccgcccgccgtcagcctaggttgaggcgccctgcgtgtgtctataactttgtgctgctgccgcggccgccctgctcgtggaagggaggaggaggaatgtggaaggtggcggcgcgcgagctgacaggcggttcctcgggcgggctgcggcgacggcccgagcgcttctccttcgccgaggttgcgcgccccctcctcgccgtgccccgggcccgcgcgggatcgtgcgtcgtcccgccgcgtccctgaagggaaggaagcgaggtaggcgccggagccgtgcagcgggcggccgccttcccggtgactccggatctgcttccgagctgggccgggcgcttccctttcccctccctgagccgcggtgtgcgcgccccccttctcgcccgctagtgtttttaaaggactcgggaagggggaaactgtcaagatggcagcagcgggagcaaggaggtgatgaacgtgctggtccgggttttctagcagcccgggagacttggcgcttcccgacctgttggaagatttatgttccgactcgctccctcccccggatcccgactgggaagggggcggaggggacgacgtccgcgagaatgcaaaccacacaaaaccccgaagtggccgtccccgccgggctcgaacctctgcgaacacccgctgggctgctgctcccccttctttctgtctttcctttattttttggaagtgacaagggcccatctgcgcccagacccccgttcgccctctggcccgcgggcgaagaggggagagggagctgcccgcgcagtccccgggctcgggccattcgaccgggtggggggtgacggggggtcgcggaggcggccaggctaggaaaggggagaagagccgaagacagcacagacttgagcggcggcgccgcgggaggcactagagcgggcccgagcgaaacataaacaaacgcacgcacacccgagctcgggctctgaccgcggctcggctgcgccagctccggccgctgcccgctttaaaggcgcggccgcccctcccccgggcgcccctcccccttctccccgccccgccgcctagcccgggagggacctgcggctgggcggcggggggagggggctgccccgcgcgaggccgtcgattcgctcgcggctccatcgcggcctggccggggggcggtgtctgctgcgccaggttcgctggccgcacgtcttcaggtcctcctgttcctgggaggcgggcgcggcaggactgggaggtggcggcagcgggcgaggactcgccgaggacggggctccggcccgggataaccaactctccttctctcttctttggtgcttccccaggcggcggcggcggcgcccgggagccggagccttcgcggcgtccacgtccctcccccgctgcaccccgccccggcgcgagaggagagcgcgagagccccagccgcgggcgggcgggcggcgaagatggcagaggcaccggcttccccggccccgctctctccgctcgaagtggagctggacccggagttcgagccccagagccgtccgcgatcctgtacgtggcccctgcaaaggccggagctccaagcgagccctgccaagccctcgggggagacggccgccgactccatgatccccgaggaggaggacgatgaagacgacgaggacggcgggggacgggccggctcggccatggcgatcggcggcggcggcgggagcggcacgctgggctccgggctgctccttgaggactcggcccgggtgctggcacccggagggcaagaccccgggtctgggccagccaccgcggcgggcgggctgagcgggggtacacaggcgctgctgcagcctcagcaaccgctgccaccgccgcagccgggggcggctgggggctccgggcagccgaggaaatgttcgtcgcggcggaacgcctggggaaacctgtcctacgcggacctgatcacccgcgccatcgagagctccccggacaaacggctcactctgtcccagatctacgagtggatggtgcgttgcgtgccctacttcaaggataagggcgacagcaacagctctgccggctggaaggtgcgtacccaccccgggctggcagcaggacccgccgggcctcctgcgcagcgcgagacgcgtctcggattcgtcggagtgcgcttgcgggctccagggcaaggggttggcagggggagcctccgctgcgaggctttgggggttatctttgatccccggagtcggggcacctggggacggtctcggaggggtgaatgaggctccccagaagcttggggcatggccaggtgaggagagggggcaggggacgccggcgagggaagggcgaacggacaggagtacatttgctggattctccggacagcaccgaggaggtaggtccgcagccaactttggagtagagtttaccgtagtgggggtctggtgcgggcgctgtggctggagtgagaggtgtgggggtgtttgggacgcagtgtctggaggaggggttggatgtgtggtttccagtctgtcgcaggagcatgttgcgtcgtcactagctgaatgagaaccttcgggtccaagtttcagcttgtgggtgttaacacctacaggcacatcgatccgattagaaaaagcagtggttgcaaaccttttcctggacggcttcctttccttgcctatattgataccttttcttctcggagatgtcgctccagtaaacctgcttctgactagctgcttctgaaatgttctggggcctcgaaccggccggtctggccacctcaatccagactggctgcacccgctgctcccgccgaggcctggattcaggcactgtttgagggaagggctctggtgtgggggacgcggggcctgcgcttcattcactctggcgtttgggaggaggtttgggggctgggccgggccgtaatggcttctacctgtaaatgaacccgaagagagactctctaccgttccttatcatcctcttggggcacgggacacgtggtagggagagaggtgtggaaaggcctatgatgtaatgacttcctgcagttgggtatccaaagagattaactcctctgcccctgctgggctgctgatatccagctgctttcctcttcctaggcacctccctggccccttcccccaagacagtgtgtgtcagtaccaggccaaagagtcctgtgcgattggagatatacatctcttatcagctgcccatatttgcaatttagcttagatttttttttgttttgttttatgtaaaagaagtagttgcttcctccttccctttcttcattgtcattggggagccctctgtcttcctgggtttcaggaggtataaaaataagaacagtttaatcttagtggagaattcaatggaagcactggagacgagcctgtagatgaaaaagttaaagaacttaatgtagagaatgttttattttgcttctagaaaacccttgcaaagttaaatacggcttatatcagagaggctttgtattagatactttaaaagcaaaacacgtgtgctttgatattaatccactaatgtgtctcatttcttttaacaaatgcttacattatgagtcttatatttggtttaattcaattgctttgtaaaagaatgccaggtgtatgatacgagagttctttacagaaaggatgaaagttagacaattccatttgaaaagagcactagtgtgatatgttttaaaactgggtttccaagtggatgggaagggttaatcagtgtatagtatcaggaaggcgtaagcggacaggatctgagaacatggatttgggggttcgaaatgtttttcagatttctctcacttgaaatttagtcttgcatgtttgaatttggtgaggagaatacgttagtgaaaagttagttaactttaaacttagttaaaacgttaacgtaggaaggcgttttcacctttcctgtgatttttaaggttacaaaaataatttaatttcacaaatatttcttgttattttgtttatagttaaatataataagtttaatgaactttatttttggggggaagatttacatgagataatggtattaccaaaagtagccgcgaattgagattgggctagatacattttcatatagtttgtaggacttgcaatacagattttgggactagtcataaactttatggttttatgtcatcgtttttttgtcttatggttttttttttttacccttctctgctatctcatttctcttcaactaaaatcttagaaaatactgtaaattgaaattctcaaggcttaatatgcttaatacagggcacacattttatgattcttttaccttaaaattttttaccaattccatttctgagtgtcacatgacaactaatccttgacgactaaagggatataattttgttagagtttttataagatgatcttcatcaaaagatgcagccatgcaggaactttcaaatctttgatgatggagaaggccctttgaaactggagctggttttatattttgattatgactaataggcaacctttttttgtgtgtgcttgtggtttagtggaagaagagggaaaagggagagatcaggagctaattgtgacccatttccaagtgtccaagtttaggagttgattcttgtcatgattagtcattttggaagcacgcatgtgcatttaaaccacactactttcattctgagtaatgtaagaggatttttaacttccaaaaatgtctagaattcaggttaacgtctcctagtcatgtgtgcataaagggcacggtatgcagggccttacttcttttcaggctatttgggccattgcattatgagaccttgtaaccaaaattatcaccctaacatcataaaatgaaagaattagaaaagaggacttagagatcagaatctaaatcagtggttctcagccctggttgcatgtttgaattacctgggaacttctgaaaaatacaaatacccagagaatttgatataatttggcttgtgtgtggcttagcattgatggttttgtgttttgtttttttttttcaagtttcttaggtgattctaatgtatagttaggatgaagttttctgatctagttcaaccctcttattttactggtgaaaaacctgatttttggaaaagctaatgactttcttaagatcacacagctagttagtagagaggtaattagtagccacagttctagaggtttttgttttccattttcttctttaaattgatcttttttaaaaggtcatttgctaggtaatggatagtctcacataagtagcgcttgctttcctgaaaggcttatttgcctctcaatctaaaaacatcttgcttattatttcagcatcaaaaggatgggcaaatgtagatggaggctgagtgagtgtatcatgtttgcatagctgtccagtgcctgtcagtaggggtacttaggaactatgaagtgataaaagaggtaagaaggatagcattttaacaaaaagaggaagcccttggttacttacatttgtcagatactgtgtcagggagaaggatgatgactatctcacaggttcccttacctcgggcattaaagtagaaatgaacaatcagatgtggttaagaggggaaaaggttacatttcctttaattcagattaagcttgcactgcacccatgattgaacaagtgagttctctcagttcctcttgtcttggggagacctctaaggacgccagggcttacctggtaaggcctatctatcacttatttcgttatacacagcacacatctgcttttcccatgggtcagggtgtaatcaaattaggcagacttgagtttctgtagtggttcccataatttcacaagtgtgggggatactgtgttaagatttctgctgctgctgctgctgcagaagataattcttcaagagtccgagtcttctttcatgtaagaatgtgtattgttatggcttcttgccaagataaaaagatgagggctgtcctgtcacataatgcttatttgtgtcctcactgtttctgttctttagattaatacatccagttccttttcaacacactgtattaggaaaatgttattttaactgcaactctgttttaaatttttttttaatttgaaaatgactaagtcataatcattccacattggctcataattttgacctcagtcaccttttggagtaactcaccaaaaggccagttatggtcgtgtgtgaagaatctgtctgcttggcccgtgttgccaaaatgtcgttttgtaatttcctttggcaatagtgtcttcgtcagtgattctcaactaatatacttcctctttctacagccccagtacactagagggactgtttttcctctttttcaaagctgtgtcattgacctctgaagtgaagaaattggcccttttagactttgatctgtgagtcccatgtaacagagactctttaaaaaagaagctaagtgtgtgttttgatatgtttatctccttcttagaaaatgaaatgaaactacagcagacttatttttaggagattttaggagtgttctattttaagaaaatgacaccatacaagaacatcttttagttaaacttcttagtactctgcttgtgattcttacttaaaacctgcaagatacttttatttggaaaattaatgaagaggccttgtctcactaataagtcatttaatttggtctggcaaaagtttaccatccattcaaagatcttcatgaaaatgcaaagataaggctgtttaggcttgagcccaggagttcaagaccagcttgggcacatagcaaaaccccatcttattttttttttaaagactgtttaggcctgtgcattctggcaggttgccccacttacccagagcaggtgcatcagattccagattcccagggctggagagaatatggaatttattttgtttgtatacccacttattttgcctatagggacagacttgaccctattctcaactcctcatttctctccttttcctgcatcacaaattgaggggtcctgaagagccactttacctttttggtgctataaaaggagctggggatcataaatgcaaagacgagttgatatcagtggatgttacagctggtatacagtaagtgaatgaaagattggaaagagaaaaccctttttacccatttgcatcacatcccatttcatgtattcaacaaatgtttatcaaaggcatgctgcttgcagagcatttgccaggacttagggatatagtggtagcagaaggcagataaagttccagttcactcacaggagttcatattctgatggaggagacagaaaataagctatagcatatctgtgctttgtgaatttgtcattgctgcctattcccgttgccttttttttacatctgtatttctgctttctctagtacttcaactctgctaagaagttgctgggaagtggcaaatttgatgtggggcatggcttggagctggcctttaactctctgcagatcattttgagcttgctttggagatgcaaaaccaccgtaccatggctcctgtggattgggtctgtttgggagaagctttggttttccaagctccacctggattagatagagcacatctttggccctggactgatgtgggatccccagttctgtctcccagggcctgatgtagatctggccttcctctggagtggatgtggagccttgatgccactgactcatctgtattacttgttgcctaaaactcagaactaaaagagatcttaaagatcatctaactaccttattttgcaggtgagaaacatgctaggactatgtgagtgactgggttcagggttccacagctagtaggggtggagtaacgggtgtgtccagtcagtgcagtggttcatgcctataattttaacactttgggaggccaaggcaggaggattgcctgaggccaggagtttgagaccagcctgggcaacaaagtgagacctcgtctctaccagaaaaaaagaaaactaggccaggtgcggtggctcatgcctgtaatcccagcactttgggaggcccaggtgggtggatcacctgaggtcaggagttcgagaccagccttaccaacatggtgaaaccctgtctctactaaaagtacaaaaagctagccgggcatcgtggcgcatgcctgtaatcccagctactagggaggctgaggcaggagaattgcttgaacctgggaggcggaggttgcagtgagccaagattgtgccgttgcactccagcctgggtaacaagagcgaaactccatctcaaaaaaaaaaaaaattagctctgttgtggtggtgcatgcctgtagtcccagctgcttgagaggctgaggcaggaggatcccttaatcccaggagtttgagactgcagtgagcacgactgcaccactgcactccagcctggatgacagagtgagaccctctctctctcttttttttttttttttaaagcgtgtgttcataccactgtactgtagtgtctactgcctaccattgtggtttcacagctgttcatctcagtgctgtttgcctcaagttcttcaagctcttcacttgctgtcttctgcttctcctcccctcttctaggctagctcgcactggagtcgctgtgtttctccttttgtgttctccatcagcactctctacttaccttgctaaatgccttttctttcaacgccaccttaccctgcccaccccatggctgctacctgtttattttgtcattttgctaagactgttgaatatttttaagcacagtataagaggctttaaattagggaatgtgtctgccagacaaataagtgtttctaatatttggagctgctttttggattttataatcaacccatatggatagccttagttctggggctgtgactctgaaaggggctgatgtgactcaggagtgagctggtgtcatgagtggagtcttttggatacttgcagctctgaaggtggcatcagctttagacctcctagcatcgatgttgatgtgatgtggtgtaaatgtgagatgatgctgtgctatctggggtttcttgcagtgccttgttacccaatgcataagtctctgaaaactccataagtgtccatcactacttaccacagaaactgaaggaagcctgatcttgggatgaccttgttgcattaagagaaaaaggaaatgaagtttgccatctgtatgtaaacccgctatttgtatcatcaacatgcagtgtcgagaaagtcaccatagaattgttttgcctaaagtttattttactcacttttaggaacaaagctgttatgtaaagccttagttgtttgtaatgttctgcattttggggcagaagtcccaaatgtacttcaagttttctgtccatggattgggaaatagaagtcatgtatgaaaggagaggagatagcagacagtctttgagatgaactatttcaaggaccagtctgcagttcttccaagttagagttctgaatatgtggttaggctagtgatgatgatagaacaccccagttctgactgcatcattgcccagacagacccagtatctttcaccattttattcctgaccaaacaacgttcatttcccagtatcttagtctctcctaaaggaaaaagaactacggtagctggcatccatagagtactgtgatgtaccactcttggtaaaacggaaatgtctgattggagtgtgtttcaagccaggcttttctataattcgcttgttccacttttcactcctgagtttttgaggttttaatcttgagactttttctctgcagtgcctcagttactactatggaataacataataagcgaagaggatgacttctctgctgggctgtggttcttctagtaattccgctactcctgggtcattgcctggggtgaggaggccaggttatcttctggaggctcaccacaccttggtgtccagatgtgccctaggactgcagtggagaggtgagcacagagtaaggaaagcatgtggcacatgtgtagggggcaaggctggagcaggaagtaaactctcccccaaacaaacaaataaacaaacagcatacattaccttccttctggagtgaacctatagtaaacccaacagagatgtgtttggcagttttcagtacgtgtttaggaatttgtttgaaaaccattagggggtggggtggggtggaagaatccacatcatgttttcccttgcgtggttttttttttttttttttttgagacagaatctcgctctgtcgcctaggctggagtgcagtggcgtgatcttggctcactgcaagctccgcctcctgggttcatgccattctcctgcctcagcctcccaagtagctgggactgcaggcgttcgccaccactcccagctaattttttgtatttttattagagacggggcttcactgtgttagccaggatggtcttgatctgctgacctcatgatctgcctgcctcggcctcccaaagtgctgggattacaggcatgagccattgcacccggctcccttgtgtatttttattttaaattttttatttgagacaaggccttgctctgtcacctaggctggagtgcggtggcacaatcatagctctccacagcttcaaactcctggctctctctgtagagagctatgatcctcctgcctcagctgccctagtagctgggactactaatgagcgccacgacacccagctaattttatgttttttttgtagagatatgaggtctcactttgttgccaggttggtctcaaactcctgggttcaagcgatcctcttacttgggcctcctaaagtgctgggattataaacatgagcccctgcaaccagccttccttgtatttcagatgtctagtgaagttagttaagttagcccttgaaggtattgagaatttactttaaattcagagccagcagagggagtacacaagtctttaagctgatgtcaagtatttttttctccacacagctaaaataataccttgattattttttaaagaactctgatatatagtgtttccatgtaagtttattgtcatcattagaaaaggaaaatttaggagagggggtgtggagattaaaaacttaaagcaagtgttttaaaggaaaccctggtcttctaagacccatgatttacttcccactcctagatcattaaatgagagtgcttttaactgaaaaatatcctcccctgcctttcatctttttgctactcagttcctgatactacatgttcatttatacctaacaccaaatttttacagagtagtcacgtgtctggatcagtgggatgttctgtgttttagtgctattttgattgggacttttgatattttccaaagcttcacagttgctcatgggtgagagaaatgtatgtatgtatattgctctcaggtaagagagaaaggtaaggtaaaaagtaagaacaacattatttccaattcaaaaatgaatagtcatggatctacaggagactactgtaactttgaactttttgtaattctgtaatgctatatcggtttctcacctccctccactatgccccatattttggtggtgggggtttatttttgacatggcagttggagagggttaaatagagttcctctaaaattcatgtcttcctggaactttagaatggtgaccttattgggaaataggatctttcctgaagtaattagttaaattaaagtgaagtcatatcggcttagggtgggtcctaaatccagtgactggtgtgtataagaagaggagaaaatacatagagacccaaataaggccgtgggaagttggggacaaatattagagtgatgcagttataagccaaagaacaccaaggattgccaggagccgccagaagctggtaggggcaagaaaagatcctcccctagagccttcccagggagcatggctttgccaacgccttgattttggacttctagcctccaggactgagaaagaatgaatttttgttgttttaagccctgaaattcatggtaattcgttatggcagtcctaagaaagtaacctaggagcctagggatagaagagtgggaatggcacagttgcagatggagaagaataaaaagactttatttagattcaaatcaaagtgttaataatcattcataggctactttcttgtcatctacattttgtctttttttaatcctgcagtgaggacagagggaggcatgaattttccttgatttcccagttagagctactagaacatgtccctcttttgcattttgaataaggtgtgtccttccccctagtccccctccttactgaatttctttttctctgcctgttttgtgaactgacagtatggccgtgcttgttgattgtggacttgaggtttacagtaagtccatgaaatctggctgagggctttggtgtagaagagtctgtctttgaggggaggggagggagaagccaaggatcctcagtggaagaatagtgtggaagaagaagcctccttttggccctgtcagggcttgagaagatggaggcataccatgttcactgccatcagtgatggtagtaaggctaatccaaatctctctggagtcccctcagtgtgtcctatggttggttcaagccttgtagagtctcacacacttggtccttcaggcttatgtctgctctgtttatatttacattcaaaaaaccagctcttcttttaaagcatagaacatggagtggttgtcctcacagaaacagcagcagtagcagtagatatcttgtaggtacccagtaggtgtttggcttgaaatgttcagacatttaagaatcagaattgcatctgtttattctcatattttaaaattatatttttggggaggggtgtcagggttatattagagatatgtgtagtttttgcaataaaaagagtctacacaagacattttctagcctatttatactaataatgacaataatagtagctgtgatttattgagcccttattatgtgcccgttactcaactaggttttttatgtctaatattgattctataagataggcatttaaatgtaagcctcagtttaaagacaaggaaatggttcaggaaggtgaaagtaacttgcttgggatccaaacccagggctctctgacttgggagcatctgccttttctagtatactttcctgtctcctggagtgtgggtgggactttgggtggggtacaagaaattaaagagcttttggccggcgcggtggctcacgcctgtaatcccagcactttgggagactgaggtgggcggatcacgaggtcaggagatcgagaccatcctggctaacacggtgaaaccccatctctactaaaaatacaaaaaaattagctgggtgtggtggcgggcacctgtagtaccagctactcgggaggctgaggcagtagaatggcgtgaacccaggaggcggagcttgcagtgagctgagatcatgccactgcactccagcctgggtgacagagagagactctgtctcaaaaataaataaataagtaagtaagtaagtaaataaagagctgccatttaaaaagtttctactctatgctgcattctttacctctatccccaggaatccccaccttaatccttctgactccatcttgaatgctcatcttcagagttgtgctgactctgagtaacagcacctctctgtgtgctggtgggaggtgaacttggctccgttatttaggctccttcccttgatttttgcatgagctaaataacttttaagaattagctgggcacagtggttcacgcctgtaataccagcactttggtaggctgaggcgggagcatcacctgaggtgaggagtttgagaccagcctggccaacatggtgaaatctcgtctctactaaaaatacaaaaaattagctgggtgtggtggctggcgcctgtaatcccagctactcaggaggctgaagcaggagaattgcttgaacccgggaggtggaggttgcagtgagccaagatcacaccattttactccagcctgggggacaagagcaagacttcatctcaaaaataaataagtaatgataataataaagacttatgatattggccgggcgcggcggctcacgcctgtaatcccagcactttgggaggccgaggcaggtggatcatgaggtcaggagttcaagaccagcctgaccaagatggtgaaatcccgtctctactaaaaatacaaaaaattagctgggcgtggtggcacatgcctgtaatcccagctactctggaggctgaggcagagaactgcttaaacctggaggggcggaggttgcagtgagctgagatcacgccactgcacttcagcctgggcgacagagcgagactctgtctcaaaaaaaaaaaaaaaaaaaagaagaattagtgcgtacctgggtctttaatgggagagtaggaatggcttgagaattctgtcagaaacctgttggtttggtgattctgcagttctctttggtcactgccaggtgtgaccatggtttactatgggtcagaggcacagtgtattatttagaagaatagagtgacgcatggtaggtagaaatcttttgggatggggccttatcgcagaaatttctgtgttgggacagtaggatatctgtgctttttataggcttcaagcacgtagatgaatgcaggcagcaacatcaagaaaagcagatttcaggaaaaaaaaacatttacaaggagttcttggcagaagttttgctgccaaatcagaaatcataatgaaagatattaaaattattttgtgaggtggtcgtctctttgcagtgcagttactgacgggtttaagagcaggctgccaagatagagacagaaaatgttgcataatgcaagttgctggccaggttagtgtttatctctactgaagagcctacttgcttttgtcttcaaggtaaaaatatgtatgaataagacctaaaatggtggttttaattggccacaggaaggcagtgccgtaagataaaatgtagttaacagaatagaatgctaattatcccattttgttctgtgtatgttggaaaaaaattacagaactctcagtttcatagtaaagataggtaagtagtgtctggataatgtccagaggatagactgaaactctgtgataaacgtgagcaggcagcaggatgctacctgataactgagtataacagcatgcaggggaggactgtgtggctggaggcagctgcggtagaagttggcagtgccactgtggacttttaaagggacaactctgggtacaagcctgaagtgtaaggaggacataaaattaaatacaattgagcttgtctccttgaaaactggttctctctttttactacattaaaaagatcaagtggacagttaagtcattaattcaggtaattccaatcacaaaactacttttttcctgaagtgtcctaatcattgatttttaaaaatgatatttctttcatcataaattatcagcataattgctttggttccatatttcatattaagcttgggctgagtgatgtttaaagcctcctgcttaccttccccccttttcttcctattttattttacttaatacctaaaaaaaaaaaaaagaaaagaaaaaaaaacctcgatgtaaattattttcttctgatactgtgatggtttcatagagtaaaacactttccttagatctcttcatttgaacatttcctgttgataaatcactgaaaacaaaacaaaactacctaatttaaaagcgttgcgatgggtcttccagagtttttatcttacacatagctgttctagggcttcccaccaacatttatttccaaaccaaggacttgtttatctcatccttcatacttttgcatttcagtccgaattggatacgggtttttgttgtctttgtttttgcagtagaaaaacttcagttggtaggatgaaaaggagaacaaatctttattcactttcagtatagttccattaacagtattaatgtgccatgtatgaatatacctgtcatgcagactgaggcccacagactaataacattttgagcaagataattttaagtaaaaactgaagctctgaactcaaacattctttcaaatttctttaaaataataatgatcacttagatgaggtgcatcatttatgtaaccctgaaaagcctggaattgacttacgaaaatgtcataggcctgattattttaaagttatcttcgagctgatgctggtgtgagcatgtttgctttagaacacatggactcttaagctcatgatagataatttcctaggtgagctagtatactgtttcttgaaattagtggccttgatcagcccttctctctccaagcctgtccaataaagataagtttacagccttctttttgaatagacacatgtcctctgctgaactgaattatctaaatcagtcctatttagtctcctccccttacaagaaagatccttatttcagactgaaagactaggtgatttgggccatattttaggttttatcatacttacccttcatgtcatttgttaaggtcaagttcagcatttgactgtggacataatttttagtaggtgttccttgggaagaggcttattgggaagagaagtttattccaatagtctcataaaatcagtgaatgctttgagttaatttatcagcaacctgtgctgaataagcaaggtgccatgtgttaaattaggaaaggtaacgtgctgctagtgaaaactgtgtcttctaagttggctttaaaataaattgtttaccagattaatgtttcaatcaaaaattacaattctcatttttaagatgcagctttatccacatctaagttttctcatcagccaaaaaaaaatttaaatggatgaatctgtttagcttataatgcagtggaaatacatctggatttttatctctgggctcccagtgtttgccctgttgatgtgagcagagatgattttcacctgacatctttgttgcctgcttggagagtccttgctctttccattgactgagtagttctagctagtttcttttgtgttcattgttctgccttaaacaggatcataaagctttcaaaaatttttttttcagcttgttacctcatgtgtctgtgctggccaagaaggaagagaagaaaataactttatcatttgcatcacatgattttacagctttgaaaacccatttgtcagtgtggttactgggaggatgattgcagctattgagtgctctgagagttacttctttaatctcttccctcttctttccccgtttaaaaaaacagttaattttgctgagggagaaattttattgtttttttggtatatgatttcaaagttgaacctttaaatgatttgtgaaaagttaaaagttctttgccccaagttcttagtaactcttctaaaaaaaaaatagtataccttattaagagggtttcctggcatgttctttggactgttaccaagtctttggcacacgagggtacttccttgatcgtctagccatttctgatttttgaacctgagacagccaacattgagttgatctctagatcagctttacagaatctaacatagtaacctcggtttcacttgtcctgggcactcctggctgctgttccatttttgtcttttccttttatatctactacacattgtctaaagagggcttattccccttctctttcctatccactggtcaccttactccaacatcagtggttttcaaccctggctgcattttagaatcacctggagagctttcaaaaccaccagtgcctaggtaccatcctaaggcagttaggtcagaatctctaggtatggggcctgggcatctatgttttttaagcttcccacgtggtgataatgtatagccaggattgagtgcctctattttagagacattagattttggctgtggaagttatcagctattttagtactgacttttagatgcatttcagccctctcctccataggaagctccacatgacaaggagtgctgtaaagttgggattaaagagtaaggttggcttctaagggcaagagcattattatcacttaacaaactgtgtttaactggggtctcctcttctttaatataaatgcatgtgatgtctttagtttccaactcccactcatttttctagtctctactggaccctagttaagttattttgaagttttcaggaatttttaagaagagatggtgctgttttaagtcattgcataagacttgaaaactgagagatataaacttactgttcttttgtgcaacctaatctgatataccagaagattccaccatatcctgatgtttgaaggtaatggttctccaagtggtccctagctcagcagcgtcagcatcacataggaactttcaacatcacgtaggaacatcacgcagattctcaggcttaccccacacagactaaatcagaaactctttaacaagccctccaggtgattctactgcaagctgagggttcagaaccactcttttaaagtcatttgctaagtctgtggaattattctggtgataggagtaaaaaatcttaacgtcgcttgccatcttggcttcagaatcatggcaaaaatggggaaaaaatatggtggtatctgttgaaatataacaaagctctagccccttgagtattttggacttcccacagatctgtgctgctctgtagccttctgtacaaggcaaggatactcacctctcaggatcacagcaataaaggatccactcaggtgtatagaggaaaccacatgttcaccttagtgcatatattgtgttcacagaacttgtgtttaggttggattcatgtttttttttgtgtgtgatctttttctcttgtttgttttggtcttttgaggacattcctagttttaaaaccactatcagacgggagtagttgcactgactcatccccagacagacatgggacatgtgagagaaagataggataaaaatgtgctgggtgtaatcagtgtgagaggctcagtgcagtgaaggggagagtgacacggctctcgtgatgaagtcagaggtaaggcgggacattcacctcggctcaggatcctaaaaggcgcacgacctcttgcaccacaggtggaaccaggtacagatccaaacaagtatgctgcttgtcagtatcattggactctgtagtccattaagcagggcctcatgatcagctagctatatcaaacctagctggtggctttaggaatgtaaatagtgcaaaacacagtgggttggccagttctggatgttcatgtgagggtcttttaccagctgtttcagaatgttgcctgagattcataaacactaaaacaaaacaaaacaaactccagcaggatgactttggattacagttcattctgctgttagtggcattccttttcgtacatgaagccatatccaagatgatatggcttgagtgctaagcctccgaggtacagtgatctgggttttcttcttgggggagtgggtagggcaggccagtcactttcctcagattcaccaagattcctgggaagggtcaagaaggcaggttcggtgttggaacaacatcagaaggtccacatggaagggaaagctgcactgagggacttctgtctggggtcagagtttggaggaaagtccaaaatattgtgctgttaactgtgaacagcattccaaattgaactccaggagagtaccagggacttgtacacattggaagtcagatacagctggtgggcactggaagtgctggggacagtaggatcctttccagagccatcaccactcacaggtgaaatgtgtcaacacacgtcagttgctcatccattttggttttcccaaagcatgggcctctgcttgcatgttctgggggcaaggagagagggtatcttgaaaggatctggcatcaggatcactttcacagaggagtaaaacatctggtagcagtccaggaataaagcctgcccagtagcagtccagaaggcttgtctctcagcccagagaaacccccagtccttggcttctgtgtctcagacctggagataatgagggacatcacctgcttgacccctctttgaacatttccttaaggaggctatagaggaggcctctggttttgagacggtcggtgtcctgacttctgtgtgctgctgaattacagagttgaagtttgaaaactcttaattcctccctgcccaaaaggggcaaaaagggctaaatcttccttctgtgttggtgtgaatgggtgtgatgtatacagtcataaccttagatttatctatcattttcatggctgtaactaaaagctacggttaattgaacatttattagcagtgtgccagacactgttgagctttatgagtattagctcttcttcattttttttttttttttttttttttgagatggagtctcactctgttgcccaggctggagtgcagtggtgtgatctcggctcaccacaacctctgcctcctgggttcaagcaatttacttgcctcaggctcccaagtagctgggattacaggtgcccaccatcgtgctcggctaattagtagaggcggggtttcactatgttggccaggctggtgtttacacatttcaaactcctgaactcatgatccacccaccttggcctcccaaagtgttgggattacaggcgtgagccaccgtgcccagccttagctctttctctttactcatgaggaaactgaggtacgaaacggctaagtgacttggctgaggccacatagttggtaagtgatagaagtgggactcctgtatcagtatgtctccactttgactaagggaactccaaagtcaatttatccaagcttcagggatcttgattttgtaatactgagacctcactggcttgttcttttctatcatatttcccattttggtttaaaagaagagaaagggagtttgcatgatccgttagaattgtagatgtgttctacgtagctgtcattgtttgagaacccatagaaagaacagagttgagtgttaggttgtagacaagcattcacattgaacacaaaaggcttttcagacttgtactcttgtgaagtgtggttattcttagggatgggacacttcaaactgccttttttctccaggctctagagcagatgtgatattccagcaagggtgacccagctcatctttcacagattcagaaatgagacacatagatgagtttactctaaactgcacttaaactttcctgtagtcattgctttctctccctgcccctgccccttctgtggaagttgaagcagactaattgtatatcatcttttgttgaacagcgacatcgtgcttggaagccagtgggtcatttgggtctagttttcattcttttctttggatctgcttcacagtttaaattaggcccaggacattgtatatggtggtttaagaaggtgactgtaacaggcagatgttgaaagatggaagcagtaggaggaggccaaactgtggaggacaggggtaataactggattggcaaatgggggttgaggagcatggaaggcagcccagtcagaataccttggcagaggctggagggttgtagttgtgtgattgtgatgaaatattaggggtgatggctgggtttggaagagttaagccgttacgaaatttcttcaaagaacattatcaaacaacacatatgtactgctgattaagcaatatcattaatgagcctgctttataatttaaaatgcaagcagatttactttcagtttcagtcatggaaccattgagacactttggggaggcaagtgaaccactgcagttctttctatactggaaggaaaaggaggaaagcaaagttattttgtggttttggagtagtttaaaaaaaaaagttttgtgttttgatagtgccttccaaagagttcagcattatgaatcatttcttctttgtcaaggtgagagaggcattctgtctgtgaactaaatctcccaaagtcttcagtgtttgatgggcaaaggaacgagaggaaagaaataggaaactgccatgccatctttcccccattatctccctttcatgaaaaatgatctgtggctcgctgccaagactttgtttaaaaaaacttggttgtctggtatttctcatctgcatgaaaaataaaaagtgtctccattttttttctgagataaatggtaaagataaagctttcttaatgtttaaaaatataggctgcatactctccaagaaaaaaagccctacaaacaatgtcagctatttttggaatattatataaacagttttaactgtcatatagggacaacgtatttttcctgcactcctaaccctcacaggaataaaggacattggccctttcttcactggcttggtataggccatttatttactagccacctaaataagtgcctaccagctgcttttaggtgaaatctagggaccatcctaaacatcttatgtgctaggtgtgggaagcaggcccagcaggcttgggctgaatagaagtaagagttcccagccttgtgttgttgttgtcccaggaggcagattttcatctgtgaagtcatctgggaatccagttgtaagttatatccagttgtaagaactcagtaacatccctttgctcagtccagaccaataacattttaaacagttgctggactttttaaaataaaaattttgtgtttcctgccatgtaaacagagatgttcctaaaagaaaataaatgaaccatttgtcagataatgcatttattctggttaccttaatccctttgttaggtttttgtcatggagatagtagatgacagctttgaagggatgttaagcagtggggttatttttttttttccccaaggagacagtttttagggcagactttgagtattttttctcttgtttttgagtgtgtagctgtatattaagatgggaaagctgactctgacccaggaaaaacaggacggtaggccagtccacctgctgggtctgttattcacattcttgttgggtgtaactgccttccatgtgactctcggtacccccttctcagcagccctgctttatgtccctaatgttcccctgttcatctcacctggactgcttcctgagggattttctaggggaaggactaatctgagatgcaaattaatgccaaattgatgatggaactcctgagtcctgaaacgcagtgccttggatgtcatctgacttaccctttattttctggatgaggatattaaggatcaaagatgtaaaggaggttacttgaaaccacccagtgaggtcactcttacctgtgaactgactccgtggtcaccaccattcttgctgaggaagatctgcagctgtctcatgaacatatgtaatgtgcctggatacagtcctcgcttcagactcactactttattttctagggaagaactaggctttttatttcactgtggctggtgtgggggcattcggtgaaaaggtagctatgggagacaacaggcagccaaaatgctacctaataaacctttgaaccttgaagaaggattgcccggtggtagccctattatccagagtgatggggcctgagttttctgagtggttgtaactttgatggttgtgactttgggaaagaagtatattgcatgtaatgtttccaagaattagttactgtgtgccagaggagtgggcacataagctggatcagtggctttaatgggcagcagttggctgcaagagaaatttgcagtttcaccagtcttaatgctgggcaacccatatattaaataatgtttggtacacttggatatcttttattgggaattaagcccccaaagcagctttctgtaactattaaagtctgataatgctaagctcttcttcaggcactggagaagtttggcagtctctggaataaggaatttgtttggctttggcactgatagccaaaatgccacttctagtcactttaaatgttaccaagatttcagtctcattgccgattattgaaaggtctgtggcaaataagatttcagtgctgtggtgaagcaatctgtgtgtgctttaaaggtaaataaaaatacagcacattttctgagtataattctcgtagacagagttttgttggtcacccagatggttggaagttctggtccttcagcagtatgggttggtggcagtggtgctggcttctgcagcctgtgctggtccaggcctaaactcagggaaaagtatacatgtccagggctcatgtgacttgatcatatgggggcgtgcttcataggtcacagccatggttattcatccatttagtttcattccgccggcacggtaatgcatggaataaagatggacatacaagtgggcattgcttctggtgagtctgcagtatagtgggtgatagggatatgcaaacagaaagttgtttttcttgggagatggcactaatccaccttgcctagaaagaagggaagtcttgctgaactgtgcatcctggcatgtatctctgccatcattcattattttcacctttgataatgaaatttctgacaatacagggtgttgttggagttcatttttttgttgataaaagtattactgtaatcaaagaattccttgcagaagttttgcaaccctcaaggaaaagtgataaaaaaacagaccctgcatgatggattgcaggtttcaaggaggtgggagttgtccatcctttcgcgttggctttgcttttgtttgtgtaaccatgaaaggatactgagtctgctttttgtaaaggagataacttggttcatccgtaacatgcagagtgttgggtgaattaacgagtggaaggcacgtaatgatgtgtggcacttatgtagtattttgatgatttcacctagaatcttgccatctggaaacttgcatttactaggatgtagagccaattttggatgatactgagtccaatgtttatttaaaatggtttagattttcatttggctaaaatctaggaggttgtagactaatagaataacaataatgatagcctttcctaaggagctctgaatagcctcagtagtactatagtgagaggtaaaagacaagaatcttaccttatttcatagtgatgcagttgaaacatggtagcctgcacagggtggtagagctggcccgttttgaaatgagaagttgaattcctgatctatggctttggcacttgctttgccaccaagaattgctatctccaaaatcttttttttttttttttttttttttttttttttttgagacagagtctcgctctgttgcccaggccggactgcggactgcaatggcgcaatctcggctcactgcaagctccgcttcctgggttcacgccattctcctgcctcagcctcccgagtagctgggactacaggcgcccgccaccgcgcccggctaattttttgtatttttttagtagagacggggtttcaccccgttagccaggatggtctcgatctcctgacctcgtgatccacccgcctcggcctcccaaagtgctgggattacaggcgtgagccaccgcgcccggcctctatctccaaaatcttcaagccatgaagaatctttgccatcttatttattttcccagctcctggggagcagaggtttcccacttggagtttagattttgctgaaagcaccaaaatccaggcctgaaagatctcaaagtggatcagggcctggggaccagctgtgcattattgagattggagcccaagttggcagggaggccatggctccttaactatccaggaaggccctctgccctcttactcagcgcttcagcagaacagggctgggctcttgatcctgagacagctgggagtctgcaaggtgtgccccatgctttccttcaatgtagagatgccttttacctcccattagagtgcttcagaggctacttagggtgccttaggaaaaggtatcgttattattattccattagtctgtaaccttctagattttagctgaatgaaactctaaaccacttaaaacacactgggctcagtagcatacaaaatcgctctgtgcttagaggcgtctgcaaagtggtgggcgtgctgccccagtggctgtcactctggctgctgcccttatgtctccttcaagggtacatggaagagagatgagggacacatgcctaaggtcggcttctaccacattcctatcccactttctcagccggcttcctactttttcactgcctctgaaatagacacagacctgccagtcctggaaggcctcaagcctctggaaaagcgaagatcacttttccccaaagatgttaattccaaacttgtttatgttcctccttggaatgacagcttataaaaatatgtgcagtattaagagatgaagcctgagggtgaaggacaacatagtacttgacaggcaccagaattaggtgacacatttcactcttgagtttcatagcagctggagcaaaaagggacataagattagcttccaaacttatgttatgcctttaaatgaaaacagaagtagcgtggctttttctgttacttagaaactttttctcttgggacatcataaagagaacactgatctaataaacgacattctcctgcttgaaacttggttctctgaggtaatgagccagtccattagtttcagtgtaccttcctcagtgatgtatctatgttcatctatctggccttgtgaatatttttttgacgtaacatgagctagactgagtatgaatggctccaaacttaggagtgactaggatttacagatgaagcagtatggatcagtttctttgggaaggttcttggaggaccctatgggaggaaaccctggacaggtaggaaaactgaggaagcagaagagaagggcagaagacaaaaaccctggcataagaaattgtcaatactgagaagtggcagggacgtagcagaaggggatggttgaggggaagaccagggggctggtatgtagttggtccccaacagcagtgtattggtgtactcgaccctccagtgtgattctgggcatgagacaagactcttgttctcatgaagcagggcatcagggaatgggagttggtgaggaaattacattaacatttattgagcaccattctcactataaacctgaacgtaaatattattattattattattattattattattattattattattattttagtagagatgaggccttgctgtgttgcctagactggtcttgaactcctgggctcaagcaatcctctcaccttggcctctcaaagtgcctctcaaaggtgtgagccaccatgcccagcctattcgtttttaatttctgaagaaactgaggctaacagctgggtctggcccatgactggttcagttggtatttggtggaccaagttgaccaagctcacccagcttctgagtgacagagtgaatataaacccagcctgctcactccatttcctagttttctcacctctaccagggtctctgttgctcacaagagctcagggctgggagaagcctctgtgtgacagatgaaggggtcctgctgctctctagggaagaatcggtcccaaattgctcaagggagtaaggtggtttcgttgaggagcatcagctagggggattgatgggaataggtgtcaggcagccagtggaaattttgtgtgcccacctgtggcacatgtattatgcaaattcatgcaaaaatatatatatgtgtatgtgtgcacacacaaatacacacacacacgccccacacacttgttctacggcttgcttttgaagtgagagccccggctcagtgttggccttgttttttctccccttcgttttagaccagtctgtgttcctgcaaacagacaaggcattgtttaaagtacaatgtactctcctgcttttgcattgtcatcagaaacccttggcaaaatgtttaatttttctcacagaggttatctgtacttacttgacttccctgatggtacatttggttctggaacctggaacttttcttttgcccacctgtattgtgttaagtcagccataggacacacataaatatttttatagaaaacttaaggattctttcgctttgagatgactcagacccatgtttccaaactgggacatgcactagagaagggctcccccatcctccctcctcctctagcttcttgtctgtgtagcgtccttcctaatacccactgtttgcagtcaggcaaaaggaacgtgcttcctaagtgtaagcttccatctaaaaatgaacataatttcaaaggcaactttaagttaacagctctaagttctgtgataatctgctaacagttgcattgcttatgatctcatttacgaatgtgttttatcatctttaagttgataagttcaagaaaggtacataaagtgtgtgttgttttttaattattttgaactattcagtatattgaaaaattcaatttttgtttttctctgcatttgggcttgttccttttgctagttttctgattgatttgcatagaccattgactggatgttgtattttttttttctcaaagctaaactgtatgaaaaatcaagacttaaaaaaggtaaatggaggcagttgcacaattacatttgtttaatgagcttttacattttaaaacttttaattaatgttatactatttcagaaattcaactgtagttataaaattataaagaatgcatttgttatttaaagtgagatatgcgtgcagacacacagaccatggtcttcccttcttcctctggtctactgcttctgccttatatcccctagattccttctcactccccaaaaggcagaggttaagaagaaagttaaaatatcaagacacactaaactgtttttgtggtgagtcaagctgcagtgcctcgctgactgggaaacaatgggctgggcctcctagaatatagtaggctggagaaacagaaaatacagcttgactgggccttgccctctcactccaagcctcaacaggatgctagagctttagcatgctttctgctgtgctgggattattttctgcaactagacaaaaaacccacaaaactccacatggtttgttctcaagcaactggaatatggaaaggcttgaaggaatacttacactttttgatggaaggtaatgaccttagttcttcagtatttattaggtaagcatgggttctgcagtatagcatttaaaaattcatgttcctcagggtttcctaagacaaaatagagtgtgtttggtccagtgtgatggagaagtttgatgcaaatccgtcttaaggaggagaatggaggctgtcatggagtcctgtggactgtttcgcaagtagttgttttccatgttccagttttacttaacttcagaaaattattgtttttgaaaataaagaaaaaatctaagtggtagagagaaatataggctgtatttaaactggcctttataatttttcctgggcacacgcagcccacattttggagctctgtgacataagcaccccctgccccggagctgggagtcttgaccgggccaggccttggctgccctgggctacacagacacaagcacaacccgaatctttgtttacttcctctccaagtgctggggacattcagtactaagaaggactgtgtgcttgcacaaacactcctgccagcattctctcagccctgccattcctgactgtcttggaaagttcttcgtttaaggcaggcttttgttcttagagtgcatgcattattccccagtcaggcagccttttccgggtttccagtgcagacttgcaggtccactcccctgcagcctagcccaggggtggaaccttagctttagttgccattaagagcaggaggaggagttaggcaggggtgactggctgttcatgtgagttcctgtgactgatgtctctgaagaaaccaatgccttcttcagatccttatgggaaatttaggggacttttggattacacagtgttgccttttgctgattctaagatagagccttccaattgtaagtatgttaaaaacacacaactatttcctactgaatgttagtcaagctaaagagtgaatctgcaatttcatgaataatcaaaacaaaagcatgctgccaggatgaactgttgcaagagcaggtgctatttttttccagaaacttttttatcctcgatcacgttatgggtattaagagagttattcttaaaggatatcatgttcagtgcaatgtcttaatagaaaaaccttaaacataagtatgcaggcaaacacaggtacatagctgtataaagttaaatatgaagactggaattcattaataggatttaatttaaatctttttttttttttgagatggctttactctgtcatgcaggctggagtgcagtggcatgctcactgcagactggaactcctgggctcaaaggatcctgccacctcagcctcctgagtagttggaactacaagcgtgagccaccacacccagcacccacctttttttgagaaataatacagattgagcatccctaatttgaaaatttgaaatccaaaatgctccaaaatctgaaactttttgagcgttgacatgacactacaagtgggaaatttcacatccaatctcatgtaaggggttgcagtcaaaactttgttctgtgcacgaaattatttaaaatactaaatgaaattatcttcaggctatgtgtatgaggtgtgtatgaaacataagtgaatttcctgtttaaacctgggtcgtatccctaagatattttattatgtatatgcaaatattccaaaatctgaagaaatctgaaatctgaaacacttccaggtaatttggatgagggatactcaacctgtactcaaattagaggaaagaaaagaagtaatggatagacaaaagaaaagtacttatttagagtttacaatggccaagaattaggaatgaagaattgagactgatgttcttgtcagaattttggatgccttgcttgcaaatatggttttaaaaatatgcaacttttctcattttagtattgggattgtggcgcttttttgagcctcatatgacagctttcagattggagataacgttagagctcatcctagctcagctgcctcccctgacagcagacgaaactgaggcccagcacttggtggtgggctcagagtgccaaactagttaatgaggcagagtagacaggcaacagccttctcatgtaggtaggcctcatcctttagaagatgttgctgcctgcccttgtgacttgtaaagatctgtttgaagcatgagtaaggagatgggggctcaggagtgttacagcatttcacatctcaggtgtagctgggacttatcgggtgaccttttagaaactgtttattttcatttttgtaccccacattgggataagtatggtccactgacattgagaataaccaggcctgttgtagacagccagccatcctgaaactactaggtttatacttcttacctgttagaacagagtttcccaagttgtattcccttggaaacactagcagtcgtgcatcatttgggcagttaggttacacaaaatttaaatggtctatttattttcttttccagacagaactcagggcagtcccacctcaagggaaatctcattacatccttctgatggtggggtagctgggagtcagcatgaaatccaaaattctaaatcatcgggaaaaagcagaagggttggaacccaaattaaactgaagtcctaaataaagttcacttttcggtcaggcattcaggaagcagcacgtgaaaatttgcttggatacagtttcctcatagttcttcagcagcttgaaataacatcttgagctggctgtaaacaaaacatctcaagttatcgtttttctttccatttgattgagccagttattgtatagggaggtgacacaaaacaaaacttcgtgtttctgaagccgagattttgggattgtactttatgcaaagttacttataagttctgattactttgagagaaaaatattacagtatccttaggaagttttatgtatttgttttaaagctaagcaccaccctctttttagttaaaaaaaaaaaagtttggaaaatagtgacatgtcagtacaaagggaatactgctctacaataagaaggaacacgccacagatacatagcatggatgaatgtcaaaaacattgtgagagaaaaatgcctgaacaggagagtaactattgtttgattccatttctgtggaattctagaaaaggcaaaactaacttatggcaacaggaagcagatcagcgattgccaggggtgatggggattggaggaggttgactgcaaaagggcagaagggaacttttcagggaaatatgaaatgttttatatcttaattgtggtggtgcttacactggtgtaaatatatttgcccaaattcgtgtaagcatatgcttaaaatgggtgcagttttttgtatgtaagttacacctcataaagttgatttgaaccgaaaaaaggggttagaaaaggctgtggttggaattttttgtgtaacttaaggccaaatagtccatttacgccagtttttacagtattgtaagctatgccctttgtgttcacatttcttcagttactcctttattcgtcatcacttaggagactttgcatctcatctgccttcctcctagctccatgatttgagcaatagaagttcttggctttcaggaacctcacagttcttgttagtcataagcaagaatgcattttaaattcacttcaaattattttttaagtaggggttctggtggttttctggaatggaggtgtggtggaagcttgagtgtgtgtgggaagaggctgggtgttcctcagatcattgtaccatgcttcctcacacctgtccaagcttctgtgcgaatactgaaataaagtgtcatgaattttgcttctggcatttgtcggccacagctgtggcttcgggttgcacatttgttgtggtttcagagtctctgagaagccattggttgggagggcgctaagaatggttggtgcacgtggtaattgagtgcttaaggggaggaggatgattcttagtgcactcattgctctccagtctttatctcaatcctgttataatttagagagacgttttcctggtgtgtccacagagagatggatgcgtgcttaggaatgcataatttagtgagcagtttgaacatctagatgttgggaatattgttgagtatttatttttaaagttcaagttctccatgtctagtcagtgttagcctgtaagaaagaactagttgttcttaatggatcatgttagctggacttggtacaagtgttttttcttagaagggaggattacacgtttatagtaacaagatgttcttttatttcctagtttatcaaaagattgtgaaatagggtgtgcagatattttaggtagtactattttttaaatagatgagcttgaaagagtgagaaaaggttgtgtcaggttaattgggcttaaggaaagctaaataattggtgggagaaggaaaagtaaatattaattttttcctttgctgtgtatttcttttttctttttttttttgagatggagtctcgctctggctggagtgcagtggcacgatcttagctcactgtaacctctgccacctgggttcaagtgattctcctgcttcagcctcatgagtagctgggattacaggtgcctgccaccatacccagctcatttttatatttgtagtagagatggggtttcaccatgttggccaggttggtctctaactcctggcctcaagtgatcctcctgcctcagcctcccaaaatgctgggattacaggtgtgagccactgaacccggccgccttgctgtgtatttttcttttcttttcttcttcttttttttttttttttttttttgagatgtagtctcgccctgtcacccagtctggagtgcagtggctcaatcttggctcactgcaacctctgtctcctgggttcaagtgattctcctgcctcagcctcccgagtagctgggattacaggcatgtgccaccacaaccagctaatttttgtacctttttagtagagatggagtttcaccatcttggcagggttggtcttgaacgcctgacctcaggtgatctacccgcctcggcctcccaaagtcctggaattacaggtgtgagccaccgtgaccggcctttgctgtgtatttcttttggacatcttttggctttgtgtttgtgtaaactttgaggtttcttaaaactaccaaagcagtgaggagaagatggcagaaagctgtgtgctgatattctttttcctgtttcttgtttttccctcccccaaaagttgtggaattaattttaagtagaaggaaaagggcagcttgagatgtttaaatttgacttaagttttaactgaagtttgtttgcaaaaagatgaaaacgggttaataactttagagaaaaaaaggagagtccctgttcttctccttcctcttttagggagagttgtagaataaaaggttgatttcatactcctaaggtttggaagccaaataaagaaaacaaaactgtgaagttaacatagtagttttggtttcttatttgtagaataaaggtatgatccagccccatggaccaaggcagcaggaggagagttcccagggtttttctaaggtcagaggcatgcagcattttcttccctccttccctgcctcagccacctctccctcccacctttacctcccgctaatgcttcttttgggcttgcttgggccatgttgttttgttttgctgctttttgaactctaaaaatataggtggcaaatctcaggtctgccttgcagggagtggccctggtctttccggaccccttgtgccccatggccctgtgggtctggtgtgtctcagtgacccagtaggtgtagggcagaatggctaggcactggcatgcccattcatccccaaatcgggccttgttgaatgtggcacagctccagctctttccaaacatgactcctgccagtccctatgctgtgagataagaatgggctacacctaagcaaagttttgtaggcagctctcccttcctttatgtgcttatgcaaccttttcagcacgttggtacctacgtgtcagggacaatgtgtgattttggtggagatgcttataatccaaagtattttcatggtggttccccaaacaacactaggctcagatttcagtttatcctcctaatattaatgttgtattcaaggatagatttttccctcccaggtgtgacttctactctttctgctccccctcccacaagcagctggattttgcaaaaactcatcaagctacaggttgtcgaggcctaaaacattcttatttctgttgagcttatgagaggtatgagcataattgtgtttttaggtagtgatgtggaatgcaaattgaattttcggaaatactgggaagtacttctgaaggaggaggtagagagaaaaaacttttcattgtaactgtgacctctcccttcttcagcttaagctaaatttagtgatacatagaaaaagtttggggcttatgatattgaattcatttcccaagcatactcattgttttgtaagaaatgcaacaaagttttcattttttaataactcggcaaaggtactgggtacaggggacccctttgccctttcattgagaccatttacataagtttttgtagtttctgtaacttttattattttatgttctctctcatagaagtgtatgtttctggaaggaaggcgatttgttaatacaaatcctaaagatagattgtttacccttgaaaagaaaggatcaaagaaagcaaaaaccatataaaatctgccttcctacatttcccattcctaagactttaggataaaatctcctctcctgttttaagtcacttctgtctaagggagtttttttgcacacaacatgaaattagtgacctctgtgtttgcacgtggttatgaggggcctgatggtgttcaaatgccaagctgccaatttaccttgttagtgatgagtttgataattctgccagaaatggactttttacattaatgggccaagtatagaatattttgagattcagtaagaaatattttaatggtggcaggccctggtccccttcattctgtcagactgcccagatactgcttccttcttgtccgttttgtttaaactttccattcatatttttttcttcctgaaatgtttctttattttgaggaatgcccccaaagcttataacctgtcagtgtgcattattttaccatgaaggtcaaatgctttattttctacctttctcttccccatcctattatcccttagcattgaaaacatttttatagtactatttttgttattgtttcccagtggtttttgaggaataatggacctgtttgaggaaatgtgtgttgcctgatctctagaaaaatgtggttacctaagacattttgcatgtgatttggatatgatttcaggggcttatggacccactaagtcccatccatggactcctggttaatggcctaaatgaaaaaaaaaaaaaaaaaaaaaaaagttcaaagtaaaagtagtaatgtggactcagaggtatagaggggaaaatgtccagattacttgaaaagttatgggttgttgaatgaacatctcctctagtatgttttgtaagtagggaaggaaaacatttgtttgccaagggaatgagaaagtttaagcaggaaatggaaatcggagatgggtcactaagaagcaacatttagaggaaagtggaaggtaaataaatgtgtacctgtccataggcaaagttacaggcaatttgggagaatccagaacactagcctaattacacactgtgtttaaaaagtgatctgtggtttaaaaaaaggatctggaaaatacttaatatacactgtcaccctttagggacttcaggatgcgtaccagcagactgaagcccataagtcctgcagtaaagaaacctgttttatattgtttaatccatcatatcccaaacagttgcagctcaaagggatgctttttttttcttttttcttttttttaacagaaaacagttatcagcagaacatactttgggaaataaactgttggactaaataaactagagtcttatctaactctttagagtctgaagtgtggatggtatcttgaaccacaataagcagagaaaatcccaaaggactggagagaaaatttactctggagatggcagcagctaagtgagaacagaacttggccatacagttgtgtcttaacttgtcccaaaagggaagtgccagaatgtgggtgatgccattgggctatgttagagacacatcagctcagaggttgtataagttgtttccatggctagatgagaaagagagccagacctaagagtgtccccttgagccattagaaacagtgtcaccccagagatttactcttttcaacttctctgtccccattaaatccagaagcacaccaggctgagaatgggtaataggcttaagcacaaagaaattgcttatgattctgaatgtggaaggcatctttcttttcagctatgaggatgctcatttaagagaaattgctttcttattaaacagaatgattgtgctttttttttaattggatcagaacatccccatgctgccttgtggtatttgtacctaacaaatggataatgactatgtgaaattatggattctgttggctaaatttaagctgtcaatacagggcaaaagggtactttgattccattacacattgcgttaccagtctccagagtccatggggttaggtactccatgttttaatatgtttcaataacttttttatactgacgtctgcaggctttggtaactcatactgtagacctgtatgtggctgtgtccagctgcagcatgtgaggtagccagagagctatttcaggaacaaacagagctatttcatgtttcctctaatttgtaataagcacttaggtctgcctgactcttgagatgtatcacagagttcatcacacgccacctattgtagtactaaaaggtactaaaattagaattcatgcttttggtgttttaaaattagcgattcttttccctctgttgaagctatatatatttgttaaatagtgtcttttaaacccataaattctaagctagaattgatgaacattcagattaaagcaagcaagaaaaaacttaataaaaacaaaattcctctcacggagtttgaggttccagtgatttagtgggtcatgtgttttccattaaggatatagttcccatgcagttaataatgtacaacactgtgggttctctctgctttaatctttgccttcttcctccctactgtcccctcttccatctccctcaattggggaggggaaaatccctgtgcatctttctgttctttgtagaatttgttccttggtagtttcttcatcaacttgagtcacctcagccctagaggaggaatggattagctgaattctgctgacttgttgctacccagctctgctgatagggacatttgtagggtggggatgacaggggattaccaagcagttgctgagtgataaactgaactgaggcaaccacaagcaggatacataaaaaagaaccactggcacgcactgacccattgctctgaaccagctgtctgtgctgggccctggtgggaaatggagggaaaaaaaatctagagctttctcttgaacaaagttacgcacaacatgagtcagaaacaaaattttaaaaggtctggggctgtacagattttgttgtggggaggggagtgttacacattttatgatgattgacttactggaaattcaccatcatggaaacaaaaatttagggaagaattctgaatgtgttctgggaagcctctcattcatgacattggtttggcagacaaatggcttccaggaatgcctacccagggcattgctttgtatggcaagatgtggatggttgataactccttgacctggtggtcattggagactgcccacccagggcaggggtgtctgtatacccctcacctccttcatgctgacttagcatgatggccggcaaggagtttctctaattcttgtctgggcatattctttctctttcccttttctttttttatgcaactaataaaaagattgctaacacttattacataggaaacttgagatgtatacagagttctagaaaatgggatgagagctgtttttattcctagaccagagtaactttgtgagagcaagctgttttttattccctgtcctccaccttcctttcactctgttattattcctgttaataagtaaatgacccttctgaattgaaacagggttgggtctgctctttaaaaacataacctttttattgggattttctttaagataggctaatttattaaaattaaaaaatcttgctaggtattaactttgttgcttatctaagaccaagaaatatatttttatacatctcagctctcacctatgtctagaatgttgtatatgtgtgtagtttgtggatttatgttttgaatacattatttcttatttgaacggtgctcaacattgtatttaggaagcagcatagttgaagatgatgggattttcataatgcttcttataatgacccctcacttagtatgtgccttgccctggggctcagtgagagggttgtgtttccacaaacatgcttcttcgtggtcttttccattatggtaagccatagaggctttcccgggctcagtgtgccaacttctgactgcaaatgatctcattttctaaaatctttctcccattctcctttaagaaaaaatcttagttattaaaaatctgcctcacaaacttagaaatgcttcagagtaagtatctgagaagcaagcccaccccacatccaccatatatcatcgtttctgttaagggccatcccatttcttcagacaaattctatcttcttcctcccatcccacttacttttgactttgaaggtggattatctcatctcaaatttccttccagaatagaaccacatttcagcaaaatattgggtggctggttcttttcttcaagacccacctgcatctgtgttggtcctctatgtgaggaaggtcctctatgtgagaagatctgaggggtaagcaggttttaatggactaagattttttttatatgtataaggagggtgggaggaggattttagaaaactagatccattggcctgcagttagaagtcgaacactgaacttgggaaagcttctgtggctgaccgcgaggaaaaagactactttagtgactactgacataacctggtttgtattacctgtgaggactagcttcacacaaattgatgttccatcgatatgagcctttataactttatttcctcccattataaaactatgtgtgggccaggtatggtggctcacacctgtaatcccagcactttaggaggccgaggcaaggcggatcacccgaggtcaggaattcgagaccagcctggccaacatggtgaaaccccacctctactaaagatacaaaaaattagccgggtgtggtggtacactcctgtaatcccagctgctccggagactgaggcaggagagtcgcttgaactggggaggcagagattgcagtgagccaagattgtgccactgcactccagtctaggtgacagagcaagtctccatctcaaaaaaaaaaaaaaaaaaaaaaaaaagtatgtgtgttcattgtagaaaatttagaagccagagattgcaaaatgaaaacaacctataattctgcaatcaattattgttaattttttgtgtgcatatttcctggttggttgattggaatgataagtaagattttaaaatctggttttcacttaagcctcaggtactttgtggttgaatgtcttggctaatttttataagggaagaaggattatgaatacttttatgtcattaaataatcatcaatgacttcaaacatcttatttttaaataattgtagaagttgtgggaaataatgcagagacatcccatgtaccattatctagttccccttgtgttaatatattgcaaaactgtagttcacacaaccaggatatactgacattgatactgtcaagatacagaacatttcttatcactgcaaggatccttcctattgtcttttttttttctgacggagtcttgctctgtccgccaggctggagtgcagtggcgcaatctcagctcactgcaagctccgcctctggggttcactccattctcctgcctcagcctccccagtaggtgggactacaggcacctgccaccatgcccggctaatttttttttttgcatttttagtagagacggggtttcactgtgttagccgggatggtctcgatctcctgaccttgtgatccacccacctcggcctcccaaggtgtcctagtgctttttaaaacattttatttttattattttatttttgagacagagtcttgctctgttgcctaggctggagtgcaatggcacaatctcggctcactgcagcctccgcctcctggtttcaagtgattctcctgcctcaccctcccgagtagctgggattacaggcgcccaccaccttgcccggctaatttttgtatttttagtagagacggagtttcaccatgttggccaggctggtcttaaactcccgatctcaggtgatccacctgccttggcctcccaaagggctgggattagaggggtgagccaccgcacccagccccccttctattgctgtcttatagcaacagctacctcctttcccctgcctaacttgacccctggcaaccattaatctgctcttcatttttataattttgtcatttcaagaatgttacataagtgatcatgttatatcatacagtatatggatttttgggattgactttttccattaagcctgatttcctggatccaagttgttacacatctcagtagtgtgttcctgtttgttactcagtagtgttccactgtatggctaggttacattttatttattcactcatcactcaatggacatttgggttgttttcagtttggggctattttgaataaagccttgtgctatgaatattaatttacaggtttttatgtgaacgtaaattttcatttttctgggataaatgcccaatgacttcattttaatgatggcaaaatatttcattgtatgaaataaatatttcattaatttagctgatttcttctaaatgggttgttaagggtttttccccctagtttttctgctgttataaatatcactgatgaaaatattttaggtaaatcttaatgtatatctacttttatttctagaagtggaattgatgtctgagagcatacagaattttaaagctttgctttttctagtcactcttttttttctttcctaaaatcttcctaaactcctaccatcaatgtatgaaagtgcccattctcatacccttgccaacacagagcattattactttaaaaaatctttgtaaatttctgccatacgcctgtagcagcataacctaaagcttcactgtaagttttccaatcccacttggcctaagaagatctttcagagtaacagagatgccaccaagatcttgttttttgcgtgaagtttgggactctgcagcttcatagaacctcagaggatttggtctagaatggggtaaagaattacaggaaatcactgagtttttgtatgttgctgctgtctgttatttgtccctcatatttatccagaaggaggcaagtgtgctgtcataagcaatagcattaaaaccaaaccaaaaaaaaaaaccttttattattaacaaaggttatttttttataatagatgtggataactttttataaaggccgattaatataagcaatatagatgattgtgtacatgtgtctttctgtgtgttttgtattataggaacctattttgaagctcttagagctgagagttaagtggtcttttaatggaactgctaagacaaggtagagtaggagatacttttcttccctctttatgctgaagtgttttagtgtttctgtctgtgactaggcagtaactttgaaaggaataagatagggttaataacatatctactaaaacttggaaaatatactatattttctgagataaaaatctttggattgaaaattactttctggtggaatatggcaaactgacattcattcaatgtaagactttttttccctcactttttgtgttttcatctgtagtttttttttttcttttttacctgtggtaccatttttaaggtgaatcaggccagtttcagcaaaaaatggttgtactgttcatcacttcagtagaaggtaggatgacttcgatgaggttgtgctcagtaacttctctggtgctgaattagtgtcctgtgacaaagaaggatcccattcttacaaataaatgaataaaggagactagcagaatctggcatttctctttttaaaagtttataatcaattattcattcagtcattcaagtaccttctacatgtttgcagctaaagactaatgagtgtaattaaacaagtggatcaagtaaagcatcagccatgaaaacttttcactttctcggggatgataaaggaccctcctttttttccttgtcatattttccagtttatcatgattcttatggtattggtgattttaactttaagtgtctagaaaatttacgcacattttggcctaggaaagaaaatacagtattgaagaacaagttgaggatctccaggtattaaatataacctgatttccagaggaacttgatataaagaggataggactctgctaatggggagaggagggaatcattgttggggttttgggtagagcatcttctttgaactaatcctggacagcctttcccaaactgagggtgtgccatcatttccttgagggcagtagaaggccctgagaatctatctgacagcattattgaagctcaagagtttagttctattttttaaataaaaatttcccagcatggtacattagacaatttttttttatttaaaaagaagtatttttgtaatgatcttggaaatatctataggtccaggaattcctagaataatttttttactatgaaattgcctaggaatggtgacttaagctactctgaaataatatggtattgaggatgatcacatcctgcaaacaactgcagcctcagactactttgactaaaaggattctaatgtgagtggttggaaggaaaggaggcagcatcaggcacaatttattgaagaggtcagaagtagctagaggagaaaccaactttttactcttaaataatcaagatttttatgtagatattttaggaaagatatggtcattaaaatttggaattatggtgaatgaaataagtaataaagaaaaactggaaaacgacagtacgcactgttaatacatttcttggtgactaaatgaggtgaaagtcattgggttcctttgccctcttcagtggcaggttaagtttttatggcttattatacctttggatgattgtgtagaagaacttcctgatatattttttttcttttcgaatttaaaggtaatttaacagcgacgtgcctttgcctgaaatgagtagaaatgttatatgacttattagtatgtaatattacttctgacactgacatttgtgaacaaggaataatcagtttgctttcttgttcattattatgttttaacaagaaataagtgttacagtgttagagtctctactagaactgaatttgaacaacaaccagtgaatgcagccaaagaaaacagccagtttggatgtttcaggccccctcaactttttgaaggttgggttttttttttccttgttgctttttgcttttcagtttgtttggtttggacccttttttaagtatttgaaggattgtctaagcttaagtttatccttatggagatgccttcacgtggggcatctgaatgtcatgagtttggtgattctaagccttcccgttttgtgacttggctcacttatggagtgtaaaggccctataagaagagagaaaaaggtatttgaagtcaaatgtttctgttttgcaaatttactttatactgttccaccacaggatgtggcctcttggctttattaatttttatttttaagcttaagatgttgcttaggccaaaataaactttttagttgagataaatgaagttcatagtcacactctttatcatgggtatccttatatctaatactaacttttctttttttttccctgagacggagtctcattctgtcacccaggctggagtgcagtggcacaatctcagctcactgcaacctccgcctcccaggttcaagcagtttttctgcctcagcctcccgagtaactggaactacagacgcccaccaccacacctggataatttttgtgtgtttagtagagatggggtttcaccatattggccaggctggtctcgaactcctgaccttgtgatctgcctgccttgacctcccaaagtgctgggattacaggtgtgagccaccgcgcccagtcctactattttttttcattttatttttgcgattttgaaaactattaataatttctgagcattcactatgtgtctgacactactgtgtcttttacatacagtatttctaatctataccttggaagttgctcatttctcagaaaaagaaacaggcctagatcaattaaaagcttgcctcaaatgacacttctggtaaataaagagtgggattacaggtctgatttcagaaatggttcagggatgattagaattatcctagaagggaaagatttgtttgttttgttttgtgttagcacagggaatatcaagatgtttcttgttttgattacctgcttagataaagcaagggaacaggccaggaggctgaacagttctgagagggaggcatggaaatgcagcatgaggcaaattcgcatgtaggacagcaaattagatgaaaattaggttgaagggagaagtcacaagatccaattattttgttcaatgtagtgctttcaaatcactcaaaagaccaaaaaaagttttattttgtcatgtgagcatgtgatcctggatagttaattgctttgcaaattgtcattggtaaaatgctttggaggtttttatgtaagagttacaagtaaattaaaatagtttgtgccacaaagaaactttggtgcgaaacagaacaattataatttaaaagaggtggggcagtatgagaaagcaactaatttggtattaaaggtttgaagactggaattctgtacagtatgctgggagactcatcagaacctcttccctgttgtaaataatgttcttgtcagttaatgcctaattgctgctcttgcctagaaatccagaagctttggagataaggaggtctctctgaatccagttccacagtatatcagcccctttgttcaccccatagactgtacccttcccaagggcggtttgttggcaagtctgtctggtagggcggtgttttctgcatagtaatcaggcctctgcaattgtgatattcctccccttccccctaaactctttgggttcttgacacacatggcaatgccactggtataacagaaagtcagaaggagaaaaagagaaaatgtcttctcgagttccaagtgtctgcacagccttgccagactatgattaaggcttatctacaggagactgcatgaaaaactttcttcttctcttcccaggaagcaagcagccttgtgaacaagcaggttcggaaagccaggaactgacaaacttttctagtccttttgccagcctgttctgcttttaccaagagtttagtgacaggactacctgttttcaatagttaaaatgtatattttgatcacctttagcacatgctaccttgcacagctctttttaaagccttatgtattctagctatttgaccactgttgtgtgtgattttcatttttgatgcctgatgtgacaggagggggtgaggatgggggtcccataaagatgcagagtaagttgaagaagacaatgcttgtcctgccaccagatgtctcttgtttttatttttgtttttgttttgttatgtgtaaaaacaaatgaacccttgggatattaggatatttcggagcaaggtgttgtcactgtttctcagacttggggaatttagaactcatagactttttaattattaacttgtatgttttgtctttcatacctgaaaggtcgtacttaggagatgaaagaatttttatcccaaattgaaatgtcttagaagaataatatttcagctgggcgcagtggctcaagcctgtaatcccagcactttggaaggccaaggagggcagatcacttgagctcaggagttcaagaccagcctgggcaacatggcaaagccccatctctactaaaacaaaaattagctgggtgtggtggcgtgcacctttggatcgcagctacttgggaggctgaggcaggagaattgcttgaacctgggaggcggaggttgcagtgagctgagatcctgccactgcactccagcctgggtgacagagcgagactatctcaaaaaaaaaaaaaaaaaagaagaaggagtttctgtactcccttcagaaacttgcttcactgatattttcttttctgatcctggaaaggttacatgttttgaaaatggaattgtaaaatgtgcttgtttctaaccctgtttttcttgctctgtttagatgtctagatgattatggatacattcttttcagtctctaaagtctgagggagtccctgtatcctaatttttctgccagctgacatgtagtagaatataagcatccttctgcctttagggacttgcagattatattctttggatggcttacttcagatgctaaggacaaaatttattcattcactcaataaatatttattgatgcttactgtgtgccagctcctgttagagggttggggaataaatacatcagtgaacaaaagataaaatccccctgcctaaaggagatcccatcctaatagaaatgtatgttctttaacagtagattattatcctggaagaactaatctttataattaccagattcttacttcagagcagtggcatttggggagttggtggcaggtctaaccttcagtcctgccctatttactgccatttccaaggaccttgggatcatataatggtagagttgaaagacaggtggaaattctagtccagttccctcattttattcatcagaagtaatgtgcaaattcatatgcatactcccagtgggccttaagatcacctcaagtttctctctgtttcaaactgaagtgtctgttctatactcagaatcatctttagaacacttgagtgagatctctagttcagccctttgaaaaactgatgcttggataaattaagtgacgctctcactttatttaaagatgattgagaattggctatcactggcctattttctggtcttacaagtagttctgccaaagaggctaatttctaactgggaattgtcttttgtccccagagggaaatggaacatgaactggattggaggcacagtcctaaagagagggatactcagagaactttgcagaactttttgggttaaaaaaaacaactactcttttctggtgctactgcagtttttctatcaaaaacaaaatccaggaacaaaaatactctggcagaaaccaggaaaccaaatatcagaaaccaaagagccaactctatggtttctgaacagagtgtaccatttaggatcctgtttagctacctttgggtttattggaaaactactccattgtggttacaagtggaaaacaatttaaaggctcttctttggctttggtacttttacagggtttcacatttctaatagtaaacgcttcagaaagtttgaagaaatatcctattctcagagagagggtaggggaaagcttaactttatttttctctatccctcccctcccagagtccagaaaacgggccctaaattcccaggacagatttgtttcaacctcaggacagttgcttaagcagttaatgctcagcagtatagaacttgtttccttttgttaacgctgaggttgctacggtacttggccagctgtggaggtttgtgagctggacctcaagctattaagaatagctttggttggtttcgccttaatccaaatgaacagttaccagaggacatgatgtagaagaggttatcggaggttagttcttaaaggtctttaagatcagcctgttgtaattcacattcagtaaagctatggtttataactggtaagctgagtaaatggattatctctaagccttactatttttaaccttactccccaaataaatggtgaattgtcacgtcacttccaaaaggttttatttcagtgagtgtttagagactagacagatttcactttgttcctggagaagtcatggttgtggtgactgagggcattgtctgctattgtgggagaggcaccaagatgttacacacttggttgctgatgggcctgggttctaggccaggtttagatgcttagtatctgagtcacctagagcaaagttgtaaagctgtgctcttgatctctttagctttaaaatcagccaaaatacgatttggcctattagctttccaggtggtgatgaaaagacactattgaggttgcaggtggtattgttaagaagggaagcaggaagactgagcatcagataggcctgtgagtttgtttctcgctgcatctctctttgtatataacgctgtggatcgcttttaaggctaaggtatttgtgtttctgggttagccacttgtgccaacaaagcgacctctctttaactggaaagcagtttggtgttctcactcatttcttcaggacatatcattacaggtctttgagttgtagttaggactttacacgtatgaatatgctgctaacacgcctggaggacttaactgttgacaacagggctccttttgcctagactagagttttttcattaaattcaggagatgtgcctgttgaattttttttaaatgtacacatacatgcacacatatgtacatttttgaaaagaaaacagttgggggaaacctgtcaccactcctcttatctgagttccttgcagatttggccatatatgcatgcattgtttgcttggctgcagtaagagattttttttgcactttgctttgtttccccttcccctccccatatacaggctttacaatggctatttaaaatcgttgctttaataggacaagggttgaatggatttataatttatttaattatttcctcactggagagcccttgatttttttcctctttattttaatattcttcaatattataggtattgtttttgtaattttaaaataaaaggactgagtctaagagtcctgtaaattgcttagattctgttaataactggactccttatcaggaactcagagtaaactggccacaggaaaatttgcctcacaagaaactcaatagaattaaaaggagaggattcagtgttcttaagtacaagtgaaagtcatgggactggaccgcttagcttcatgggctgagcctcttcacctttgtgctctaagaggaaaaaacagtggagctttctgagttttgtgtgtgcccctgtgttttggtttttaagagagagaacgcattcatactctgttgtctttgcaagtagatagaagtgataggacagggactgggtgaagtctgaggcatttaaatacagtgtaaaacagtgcagagagcagccctccccattttcctatcgcccacaccttttgttccttttcctccctccacatcttgtaacccagaaaggataaaaactcttttcctataatcctgctgtttttgtggcatttggataattttacagtgacataaaattgcctccctgttttgaaactggtgatttattttgaaaattacctgtggaaaacaatcgtagttattgagttgtaatttgaaaacactgaaatttaccaatttaagtataaaatttgagttttagtgaatgtgtacagttgtataacaccacaattatgataaaacatttcaaacatttcatcgccacaaaaaattccctcatggcttattttcatcagtccctctccctccccctacccacccacaactgctgagctactttttgccttttctagaatttcgtataaatgtagagtcattactgtatgtagccctttgtgttagcatctttcacttagtagagtgcatttgagattcatccatgccttttgtcagtggctcattcttttaattgctgagaagtatgccattgttgtatggatattctgttatagaaatataccggaatattttatccattcaccaggggatagacatttgggttgtttccagttttttacagttatgaataaaactgctattaatatctatgttcaggacttttggggatgtatttattcatgtatttgtgataaatgcctaggagtaggactgctgggtggtaagtgcagtgtatgtttaactttataagaaactgccaaactgttttccagagtgaatgtactgttttgcatttctgccagcaatgtatgagagttctagttgtttcacctcctctccaacacatgtaattgccagtatttttacttttctccattgtataatgtagtggtagatacctcattgtaattttaatttgcatttgcttaatgattaataatgttatgcatcttttcatgtgcttatttgtaaattgtatatcttctttggtgacgtgtctattgaaatcttttgccttttttttttttttaaaggattgtattcacaccatttagttaggaatttcttatgtattctgaatacatgtcttttatcagaaataagtattgccagtactttttcttgtttgtggattgcttattcattttgttaacagtgtcctaacaactaaagagctaagttttagctcttaaatttaagactttgatccatttggagataattttaatattttgtatgagtctggattcatttatccattgaacttccttgacaccttcgtgtatttctagaccctctgttctattgattgcatgttttctttcttatactaatactacattggtctttattactgtagctttattttgtcaggtagtataactcttccaatttagttctttttcaaaatcatttgtactgttctagatctagtcatctttaatttctctcagcagtgtttatatgttttaaaatacaattcttacatactgtttgtgaaatttatccccaagagcttcatcttttgatactattgtaaatgatattttaaaaattagtttccatttgtttagtatgtaaaaatataattaattgggttttgtgtattgaccttaatgttgtaactgctaaactcatgtattagttgtaataccctttttgtagagttcttaggatttttttacattgatgatcatgtctataaatagagttttctggccaggcgcggtggctcatgcctgtaatcccaggactttgggaggctgaggtgggcagatcacctgaggtaaggagtttgagaccagcctggccaagatggtgaaaccccatctctactagaaatacaaaaattagctgggcgtggtggtgggcacctgtaatcccggctactcaggaggctgtggcagaagaattgcttgaacccgggaggcagaggttgcagtgagccaagattgtgccattgcactccagcctgggtgacaatagcgaaactctgtctcaaaaaaaaaataaaaaaaaaattttttttcttcctttctaatatatactgtatacactttatttctttttcttgccttatttcactggccaggacctccaatacattgttgaatagcagtggtgaaagcagagatccttaccatttttctcatcttaaggggaaagcattcagtctttcactgttaagtatcatgttaggtgtaagtttgtcacatatttcctttatcaggctgaggtagttttctctattcctatgtgttgagtagtttttgttttttaaattatgagtggatattgaattttgtcagatgctttttcctcacctgttgagaagatcagatggtttttctttttcagtcttttaatatgatgaaatacattgactgatttgcaatgttaaaccaaccttacattcctgggataaatcccacctggtcttgatatgttaccatgagattcaagtagctaaaattttgttaaggatttttgtgtctgtcttcatgaggaatattgatctatacatttcttataatatctttgcctgtttttggtaccagggtaatggtggtcttataatatgagttggaaagtgttccctgttctgctctggtagcactgtagtatctcttccttaaatgtttggtagaattcaacggcagttaagccatcagagcctggagttttttgtgtgtgaggaaatgtttaactgctaattcaatttatttcatagatacaatgctgttggcttgtctgtttcttcttgaatgagttttggtagtctgtgtcttttaaggaatttgcccattttatttaagttgtctaatttatgggcataaagtcatttataatgttctcttattatccttttaatagatatatcatctgtagtgatttcattttcattcctgatgttgataatttgtcttaactccctttccccctcattccttatctgtttagtgccttgcaatttcattgatcttttaaacgaattaacatttgcttccactgacttttcccccgttacttttatgtttttacttccattgattttttttttctcttttaatcttttatttcttttcttctgcatgttgtgggtttaatttgctctttttctggcatcttaaggtgaaaccttagatcatttacttgagaccttccttcctaatataaatgttgaaagctatacattccttgctacaactgctatagatgcatccagtgaagtttgtttttgcattcagttcaaaattgtttctattttacctgtaattactttggtctgcagtttgtttagaagttaatttttaaatttccaagtatttggaggattttctggatatttttctattactgttttctaactaaattcttttgtggttggagaatctgttttgtgttgttttaaatttgttgagacttgttttatgagccaagaatattgtctatcttattgaatgttttccatgtacttaaaaagaatgtgttttctgctgttttgggtgatttgttctataaatgtgaattaggtcaagttagtcaagttcattttctcactacatgttctatcaattactgtgaaaggaatgttgaaatatccagctgtaattgtggatttgtctacttcaattctattagattttgcttcatgtttttaacaaactttaattgaaaaataataattgtatactgctttatgtattttgaaaatctattattaggcagattaacatttaaggttgttatatcctcctgatacattgactcttctattatgaattgtctctcttcatccttggcagtatttgttgttgaaatctgttcattaataactgttaataatatagttactccagctttcttttgactactgtttgtatggcagatcttttttccttgtacttctaatctatctgtgtctttatatttaaagtggattccatgcagatagcaaattgttgggtgttttttaatccaatctgacaatctctggcttttatttggagggttttttgttgatgttttggtttttttttgttttttattttttgcgtttttttcaaagaccattttgtttaatgtaattatatttgggtttaaatctgttatcttgctattagttttctatttgtcccatttgttctttgtgtcctattcccccttttcttgccttctcttgagttaggtggttttgtttggttttaatgaacccgtgttatctccactcttggcttattaggtacatctctttgttattttttaatggttgcgctaggatttacacatctttaactgatgatagtcaatcttctgccactttacatggagtataaaatccttgaaacaatatacagccacttctcccttattattcttagtgctattttcttctacatgtatgttataagccccagaatatattgttatttttgccttagatagtcattatcttttaaagagattgaagataagaaaatattgtctatatttactcatatattgatcattccccgctcttcattcctttaagttcagatgcccatctggtatcattttctctctgcttgatgaaactactttttaaaatatctctttgaatgtaccactgctggcattgattctcatttttgtttgcctgaaagagtctttattttatcttcgtttttgaaagacacttttaataggtataaatttctagattggtagctttttccctctcttagtaaggatgttcctccattgtctcacatagtctctgaaaagtgatttgctcattctatatttctcttaatgtcttttttcttctgccgcttttaagtattttttttttgtatcactggtttttattattgtgatgtgccctctttaattacatctgttctttttggagtttgttgagtttttcttggatctgagtgtttatagttttttataaaaaaaatttaaaatccagccattatttcttcagattttttttccatcctctccctctttcctcttcttttatgatctcaattacacatatgttagacaatttagtattgtccccatagatcactggatactctcaatttcattttcagtctttccctgtgcttcatttgggttagttggttagttgctgttgttgtgtcttataatttactgatctttctgcaatgtttaatttgctgttaatcccatccagtgtatttttaaatttatttttctttactagaagtaccactgggtttatttcttttgtatcttccaatttcctgccttttttccctctaccttcttactacatagagtatatttataatttttttttttcctttgagaatgagtctcactctgtcacccaggctggagtgcaatggcgcaatcttggctcattgcaacctctgtctccccagttcaagcgattctcccacctcagcctcttgagtagctgggactacaggtatgtgccatcacgcccaactaaggtttttttttttttttttttttttttgagatagagtctcattctgtcgcccaggcttgagtgcagtggcgcagtctcggctcactgcaagctccgcctcgtgggttcacaccattctcctacctcagcctcccgagtagctgggactacaggcacccaccaccacgcctggctaatttttttattttttagagacggggtttcaccatgttagccaagatggtctcgatctcctgaccttgtgatccacccgcctctgcctcccaaaagtgctgggattacaggcgtgagccaccacacccggccaatgtttgtattttttagtagaaatggggtttcgctgtgttggccaggctggtctcaactcctggcctcaagcaatcctcccaactctgcttctcaaagtgctgggattacaggtgtgagccactgcgcccagccatatttataactttttaacagctttgttgagacctaattcacattgccatataatttaccaatttaaagtttgcaaattgatggtttttagtatattcacagagttgtgcaactatctgttgtgcaaccacaatctaattttagaatactttcgtcaccccacaaagaaaccttgtatccattagcggtcatttcccatgtaccccactccttttcagcctatattgatatgaaatgtcagtctatagggactcttctggacatttcatatcaatggaatcatataataggtagtactttgtgagtgccttctttcacttagtatgttttccaggttcatccatgttggtagcatttatcagtacttaatttctttttattgctaaataataatccattatatggatatactacattttatttattcatcagttgctgggcatttgaattgtttccagtttttagctattatgaataatgctgctgtgaacatttgttaccagtttttatgtggacatattattttaatgtctttgggtatatgcctaggagggaattgctgggtcatgtggtaactctctttaaccttttgaggaactgccaagttgttttttaaagaagctgcactgttataatagctagttcagtgcccttgtctgctagtcccatcatcttgtctcatttctgggtctgttaattgattgattattttcatttttatgggtcatattttcctgttcctttgctatgcctggtaatttttacttggataccaggcattgtgaattttacatagtttttttttcatattaaacaagaagtttatttaaacagtaagacgcttgacttaaagagaaaactatataggattcttttttttttagagtagtttatccctagataaagacagattgccctacatataacagctacatacaaaaaagttataaaattgtccttggttttacagtgatcaattaaaaacatgaaaattctccagttgaacaaggtatgcaaggatttttatgggttttttgtttgtttgtttgttgttgttaaaacagagcaaaataacttactggaatatgaagagcaggatgagcatgccactaatggagagtgggggtgttttcacagaatcagtgtttttccccatcccgtctccacttgatgtcaatcaaaacataccgttggctgttaaaaaaaaaatgcagtgtgcttgtgcacatataccagttacttttatgtacagtaaaagaatggagaaggaggaaatgaacaaacagagaaaactatgctgtagtagtcagggatgtattggaaccaaattgcagttttctacttgagaaggtaatcgtggtctgcgagaacagagttctggaatgaagaagcaggttcccttctcagtagacacctcccatctgctgttggaacacgtcaatcgtatcttcattctccatttccaactgtacaggtgtgtctttttcattgatttggttgccggtcaaatcagagtctgatctgcctcatggacaatccctgtcattcacaataggctttcattagtttactaagtggtgtatgcctcttaatcttaaactgcaccacagaaccaccctgccccaccaccttcaaattaatatgattgttcttagtcttgactccttcctggggctttttgtcagccatgatgagcaccggtttctcctcagctgccgcttcacaaaagagatatcaggtccacactgaacgagcacatgagcagcaccaggagccacagaagaaggaggcagcagcagcagatgaaggagagggaattttacttcattgagtgctagattttgttgtattcttttcaaaagcgctagactttgttctggcatgcagttaagttacttggaatcagtggtatcgttttgaagctagcatgtaaactttgttaggctggctccagagcacccattaggaatgatgtagcccgagtacttatctgccgtaaggcagtattcttctgaggactttacctgatgttgtgtgtcttgtgaattatttttgtttttgttgctggtggaaacatgaactattgctagctttatgtgaactgtaggacttcttaggccaactgctttctggtgctcgtatccctaactttaagtagtttcctttgagagatgtgcagatcagtctaagactctaggaaccgacccttttgtgctgctctcttctcctgggtgttctgcccttccaattctagccgttttggcctccttgaatgtggcttctctgattactaatctgtgttacctctactcagtaagactgacatgctctgtgttcccccttctctttgctgtggcttggacactacctcctggcagtaagttcaggcaaataagttcaaggcttgtctcatatgtttcactgttctcagaaattaagtcctatactgcctgttgtccaatgtctgaaaacagttgtcttgtgttttgcctggttttctagttgttcctctatcatagatggaatccataataaatatgatgccaatgccaaaatctgctactatattactctttaaagcagagactgtataggaagaggaaaaaagaaatcagtgtaaccgtgggggcaaggcaggaagcattctgtttatgtaacacagacgtggcattctttactttctaacttaggacatttgtgatttgaagaagagacacctgaattttcaatatgttagtctttgttggaataattggctcttctcattctttagtcatcaaataatacttattaaataccaactaagtgctttgtgccctgctaggcattacttctctttattctacttcttaacagttggaatatgccaaacaaatgaaataaaaatagttttcctattctagttacaggttggattcttggatttatctcccaagctttgacattcagaaactgaaagtggaatatagtgtattctcagatgtaaagttgatctcatttcctcactggccatctgtttatttgcgtctaagaataacaaaactttcatagtcatatctgtattttttaattactaaaaataatgaatggactgaaccatgcttgccccacttttgaaacaattccttctatagactgttgcagtaggaagctaatacccctgattaagaataaagaccagacctacataagcatatgttgtattggtgtatctgaagtcatgaggatgtgattaatggtccttaagagttttaatttggcgtgtcttaatgcctaaatctcacttaagcttggttgcaaagcctggcaaatcagtcttctgtacatggcaagctaagatgtggcaccatcttcttgaggtttcatatcctaaacctgtctgtccttacaggttaaattcaaaggatagggccaagcttgatttgctgtagtcatagtgaatcatcacagatccattcttagtgcagaagagttaaataattccttggccaagagcatggtgccttccccagaccaatttctaacagtgtcctctgttagatctttaagttaataaattcttttattagatttttgggtcagaaaaacagactatgcttgtactcaggagcccagaaatacataatataattgactaattcctgtctttgaggtcttaacgtggtttcatgtgccttttgatttgtttttacatgtggatcattttcccttaacactttaatatgatacaatttttgtctatcgtttttcttaaataggagggagaaaattttttttagtaggaaaatatctggtggtaagtggcatctttttattccatgtgggatgcagaagtttctcccaaaaactgaagtgacctgctttttgcagataggacccctgtatttctcccatattactttatagctggtagatggtagggctgtacacagcaaatgggtttgaatgcatgatggttttctggtggagctgagataattagtattatgaagccacgcttctgattgtgagaatgagaacatcaagtcattatttatcttggaaagaacgaataatttgtttatagtaataacaattttatttttctttctcttagtcaatagctgctgctgttggcagcttattatgaaaagatttcaagttgtagtttttaacctggggtgggagtaggggagaagaaaattaatatcgtaaatgtttttacttgataaaagttttatttgatacagagcctatactggtgtttttattgaatagtgttttattgctgacattcaatactctctttgcctgtagcctcccacgttatccaaaatgaaggcacttcttagatgtttcaatgaatgatacaaccaaaaatattaaaatgcctatttaagtcatatcttatttaaagccccatttcaaaggaggattttgaggataattagtattttaattgttaaagttagataattttgtttggatggaaaatctatgttcctgtgaaattggggtttatgaaataagattggaaaaaaatagagtgtataattgggcacattctgtactgcttagtgaatcaccaaacgagtgtaatcaccattaagcactttaaaagctatgcttgtatgtcctcgctctgcctgcagagctaggagtgcccacgaggaacagcagttcattcaggctgtagtcattggggtgactcgtggaacccctgcctgtgtgagtaagcccgctgccttgccaactgcctgctgtgtgagtctcaaagacatcagatgtcatcaagccacaaggacttcttggtcattcttaaggccatggcaggagcacagttcaaaatccaattcacaaggcaacgtctggaagaaagaatcaagtatgtgtgtagtgcatgatgtacctcagctactgtagtgaaaaattgttgggatgagtctttcaccatgttagtgtttttttttgttttgttttgttttttgagacagagtcttcctctgtcacccaggctggtgtgcagtgctaaatatcctgcagtgcataggagaggcccacagcagatgtgtccagctcaaaatgccagtagtgccagggctgagaaacctacctgaagcctcacagtggcatggtccgtttcagaagtatgtgggagagaaaattgaaggtgagaggtctgtagctctcctgaagtcaggccacataagtactttgccaggtaggtagtgcctagtgacagggatgtactagaaagaattcctcttgagcttggccttgggtctcgtgcagacatgttcatgtgacattaggggaggctgtgggcctcaggcagctaaggagtaactggcaagttttgtatggagagtcgggaagacagaagcaggggcagccgggagtggtggcttacctagtaatcccagtactttgtgaggccaaggcgggtggatcacttgagatcaggcgtttgagaccatcctagcctggccaatatgatgaaagcccatctctactaacaatacaaaaaaattagctgggtgtggtggcgcatgcctgtcatcccagccacttgcgaggctgaggcaggagagtcgcttgaacccaggaagtggaggttgcagtgagcccaaatcatgccactgcactccagcctgggcgacagagcaagactgtctcaaaaaaaaaaaaaaaaaaaaaaaaggcagggatatctgagacttaagttcctcttggagagctggagggtcaggagagcgaagctttctatcttgctttgtacctgagatctccttgaatcagggtgggcagggagagagaagggatctgttcagacatttccttttggggtcaaatgagaggaaggagtccttgccccttggagaattactgcaaggatctggttgagttgagaatttgtttcccccaccagtattgtttttggtgtttttttgttttgttttatttgttttgttttgttttaacatctctgtttccttcccctttctgttgttgctccttcctcctcccactccaactaccacacaaatcctgacaggagcctttctgcccctctagggaaggggcccgtgtgaggaactcttactggacgcccccttccctgttgctgtgctgatcttacacatcagtttccacggatcccatgtgaatcagttgtcttcctcatttactctgagcaagggtggcagcagcaatagcagaagacgtagatgcagtgactcattttgcatgatgtctgcaagagagccgggcctcccgtgtgctgtggctctcgttcaggcattgcttcagaaacttgattcttctggaattgtgcataagagggccttttagaaaaaaaaaaaaaaaaaagctggaagagttccccttcctgagcttcagtggaagcaacaggagggtgggccacgtccaggacagtgggagagcaaggatggaccctctgtgtccacctccagtgtgtggcactgttttccatctcatcttggacatatcatggggctacagcatgcctcagaagcctgccagaacctagtgatggtttccagcatctgggtttggggaggactgtggtgatgcgctagggatagccatctggaaggggtggggcagagacagcaggagccgtagtcgtctcaggagcctactctgattagcttataagttggcctcttttcatgatttctgggtcattggtgagtggataggagttataggatcctttgtgggtgagtagaagatactgtggcagataggttttactgaacccacctgcacatgtaaatctttcctttttaatgtgtcacctcttcagtttgggtggagaagcttgccacccccaggttcatccctaagcattgtggtaggctcaggactaacagacactagctcagccccattgagggcccccaggctaggcttcagctttgggaaagcttgttttctccttgggcaggccttgtcagacgttttgctcctgggtgtttgatgttttgatgtctgtactatacaaagccacatgggaaggcaaaggaatacacccctttgtataaatgacagtcataacaaatgaagtatataccagtttgtgctgtctgtcaaggagtaattcatctcagctagtaaaataaaggggaagggaaggaaattcaggtctttagctatgcattcataaactggacttaagaagagccttcctcctcttataatgctaactgctcttaatatttccttcttaatgaacagttgatataagagttttctcctttcatctaagaaatacagaacaatctgcaagttttcttagttgtttgttaaatggacttcgaaatgattgagaaattcgtatttctcagcgaaaataagtattaagttaatggacaagtagcagtccttgttgccaccaagattttgcatctgaattgtatatataaactgtgtcaggaatatcataaaatcatgttgaggctgcagggacaaggaaatttcatctcatgaatctgtttgatgttttcgggatgtcctgagagaaaaattctttgacctgcctagtgagcaaggtctaagtttgtccacccaggtcacattgtaccctgggctttccaaagatttatcctgcatctgagccaaaggcttttgaagcctgtggttgctggaattttagggtgtatctctttgcttcttcagatgagacatttcttaaggtagaataatggttaaaaaaaaaaaaacctctcagtttactctagaaagatacagcatttttggtacaaatccaaggaagtccaaagaggatcaggttttataattatattttaatatgtgaaaggagaaacctgttttatcaggccagtaggttttttgcttaataaatagtggcaagaagaaagctatgggcccagctggaatgggtgcagtttttagaaaagattatttgtagttgttgggcacatccttgcatgtggactttgaaataagaaattaaatcaccaccttatttttgcaggaaataatccaaatataaaaagttaaagttcgtattgtactttggtgaagctttagatatattttatatttcttaaaataaactttttttctatgcataaaagtggaggtcagatgaattacaagtgcattcttaactgagtggaaatgggtgctggtgtttcatatatacatataaattttttttgcagttgtttaactttttttttataaagagtcttgctctgttgcccaggttggagtgtagtggcacaagcatagcttactgcaactgtgaactttacctgagcctctggagtagctggaattggagatacaagccaccacgctcagtgttttttgttttgttttgttttgttttttaaagagatgggatattgctttgtttcccaggctggtcttgaattcatgggctcaaatgatcctcttgtctcagcctcccaagcagccggaattataggtgcaagccactgcacctggctgcttgacatttttatagactcatactaaaaagtttattcattgaatgagtactgtgtgcatagggttaaatttatctgacgtttgttataatttaaacaggagtgttgataaaactgtgtaaaatgaattagcatatacttgccattatgtttttatcttaataattgttatgtagtttctatgaaaagttcagttacttaacatttccatgcttttttgtgtttgctttatttaaccttaaaagagtgattgaagtaatagttttgttaggtcattagattggtgatctccccttttgtatagtcaaatttaatttcattgtttaagattgaaaactagtgcaaattctagtttgatcacaggaccacagttaaaggtgcattcacatatctcatataagatacctattttcactgtattaatcatttgcattaatcaataaattttaacttttaaaagatttgatggttaaaaagatgatggaaggaattatttctctaaaactaaggaaatccttgctctgggaagctgtgttgagaagagttctaagctctgctgcctgtgtcagtgttctctggaaagacctctcttggaaggatgctgtgatgtggagtcaggaggtcaggacccagccctaccctccctaccacctgccagctgtgtggccttgagtgagccaacaactttgccaggagtcatttgccttatctttaaaataaaagatcactaccatgtcctgggttgtttaagtgagattatgtagtattagtagggtgcctcccaccacaggtcctcagtacattgaggtttctttccctgcctcctgcctccttgcaaggaaagccagagcactttgacttagaattgtgtctgaattcagctggtgtgttgcataagcttggttatctgcttttcctctcagttcttcctaggtagaggtgagggtgagcgggggagcttcatgcagaggaaatagtctgaggctatttagtgtagaagcatacttcagtgtgatcctgggatgtctagaaaaggctagattatgtccagtatacactttttaaacagctaccattttaatgttttggtactgggaaatgtgttagttgaaaatttcacttacgagtaatccttttatttctctatggtaacaagacaggtaaggcatatcagttggcccagactcattggtcctcaatgactgactgccggactcagagttgagggtctgatctcagaggacgcaggttgtgttgccagcccagatacctatgacaccctttcctagcaagtggacgctgttttctgaaatatctgtcactaccttgaggcaatcctcattattttaatctttattcttaggctaatgtcttgagccatgtatcagagagagacaggcaggttgttgatttttgagatgaagaacaactatctggccagggagagaaagagaaaatcggcttataagttagaatggtacagagtgctctgccttctcagattattttgtttccaagaatcactgattatatagctttttttttttaagtttaagcccatacccattctgcatatttcagagtgaaatgtcctttcgggacaatcttattaaatcactaatctgaaattttatgttccctagttggccatgccagtattttggttagggttttaggtgatttttatatccactgtaaacttggatataacttaccattaaccagatacttaaaaccagggtattttcctaaggtttaacattggaagtggtatgtgagctgagccttgaagggtgacaccaagttttttgacacgaaaaggttggatgagctagctaaagggcttgttttttatcctgtagggcaggagtggttgtagatgccctctcatgtgctgacatactgattgatggtggcttctaaggtctctcctgagtctagtaggaggcaggcttcctaactgtcatggacaccaggcaggcaggtaggggaatgaagcaagatttggcagcgcagctgctgtgagtttgctctccagtggcttggaaatgggaagtaaaggattctgatcttatgtgagaccattttcagactgtcctagtctgccctcacatatccctggaatggacacatacaggctggtcagggctttcttggggcactgaggtgggagaagctggaggcctgggcagggtagtggaactgagagtgagaagccccctacacttggatctcttgcgtatcacacgagactcatttattgatgactgcctagctggctcataatactgatggctgaatgggggtatgaaaactggtcctcaagagtatccagtcttattggaggaataatgcaaaaacaaacaaacaaaaaaggataaaataaaagaaacaaaagcccaggtggtaaattttccagtcttcttggagaagtaacacagaaaaaaaggtaaaataaaagaaacaaaagcccaggtagtcattttgcagtagagctcagtgactaagggcagagtaccttgcagaggtgttcagtattttggcttccctgggccacactggaagaattgtcttggggcacacataaaatacactaacactaacagtagctgatgagctaaaaagaaagaaatagtaaaaaaaaaaatcccataatgctttaagaaactttacaaatttgtcttgggccacattcaaagccatcctaggctgcgggttggacaagcttggtttaaatcctctgcttaacagctgtgtgaccctgggcaggtgactcagtgacttcttccattggtttgctggtctgttagagtatcacgtactttatagggctgttgtgagaattaaatgagtcagtatatgcatatttaaggtacttagagcagagtttggcatgtagtaagtgccagataattatatataattattattttggagatagagtccctaagcctgttttgtctttgaaataagaacttcatagcattgtgcaggtttagtgaagtaatgttggtaaaagcatctggaaaaaagcctggcagagaccaagtgctcaataaccagtagttgttatcattcttatcatttaatacttacccattggtgtgagtttatttggttctccctccacagagataggggaagaaataatgtattttagccatcgatttttgcttttggtttcagaatccagttttgaaaacaaaatgtgtttgttaacaggctgctcctttgccaagaaaaatgacaaaattacctccatgtactcttctctcctcccccaaaagccctgtatgagtgtgtctctggctgcgcatatttaagtattaactgagataaagcatgagctcagcaggggctttctaatggctaatccacagtaacccatttaaaaaatctttttctccacacaagaaaaagaactagtagggaaaggacattttggtggttgtttgaaagaagtgtcactcgggtatttgggggaggaagagtggtgtctcaccattgagttttttgtttggtggatgcctcttttccaggtccagttgctgaatccaggacatggagtggagacagggagtgggtaggaggtgccatcaaagttctaagcaagttcagcagtgttgaaagaatttaaacccactctgcagccgggttatagctagacagtactctaccctgggatagtgtggagaggacatcctttcccattaggcactgacagcccaagacaaaaaatgggaagaatcttgggtgggtgaaaacactttacacaataagttcttggtggtctcctgacctctagggacctctgaacttctggagttaagatgaaggcatggacagtctttttttgcgaagtgtcatgtagcaacagagtttgggctttagaatctgacagacctgggctctagggaaacctccttaggagcttactggctgaaatcgagcaagttctgtaacctctctctgcctccatttttcacaggtaaatcctagtcgaggattaagttgaagctatgtatattaagtgcttagcatagttcctagcaaaaagtaaatttaaaatgatctgttactattagtggtggtggcggtgtggtgatcaccagcaacagtcagagggtggtggaccaaggaggaagcagacagcattcttaagagagatggaaattgccctctacattatagaggacccatctgagaccatctcccagttcagttctgtaggaaaggcaggtaagattgagaataagggttgtgtaattttcgggtgccttcttcctctggggctcttaagatctgagcacagtggattcaagtaaggtaaggaaagactaccagtagggagaggtctggtagttaggggtgtcagtttagcgggaggttttttgtttgctatttttttctttttgtcttagacactatgttgaacttttttggagttgtgaagtcaaaggatgataatattgtaagcaaatattctcttttcagaaaggattaggagcaggtaaaaactttagttagctgatatttttgctttatagtaaaacctctccggcagaattattttataatcttttttttaacacctttttttttctgacaggagatattaagtaagaaaggtatctactttgtatgtgttgttctctggctttttatgaataaagtattacttgtctttaagcatctctgataggaatttagataataagccagtgaaatatttttcctccataaattcctgtggccttgatggtgaacctgtgatcaaaatattagaaatactgactctgaaattgattcagatacatttgcttggttatataaattctgtacttttggccctgaaatagaaaaagcctacttgaagctttggggaccttcttactacttccaggtcatcctcgaaggtcttaaaatgtttttaaacatgaccagttcttttctactatattggtctaaactctatgttgctccttcctgagagaagatagtttcctctggttttgtctagaccacaagtggcttcagagaaacaggcttctaggtatagcatggaaaggggaagatctggtggataaggaaggttttagatgacacaagtaatactggggacaactgtggaacaaagagtgagaaaggtatgaagaggagggtacaaggaaggcagaaacagggaagagcaggccggaagagagagaagggaagaaggcagaatgttgaaaatggggaataaggagcaatcttgagaggacagagagggtgttaggtaggagtagagggggataagtggtaaagagagactgcgttagactggtgagtgaggaggcagtgcctgaggtatgtctttgtggctgtgagactttcaagggaatttgaacatttgaggtggctagggtagtattgcggacctggctgctcaagggagctgttgaacatttgtatgtagtgatatcacctgaacttttgtgctttggagtgggaggaagtagtagaaggaagctttgcctatccttttatgttaactttcttgtgatcttgtgaggaggcctgtccttgttgagtcatttagttctaccagtctacctcctttctctaagttgtctcaactcgtgcataagtcttaccacttctctctataactaactctttgcaacatgttttgctttaagtatttttaaaaaaaagctttttaagggaagaaggaaaaactatattagaccttctcaaactctgctgccctttcttcctattttctctctttgccaccaagggttgttgtactccttctcaaccagtcattaccgaaaggctattaattaattgattagaatgcaaaaaataatcttgggctttgggttcctttattgcctttcattccatagggagttttttctttttgtttaacatgtataaatgtctaagcctatttattgtagacattttatagtagtttttctaaaatgtattaaattatactgctttcttaaactaagtctggaacttactttatcatcatgaaccatcagtgttttccaaatcaactggttttcagaagactgaggtggttaggattgtgagtacatttactcatattcatttgagtgtgttttatgtagatgggcacctggggaaatagtggcaagcaagacagacactgtctctgcatgttggaatttagtctgtaaagtctgaatggtgatgatctggaccagcatagtgtggaaggtactggtctgtgttctggatgatttaggttaccatgccatctccagataaatggagtattgctgtttagggccctgacttatacacttggtcatttccacctctggtctacagttgcctaccccgcaatccatatgcaattctgcatatggctttattttctaggaggtggagggaggaaaagaggtgaggatttgcgtgaagacaagctagtgttggtccaggttttttctgctttctcaattatcctataatctttgaaaacacattggtttttttttctctcttgacatttttcccccctttcctctcgtgaggactttaaagcaaatcccaggcttcagatatttcacttctgtatacttcagtgtgcacagaataacatgggcatatgcttacctgaccagggtcattatcacacctaactgtaggtactgtattttgttgtataacctaatgcccattgtataattttaaaaatttctcccttgtacaaaataactgttctttatggttttgttagaatcaggattcacatgtgacatttggatattatgtctcttaatcaagggccattccctgctccacccctcccccctttttccatgccaatgacttgttgcagaaactgggtcagttgtcctgcagaatgtcccacattctggatatatctgttttcttgtgttgtcattatctggttcctctatcgcctgaatttcctgaaactggaaattaactctagaggcttgattaaactcaggttcagccttcttagttgggtagtgctgtgtgcttcacattgtatcacaccagggaaaacctccttaatttaagtaaaaataaaaaatattagtgagcactgagtttgttttagatgcggtgctaggcgctatggggtctacagagattagcaaagtgtaatcccagctgccttaaatttgtttttggaagcagaccatgaacaacagcatgacagaggataagtaaggggtagctggggaacaggagaggtcaacagccagtttctctgtatctgagagactgcccacgaagcctgtggcattttagcagtctgaaaaaattaatacagaaatgtaatactttaccatataatagcaactatgctcttttctaaaactagttttatctcacataattcttgagtaatttctctttctcccctaacccactgtgcgttgcattatttgaggcaccatgatatggctgcagatgccttttcgtgcacctgggtcaggatgggacctgcggaaatccctcctccttcccatatttagacagtgagacataccaaaggcaagtgaagcacatggtaatagagaaagctggcactacgtttgagctagtgatctgctggtgtcaactggcagtgttttttcaggtcatcctgcttgacccttatagatgtagagaagccaagtacagtgtagaaaacgtcaacttcctggtggtcacctaagtatttttttccccttcttttggaggggtatatggagagatttctactttaccaagaatgaagctggaactttaaatggtttatgtgtgttttataaaactttttaaaaacttgcaaaatcatatgttagtatattacagtttttacttgtgtcttgtctgcccagttgccaccacttgtaaattttttttttccataagcaagtaaaagttcagctggaagatatcttcttaattgagggttcaaaagccaggaatttaagcaaaagaggaaattcttctcaatattcaaaatacaaaaactctaaggagcatcttgttgactggtatattttagcattgagcatagtgcttgatactcagtgctccataaatactgattggataaataaaatgagatgtagaggcagtagtgtttattctcatttataaattagaagtaaacaatgtgatcacagtgaaaaatccttagcctgctttggataagaactttcactcgtgcactagagagagagggaatgtgggtatgaaagtgtgtgtgtgtatgtgtgtgtgtttgtggcattggcaaatagaagagaaggatttgtcttatctgctgatttaaaaaaaaagattttatgtttattatcaagaatgtagcacttaagatatatgcaacttaaaaaaactactgagtaaaattctgggttttgtccttgaaagaaaagtggcatttcctgcatgaaaaacagtttctattataaatgacaaaaaattgttagggagccaagctttgatgcatttactacatgaaggtcaaatacttaggtcattataattctgcccccttttgtgcatgcagtacaatgaagctctttgacatggtgctagcacattctcaagatgaaggaaggtcacgtgttttcaggcattaagagcatgatctactcttttttggttccctgttataagtggctgttgagggtaaagttgaggggagaaactggactaatgaatggcttttgtctacctttgtactattttttacttttcttgcacagaagtcaattaaaaaaaaaaaaaagttaaaaagctgagaaccaattgcccagagcaatccacaggcaaccttcagtctggctcagttacccagatttatatcacatacttgctagcagagttttgattgccgccaaacctcaaatgaatgtgtggcttctttacatggaactggtccttttgttaaggaggccttgtgagttattatatgggccttggagccagttcatctgggtccaatatgtggtttcatttattggctattggccttggaggaattatttaactccactgtgccacagtttcctcatctgtaaaatgagttaatttgcaacaggaggcatgaaagaaaaatgcctggcataaacaaagcacttggtaaacatcagcaactgctgacgtgtgtgcgtgtgaatttatcaagagatgcagttcaggtattgagtatataaaggagggtgaagatggggtttctatgtgatgaggatattatcttgggtggcgcaaggtttcagagataagaatctgacctgggattgaaggtagtgggcaatggaaagggtcagggatgatgacccccttccctgctccaaattcactgggaaaggagaaactcacactcagactactgggcctgactacagctggcattcctctttgcctgtttgatccatctgctaatgatttgagccataatatctagggtgcttgaggttgtgtacttgggtccttccttcccccttctgccttggcttctctttagaaagccaactccaacaggcatgagacctttaaactttttgcacgtatgggatttgtttcagagtgattagagggtcaggaggggaatgagtgggtaggggatagatgtgaatcttaatacagataagatggatcatgaggctggatgatgagtacatgggggtgggtttattataacagtctttctacttctgcatatatttgaaacttaagaataaatattttttaaagttaagcaaaaaatgcaagtatataacaatatggatggtataccttttatataaagtttaaaaatatgcgagcagtattatgtattttatatataatgtttttgtattttatatataaggtattgatatatacattgtgtgcatgtatatatatattcatataagaatttaaaattttataaaataataaatatggcgggcatggtggctcacacctgtaatcccagcactttgggaggctgaggcaggcagataacacttgaggccagaagttcaagaccagtctggccaacatggcaaaacctcatctctactaaaaatacaaaaattagctgggtgtggtggcaggcgcctgtaatcccagttacttggaaggctgaggcatgagaatttcttgaacccgggaggttgcagtgagcggagatcacaccactgtactgtggcctgggcaacagagcaagactccatctcaaaaaataataataataataataaatactagctttgggatagtggtcgtggttgcttctgagaaaggtagaaaagagatggaatgaggagagggaatacgaagggtatttcacctgtatctggaatattttgcttcgttaaaattttttgaagcaaatacggcacaatactaagatttgctaaagtcgagcagtgggtacacaggtgtttgttatattctgtgtaattttgtttgttttaaatgtgtcacaaaaagaataaaatgtcatgattctataacaagaagtgtctttagacatgtcaggagctgagctgcaggaggtgctgggaggtgccttgcctttctgctagagaggcacatcctgtcatagcattgcaccttgcagcaggggtggcgaaacgattggccacttgtacagttgcataatgggggaagccctcgtggttagtagaggtggatggtggtaagtaaggctgtgtgaattacaggcagttagatacagcagaattcatgttttctggaccatgctgacctactgcctctgtcagagggattgggctgggttatgaatgatgagttggttacgatgactggaggaagatttttagaaagcacagcttttgtgtataagaactagtttccttgataagacttctcagaaaaaaagaaagctgtttctactctggattggttgtgtggtaatcttgtcagtcttcccgcacaaagcgggattaagcttgtcactcctcagctagggaagcaagccctccatctggggagtgagaagacagattgttctgagggctgggttcatgggctgcttctgaaatgtgactagcacctctgtgcctctgcctgcttctggggaggaagacctggagattgaagtgatccttgtgcccaggtcccagtctgtgtgttacctagtgtatcgatgttgttcatagatgttgggggtggtgagcttgtgcagtatgcacacatcaagtgttagtttgatctcacagagaatacagatgtcagatgtccacttctttggcatttattcactagatctctaaacaggagatcactgtttcgtatgctctagagagctcatttagctgaggggaagggtaaacccagcatccttacaggttaaaccttcgggaatagaacaaaccctgtgtgttgagcccagtggaactgggctggggtggggggtgcatgaggcaagagaccaagcatcttagagtgttttttcagcactcacatgctagtatcctagattctcaggaaggcggtgactagaccagaccagcccttcaccacttcaccactgtgcatcctgggaagtggcctcctcctttaaatagggatggaggtctccagggtgtgctctggaagtttgtgaggatgaggatcagagaataagggaccttcctttgacatatgccaggtgagaaaccacaggaagcaaagaccacccagcctagcagccactcacaagtgctgtgttctggagaaggacttcatgttctgtgtccatccagcctgatttgcatccctggaagaatttgagaggttacaggaccctggcacctgggcagctctgcaacatcctcccaggtggtcccactgaagcacctctatttaaatccccctgttccgaataaggaggctgtgtaaatggacctgcagatctttctgacatgtaggaatggactgggagagatgcagacttctgcagagggagagagtttctgggcattgagcagcaacattgcctctgtccttcattttagtttacaactttatatcttcccttaatgaggttttccgcagctgtgaaagaaataaaataaattgaggtattgagagaacacatagaaagtggagaggctatttttctgttacctgtttttgtcttccttaattgtctagtttagcaccacttgaaaaaattgcgttacatttaagtttgatgagctccttgtgaacatgtgaatcagtagtttctcgaggtgctgctgggttcggtgacacaatacagaacacaaagccagaaaccagcctagaaaccagacagagggctttgtcccagagtcctgcttaaccttattacagctaagtgtcgaaatccagcccgtggttctcccccagaatactggggggcaaatctcgttcaataatagaaaggtatggttagcctctgagtgttttatgggtgtgtatataaaagcagtattagatgagttaagcctatgcaggtttattatacatatcagactcctgataatgatagaataatgagttcattttctagagtcgtgattctggaagactttatttccaccaagaatttccttagtgtctgtctttcccccggatgttttctccctgcctcagagtcagcagtgcatcctctcctcatggcctggctttgcctcttcccccttttggtctcttctctagtagctttttggttttcttcccctgtagttaatattgtcctcatttaaaatttttttcccttcagttgataaaatgttcaaattttgtgacatattttagaaggtagccatttatcaaaaagaacatcttgaaatcctcaggagtattaatgacagtttaatgtgttaaaaatacatatattcaatgttaaatcagtagaacaggaaagaaaattgtgtttccaaatttgtgaaataaatatacttagaagaaaaaaatgaaaacaaaatataaaaatgtcaaaatggttaagttagggtaattagaatatgagtaactttttaccctgtttttctcattttcagtaatgtcattatatgcatgcttgcgtgtttcccctgcatacatccctatggcattttgagatgaatgggacaggagagtataaagaagaagtgggtgtggaggagtcattttcagatgcagtcctaagaaaccccacagactcttggtaggggggcctgagggccctggaccttgtgtccccctttaaccagagcttgtccacttttcatttgctatgcctatcaaggtttgtccaagatttcatttgggaagaggattctgctactaaatacaaggtttgaaaactttacagagaaaagagaacacattgggatcagaggtaggaagtgtgggtcctgacccagcctttaactagcagtgtgtctctatgtccaaggcactttagctctctggacaccagtgttttcatttctaaaatgatgggcttgagctagtggataagctgaaggtcccctacagctttgacattttaggattctattcaagtggtgtcaaaaaataagtaactccaggaaaagaagtttgtgattcccagccttctcccactgccccagcagttttcaaggcacctggaggacaacagacgacttgggcaagcatcgcattgtggaatttttgcttttttaccttgcagtttgttttctgttcgtattgtgtagttaggacaaggagcaataagacccaacacaacaaggtatagagctgttttaagacgatttactgtttttaggttagaggtctagattctttggaaaaagtgaatggtgatttctctcatcctcaagttattcctgaagttctgttaataaaatctacagtcagaaaagtggcaccgtgtcctgcctaatggtgttcggggtgtcctttccacaggccatccagagtccttttccactgcggtgtcagcactgtctagatggccgtccttgggaggctgggctccctctggacaaacaggcctataacaggagacttttcacgttaatggacccagaggaaagataacctcaggatctatcccttttcactggagacacctggaggcctggcaccagtttgcttctctgacctgaaaatagagcattctcctttctggccctgcctcccactgggtgagagaagagcactgggtgggtgaggctaaatcctgcttcctttcatatgcaaagcataatctctttcctggacctctttgggcactgaaacaagaactccactagctgccacactgtccaagcatttagctttttgacttttggggaaagcttttatttccaggtacctaaagtgtgtggcattgtaaataaagtcagaagctcagtttgttggtcacaaatacattggacagaaatgaaagaaagccaataagaccatgttctttctgtgctttgccctcagaacgcattccctgggatgaaaaaccctgctcaagcctgggtacagtgacccaaggtgacagcaatgacagtggcccttcagaaaggagcaagtggaggtggaccctgcctcaaacaggtttggtttgctcctggttgagcttagcccaaacctccccctgctgaaaataaataaataaaatccagatactgcaactacttacgcaccttccttttctatttaatttcaataaattgtggactaattcttcctaaaagtacatatcaattaagaagacaaaacttgaatgatcaatacattgtggttttggctggtcctatagcataacactgtagattttactttctaaatatttattgaacacaatactctgtgaatcaaactgaatcaattactgtgaggttcagaaagaacatagaactcactccttggtctttgattttacagtctccttggaggggcagaatctaacagaaaaccatacacctgtgagacagagactagttcaaaacagtaaaacatcgcataaaagacagctctgtttttaaacatggagcacctgctcccagatgcagaggaccacagcagtggtccaaacagggtggagccagtcttgctgcaggtagtaggtttcacatcagaatttggaggaagtgatgggtgtgaggaagaggaaggaggggcagtgctcccagagaaattcctttcattggataagaaaggtagggatgatattgtgtgataataagagggctgtggcacagtaagccttagggacagtcttggacaggggaatttttcagttgtcgtaattggggcaacagtacatacaggctgaattgaaatggggatccccacacccactcattagccatgtgatcccccatgtagtttactaacgtcaggtcactgaatgctttaacagcagtatacaatttggatcagagttgatgaactaaacttttactaagcacatacttgtattaaataaattcacaaagatctacatcatcattgacaaaaatgtgagcatttcatataaatacatgtgcattatcttgatgtttaaagtgtttttttaatgcatcgttttcatttgtgtgaacattttagcatttgttttatagcttgtttaggacatttagtcaatttgaggtttttgatacttcacaatttcatatgtacaattaatagatagaaaatttgggtgattaatcatacagcttattatagtaatgccttctgggcatcctgactttgtactgctttgatcttgcccttttatgttgggttttcttaaaaagttaatggatcctattcattcatagttcattcaacaaatatatattttgccctactatgtgctgggcacaattctaggaattgagctcccagttactgatttggaaactcagtatttctttcttttttgtctttttgagacagagtcccactctgtcgcccaggctagagtgcaatggcgcaatcttggctcactgcatcctgtgtctcctaggtttgattctcatgcctcagcctcctgaatagctggggttacaggtgcaccccactacgcccggctaatttttatatttttagtagagacagggtttcaccatgttggccaggctggtctcaaactcctgacctcaagcgatctgcccaccttggcctcccagagtgctgggattataagcgttagccaccttgactggctggaaactcaattatttcaatatgaagggattgttgtagctaattttgattttcttactatgcctttaaacttaagttactgattttatttaaaatatttcatcatcagtacagaacccaaacattcttactagtgcttttgaaagaaatcaatttagtaaatttggcacattgaatgttgacaagttggtcagcttctccccactcagagccctaaagaacctctagggctccataaacagtttgaaaaccactgggtcagataaactctaaagcctcttaccattgtaaagctctgtctcaacttctctgtgccatttttcttttgcatatttaacttatggaataataaggcaacttatccagacagagtcgtgatgactacttgatacatatttaaggtataattcaccttattccatttttaatatgtctttgcgttcccctggtggtttggttgctcccatagcaagcaggatggcatgtgaggactgcagaatacctgaacaccccttaaaatataagtatatgagagacatcctcaagcctgtggtgtatgtggagggctagaattgccacaaaaaaaatacagaaaaaaagtacattgtacagttaaaatctcttgtattttgcttgtaaaggagaacattttacctaaaatagactgtactttgaatacaaatgctattcattgtattaagacctgtccatataaatgagttaactggaagatcattctgcatattctgtgttgtgcatagaatttagaagaatgcaagaatgcatgagacttgaagcacaaagcattaattcaaattttgagagcagtacccaggtaaacagtgaatagtacaggtcattgaagttttttgcttttggtgtttttttttttttttttttgagacagggtttcactgtgtggaccaggctagagtacagaggcacgatctcaacttgttgcaacctcccgttcccaggctcaagcaatcctcccatctcagccctccaaatagctgggactataggcacgcattatcatgcttggctaattttcaaaatttttttgtagaaatgaggtctcactatattgccaagactgatatcaaactcctgggctcaagtgatcctctatccttggcctcccagagtgctggtgttacaggtctgagccaccatgcccgtcctgaaattataagaagtatacttaagagagtttttggcaagggggactgctgatagcataacattaaattgggggagtggcgtggatcaggataatatgcaggataatatccatataaacaagaaactacagaaaataagtagcaaaatctacaaaggttgtagtttagaaggtcaattacgtatgttttttctgcttctccacacttgccagatgtttagaataagcatgtaatactttgatactcaaggaaaaggtaaagactgaaaataaaaaaagttcggcagctctcatccaattcaaggctagcaaacgacaggagattttgaaaaatcagaatgatgtgtgtatggcagtaggtgccctctaaattactttaatactatcactgagactatcattttaactcttaacttgcattgttttggacagttgctgggagagtcacaggtaggatagtctgatccctgtccagttagtggttccataaagtccagttagtggttccgtaaagctaattcattgtcaactaatgtaacttcagcttttgttgctgcagcttgtttctggtgtttgcatacagattgagcacatttgcaagaatccagaacataatgtgtatttcacatgatcagataagtacatttaagcttcttagctaaagaatttctatgggttactctttacttccaaatccaaagagactaaatcataaaatgtaaatagacttctaaactttcatttccccaccttttggtacctccagtttttgaatagtgctgttctacagagggtgatttcatttttagttcattcttgtaattttcatttttagttcattcttgtaattttactgtgtaaacaatcagttctttgcccatgcccagtttgaccttttcagactttagtgcaaattaaaactggctggaggcagaagggacaggaaaggacctggggaatgaggatgaggggactagtcaagtaccttaggttacttaatgttgcttgttttgaaccttgaggtcacgtcagagaggagtgctcactccttcaagtacctaagaagtgttccaaagtgaatgtgaagttaatgggattgctaggttttgaaaacaagatgagcaacactcagaaatcaacaactgctcttctattttgtttttgatttttgtttgtttgtgttcctggttatggaatgagagggctgttcagtggcaacccaacaatttcttctcttttggtcaacttttcctttttgaccagaatgtaagaggagagtacagatagcaagaatgattggtgtgttttgcttcaccttgtccttgccccagctatagcagtgttgcccactaattaacagtgctatcgtccagagctgaactgcagaaagttcaagaggagtgaagatctgaccttagtgcagagttcagctgtgtttgcccctcaaatcatctttaggatggaatgattttcatggttcattaatgaatagtggagaagcaagtgggaacttatcaaaatctgtattctagaatgtaccatccccaagatagtaagtatttttgcaagatggaaggactgttcctgtggccgttgttacccagtgtagtcgtagagcctgtaggattgttttgccccattttatgtccctcactggaaaaggccatcatgtggcttgagggtcaggacaatgccagtgcctggctataggctccagatcctgttccctctccctctctgaggccctcactgcggccctcactgcatcatgcttaggccctggtgcaaacctttgagttctcatccatgtggtcttgggcaggtttctgcaagcttcagttttctcatctgtaaaatggggaccatattgtcctcattgttgtgaagacttacagagatagtacgtatgaaacacttagaacagtgtttagtacctcatatgcacttaataaatgttagcgtttttattattagtagtgatcccttgctggcatctttcctggcttctgtccctaccactcctttgatactgctgttgccaaggcaactagtgataacctcttgttgccaaagctcatggacactctgttctcctctctttctggatctttcagtggtgactcctttctccttgaagcactaaactctcctgggcacgatcgccacactcccctcctgtctggtggcttctgttctttcttttgtctgatccctgttctctacctgccctcatgttgcatgactcccatgagaaactctcaggttttctcttctccatttcctctctaggtacacccatccgctccatcctctctaggtaaacccatcccagtggctttcattacttagttgctcctcctgcaggtcttaagtctttcctgactttccagtctgtcttaggtacacccagctgaccttgttattttctcttatggtatcctgttgttttccttcagagcacttttcacaatttgtaattatgtatgtatttgtttgctttaattaatgtctgtcccttacctccctctcactccacaaaattataaaatctatgaatgagaccagggaccatgtctgtctgttcactcacatttgtatgcctggtgcatggaaggacctcagcaaataccaatttgaatgactgaacctgcggcctctccagttcttccaccaccactctggccctgatgttatatgatattaaatgttaataaaaataacttttattttttagatttgatgctctgggcttgagtggagactgccttactttctgttcatttcgtgttactccaaagttagaaaagcataaacttaaccaagttacaatatcctggtatgttgtggataatctgtgctcactggctgttgatgttattttctgatagttttgtgaaaattgttgctaaggcattggcccagacaaaattcccatgattggtagaaataaccctatatattctgttaccattgaattaattcccagtaaatggtaagaccatatgtaagcctctcttcgagccttctttcccatgattcattttttttgtcttgaatccccagaattgctttttttttttttttcttgaaatccaggttgacccaaaacaagaagtgtcaatagcctcatcataatatagcctcttagctataaatgtattaagtccctatccttaatggcctccacatgagaacttctaaaacttcagggccaggaggattactgttagccctgccagtcggcaacattagaagatgatagaacccagcacacatacaagtcattcactgaaaagcacttttaaagtgcctgatgacacatacatcagggtaggtatagaatataggcacataaaagtctttcttgttaggtgtttctattgcattatcttaacatgaacagaaacctctaattaccattattaatgcttggaattttataatttttaaaaaatctaatttatactaaagttgagagagagtgtgtgtatacacacagagataacatgcaggagggcatgtcagtaaaattaattcctaaaaatagaattgttgagttatcaggtaggattaggtttggctaatggaaaacaaatttaatagtgaattattctcatgtaaaagaagtctagggcttgtgtggccactgtaagaagtgattgatgctcagactcctcttattctctgccctctcatctcagcaagtggctttcatcctcagggtctcctcatggtccatccgaatggaggccaaaaggaggaaaaacagcacgaatgaagagactcatctctcacctgagtagctgcctttaaatagtcttgcatggaactcttccacttccatgtcattctattttcaaagctaagtcacatagccacatctaacttcgaagaaggctgaggaatgtagtctttttgtctgggcccagctaaaaattggcattgtgtgagtaatgaataagagaagaatggagtagtctgttctactaagtcaaaggttgtgtgcagtatcaacagatagtgataaacagtccttcaaaaactttgcacccactttaacactttcaccaaccaatccaaatttttttttcccaaatcttaattaaaaacaaaatgtcctctactgctgtatttgaattgtgttgtctttttgaagcatgagtataacttctaatagaacttaattttctattcagattttaaacttctaaatgcttctgaagtttaaggcagataacctagtttatttaagtctgatagtttattcctgtgacttcgattgctaaaggtaggttttcttggagatgggaaacctgggaaaagagaatgtgtacttctttagtgctggaagaatgtctgcttctttcctcctgcattttattgcagatgctaaccttactcagcatggtttagttcagaagagaaaataaagggagaattcatttatgctttcgagaaaatgtgttgagtcttccacatgccaggcatctccaacataaaagaaagagatgtatctcttttgctatctaactcttcccactttccttcttatgatctgatgtgacttctccatatcttatgtaccttccccccaataacaattgtaataatcatcactaagcgtagtactgcacaaaagagagctatcaggtaaaaggacagaaaaaccacgggagttttaaaatgtccaagtagtatttaaattttaaaccttacttttttctgtttttaaacctcatatatgaatttagacagacaaactaaaacctgtttactatagtaagaatacctcactgtagcttaaattggtgtttttaaaatgatggctttggccaaattctttggcagctaccctagactggaagcattaaaaattgattacttgcaagttgttgctaatagttccttatttctgcaggccttgccactcagcccaaactggggtccctgcataatgtttattgtagctggagtgctgtgctggtgtcctgctgcctaagtggagtgagttgaccctaatttactcctggatgcctgcattcttttccatgcatgtccacaaatagcatcacagcaaattaacagaattttctgattgatgtagggagaaaccaaagaaggcctgtgtttggtggccaaaacaccacacagtatgagcagagtggaactactggcccattttatagcattctaattgataattatcaaagagcacattatttgaccatgtggcaacaatccagtatcatttcagaggtactagacatgtagatgtccgtgaacaccatagtgaatataccccctccttttgccaaaattgaaataggttatccaagaggaaaggggagggaaaagaaaataccaatttcctctttacaaaactgtggcaaatgagatgtcataaaattctgtatttcatgataaagcctcctggctcatcattaataagctagaaaattaactctttttttggaaacttggagagagtctataaatgtcatcgtatgtgtttgctgttggttcacaggcaatgcctagtccattttccttcacagagatctaaagctactaaatactgtcagaagaaagaagaaaatttatgtgggagagctaagtggaaagaggagggaatcctaggtgtctacattcacgacactttacaacagcaaagtcactgtggcgaggggagagacctggaagcacctctgccaaggtaaaattgagggcagtccatagacaagtcgaagaactgaggagaaatgtttcctggcccaggactccataatggaatctgtctggaccctgcagaaactcagtactgttaggactgccttgagatgaggcagcccagttgtcagggagatgggagtaggaatggacataaggtgtctgttcttgtattggtggaagaggaaggtaaaaagaaataaacctaaacctgctgctcacttagctctatttcccacaagcaaaccgcaacattgagtaacagctgaaaaagatggtgactaatgtagatgaaacactgaaaatgactctctgggggtcttctcacccctgctccctttgattaatggtttattgtcgtaaagccttaagggtcgttggcagagccaggtcagagcattcagagtgctggagccatgtatgtctgcctctcttgctttttgtttctcatcctattatcttgtattccttcttattttacataggagaagagaagaaagatggctagagatgatcattgcccaattttatctttcatggttaaggaaataatcagttcacaagctaaagcagtggactgtcaagaatggcaaagtggccaggcacagtggctcacacctgtaatcccagcactttggaaggctgaggtaggaggttcgcttgaggcctggagtttgagaccagcctggaaaacatagtgagaccccatctctacaaaaaaaaataaaaaattagtgaagtgtaggggcgcacacctgtgtttccagcttctcaggaagctgaggtaggaggatcacttgagcccaggagctcaaggctgcagtgaactgtggttataccactgcactccagtgcgttccagcctgggtaacagagtgggaacctatctcttaaaaaaaaaaaaaaaaaaaaaaaaggactacaagtgtctcagatttgcccctaccagacgccaaactcttgggtcagaggcaaagggatctgttattctctcatggcacagcagccagcatgagcagtagtctattttgcattggttcttccttgcccccgaatcccacaggggtgacatagataggcccaggttgatggctgcacatgtagtgggttgtgcaggaaccttgagcttagggatcttaaatcatttgtaataggcagtaagtatgtctgccctttgctctggagggagacactatgactacctttcaaggctgctcactgtgcagatgaaagatagtcctaccttgaaagatagtctagaacaaagacccgtcagtactttgcttgacaaagcaaagacattcagtaacacaagaaacccctggcaaattgttctccaaatggagatttgttaatcttataagtagctgatatccctagttcaccaccaccctcagcttttttttttttttttttttttttttgagatgggggtctcactgtgttgcccaagctggaatgcagtgacatgatcttggctcatggcaacctccacttcccaggctcaagccgtttgtctgcctctgcctcctaaagtgctgggattacaggtgtgagccctgtgcctggcccctacttccctttctatccacaaattaatatcaggactcagctgtctttcttcagaaaactccttagtttatagctgtttgaaaggatctgatgagcttgtgtctagagaaacagctaacattccacataatgcctcagagagttgtgtgttacttgacgtttgttgtgtgttactttgaacctgaaaatggctcagaaacatctgtttcttcatatttgtcctcccttgtcttgatgtgaagggattactctcaatggcccccatatatttaatgatttgttaatccttagggaaagacctagtacctgatcgtattatgagcccacacatcgttcccattagcaaatgaaaaacctgactaaagggaaagggctggaaatttcaggaggaccaagttaaagagttccagaaagtttggggagataatccaagggctgaccctgccaactcagacttaaccaaggaggtagttataaggtcaggggtcctgcatcctcaggaatgcccttagagtcactgactgctaatatggtgggaccagtgagccctggagcacagggacacgtgctggttgaggagtgggctcaccctccaactctccaccgtattctgacccctccctcttagactcttctgtctcctccagccacaagcagggtctaaaagaactgtttcctacgttcttttagcccctgaggcacccagttataggaattttctatttctactgtgtgttcagcttttatagtctcttgcatgactgtccttgccagttaatactatttctcctgccctttgggtgatagatattacactactgatgcttgtatttccagtttcttaagtgctttcaagtttacctagcatgtacatgaagtagattagagcctgctacaataaaatactgcatttctgttatggcctttagaaaaactatgattttatctcatgtgcattcagtctgcttcattcatcatagtttaggggtagtgctaataattaacttacacatttgggaacaccctagattttaagttagaatacaggggtatctgagtggctcagtgaatgttttttcagaaaaatgcaatcagtgcctagttctttagttactggaaatgtcctttctttatttgatctttttttgtgaacttttgagctttctgatgctcatctgtgtgtgtaattagcacccaggagtgtcgtggaataaatagttgacttggtcagcatttcataataccattatattggtcatcagccgcttttgcatcctgtggttttgaacaagaaaaaaaaatcttgcaaaaccactatggtgaaatactgaatatgcagatgaggtataggttaaagaaggcagtccctcgggaggctcctcattagagctgaatttcagtgaggtgtggaggggacagaagatactattagcccaagtcattttacagaattgactgcatcgtactctttatttccgtacagaaaatatacatcaattgttttgtttgcagtagccaacatggggtattctggtgtgtagcatttactttctctgcttctttcactggtaacaccttgatttacagtgactattaggataattaacattgacacttggaagatagcctgcttccaaatgcatgcacacttgtctgttttataaatgctaacccaaactttttcctttcctagctgaaaaatgtgtctccactccttccaatctttccagggtgtgggcctgtgcgtagctgtgtgactgtgcccacacactggcatatatttcagagctaccaaaaagaaatcagttgctcttgaaataacaagacaaaaaggaacggtttttctgagccataacatctgaagagctagaagcagttgtgtttgtatgtgtgacgctaaagccagtaaatttcatgtgaaggaagggattgtaaactaagaacagaaaagcagttttcctggatttcagatgtcaaactctcaagctgtttaactcacccactcagcacctccacatccatccctgtaatgtgcttgcattgtcagtgatttgtttctgcaggttttgatgccagaagacaaataataaaatagtaggcatatgtaaccttaaagcagttttctaccagagtttttgattgaggttaaacagaagtatcctgatcacgtcgtcagttggcaggcaaaaggcatcatattttaagattcacatagttttagagcaagctcatcttttctggctcaataataaactaattacatgttttaaatagtatagagctgagtccctgtttcagattaagcctcataatagcaagggccaggcactagcagacatttgcttgatgtttctggcttgaggatccgtaacgtggtgccagctgttttagggcctgaataggcctgccagggacagccaggtgatattggcttgacgtagtcacaggctaattctcccagaacacagaagcctccagacgtgccaccaaggaaagcctggatatgtagaagttcagtttatggctatagtaatatttgggcattccccaaaatagtgatcccagttcaggttaggacatgatagtagtgtccctttgaggtctgtctgagaaaaggtgtcatttctaaaaaattagtgttagcagatgggcagatgtggctccaacaaggcttgcttcatggcttatcatttttccacattttccatccctttcataagcctagggaccacatgctgaacatttaattgaatcacacagattttgtagtctttaaagcttcttattccttggtcacttgttagtggtgcctccctccttggtcagtttggtgacttcagaaggaaatacacagtgcagtggtgagagcttcacttttgaagttagcctcaggcttgatttctagcaccaccacccactagacaaattgcttaacctttctgcacctcagtttcctcctgacaggcttgtttagaaaataaaatgagatcaaatttgtcaagcacagagcattggccctggtaggcaccacatacatgaatttccttcagattgtaggtgaagtagacttgatttgggatttctcttgttacctaggtgcttgtgtagaggagactttagaaccagaatgtgttatttgtggttttgagtgtgcctgggactctgagccaactgaattaccaagtaatgggggccccatggcatctcatgacaggtggagagccggctcttcaccctggatggacctgaaatgcctgctaaggccttgctccaccgagtagcacacaccctatcagtttgcccttctttccatctcttattctagagaccttaaagcctacttgttggtatatattttcaggtttttggaaattgggctgtttaattgaagttaataccagtgatgagacttttcaacctgagaacaacctagatgctacttcacattttgcagtggaagcttacttccatcttcactcatgtaggacattctttggtctcaatgttttatcacatctcatgttaaagtataattcaggtctattttgtggctcctgcccccttcccattaattcaatggttaaacagatacaattttttgaccccctactatgtaccaggccctctgccgggtgctaaagctatagtaaaacatggtatctggtttaaagagccagactgcaccctgcattttatctttgctattagtgtgctaatccagacattggtactaatgttctctttctgggtggtgggttacacctcaaggccaggtggtgtgagtctgtctctgctctgttgacacttaggagctgattggattcaggtgtggcactgtgcctctttggtcctccgggtctgcgactgtgaagttggggctgcctgtttcatagaaagagggtttcctggccctctccatgttccccagctattgctatttttactgagcttcctgccctggttgcttgtcatatgtcatgaaagtgatgctaaattcttggatgtgctcctgagttctggatgcatgtttcctatgcccttttattcgatttccacacacagtaagttttcaaactggaaaaaggtgcagccttattttgtttaagctaagtgaatattaataataaaactatttctgttccacttcatggcttttataacttcatgcctgttaactctttgaggcaaccattttgtgtggctaatttgagcatggtcttaaaagagaatttcagtagcatgtgtttgctgagcaccttgtgggaaggggaaacagattcaataacatcacaggagaagcttggagaaagacaacaggggcatccaaatgctgcagctttaacctactttctgggactgtcatctcgctgactgcacgcctttagatgcttcttcctcagtctatggggagagggacctggggctagaaataggagagtttgtggggaggggcaggatgctgcagggagtgggtgtgggcagaggttgcaagactgccagggttctctgtgtgccggaagtgcaggtttggctgtgaggaatggaatgttctctcttgccctccaagagcacaaacagctgtggaagagcttgaaaagaagattactaaaagaaaaaataataataattaatatgaaaataaaatccaccctagaaaacccaacagaaccgtgtgtggagtatagtggtagtcatctttttcatgctatttaagagaactttcttcctatctaggatttctttttcagttgagggcaggataaattgtgtacccagccctttctccccttgggaaagcctcatatgtctcattttgtttggatagaaaattgattcattattctgatgaccagatgatgattttattctttttatgagggaccagaacctgtcgcttgcttgctgcttgaaaacttaaatgttagtttccaaaggccatctctgtgggtagagggttatcgtcagcagtttaacgggaaatcttgtttctaactggaaatttaattattcagccaagttcccaacaatgtttactttagagcatcgtctttttttttttttttaagtcccttaatggtttaaacttttaagctttaggcaagagtagagtggagctagatttacatatcaggttgtttgtgcaatcttttacatgaaagtttatgttttcttctcaatctgaaaattggttttggccattatagctggtattatatatgacgtaataactctctctgatctcagatacatttttatgctgtcatactttctgcacctgcttttgaacaacatcttagtcccaaagtagataaaatctagcagaagggagtaggcagctaaaaactagattctagcaatatctaaggaaattacaaggatcagttagtgttccattccttccttctttggctatatcaattcctagttttgtgaaagtccacatgccttctttctgtccatgcctgtgcatgctgggtggagaagcatcacagagcagaatgaggtgactgtccccaaggcagggtaaggtcaaggatctttcccctcacctcatgattttcaaaagaaaagcagatctggacctcagttacctaaaataaaataaaattaccctagctcttattctgcacataaaatcacagctttaatctctcatcccagttctcacctttatcttctcaatgatggaaacttggacttaaaggaagttactgtgctatgttaccagatctaaggagactgggaatcattagattggaatcagatcctcagtcaatggaaatataaggaggaaagaccattggttcttggccctaattgcacattagaataatctggggagctgtaaaaatgtacctatatccaggccttaccccatctattgaatcaaaacctctgagactgggatgtgagtgtttaaagtctccccaggtgattctaataggcggggtgaagaactactactgaagggaaattgagggcctcttccagagaattgcctttgaaagatcctgtcattatacaccgaaggcgcccacccgggcctgctcctgaagctagctgtttgcagtgctctcctgtggcacgcagacctctgggtctccctgtgaattggggttccattgggctgttcaaaaaacctttgtcatctgtggttcagcagacgcgtatgttagaattcaggcatttggcaacctcattctgaattgtcagtacccacaagtcaagcagtgagacccacttgaaatgctggtcctgtacacaaagtgggtgagcactgtattgaaagacagtcctttccagtgctttcccctgaaattccttgtaaggaccaggagacgcctgcagtcggcctggtgggaagtagtgggcctggctttggagttaaccataactcattttgctgctccagacagtcctcctcccaccccaccccaccccacctcaaaaaaaaaaagagagaggagggggttgtctttaaagaaaaaaaaaaagcaggggcttttaagagttaaattacacaactcgctttttatttttaaagtgagcagatttcttgttgtcgttgctgagaaagataaattgataccacatgttgcttccagacaaaaacctctctgtgttccaggggaagcacatgcagctggtgtctgggtgagtggacagtctccacaaggtaaacatggtttggaagggctgaagcggacgtagggtacaaaatttaagaaattaccagttacttctgactggcacggcacctctgaaatacttttttaaagtttgaaatcctttcctggaaggggccgccctggaaccttttggcttaaagtatatgatgctcggaaaacagtaagttaacatttatgatgtcactgcttccgtgtgggatctaacagttgttgggagctgcttttgtacttggcacttcactgagtagtttgcatgcagagctttatttaatcttcccaaagagccaagagatagtcaaagaatgtttttatcctgcctgtgggaattatcccctttgtaaattattggtggaatacttttcatttcaggaagcttctctctcacacctaatctgatctgtttggggtccatgtgtcttcacaaccagttagcatgtatgtagagatcatggatactttagtattagcaataattgtatcttgcaatagaaaacggtcttcattataacaagaaaaataattgccagattctgctaggtgcagtcatctttatgctgatttattcaaggtggaccaaacaaaggaatctctaggcagcaggactgtgaaatgtgaattccatcatgctgcctccttcacacacctattgcacctgcctcctggaagggttatgccactgattgccagttctgtaactgattaactacacctaacgggtttctgccccagtgcagggcttccttcagtgtaaattgttttgtaaaagagaagatggacataaaaatgaaataaagagtattcttaccactgcactctctttagacacattgtgatagaggtgttttaagggttctttaaacctttcggcccacgttggggacaagctggtacatttgtccctgaagctgaagttttttcctagagatctttctttcttgtaatttcatcaaaatcttgatttctaagtactgaatttaaatcacatgattttgggtttgggggtcatagtagcttcttagcttctttagtgagtaactgtgacaattgcctgagctctagcagtaggtgtcttggttattacgtaccttactatcttagccttaaggaaggcacatccctagttcttcagccagttaccattggcctgcctcaaagggtatagcaaaatgtgtatttagatgtgattagaaaaatcattctcgttctgtcaagccagtccttttttatcttcagctcccaatcccaaaactaatgtaaaatgttagaaatttagactatttggtaaggtgacatacgaattagtgaaaaatcatagaatatttgtaatgatagttttcctgggattgaggtggcaggagggacatttgaaatattacagaaattgtatcaccattaatttttgataccagggaagaagtggggaaacattggagttctggtattttatctggcatctatttatttacctttcctgctttaccaacatttaagtagagaagttagtacagttgagccttgaacaatgtaggtttgaattgcacaggtccacttacatagagctctttttcaaccaaacacagcattcccaggatgtgaaacccccctctgggcctgggggagttggctcttacatgtgagtttcttctgcggggctgactgtggagtggagtatgcacaggtttagttatatgcagatggtcctggaaccagtcccctgcgtataacaaggattaactataatcagaatcatgacctgtgaggaaaacagaatgtatttctggcatctgattttgaggggtaactgggcgtttgaactggaaatggacagatgagccatatttgttggcctttgtcaatgccctaccttcagattatggattttgtcaatggaaggctggccaccctgtatgaatagaaggctgctgagattggggactgtgagaatgatggtggcacagtttttgtttgtgttgacttagtaatgtaactggaaaaacctgtctgaactttctgtaggtaataggctccagggaatgcattctgccactaagaaacctctaaactgagagtcaagcaaagattggccattgaagctaatcatctatttaataagttgggctttgtttcagaatctaagagtagttaatattgggggtgggagggttgtggttttttgtgtgtttttttgagacggaatctcactctgtcatccaggctggagtgcagtggagatggggtttcgccacgttggccagcgtggtctcaaactcctgatctcaggtgatctatccccgcttggcctcccaaagtgctaagattacaggtgtgagccaccgtgcctggccaacattggtttgtatggtatccactgtcctctttagaatgaatgtgatcatggccactttactaaagaaagacaagtaagtcctatagaataagctcatactttgaggtttcctcttctgaaagacttttttttgtttgctttttggggtttttgtgtttttttgtttgtttgttttttgagatagggctgtgctctgtcgcccaggctggagtgcagtgatgaaatcacagctcactgcagcctcagcctcccaggcacaagtgatcctcccacctcagcctccccagtagctgtgactataggtacatgccaccacacctagctaatttttgtattttttgtagagacagggttttgccatgttgcccaggctggtcttgaactcctgagctcaagcgatccgtctgcctcagtgtcccaaagtactggaattataggcgtcaggcactgtgcctggctcagactttgtttttaaaatcttaaaaaaaaatttttttttaggaagggcccaccaaatacccgtaactatttcataaacaaattaaaatagtaagattgtgcttttatattcctattctttcttaaatgtgaaatgattctttagataatctgtttaactgttagcccaagtagattaaatggtgacttctgcataatttggtaagaggcctatatgaaaggttgtagaaaaagcagtgcattggagtttaggaaacccagtgtcagttttggctcttgtgaacagtagctgtgggaccttgcattaagttatttaatatctctcagcctgagtcttcttatataaaattagggcactgacatactaattcttgcaggtttattatgaggattagagacgatgaatctaaaacactctggctcagtaactgacagtgctgtaatctggcaggcactgtcatccttgcaattaggggacctgggtgggtgggcagtctccattgtcctttcccacccgaacaccctgtggttatggccctggatgtgggtgttccagcccctttttaccacatgcccttgtagaagcttaatatctgtgtccagattttaaccctgtgtagcttttaattttataaaactatacgcatacgttgttggaggttagaattgtgatagatggccatcagaaaatttatgtggggcattttgcagttctataagatgtttcacgctttttctcagttgggttggaattggtgatgctaaagtacattttaaaatattgttccctaaatgctttttaagggggtatagctgaatacttgactggtcattctagttaattctgtgtgttggtgtgatctccttccagaatctaacgcagagggggctggacagagtgggagtacttagggtaggtgtccacatttccatttagcctcgggacctccgtgttttttcacttagaagcttgagtttgtttttatttaatatatctagtgacctgaattgtagatccacctgtacttgcctgctttctgaacactgcagagtacatgttgagagcatgcttcatacctattgcatagagaaattgttttactttttaaagaagtgtactatccggaccattagtagagatgccattattctttttaaaaaccgtaaaaggaatcaggatatatagtctcctgggcaacatttgccttatcagatactcagcatgttgcttatgttcttctctcaaacgcagttgtagaaatgccaacttatgacccatgattgctaatgcttattgcctatcctgaactacaggcccttcctacatgtgaagcatagtattttggattatttactaatggtaaaatcctgctgacattctgtgtttttaaaacattctgggctgggcgtggtggctcatgcctgtaatcccagcacttgggtggggaggccaaggtgggcagatcacttgatgtcaggagtttgagaccagcctggccaacatagtgaaaccctgtctctagttaaaatacaaaaattaggccgggcatggtggctcatgcctgtaatcccagcactttgggaggccgaggcgggtgggtcacgaggtcaggagatcgagaccatcctggctaacacgatgtagagacagggttactaccacacttctctgtcccctgcactttgcaacaagtagaaacccagtctctactaaaaatacaaaaaattagctgggcatggtggcgggtgcctgtagtcctagctactcgggaggctgaggcaggagaatggcgtgaacctgggaggcagagcttgcagtgagccgagatcacgccactgcactccaacctgggcaacagagcgagactctatctcaaataaaaaaaagaaaatacgaaaatacaaaaattagccaggtgtggtggcacgcacctgtaaccccagctactcgggaggctgaggtgggagaatcacttgaaccctggaggcggaggttgcagtgagccgagatcaagccattgcactccagcctgggtgacagagtgggactctgtctcgggcggcggggggaacattctggtagaagcatgtgtttgtatcttctacatgaatacagttcgtgattgccaatttaaacaaatatatatatatgtatatataacttttaggattgtccatatttaatatatggacagtagcatcaggcagtatcttttgtctttaacgtgcaaataaaaactcatctggcctgcaggtactgttccggatgtggagcatacagattcatcagctcctcccttttactgcaggaggcattttacagattagaatgagcctgctgcaggccatgaactctctccaccatggactctgtgttttataatagcaataagaacaccctgacttcatagcatgactggcttctgaaatatatcatgtgtcacccttacatcatccctgtacagagatggtttggatatgattatagccataatgaaggtggggaactgcagttgttgcagacaaattagatttgttcagggtcacatggttggtcagtggcagagataggactgaatctgggtcatcactgtcaactgggtgtatttgccaagccaggaggagaattcttgcaagatggagttttgagggtattttgccctactttttaagtaaatatttattttaggatacttttaaatttacagaaaagttgcagagatagtagagagttcccatacacccaatatcaagtttcccctgtggttaacatcttacagtatgtgacatttgtcacaactgatgaatcaatatggatatattattattaacttaagtttttactttcttcagatttctttcattttcacttaatgtttttttttgttccaggattccatccagcataccatattacctttagccgtcatatctccttaggctcttctaggctgtgactattttgagaagtactgactaggcattttgtaaatgtcccttaattgaaatgtgtctgatgtctttctcatgcttagactgaggttatgggctttggaaggcagaccacagaaggtgccattctcatcatgtcatatcaagggtacatattatcagctcatcttatccttgtagatattgaccccgatcacctactgaaatagtgtttgtcagtttctccactctaaagttgctcttttccccccttttcatactgtactctttctaaggaagttactatgctcagcccacactaacttgacaggcaagtgtctatataaattatttgaattcttctgaatgggagacttgcctacttctctaatcaacctggcaaatcctgctctacacttcttatgtctgcaagagttacatggtaaggtgtaaaatctggcaggatgagatggagtcatagaaaggttaggtaaaaattctcatcggttcttcattcacagaagtagttaagaaaaggtagacgttgtgcctctatactagtggaggaggggaccatgagaaaataaaatagccctccaccaggtgattaattacccttagagagccggggaagtttgttgcaaagtgcaggggacagaggagtgtggtagtaaattccaagtgtgaacttcaatatgggcaatataattacagaaaggccagtaattaggggcctttcaatatgggcaatataattacagaaaggccaggaatttgaggaaaactactatcagtgagcttatctattcccagcatctcttggacatgaaatcatctcccttccccctagatatgaaaactgccatttaacatgtcattttattctcaaagagggtcatgcatatatgtgtctttttgaattaggatggattttttttaacctttgaaattgaggcagctttaaaaaatgaggagttggccagcacggtggctcatgcctataatcctagcactttgggaggccaacgtgggaggatctcttgagtccaggagtttgagaccagcctgggtaacgtggaaaaccccatctgtacaaaaaatacaacaattaactgggcttggtggcatgcgcctgtagtcccagttacaggtgcttcaggatcgcttcagcccaggaggttgaggctgcaccactgcattccagcatgggcagcagagtgagaccttgtctcaaaaaaataaaataaaaaatgaatgaggagtctgatttactatatcatctgggtgctcggttttggaccattctggttcatactctgtattttcttttctccctgcagaactccatccggcacaacctgtcactgcatagtcgattcatgcgggtccagaatgagggaactggcaagagctcttggtggatcatcaaccctgatggggggaagagcggaaaagccccccggcggcgggctgtctccatggacaatagcaacaagtataccaagagccgtggccgcgcagccaagaagaaggcagccctgcagacagcccccgaatcagctgacgacagtccctcccagctctccaagtggcctggcagccccacgtcacgcagcagtgatgagctggatgcgtggacggacttccgttcacgcaccaattctaacgccagcacagtcagtggccgcctgtcgcccatcatggcaagcacagagttggatgaagtccaggacgatgatgcgcctctctcgcccatgctctacagcagctcagccagcctgtcaccttcagtaagcaagccgtgcacggtggaactgccacggctgactgatatggcaggcaccatgaatctgaatgatgggctgactgaaaacctcatggacgacctgctggataacatcacgctcccgccatcccagccatcgcccactgggggactcatgcagcggagctctagcttcccgtataccaccaagggctcgggcctgggctccccaaccagctcctttaacagcacggtgttcggaccttcatctctgaactccctacgccagtctcccatgcagaccatccaagagaacaagccagctaccttctcttccatgtcacactatggtaaccagacactccaggacctgctcacttcggactcacttagccacagcgatgtcatgatgacacagtcggaccccttgatgtctcaggccagcaccgctgtgtctgcccagaattcccgccggaacgtgatgcttcgcaatgatccgatgatgtcctttgctgcccagcctaaccagggaagtttggtcaatcagaacttgctccaccaccagcaccaaacccagggcgctcttggtggcagccgtgccttgtcgaattctgtcagcaacatgggcttgagtgagtccagcagccttgggtcagccaaacaccagcagcagtctcctgtcagccagtctatgcaaaccctctcggactctctctcaggctcctccttgtactcaactagtgcaaacctgcccgtcatgggccatgagaagttccccagcgacttggacctggacatgttcaatgggagcttggaatgtgacatggagtccattatccgtagtgaactcatggatgctgatgggttggattttaactttgattccctcatctccacacagaatgttgttggtttgaacgtggggaacttcactggtgctaagcaggcctcatctcagagctgggtgccaggctgaaggatcactgaggaaggggaagtgggcaaagcaggtcagtgccgaatgctatggcataaaaataacaatatggggatgaggggggatctctgggggagcctgtcttctctttactttgaactttattccacactgaaaaccatggagcagtggtgcacataatatggctcccagccagttccatctcagggttttacctgcaaaccaaatagggctgtcaggtgccccccttcccccgcacagtttgctgatagttcagaaatctactgctcgtgaagagaacacgtacgcattcagagatcgcattctttttttgcatccagttgtcctcactggcctgtgacgcaggttgccctacttgatggatggatgagaagagaaggagagggatgggaagcttgggtcgtacttcagggttaaggatcccagccaaagggctttcctagaaagactctctggtccgtcaccgcttttgtcaatcttcagtgttacatgttcttcatctttttttccttgtaaagtaatgatcggcaggtacttctaatttgcctgcagaatatgtattctagactctttcatatatgaatatttctaacagaagcaaaatctgttaattattctttatcttagtactaagcatctttattagctagcactcaagagctaaacctttaaaaaagtaagaggccaggcacagtgtctcacgcctataatcccacaactatgggagactgaagcaggaattgcttgaggctaggagtcagagaccagcatgggcaacatagcaagactctgtctctacagaaaacttaaaaaattagctgggtgtggtgacacatacctgtagcccctgcttctcaggagaatcccttgtgcccaggagtttgaggctgcagtgagtcatgatcgtgccactgcactccatcctgggtggtaaagcaagaacctatctcttagaaaaaaaaaaaaaaaaagccaaaaaattaatttgaaaacacaggtgtttgtatgagggagtacttactcgtgtgcttctgcttgttcaccaaactataaatgatatcagcagtttccaaacatagagtgacacaggttgtgaatggtgatggagattttttcaattgtggcattttaatgttctcagaaccacaaagatcaggcagtgtgatgtaagaaaaagcatttgattgaaatcaggaattgaggttcaggcccacttctaccactttcttgctaccactatggttgtgtcttaggtctctgagtctcaacttccagttttataaaatgaggataatagcccccattacttcacagggttattacaagaatcaaatgcactaaagcatgtgaaactgcagtaggctgaaatatgtaccatgcaactaggtatactgacaaatgggcaagcaggtagcccagagaggttaagtagtttgcccaaggttacagagctaggttgatttctttttttttctttttctttttctttttttttgagatggagtcttgctctgtctcccaggctggagtacagtggcgcgatctcggctcactgcaagctccaccttccaggttcacgccattctcctgcctcagcctcctgagtagctgggactacaggcgcccgccaccacgcctggctaatttttttttttttttaatttttagtagagatggggtttcactgtgttcaccaggatggtctcgatctcctgaccttgtgatccgcccgcctcagcctcccaaagtgctgggattacaggcgtgagccaccgtgcccggcctagattcatttcttaaatggcttgaacccccatagtagttcttccttattctctctagctggttagaaaaaaagcggggaggggagggaagtgccctgaactggagtcaaagtagcagatgatagacaagctttccctaaaaactctcctcctcaagaagtaagatgaacactgggatcttctaccaacaggtttgcacccctagccacctcgatgttaacaggttctgttccgtgccccagcccttttgctttgttttgttttagtctcagcaagctacttacaggcttctttaagtggtgtaaaaagcaagggaattcaaagctgtaaaaacttgaaccttgtttaaccctctgccatgatgaaggacttaacaagggtctcctatggtgagctcactccagctcacgggtggttgcagaaaggggaatgttaagagtgttgtgatgctaaagcctctcaactttctcaggcctaagagacccctaatggaactcagatatctgatttcagtcatttaatagcccttgagatggtgaaaagactgtaatggaagctaagtagggtggtagtacttccatgccagccagctcagttccataccagaacttgggctagtggagatttgacttcagaaatgtagatatttggcctttagaagactagtttgtcttcctttaaggagaagaatatggaagatttgtctttagaaatgtagatgtttggcttttaaaagaataaatggtttgtcttcctttaaaaataggcttttaaagacacaagtaagttttaatttgagtgtaattgtaaggaggccactttctagttcgttggaaaatatgtgttcagaagacaatgtagtatcagtttttgtctgatttttcaagtgttggtttcccttttggttgaacagcagatctttctcgtatatgtgtaattctaaaggattgtacagaaaattaagggagatctaaatacttagatttttaaagtttatctggtgaactctgattttggtgatgataataaatgactgcattgaggataatgcatttcattgttatatcctaatgaagctttagggtcatcttcgcctcagaatattttgggggaggttgttttgagaagataacttcttcagctaaaaatgaaaagtcaccaaattttcctgaaagtagactagctcagtatgaccacagagcatttaaagaaccatccaaaggacagtgggggctgtgaggggatctagtttctggtttaggatttccatttttgcttagaatccattgttctttcagcagccaggagcacatgcaacctgaagtgtattttttactttaaaacttaactgtgactgtcacttcattgaagactctcctaaattcacagaacgaggctgaggtcagactctgacaccctgcttctctcaaattaactgtcccagcttcccaagagttgctctctaataactttcttggtttaacttcttagtgtttctccagactgaattcctggcttgctcacagaagaaggtcatgtgatgctgaatctgagccgccttgtgttaatggagcggtctgctcagttgacaggcagtcttgctggggagctgcagcaagatgcttctctggcgggctgggtgtttcacacgtcattcattttagaccacgtgtagaattctttgacccttaggtctatctggaaaagaaaaaatagccatacttttttggagggctggctgctgggtcgtgaagggcactgtgttctctcaggtgttcataaagcttggtgcatgtgcttacagttggtggcagagatggtcatgagctggtgtggtgctgcaagctcgagcttccggtaagccttcttgagttcgacatgtgtcctctctgagggaaaccagcttcagtctcaccttaatttgatatcaaagatgcctgcattcacaaactttcattcatcttcatcttttgacatttggagacaccattagggagcagcccaatatttagtttaaagtactttacataaagactgggaagcatccaccagcaaaagcccagatggagaggggaggggtggttcacttcttgtctctgccacatcactcaatcttgtagaatattaggtttctcatttgtcaaaagaagacagcctcatcaagttttaaaggtgcatagtatgtataattttaaacttgaagaccgggcgcagtggctcacgcttgtaatcccagcactttgggaggccgagacgggtggatcatgaggtcaggagatcgagacggtgaaaccccgtctctactaaaaatacaaaaaaattagccgggcgtggtggcgggcgcctgtagtcccagctactcggagaggctgaggcaggagaatggcgtgaacccaggaggcggagcttgcagtgagctgagactgcgccactgcactgcagcctgggtgacagagcaagactccgtctcaaaaaataaaaaaaataaaaactaaataaacttgaaccctaacattttgtctgtgaaatggacctggtgaagtctatgttatgatacagagctagaaagaaatagtggtgtactagtgtggcatcagcaggctgcagtattggaagccatttggaatttacgtgtaggctacttcccaaaaggagtaaatctttgatgcttgtttgactgatgtttgaatgctgtgattctagtatgtctttaaaatttatgttggggataggactaattctaaccaaatacaggtaatatagactgtatcgtgttttttattgatgtagatatttctgttttagggaatgtaacatctgataaatatgaatctgttatgaattacctggagaatatattctgctatttgtacctatgactatagtcttcggttatagtatgctagcctgaagaattctgcatcttcagggatctttattcttaccttttaaaaaaagccgaaagtctgaactgtcattcagggagagaatgttgggatctttttagtgtcgatgagcgcgagagaaaattgatatggccataaaaaggggttttctttgcagaggctggtacactggctacatacgctgttttttcctggaaagcagtgacatttagcatgaaggctgctcttcctgggcctgttggttttataaaatgcacctgttttcacctctggccagcctgctaagcatggagacagagcctgagtggctcctccttcaagcagttgtatttataaacagctttctggaaggtctcttctgtccagagagctcatgtagaacacaaacagggtgaaaatcaccagaattactatttataacttagagtgttcataatgctcagcagcatcttgtaaacaacattttctatcagtagagtcttcccccaggggccacctgtgcttctcacaggcttacctttctatatggagatgggagaagggggctttctgggatccgctttgccattgctggagagattgcctcctagaggtcctccttggtcttgggccaagtgggagaatgtttgctgactgctttctcttccctgacttggagacacatatttactggactttcatcccaagatggagattctccaccttgcaggagacaccacctgcttcaccctggttttgttgatgtgttcattgaatttcaaagtattgctttccccaatcctccaaattgttttgaagtttaaagtttcagaaactaaaatgaatttaaaatgtgttttgcaaattagtatttagaggtcctgtaagtcaatgtttctcaaaatgtttctcggaatactagatcctcaagatagtcatagatcctcaagatagtgaaatggaaaatggattctgtggtcaaataagtttaagaaataccatgttaaacaaagagaaattgcattatttccaagagaacttctcagagccttaaaggttaatacacattatgaaccttttagggtaggatatgttatgcagtgtttcctaaatgtgtttgatatcttgaatcaaatcctttttcttcaagaaaccatagcaccagtgttctaaggaacccccttaagaaatgctgtcctagagttttgctgaaaggagtcagcacccccttggagacagggcttctttgcccttctcctccctttcttgctgagttttttgtatgaccttgtcatatatctagtgtttctcagccatatccatgcatgggctagctgcccggcaaagtggtaggcccgtgttggtagaagtgctcaagaaaggcctgaaatcattaagcacagttcatctgttgagtacctgctgggcacaggggatagaagtgggtaaaaagggtccctcccttaaagaatgcgtggcctagtggagaaagtggtggcagtggcgatgacagtttgtcgtagagccaaagactgccttcctcacaaggttggagcagaggtgcatgtggtgtggcagcctgatgtgcctggttttctgggacacccctgcattcaggggttctgttccattatcacatggtctattccacaaaaacacagaccctaagacttgaggagctccatactaacaggtcagagttcaggctgaatccagatgctggtttcttttaaaagctctgcagagcactttatgtttgatttctagagctggtgagttcatcacggttggacatgagccgcccacttcagcacactgtccctggggctcagctctgagggagctgtggattaaaaaagcctcccctgcagcccactccaagttaagtgagatcctgtgggatggcagaggagctgtgggacttgcagcagaaggctgcctttttcatggctgtgtgtcctgcagtcaagtccctcatctctcagtttcagtttgcttatttataaaatgaggttaaaattaaaacttgcctcacagagctcctagaaggactacctctgatatgggctaatgtcttttggcacctttttaaacatgttatttaatgtttattgtgatttaaaacagctccagaggttaatagtggaagccagaagcagccacgccagtcttaaactatgggcagaaagagtgactgttttcctcagtgaactagattcccctgggtttttcattaaaaagggatcacagttacctgttggtgtgagaacttttatttccagagtcaatgtcccttagaagttctgcctgccagtttgggggtgctcattaaaggggctgttaaacgaaactaatgctacaaatggtgttgaggagagctgtttgtggtatccaaagtgctccattagcatctttaaaggatcgcctgagaagtcccagctgtctggcttcagctctgcttagcatgggtacccatcggtgtccacaggggctagcagcaagtcctgctgaaggagatgccccaccctgctcttttcagctgccttagagcctcaagcctgagcctctcctgctgttgggaggaacctggcaatgccatctttgtcttcccaatgccggtcatcccaagccactcagagagataaagagccattgcagtccctcttagggctgtcttggagcagaaagactggcacatgatagcatggtgttggcagtagtctggccttgggtctccccagagctggtggtttatcgcttattagttactgtgatacaatttgaggttcagaaaagacagtcactgtacccttaacatctcttcgaattctaagttgagtgaaaacccagaaaaaaaataggctgttcttctctaagcgcttctaaataagcagcagccaggccagggactaaaatacatcgccctgtagagccactggacactgggatgcaggtcttttgtgtctttcctgctcagtaatagatgtggaccttagtttgtaattttaggtcggctttgttttttaataacctattttttgctaaaatccatggcattcgtttattaaagaatagtatcacttagtcacgaagtctcagagggtaattccagtgtttctgaaggctaaaactgtaattgacagtcttggtttgattgaaggtttggatgtcagtacgtctcctctctctccctccctctccctctccctgtctcttcctctctcatcctctttcttcttctttctctccgtctcccttccctcttcttttcctgctttgtctctgatgcaagaagtctgagccataaggttgtgggatttttttgtttcctttttttttaaatgtgtttctgtttgtgtggagtgtttgacttgattcttcaggggaaatcagtgactaagaagagaaggccagaggtagaagtccaagaattctgaggtcgaaattttcagttaatttccagtaggccttcatttctgtatatgccactgtaattaattggggctttcattggtcatttgtatgttcaaaaaagatcagacagcaataccgcccaacgtagttataagtaatcagaaagtgtcttgactgatagacctgttggaaggtgaccctaatgtttacctgaaaatgctgcctgcccaccgagtaacaaaagccaaagcactccctgccccactcgtcaggttctactcagactgccctgctggctggagtggggtgccccatgggaggcagccccagccggcacttacaccaaggtgcaggtgcaggccaagctgtaagaagagggccaccggggccacacacgcagattcccctcactaccggaatctgcacacctggccagggcactcctttgtctccctcagttgtggagccaccctggagttcctctcagttcctctgtggcactggtgtgatggttgttacatggccaccatctgtgtcacctgtgtgtcctggtcataccttacaggtggtttggactatttgtagaactcaactagctgattctgtgttttcagtttcagaatcacttggaaaaattagattgtctctcagaatcctgtgtatctaaagcaggaaaagagcactttagagatcctcccttcagtatttggtagctaaaccctgagatggactggcaattacacctgcatttccacccaccctccagggatctagggcatcccagcctgcacactcctatcattcatccctgccccgccccccacatacacacaccccagtaaatgcagtgaagagtcatacaggatagggtcacacccagcaaacataaacattgtgatatgcaggtcatgtttgatgactgaacatttcctcctgtactacaattccctattgtttttaaaaggtgaatcactttattgacagcagcttgaaacttagagtagcaagactcttaatttgggggctggtggtaaggatatctatggtgggatgtacagaaaggataggagaagataaaccttttattaaatacttgagaattagttgaatgttaaaatcgtgccttgtattgatttcatctgtaagaaataggagttttagaaattgaatgattggaaaccatccttttcacataaagtactgcaaatcctaggtcatatcccaccaggcagtaggttctgcctggactcagactaactcttggcaaatatgagtaggtcatggaagcagttgcaatgaaaggatgctgagtgtttgagttggcaaagaggaagagagggttcttccaggaggatggttctttgattgattcagccaacatttatagtgcatccatttagtactttcaacttaccaggttccttgggacatcaagaaaactgttgtttctttcactggaatatgtgctgcacgagggaagataccagacagtgctcttaaagtagtaggtgctccataagtgtttgatttgatttgaagactttgcttagctttcaaggagttcaacatgttaggagctcaaagtccctgaaaaagttgccatttcaggcacattatgattagatactaggtgagtgacttaagaattgagtcaaggatagcgtagggaaggtggggctgcaggagccatctgaacatgtaggtgatttgctgggtggtaagaagagccgtccaggcaaagtgtctttgaacctgacccatcggacaagcggagggtttgttcccagaagcagtagtgggccttaaagcatggatgaggacagtggaacctgatcccacaggcctttaccagctaagggttttggatattataataaagttaaataaccatgaattcagagaggatccagacaccctttaaaggctttttgcctaaaaactgggcctttaaaaagaacataatctaaaagtgtacatactattatacgtggtttgcaaatctgagaatcttaagaaaatactaaatctctgcaactttgctattgacagtaaatcaatacctgtcatatttctgccacattagtattcatagtcgactctggatatgtgaaaaatattggttaacataatccctgcctcaacataaagtcagagatagggatttatctgtccctatctctgatagggatagatcagatagtttaagatagggcattcttaaacttattttagccattaataatcgctaaatttaagcaacagaaaagctggtgcctcccagcaggtggcccccagccctttgtccctcagctatgaagtatgaggatggctacctctctccctgtgtctcccttgggttttatcagcacagcacaaaggctggctggaagggcagtccactccaggtccaggctctgaggtgtcctggaggcgaagactctggaggaccttgtcaccagccttcccagactggttcacctgctgccttgaccaagcccaggaattactgggaggcagtgcaaggcagcctttacacaagtcaagcttgtgttttacaccctgtcttcctggagtccatgtgagacttccttgtcagattgcatgaatatcaattccttatctctcctaagtgttccatatttagtccccagcttgctctaggggttgaaagtttggctaaaattatctttctttttaaagagtgaggaaagtggtgtttcactttatttttgcttgtggggcaaactttcctcaaatcatctagttctgtctaactaggaaaacagttgataaccttcatggatttgtgaatgtgaaggtttcaacttatgatctctttttccttccatgtcctatttagtattagggtcctgttctgttcttctctgcccagaagataaaaacactactgaaaaatgtttcacagtggattaagttgtgggaggacagcagtaggaacatttatgttttattcccagattaaagttgattggggttgttatgttttgtgtagtttttggaggcatttccctttcttagagtatcatgtgatttatggtgataattaggcagaaacttgtcttccctacagatgccaagattatagagggacttgctctcaccagagaccagatgacagcatccgtagatatttttagaatggacctcatcatttatttggtctccccatttcattttctttgtatcagcaattgatttcaaacttgtttattgggcagggaggggagagagggcgtcttcccttattaatgaaagtcactgatgggacagaacagcatctttgtatttattgttaattggcatattgcctagtacttgcagagtaaactacaattccatcagctgtagcttcattttcttttcaaaagttttgcttaatctgatgtgttttcttacagcattttaaaattttatttatttattttgagaccgggttatgagactaatttttgtatttttggtagggacggggttttgccatgttgcccagggtggtctccaactcctggtctcaagggaccgcccccctcagcctcccaaagtgctgagactacaggcatgagccgccatgcctggccccttaatccgatgtgtttttaaactagaagagcatcgacacatacacataaatctcacggttaactaaataaccgtataactaaaatgtcatactttaaactatttaagaatgacatgagctttcttaaaacccatgaaacttgtacccaagctaagtatcattgactttcccagctcagtagctgggtttcatcacttaatatgctccctctactctttctgtccttgattgaatcagataagcatgtacaaacattgagccacaggagagccattaaaaatctaagacagatgagctgctgctttccttttgattatttttattaccccagttttcattgtaaatggtgattctggtgttcctctgagaaggttaattgtatttctgttcaacatttatcttctatattttcagtgttttacaatctgttttccttctgtcacagaggaaaccaaaggcctttctgttctctggagtgggagtttctgtattaaatttgtcctctgcaagagttgcctctatacctgggccaaatcctctaccaattcagcctataagcaccaaggtggtttcctgagcaggcctccctgggagggcattgcctgggggacctcagcggaagctgtagaacatagcttcacaggtgaccccaaccccaatctgcagaaagggaaagtggtgattcacacatctcgtttttaataatggagttctctgaagattggggccttttgatgaaggaatggatattaagcctggggactgtggttggttagtgctttagactgtcccacatgggcctcctactcctggctttggggtgatggcctgttctgctcaaaattgtgctctgttaggggctcatgggtgtcctctgtcctctttcctgctgtgttggcccagcccacattggagcaagccacactccctgtctctgtacttggggaatgaagtgtgtcaccttcccattatgcactggcttctgtggctgcataattaatacccaagggaactggagagagatctgaattaggtagtactttacagcttctccctcggcgcttacagtaagtcaggatggggacttggggatgggagtcccctgatgactgatcacatagtgatgttggatggtggtttattaagtgttattgtgaggcgaaaaaaccaaatcctcttccagaggactgtgcctgtgaaacgctatctaatcattcatactttgcagggcaaggtagagtagttagaatagcactgactttagcaagctacggtcttcacagatgctgagatctagtatttacttcagcttttactccctctagaatcaacaagccattattttatagtccaagataatattatctagtagctttacaaagcaaagaatgccccaaaaaaccatcagccagggaaactaaaacctagggatagacaggaagaagaaaggggcttctttttatactttattgtccctacctccagtaaaacaacctaaattcttcaatttggagctttaacaaggataagtaaatatgaccgtgggcatgtaacattgtaaatactaagtcctgctgtgtttgcaaacattgagagtgaaaggtaagattgccagcaagtgcagagtcacagaagagattgaagttacagtacactcatgagaattcctgatgaccctacggtacaacctctaaaggtgggagaagcagatgtatataatgtgattttgtgtgtgagttttttgatgcttttttcattacttatttaccttgtctggagagaaaagcacgagttcatgttgtttcactaccacttttctatccatttcttggcctagagccgtttctttactaccataactgccaacactatctccataaacaaagaatcttatgtctggaggtctgtcatgtcacgtccttttgctattaagacagctctatgaatatactttttttttttttttttaatcccttaacttttctgggcccagtggtcacatgacatctgataagacttgtataaattcagatgctctaagagcaccttttttgtgcctttccattgaagacaaaataataattggaggcagaataataataatgttgttgattgttaatggggtgttttatgggggatttcttgtccatatatgtgttatgtaattttttttctccaaatttgtaatacaaaaatcaaattcctaagccaggtgcattggcgtgcctgtagtcctagctactcaggaggctgagacggaaggatctcttgagcccaggagttcaagtccagcctgggcaacatagcaagaccccatttcttaaattcttttttttttttttttttttttttttctgagacggagtctcgctgtcgctcaggctggagtgcagtggtgcgatcttggctcactgcaagctctgcctctcaggttcacgccattctcctgcctcagcctcccgagtagctgggactacaggtgcccgccaccgcgcccggctaattttttgtatttttagtagagacggggtttcaccgtgttagccaggatggtctcgatctcctgacctcgtgatccgccctcctcagcctccgaaagtgctgggattacaggcgtgagccactgcgcccggcccatttcttaaattcttaagatggcccgcttagtaattacttactctttttatggtggggaataggggagtcaagattacccacacccagcactgcagacttattaaggcctttatagaaagtggccatttcatctccactggtgttggggtattcgtggaaaagggtggtaagcaattcagttagtccacatagccagtagggaagaaccagaaaagtataactcatctacttaggatgagcggctctccttgttttagcatggaaagtcccatgtcctaggaaatccctcagtccggaagtctagaacagaatcttatctgcaccttgaacatctaactaaaaaggacccaccaaaacacccctaatgtggctttctttatctcccaaagtgaatgatcccattccctttgggcttttcaacttcagagcattttgtaataaggacaacatgagaaataaggtaagtaatctttgtgctttgtccttaggatttcagacctttgaaactggtgtagcagagcagctttgctgtgctagccctgggctctgaggtgggtgagggagatggaaggccttgacaggtggccctcaggtgcccactattgctgttgcagtgcccttaatgatctctggttttcttttctcctcctttagaccctcaaactgacacaagacctacagagaaaaccctttgccaaatctgctctcagcaagtggacagtgataccgtttacagcttaacacctttgtgaatcccacgccattttcctaacccagcagagactgttaatggccccttaccctgggtgaagcacttacccttggaacagaactctaaaaagtatgcaaaatcttccttgtacagggtggtgagccgcctgccagtggaggacagcacccctcagcaccacccaccctcattcagagcacaccgtgagcccccgtcggccattctgtggtgttttaatattgcgatggtttatgggacgttttaagtgttgttcttgtgtttgttttcctttgactttctgagtttttcacatgcattaacttgcggtatttttctgttaaaatgttaaccgtccttcccctagcaaatttaaaaacagaaagaaaatgttgtaccagttaccattccgggttcgagcatcacaagcttttgagcgcatggaactccataaactaacaaattacataaactaaagggggattttctttcttcttttgtttggtagaaaattatccttttctaaaaactgaacaatggcacaattgtttgctatgtgcacccgtccaggacagaaccgtgcataggcaaaaggagtggagcacagcgtccggcccagtgtgtttccggttctgagtcagggtgatctgtggacgggaccccagcaccaagtctacgggtgccagatcagtagggcctgtgatttcctgtcagtgtcctcagctaatgtgaacagtgttggtctgctggttagaaactagaatattgatattttcaggaaagaaatcagctcagctctccactcattgccaaatgtcactaaagggtttagttttaaggagaaagaaaaggaaaaaaaaaaaaaacaaaaaagtcctgttttgctttgcagaacaaatgaacttacaggtgagcattaagcttgcagtgagaaatgtgtgaagagtaaaaacccaagtcaatgctgaggcagttctaacttcactgttttcctaaatacacatccttgattattttcagccttgctatataatctgatctgctagaagtgtatgagtgagaggcaatagcatacaaactgattttttaaatataagcttaggttgtaattgtacaagtgactcaatggaagtacaaaatagggcagttttaacttttttttctgcttctatggatttcattttgttgtgttttcaaaaagttatggtgctgtataggtgctttctgtttaacctggaaagtgtgattatattcgttaccttctttggtagacggaatagttgggaccacctttggtacataagaaattggtataacgatgctctgattagcacagtatatgcatacttctccaaagtgatatatgaagactcttttctttgcataaaaagcattaggcatataaatgtataaatatattttatcatgtacagtacaaaaatggaaccttatgcatgggccttaggaatacaggctagtatttcagcacagacttccctgcttgagttcttgctgatgcttgcaccgtgacagtgggcaccaacacagacgtgccacccaaccccctgcacacaccaccggccaccaggggcccccttgtgcgccttggctttataactcctctgggggtgatattggtggtgatcacagctcctagcataatgagagttccatttggtattgtcacacgtctcctgcctcgcttgggttgccatgtttgagcgatggccctgttgatttcaccctgccttttactgaatctgtaaattgttgtgcaattgtggttatagtagactgtagcacattgccttttctaaactgctacatgtttataatcttcatttttaaagtatgtataattttttaaagtatgtattctattcatatggtctgcttgtcagtgagccagacttgcttactatattcctttataataatgctagccacttcctggattctttagtaatgtgctgtatgcaagaactttccagtagcagtgaaggagggttgcctctccaagcttcctaagggatgctgccctgtgtggggatgcattgcagaggcactagtagcatgggggctagagtggggagcgagatgtaaaagggtggggggataggagaattccagagtgcttccagcattagggtcctgagaacttctgagttcagagaaacatgcaaagtgactaacaaaatagctacttacctttgcagttttacagaccctgggagctgctttgggagtgagaaaggcaaccctccaatgtgtttcaactttaaaatgttgaattcttttcagacatggtatctcatttattctccttttctagcgtttgttgaatttcaggcagaatgtcttacagaatgtcctagaaccagattatcatttaatctgaaacagctgaggaagggacagagaaggtacaagggcaaggcagcacaaaacagatcaggagaatgaagagggaatgctttggttttttgttttgttttgttttttctttttcaagtaactaaaacagcatctacatgtagagtgttgtggagagctgagaccagggtaaagtcaagtgcagcatcagtactgcgagacccaccagcccctggagagggtcagccgagaatctggtagtgaagcctgtctagggtcccggcaccctcaccctcagccacctgcagagaggccagggccccagagactagcctggttctgaagtgggcaggggtgctgccagagccctctgccccttatgttgagaccctgctttcaggacaggccagccgttggccaccatgtcacattctgagtgagtgtcacgggtccctaacaataattttctgatctggagcatatcagcagaatgcttagcctc

SEQ ID NO: 15922 - DNA, 58789 bp, Human
  misc_feature (1)...(58789): n = A,T,C or G
ttcttaatgtggtcctgtccctttcccaaccccagtgtgtctgacattgttttctggatcagagaaactttgctttcttcacagaggcctacagattctccatataccagcggagcatggtgcatgctcatctgtctccaacctcatctgatgagaacatctccttccctgctgccaggaggtgccccagcatgggcatgtctgcccgtgaagttcaacccgtaaggaattccctgccagtctgtggctcattggtctggaattccaggtgctgctcatagtagcccctaagcacatccagggaaaagctggcacgtttatgtcagtgccactcaatggcctgagcctgcctgctgcccagaggcagcgagaggggagaacgtgaaccacaccaaagcatactgtgtggtccatgccaggtcttcttgggaccaatgtgcctcatggagactgggatcaaaggacagctgtgcccaaaagaggctcagcttaccagcccttcagccccataaagtcggggagtcatggggggtaggaagaatgagagaaagagagagagacctacaggtgagagaaagagagagagacctacaggtgtgcagtgcctgatagaaacagtgaccttcgcccaccggaaaagctgtcctcaccaatgtcctggtgcctggtcattcactcatggggaaaagaagagcagaagtagagtgagggtagaaagccccttcccccacattttcaaatgtacctggacaagcatccttattcacagctggaagaagttggattcagtagaatgccatttggaaaacaccgttctgaagtgccatcccctctggcccctgaatcctcaccagcttccaccctctgctcaccttgggccctggattccagcgcccccaggctcccagctgcctccctgtctctgccccatggtccggcctggagttctggtccctggttgtgtcctgtggccccattctcatgcgccctttgcttctgtttctttacctatgactttatactgatgtaaagcgagtcttctcggtcgcttcttgttctctgaggaatgatgaatcagaatctaaatggaaaatctgggcagagatagaacctcccgcgggagccaccctgcccttccatgtctagatcatctgggttccaacctccatcctcctccaatgagaagcttttgttctctcaagattccagtgacttctccgaagcttaggtgtctcttcacccctggctgttccaaggcggccccatagtcaagattccttaaacccttgccccttaaaatgtttgcctttcttaccatgctggctccagcctctggtcccaggggtgtggagagttctctcttacttctggctgatttccaggaaggctaagcacactctccccaggttataatgctgagcattttggttctctccagccctgggtccccatgtcaggacctaccttagtccagtccatgctctcccatgggcctgagagaagatttgaggtttctggctttccctccaaccctccaactcccaccccaagccatgtcagcaaggggaaggggcaaacatggagtttcccccccaactcccatgtaaactatgccccctcttagagggcagagcagctaaggacaattttggttcaaggacattttttttggctgtgtattgcacaaacaagtggacacccgggagctggccctgctcgtcccctgggccctccttccctggtcctgcaggtcttgctgcttgtcaggcctctcctccaaccctctgccacatttcagaaaagctgagaaccccttggagtgaaaaaggaggagaaacacagtgtccgtagcccagaaggaggttaaatactttcacttctcttttccccatttgggcggagccctttctgagtcagtctgtcggccgacttcctgcttggggcctgggcagccacactgcacgcaggctgggccgactgaggggctcagaggccaggctctgaggcccacgcagggcctagggtgggaagatggcaggtgggggcggcgacctgagcaccaggtgagtctttatctcccttcctttaacctttatctctggctatattgcagctttcatgcctttagttcagtttgtgcctaaggcttcactttaatccttctttgcaagaacataggtatgcgatgttatataatgaaatgaaagacaagtaatgaggaaatcagattttttaaacaggagcaggacagctgttggtgtgagttcaacttgccataacacacgtgactttcttgttttggatttactgctcagctgaccgggacactctaaacatagcagttgttggtggctgggattaactatttcctcatgatctgtgaaccctttcacccctcagccttcctctaccttcaaatatgtcatgtcaaaaaaggtgctttagaaaataaacactccagggtaaacacctggcttacttttaaacatcagacgctgtggtctcacctgtcctggcaaggggcctctgccggctgttcccatgactggctcagggtctgagttcttattccatcaaccttgatcaaaagaaggaaagggaagaaaaaggcccagggtgacaaacggctaaatattttcatttttacctcaatttcctgtcccaagatgggggatacctctgaccagaaaagagaaggaaatcctaacttttctctagtagtgagttgagaaataacattacttaatcttttaaattttttaatacaaaagaaatacactgtacattattgttcataaaatttaaaacagtggagaagtatattaaggaaaaagtcatctttgccactcagccattcttgtagcttctcttcccagtcctgtgaagagtcttgggcacagcttttcttatatttttctatgcatttatatatctaatgcattttttgtaaatacgtaatttatgttcttgttttataataaattatattacatgtgctagtctgcattttgcatttttacttattttaatagtggaaaacttagagatcttttaaccttaatacatatagatctgcctcattctttttatacatgctattccatagaattgatatatgataattatttattctccaattgaaggacatttagattgtttttaaattgttcacatttaccaataagctatcataacaatgattatatatttctttttgggtttttacatctaaacaaatatttatcttgtctctaaaccttaaaaatgtaattattgaggcaaagggtccagttatttacttggtcctgccaaattgtctttctaggaggctgaatgaatgtatttcaccagtagcaaatgagatgaaccatcttcctgcacacagccacgatttgcaaaggtgatgaatgaagagttatgtcttgttttaatttgtattttccttacgatgggaaaattgatcagcttttcatgtttcttggccatttaaattccctcttctataaattgcttgtttgttttttgccaatatgattccgttgaggtgtttgtcctttttttcgtgatatgggagaattcactaaatattctgtaagtataaatatacttttcttgtccattacctttgtctatggtgacttttatcttattaaagcttaaaacttaacatataggcctcttgtgatacagatttttttaagatagatgcacccttgttataaacgaggtgatgctgacaccctctgtgagcactcttagtttttacaattatttctgtgttaaggtggcagattcgctgctaccgctattccaggaagagttcctcctctaatatctctgaaaattttttaaatttttaaacaaaaatattcttacattggagccactttagccttcacagcttttatttgccccgttttcatcttttcagtctttcactttgtgttcataatagttgtctcaaacttttcctccatgacaattatttaccttctagtaggtttcttgtttcttgtcatttctaattttttaaaaattgatagtgtttatttttgaggagggatcttaattggtttctgtacgcctgcaagctccataacctcttgtcattcagtcttcacagtcttgctttatttaggtttgcctgtgctgttaagaactttgggatattctccttgttgtctcttagttatttttccagactgattctgtctgatcttgtgttccacgtgcctgtggtggctttacagctcctctagccaggcttggccagggcaggtcaccccaaacttcccgtttgcttagtcataatctggatgaactttttttctttttttttttaacattccctgttttatctgagatcaaattgttttttgtctgagctacagtttgaagtctttgttttgattcttatcaatttttctgagttcaccgttgattgattaaattatccttttccctgctgattcgcagtgctaccctttttgggagtatagaggcagggtgtgcttctgtgttctctcttctctccccttggccggtgacagcccctccttatgccagtaccacgctgccatagtgatggcagcttcccaggaactcttgacatctgagggagcaaatctcttcctcttcctccagaatgtcttagactcccaaatttgcctgtcaaaatctcgagattttgtgtggaactgcactggatctataaatcaatttgaagagaacggacatctttacattcacgagacttccatctcatgaatatggtttatgtatattattactttaaaaatgtctcctattaaaatttgtatttttctctctgaaggttttgcccttctgctagattccttcatagatatttgatatttttatgccattattaactaaagtagtcctcccttatcaacagttttactttctgagatttcagttacttgcagtaaaacttggtccaaaaacattaaatgcaaaattccagaaaacaattcatgagttttaagatacttggcgttctgaggagtgtgatgaaatctcatgctgtccctctccatcctgcccaggatgtgaaccatccctttatccagggtatccacagtgtagacactaccagcccatgagtcgctgagtagctgtcctggtgatcagatcgactgtcctggtataacagagcttgtgttcaaggaacccttattttagtcaataatggccccaaagcacaagaaggttgatgctggcaattcagatatgccaaagagaagccgtcaagggcttcctttaggtgaaaatgtgaaatttcctgaaagaaaaaaataatatgctgaggttgttaatatctacagtatgatgttttgagagacaaaaagagaccacatttacataatttttattacactacattgttatagttgatctactttattattagatattgttattcatcttttattgtgcctaatttatgtacagattggggaaaacatagtatatgcagagtttggtactatctgcggtttcaagcatccactggggttcttggaagcatcccctgtggatagaagggaactagtgtgctaaattttacatatgaatttgcgttggtgacccatgatctgatccatggttctattttcattcttgtttcaatactgaaatgttttagttactatgattttataggtagtgttctgtaacctaccttactgggattgaattgagagacactaaatgaacagataaatttaggaagaatttatgttttaaaaaaatcctgaatggccccagtgagaaacatagtaaatctctccatttattcatgattgtttgaacttgggaccttgttgggtcgctttagttctaggcattttaaaattgtatttgtaaacaggaattcattttccttttacattttctagttatttcttgctggcataagggaaatctattcattttagttagctgatcttgtgcataggagtcttactaagtggtcttctccctcttaatattgtcttgtgtttttctggagaaataattacatcttcaaagatagtagcagctttgtctcctctttttcagaatttatacctgtatacttttctttttctttcttttttctttctcttttgccttagcgcattagccaggactgccagtgtaatactgaatagtaacagtaaaaatgaacattttagttttattcctgatttcaaggggaatacttataatgtttaaattgaggctttcttatagacaccttttttcaagttaaggacatttcctgctggctctggtttactaaaagttatttattttaatcaggcctgtgtataggatatttatcaaaatgcctactaaagaatctttgagaattgtatcatttttctcttttaatctgatttatccacagtaaattatattgaaacattttattaattcggttattaatttcaccaaagtaaaacatatatatatatatagcttaaagtatcagtcaataagacctttaaaaacacaagtagtactttctgccatcttcccagcccatgtccagtttccctaatggattaactttttggctcttacttttgtatttacttctgtattttgaaatgatgtgctgatacagctctttgtaatttttcaagtttcagacattaatctgttcacataataggacagaagatgaagactttttccataacactccttttcattccctgtccattctcataatacatcacagttggaggttcatcagtaatcagtgttaccattatgatgactatttacatgttgttcataaccaagtcatctactatattatgattacatttcctttcctgtgcaacatcctcccgcccctccccgccgaccccacaaataactattgccctcttatatatttgcttggattttgtgtgtcctcattatgaattcttcccaagcactctgcagaattctaaaattcttttcagtacagtgaggcacattgggtaatttatcaagtccattttactttcttggggaaaccctcctggaattatccattcccctgattccatcagttctggttagtttcagcttccaaggctgaccttgaagcttgacatctctcctgtgttgggtcttgttttgtggattacatgtatacctctttcttgctttactatctcattttggtttaccacattatccagtagcctcctgactaagagtttatagaagatatacatatatatatatatatatcctaccttactgggattcaattgagagacactatatatatatatatataaattgtacatgtctggaaaaaaaattttatccttaatcctcacaactgcataaatatttggtaagtataaatgcagagtttggaaattaatttagttcactgtcttgcaacttccagcattgctaataagaaacctgatgccattctgattattgatcctgtctttctatgtcacctgttttgcctgtctgaaattttctggctcttctctttgatcccttgattctaaaatctcatgatggtttgccttgatgtgggtgttaaattcatttgttgtgctttgctctccagggccctttcaaatggacaactttatttcaattctgaccattttgcttgtgatattatttgaatagtttctcccttctgctttatctctctcttttatcttttggaattcctgttagttggatgttagctttcctagattgatcctctagagactccctggttttttttcttgaaaatcttatatgtcttcttttcttgaatctaacttctatgacattttctgaggaacttcattccttctagtgattaaaaaacttctgccattatatttttaatttccaaaagctcttttgaaaagttgtttctcttttatagcatcttgtttcaagaaatccgaaattttctctctactaatgaggatgaaaattttttttaaattttacgtttcttccaaggttgttttaagtgttagttccttccaggtttctttcccagctcctcctccattatttgcttgttctggaagaattcatcaagtgtccactgggtgtccattcacatttcggaatgagacactaaaaatctgattaggagctctgtgcaaggaatgcctctcattgactgtgcctcattttgatttttcattttccaactcgccttctaaaggaatggtgcctctaattcctgacaacttccagagttcaaaagtgtacactggcttactccttgtcagcttcccctaagcaagtaatcaagatttttgttttttcattctgtgaaattagctaccatatatgcccctatcttccaaaatgtttgattatctcttatttgatgcccttttctattccctgatctttgcttcttttctgcctctaactctctcttataggtggtttcatgggatttcagaaggaacacagatgaatgcaggtgtgttcaacctgccaggcttaaccaaatgcatagattggttctctaatgtgacctttcctggaatccctgagataacacctacatggtcatgccatatgactctttcatccactcctgggttggatttatttatattttgttgtgggattttacctcacgtgtttataagcaactttgtgacctacaattttcatttcttattttgtatttgtctagggttgatagcagaactatagcagcctcatgaaataactgagggtgattgaaattttgaatatatttatatatatgcacatatatgtattagaatgatttgtttaatacagacatcatctgttccttgaaagattgcagaaaattgtccattaaattatttgaaactgatgtctgtgtgtgtagttgttaggagaaagcagattagtgaagctctggaagtatattatgcatttctcctgttatttttagttcttatgctgacctttgagccagttttgattgtttattgtcctaaaaagtaactatttccctagattctcttcttattgggagaaagttgtatagaaatttcttatataaagttttaatcctttccttctctgaagatgtgtcctttttcctattcctaccattgtttattattgttttttcctttgttttcttgatcaatctttccattttgttggtcttttcaatgaaccaccttttggttttattgatccactactcttattttctgtttgagatttaattaaatcttgattttctttattatatttttctatatatttctttcctaattctttacttctcctttgttgaggggattaccttgtgttctgtttctaatacgttggtttaaaacttaatttacttgcagtgtttcttattttctaataaatgcattttaggccatgaatgttcatctctgtgccactttggaaatgtttggcctttataacgtatagtgttttcattggattttatttcttagccatttgttattttgattttgatttcctggttaacctaagaagtgtttgggagtagcttttaaaatttctcagtggaacgagtgggggaagtcgtcctctgtcctttggttgtttactctgatcctattacattgtggttagaaaatgtgttccttaagatttccatttgtgagagtcaattgttgtttcttttgtggcctagtgcataatcagttttgaggcttcaccacatttgaaaggcaatatagtgcaatgattaagagtgtagtaactaatgccagatagtagagagggtaggagcagggaggatcaacactaggatgattggggaagggtgatgtgaagtccagctctgccactgcatacatgtagaggtggggcaagccttgtttcttccctgtaaaatgacggtattaataatggtgctgccagcaggctgatacaggttcttgtccttgccccagaaaagaatttgaaggccagaccaaagtgaaagtacagaagattgattgcagagcaaaagcaaatacacactcaagagaggattgcaagtatgctcaaaagaatgagccatgcccaacctggccagagctcacatgctatatggataagcataatgaagtcatggaatattacataataagaggagagattggctgggtgcggtggctcaggcctgtaatcccagtactttgggaagctgaggcaggcggatcacctgaggtcaggagttcaagaccagcctggccaacatggtgaaaccacatctctactgaaaaatacaaaaattagctgggcgtggtggcaggcacctgtaatcccagctactcaggaggctgaggcagggagaattgcttgaaaacaggagatgaaggttgtagtgagccgatatcgcaccactgcactccagcctgggcaacagagtgagactccatctcaaaaaaaaaaaaaaaaagtgggggtggagcagggaagggattttctgggtaatgagtgggcaattcccagttggggtgccagcattttcttaactaaatatggttaatttggaactgctgtggtgtcaggtccgtgatgggagtgggaggtttccccagggaagttttatggtaataggggcataatgtagcccctatttgaaaacttcaaatttgtcgtcctacagaaatcatctaaatgtgtaaaaacaatccagtactttaggaacacagaccatgatataattgcttgaatttaaaagtctcctaaggttaaaatatttagttgtgattacctttcttttggtgttattgaggtataattgtataaattgaaggtgtaaaacatgatgatttcatatatgtttatattgtgaaatgattaccacaatgaagttagttaacatatccatcatgtcacatagttaccattgcgtgtgtgtgatgagaatatttaagatctactctctcagcaaatttcaaatatgtaatacattattgttaactatagtttccatactacacattaaatacccagaacttatccatcttataactgaaagtctgtgccctttaaccaacatttccccattcctccgacttccaagcttttggcaactgctatttgaccctctgtttctatgattcaacttttttagattcctcggtctgaatctaatctaccaatgggcttgtcatacatggcctttatggtatatttcatttatacccaatttgttaaatgttttttatcatgaaaggatgctgaagttttcaaatcctttttctgtgtctattaaaatgttcatatgatttttgtccttcattctgttaacgttgcacaacaccattattgatttacatgttgcatcatccttgcatcccagggataaatcccacttgatcatagtaagtgatcattttagtgtactgttgaatttggtttggtttggtagtattttgttgagaattgttgcatctatgtatatctggagaaatggcctgtaattttttttttcttgtagtatactaatctggcttaggtatcaaggtaatgctcataaaattagtttggaactgttccttgctcttaatttttttttttggaagagttttagaaggattggtattagtttcttcttaaatgcttggtagaattcactagcatagccaactggtttttctttaatggaaagttgtttacttattcaatctttttactcattattggtctgttcagattatctgctttttcaggattcagttttgatagattgtgtatttctaggactttatctattttttctaggctatacaatttgttgatgtataattgttcatagtaatctcacgattctttgcattatcatgttatcagttgtaatgtttcctctgtcatttataagtttatttatttgagacttgtctcttttttaacttggttagtttagtgaaagagttgctaattttgtttatcttttcaaagaacaagttctgagttttgttgatcttttctattgttttcctattacctatttatttctgctctaatctacattattttctcccttctgctgctaactttgagtttaccttatctttcttcatcaactgtaaagctaaatggtttaagatttttctccctaatgtaggtgtttatagctataaacttgcctcttagaattgctcttcctgcatctcattaagttttgctatgttgtgttttcatttttgtttgcctcaggatatttatgttacctttttggcttcttctttgatctattggttattcaggaatgtgttgtttaatgtccttacattatatattccgtacagaagttatgaattcttcaaatttcctcctgttatggatttctagtttcataatattgtggccaggaaagacacttgatatgatttcactcttgaatttgttaagacttcttttgtggcctaacatatgatttttttcctggagaatgtttcatatacactggagtagaatgtgtattctgctgctgttgaatgaagtgttctatatatgtttgttaggtctatttgatctaaagtctggttcaagatcaatgtttccttatatttttctgtctgattgatctatgattattgacagtggagtattacagtctcctactaacattgtattgctgtttctttcttttttcagttctgttagtatttgctttagttatttagatgttgcagtgctgtatgcaaaaatatttacagttgttgtatcctcttgatgaactgtcccctttatctttatatattgatcttctgtatctcttgtggccattttttacttaatgtatatttcatttggtataaatatagtcacctctgctgtcttttggtcactttttgcatggaatatcttttttcatcccttcaccttcagcctacctgtgttcttagagctaaaaggagtctctctctctctttttttttcctttggcagagtctcactctgtcacccaggttggagtgcagtggtgctatctcggcttattgcaacctctgcctcccgggttcaagcaattctcctgcctcagcctcccgagtagctgggattacaggtacctgccaccacacccggctaatttttatatttttagtagagacggggtttcactatgttggccaggctggtctcgagctcccgacctcaagtgatcatccgcctgggccttccaaagtgctgggattacaggtgtgagccactgcgcccaacctaaaatgagactcttctatgcagcagattgtttgatattgtggggttttttttaatccattcagtcactctatttcttttgattagagaatttaattcatttattgataggtaagaacttactattgccactttgctaattgtgttctgacagctttgtagtactttttttctttctttttttcttgttgccttcctttgtgatttgatcacttttgaaatgatatactttgattcctttctcttaatcttatctactacaggtttctacttagtggttactatgaggcttacataaaatattttatagctataccatcctattttaagccaacaacttcaaacacatacaaaactctacacttttacttctcccctccctcacatttcagtcaattgatgttacaatttacatactttttatattctgtctccaataacaaattactatattagtacattctcacactgctctaaagaactacctgaggccagctgcagtggctcacgcctgtaatcccagcactttgagaggccgaggtgggtggatcacttgaggtcaggagtttgagatcagcctggccaacatagtgaaaccctgtctctactaaaactacaaaaattagccaggcgtggtggcatgtgcctgtagtcccagctactcgggaggctgagacaggagaatcacttaaacccaggaggcagtgagccaagatagcaccattgcactccagcctggttgacagagcaaaagcaagactctgtctcaaaaaaaataaataaataaaaaataaaatagaagtacctgagactgtgtaatttataaagaaaagaggtttaattgactcagttccacaggctgtacaggaggcatggctggggaggcctcagaaaacttacaatcatggtggaagggcgaaggggaagcaagcacgtcttcaaatggtgacagaagagaaagagactgaagggagaagtgctacacacttttttttttttttgagacggagtctcgctctgtcgcccaggctggagtgcggtggcgcgatctcagctcactgcaaactccacctcccaggttcatgccattctcctgcctcagcctcccgagtagctgggactacaggcgcccgccaccacacccagctatttttttgtatttttagtagagacagggtttcactgtgttagccaggatggtctcgatctcctgacctcatgatccacccacctcggcctcccaaagtgctgggattacaggcgtgagccaccacgcctggccgagaagtgctacacacttttaaactagatctcataagaactcactgtcacaagaacagcaagggggaaatgcacccccatgatccagttcctcccaccagggccctcccccaacactggggattacaattcaacatgagatttcagtggggacatggagccaactatattaattgctatagatataattatttttaatagtttgttttttaacttttataccagaattgaaagtgacttatgcacaatcattacaatattagagatttctgactttgactgtatatttacctttactggtaagattttgtatatttatatattgttatgctgtgaattagtaccatctcatttcagcttgaagaacccctctagcatttcttgcaagacaggtctagtgatgatggattcctttagcttttgtttgtttggaaaggtttttatctctccttcacttctgaaggacagctttaccaggtataacattcttggtcagtagagtttctattctttcagcattttgaacatatcaccctaatctctcctgggctgagaggaggaggtttctgccgagaaatttgctgctagtcttatgagagctctcttatatgtaatgagttatattttccttgctgctttcaaaatattgtctttatcttttgataatttaattataatatttcttgatgtcaaattttattgttcagtctgcttgggcacctttcagcccagtgaatctagatgttcatttctctccccaaatgtggaaagtttccagccattacttctctaaatgtactttctgttcattttctctctcttttctccttcagtaattcccataatttgtatgttgttttacttgatggtgtcccataaatcccataggctttttttaattcatttttattctttgctatttttgctcctctgagtaaataatatcaaatgacctatctttgagttcacttagtctttcttctgcttgattgagtcatctgttaaagctctctattaaattcttccatccagtcattgtatttttcagatctaggatttctggctttttaaaaatggttcctgttcctttttggcattataattttgtttatatattgttttctaattttgttgagttgtctatctgtgtttacttatagttcactgaactttttaaagagaattattctgaattatatgtcagtaagttcacagattattatttctttagagtcagttattagagcatattcgtttattttagtgatattattttttcctgattctttatgatccatgcatcctatcattggtgtctgcacatttgaggaaacaataacctcttccaggctttataagtttgtttcggcagggaaagcccttcactagtcagtccagcctggagttctgggcaggtcagctggtagcatccatggacaggcagagcttgctgttgagatctccagctgggtcagatcattgcctgtgctctgaggttgggtaaggccactgctgctctctatggttgtttggatgttttgactggacccttttgttgggcagcggctaacggccaggctctaagatgggacaaggccttaagctactgttaggtatggtcacaggctgggctctgtgattaggcagggttgaagactgtgttccacagttgggtgttgccactggattagttattctccagagtagggccactggctgtgcttcaaactttatcagagttgctaccaggtgcccaggttcagtgggaccacagaatatgcccctcccttaggtccttgctacaagctgggctcatcaggaaggtagcataaatttctggaatccctgttcaggcaaagctgcaagttgtgccccacagttcagaagtgtcactggctgggctgagtgattgggtaggaccacaggctacgttctacatttggacagggtgacttgttctactccctgcctgggcatggccataggctgggatctctggttgcttggggccccaaagctgtgcccaccattgagagaggtcattggcttggtttcctgcccatgcaggtcattggctgggctttgtgcctgggcagggtctcaatttggacttcctggttaacagggttagagaccatactctgtagttaggcagggtggctggcttgattacctgcctgggcaaagacatatgctaggatctgaggctgggcagaatttctttgggggttccctggtcaggcaagacagaaacctaaacgtcttaggtgggctgggctgctggctaggcacccaagctacttagaactgctgaccatgctacctggccaaatagggccaccagcttgcctctgcaggtggacagagctgctggctgagctctctgatagggtgctgatgtcaggagcacagtaccagcatgacaatctctgcattggccactgtgagccctgccctcacttcttcatttctaatcaaacccaggtggtccagcccctctgatttcctgtttgtttcccatgaggcaagacagaattgggcctcctaagaagcagcccagaatgccagggaagctgggtgtcctcctcaggctctgttttccccactggagaaaccttaggctcagggaaaacctcttggtgtggtgctgtgccagcctggggtaggagcaacacagtcaaagtgaatccattcctcttaccccttctaatgtggtttttctcaggttttgtggtccaagggaggtggttcagcttcactcttgggttctgaaattttcacaaaggcatccttgtctatggatagttgctacttagtctttctgtgagagagactaaagccagaaacctcctattctgccatcttagtgacatcccatcctggatgtgccttttaaatctaaggttctagcttcagctctggaagactatttttttttacttgatttccctattctctttctttctattctcttctggaattccccttggcagaatgttgaaacatcctatgcagtttaaccttcttttttcacattttccatatctttccctgcctatattccagaaagaaaaatgtggctcactaagttactcttcaactgagtctattctgcacacccacctttattttttaacagctttaatgaggtataatttacatactgtaaaattctcctgttttaagtgtgtatctcaatgatttttaacagaattacagagttgtgcaaccatcatcacaagccaagtgtagaatattttcactacccttaaaagcttcttcatgactatttgggatcaattcctgctcctattctccagccctaggcaaccatcaatatactttctatctctgtagttttccctttcctggccatttcatgtaaatggaccatatattatacggtcttttacatctgggttatttcatcgaacgtaatattttgaagttcatccatgttttagcatgtgtttatattttgttcctttttcttgctgaattgtattccattatatggctctatcaatggtattttttcatttgccagtcaatggaaatttggattgtttttattttttgactattatgaataatgctgtcctgggtatttgcatacaagcctttgtgtggatatacatgttcgtttctaggtagatatttaggagtgaaactattgggttctatagtagcattatgtttcacttttttcaaatctgtcttacagtgtttccgaaagaccattttacagcaatgtataagggttcaagttttgctaaaatttgttattttatgtctttgtagtcattccagtgaatgtattttggtattttgttgtggtttgatttgcttttctctaataatgaatgctactgaacatcttttcacatgtttttatttttcatatgtcttttggagaaatatctgttcaaatcatttgtccatttttaattggcttgtcttcttattgagttgtcagaattctttacatatctgaatacaagtagtttattaaaaatatgattggctaatattttctcccagactgtgactaatcttttctttctctttatggtatatttgaggcacaaaagatttaaattttgttaaattttaacatcatttattctcttatgattatacttttgtggtagctaattctttgtcttacctaaagtcacaaagatttttcctgtgttttcttccaaaagtcttatcatttttgctgttttacaagactactgcataatttgggaaacgcagtgaaaaatgaaaatggggggatccttgttcaaaaattattaaggatttcaaaacagtgaaagcagaacactaaactaagcacagagtcttttgtgactgcacaggatgcatgcccataaagccatccctgcttttacatttagagatgcatgatccattttgagttgatttatgcatatggtgtgaggtaagggtctaatttcatatttttgcatgtgcctatccagttatactagtactatttgttgaaaagactatcttttcctcatttaattgccttggcacttttgttgaaaatcaattgaccaaaaacctaaggatttatttctgcactctcagttctgttgtattgatttttatatatatttatgccagtactgtcttgattcatgcagctttatagtaagtgttgaaatcacaaagtataagtcttccaacttttttcttctttttcaagactgttttggatattctgggttctttgcaattccatgtaaattttaggatcagcttctcaatttctgcaaaaggccattggagattttgataggaatcatactgagtctctagatcaatttggagagaattaccatgttaaacatattgagtctttcaatccatgaacattggcatcactattttgatctttaatttctctcatcaatgttttgccattttcaacatacaagtcttgcattctgtttgttcaatttatttttaaatgttttattattttgcctacctttatttttgaatttgcaaactcgacttttaaattcctaagtttcctagttggttgaatattattcataacttattcaatattattgaataatattgacctaatattgagtcatagacttttgagtaagtatatttaataaccccataacttattaggtctcaatattattaaataagttatggggttattaaatatacttactcaaaatcttgttctgtttactgtattatttcttttctctgatattacctaaaaaatggtaaaagaaagatctgaagggacctggttagaaccctgaaactgtccactaagccagtgttgacacctggggtgtagtggttccatgccttccctaacatttattctgaattttatatacaaatgaaagacttttttagtttaatttatataaaaattagatcataatatattgatctaaacatgatgttttcactgaacaacaaaactatgactgtctatccaaattactagaattaaatagctatgtaatagttcaacagtgtatatttacaataatgtacttaaccagtcagctgaatacacaattaggttgttttcaggttgaggagtatgtgttattgttgaggggtttttgctggtaaaaacaatgcttcaacaaaaattttgcatttatgagcatctaatcaacaaatatttatggaacaccttgtatatatcagatactcaagaaaaatcagtggacaaaacagacaaaatctctgccctcatggcatatatatttttgggggaaaagagacaataaagaatatgataaacaataaatacacaaataagtaattcatttagcatgttagggagtagtaagggcatgagaaaaaaaaatagaggcagattaggagcttgggagtgtgggggcaggctaaggggattgtgattgtgatttttagataggttggtcaaagcaggcctcattgagaaggtgatagtgaagcaaggatctaaaagagacaagggagttagttcactacatagatatatgtgtctatgctaagtagagaaaatagccagtatcaagtccctaaggctagagaatctctggtgtagtcaagaaacagcagaggcgagtgtggcccgacagacatgagcaaaaggagaggagcaaaggatgtatcatttcagaccctttgaacagtgtaaggatctggctttcactcatgaagaaattgggagcattgaaagttctgcagttcttgtttttataagatggatgttgtctttttatttctatacgatagattccaaaagtggatctgcatggtcagtctgtagtatatcttaaaatttagtagatgttgccacatcttttctgaaaaggctgtagtaattcatgcttacaccagggatgagtaagtgtctgtttttctgaatcttctccctcgtgacatagtgtcactaatgaaattgtgtttgccaatctaatgggtgagaaatggtttctcattgatattttagtttttatgtattcatatgtttattagacattttcattttctcttatttaagctgcctgttcaggtccattttggaggagttatttgttgctttttattaatagactgtagtctttgcccattaatatcagatatattaaccctttgtcatatatattgaaaatgcttttctacactcttttatatctgtattgctttttaaaaacattttaacctattaagagaaatcttcctttaactattctcttctcaaatgttttttgtctgactcagatatttgttctgtcatttaaatatttacattatttgattcagctttttttccaacttttatttaagttcgggggtacatgtgcaggatatgcagatttgttacacaggcaaaagtgtgccatggtgattcgctgtgtgattcattccatcacacaggtgttaagacaagcattcactagctcttcttcctgatcctctccctcctcccagcccccaccctctgaaacacccaagtgtgcattgttcctcctgtgtccatgtgttctcatcatttagctcccacttataagtgagaacatgcagtcagcactattcacaatagcaaaaacatggaatcaacctaaatcgccatcaattatagactagagaaagaaaatgtggtacatatacactatgaaatactatgcagccataaaaaaggaatgagatcatgtcctttgcagggacatggatgaagctggaggccattatccttagcaaactaatgcaggaatattttatccagtttcaatggggttccaggttgcaagtgcactatacttacataataatttcagaataatggatgttttaaaactactaccttttttgtaattggaggcctttcataatctctgtttatttagatcttatttaattttcttcaataagatttttatagttttcttcatacaagtctcatacctttcagatgtttataaatacatacatttgtatttgctattgagtctgagtatttttttcaatgtatgtcgttccaaataaaagctataagttttatatatctattttctattcatactctcatatggttttgctgtgtccccacccaaaatctcatcttgaattgtaatccccgtaatctccaggtgttaagggagagaccagatggaggtaattgaatcatagggcaatttcacccattctgttctcatgataatgagtgagttctcatgagatctgatggtataagggcctcttccgccttcacctggcacttctccttcctgctgccttgtgaagaaggtgccttggttccccttcgccttccaccatgattgtaagtttcttgaggcctatccagccacactgaactgtaagtcaattaaacctctttcctttataaattacccagtctcgagcagttctttatagcagtgtgaaaatggactaatatatactccttggtaaattctttttctagttcttatgaattttattaggtctataggtttcctacatatataattatagaacatattgtacactattttagtattcctaccaattattttattttcatgtcctattgcattagctaaagcttctaaaatatgtatatgtgaacacatatgtatatgtgtatacacacacatatatgtgtatacacacacgcatatatgtgtatacacacaagtgtatacacacacgcatatatgtgtatacacacacatatatatgtgtatacacacacatatatatgtgtatacacacacacacatatatatgtaaaagaccgtggtaatggtagacatccccatattgttttctatttaaatgacttcaccattaatgtttactacaacatttgctgattttagagacttcattttgtgttagtttttatttcatagttttaatttttaaaaaataactgctaggacttatcaaattcccttttaaacccattcatgaataggtttaaatacgttttctccttttatttattggtataaaattgtagagactttctaaagttgaactatttttttgtttcattcaatctcattgtcattggttttctctttcttcttggttctaaataacctctaactacaagttttatttcatctttgatccaacacagtgcattttcttttgttttctaaaatcttaagtaatttattttctatatgaagtctgtttcacttctagtgattataactttttgtgacttcttttgtggctaagattatgctgaatattgatatatatttcaagggtattgagaaatatgtgttctctgttttttctttgttttttttgttttgttttgttttgttgttgttgttgtttgggacagagtcttgctctgtcacccaggctggagtgcagaggctcactgcatcctccacctcccaggttcaagcaattctcctgcctcagcctcccgagtagctgggattacaggcatgcaccaccatgcctggctaatttttgtatttttagtgagatggggtttcactatgttggtcaggctggtcttgaactcctgacctcgtgatccgcccgcctcagcctcctaaagctctgggattacaggcatgagccactgcgcccagccgtgttctctgtttttaagtcacaagattaaatattaaatcactcattaatttatccagagcctgtatactttgtccatttttgtatatgtaaagaatcaaaaaacaggggtgaattgtttttcaatgcctgtaaaacatttgtctcatgatttgtttcttgaattttgatttgacattaaatgggaacagtcttgctttttgttttatttacagttgcataccataacttgctgattttcaatttcaacattttttgtgtcattttttcttagttgtgtctttagttggattctctttgattccagtcaatatcgatatcatcaatattgatgattctttttcaatattattaatattgcctttcaatatcatttttcttttacattctgtttaaataatttttcatactttttccattttgtctttatttcatttcagtagttttgggggaacaggtggttttggttacatggataagttcattagtggtgatttctgagattttggtgcatctgtcacccaagcagtgtacactgaactcaatgtgtattcttttatctgtcactcccctcccaccctttcccctgagtccccaaggtccattgtatcattcttatgcctttgcattctcatagcttaactcccactaataagtgagaacataacgatacttggttccattcctgagttgcttcacttagaataatggtctccaactccatccaggatgctgagaacgccattattgcattcctttttatggctgagtagtactccatggtgtatatatatatatacacacacacacacacacacacacacacacacacacacacacatatgggatatatatatgtgtatacatgtatatgtgtatatatacatatatatatcacatttctttatctactcattgattagtgggcatttaggcttgttccacattttctcaattgctaattgtgctgctataaacgcgtgtgcaaatgtctttttcatatcatgacttattttcctctaggtagagacccagtagtgggattgctggatcaaatgatagttctttaaggaatctttatactgttttccacagcagttgtaatagtttacattcccaccagcagtgtaaaagtgttcccttttcaccacatccacgccaacatctatcatgtttttattttttaattatggtctttcttgcagaagtaaggtggtatcgcattgtggttttgatttgcatttccctgataattagtgatgttgagaattttttcatatatttcttggccatttgcatatcttcttttgagaattgtctattcatatcctttgcccactttttgataagattatctgaattttttcttgctgatttgtttgagttatttatagattctggaatttttgcttagtcttgctttggcaatgtgggcccttttttgattccatatgaattttaggattgttttttctagttctgtgaataatgatgatggtgttttgatgggaattgcattgaatctgtagattgcttttgggcagtatgatcattttcacaatattgattttacccatccatgagcatggaatgtgtttccatttgcttgtggcatctgtgatttctttcagcagtgttttgtagttctcctcatagagatctttcacctccttggttaggtatatcctaaggttttttggatttttgttgttgttgttgttgttgttgttttgctttgtttttgtggtttattttttatttatttatttttttgcagctgttgtaaaagggatttgatttgattctcagcttgatcattgttggtgtatagcagtgctacttatgattttgtatcctgaaacttaactgaattcatttatcagatctatatcttaggatactaatcatatcattggtgaacagtgactcaagtttgacttcctctttaccgattaggatgccctttatttctttcttttgtctgactgctcgggctaggacttcctgttttatcttttacaactcattgtttcccttgttttatctctctaaaaatgcaaactatgtctgctttttatttttattttcagtgttacataaggttttataaggtctgatttcactcaatcagtagttattttcaaatcttttcgaaaggaaagaaggaaggaaggaaagaaagacgcaggaatatgtataaaggtatagcaaacatcacacttaatggtgctgctaagtgcttcttccttgaaattggaaataaggcaaggaagtccactctcatcacttctcttcaacattgtattcaaactcctaaccagtgaaatgagaccaaaaaatagaaataattgtttggaaagaaacagtaagtcagtctatttgttcatgatataattattttctttaaaatacaaaggaaatctataaataatttactagaaatactacatgaatttagcaatgccataaattcatggttaatatgtttcaaaccaattatattttcatataatagtaataaggaatttgaaaagcattatcatttaaagtaacaccaaaacaataaaataactaggaataaatttattattttttaaatttaattaaattaaattttttatttcaataggtttttggagaggaataaatttaatgaaagatgtacatgacttctaaaaactataagcagtgctgggtaaaattaaacacatgtaagtaaatggagagatatacaatgttaacagattggaagctcaatgttgttgtcatctcccccaaatttatctgtagcttcaattcaaatccaaaaaaaagtcctaaagttttttcttgaagaaattgacaaactgatttgaaaagataatgtataaaagcaaagaatctagaaaatccaagccaatcttttctaattgacttcaagacttttgttaagccatgatatttaaggcaaaatcttaccagcataagggtagacaaatagatcaatggtatagcatagaaagtacatatataaacccatgctaatattgtaaattgttttttgaatattttcatgaccttggagtaggcaaatatttcttagatagtacactaaagtcattaattataaaagaaaaaaaaataaattggatttcatcaaaattacagatttcttcccatcaaaagacatgattaagaaaatgaaagagaagctacagactgggtgaaaatattcaccatacataaatcagacaaaacacttctatccataatatatttaaaaaatgcctacccatcaataagtaaaattgaataatataaatgggccaaagacttgaacagacactttacaaaaaataaattgccaattaacacatgaaaatgtgcttgacatcattttatcattaaagaaatacaaattaaaacgaaaatgacatatcacatcacacacactggaatggctaaaactagaaaggctatctctgatagtctttgaaaaacagtttggcaggttcttaaatggttaaatgtactcttacacaatgaccaagcaattccactgctacatatttatgcaagataagtgaaaacatcttgccacaaaaagacttgtacaagagcagcaattttatttatactagtctcaaagtggaatcaactccaatgaccatgaacagaaaactgaataagcagattgtggtatattcacacaatggaatgccactcaacaacaaaaatgaacaaactactgttcaacacatcaacatgaatgataagcaaaagaaggcagacacaaaagcatatataccttttatcccatttatacaaaatccagtagcgggcagtattaagatacgatggaaaaaatgacagcagtggttgccctgagagactgcctggttgcatatggtcaggatgtgggttgacgggcagggcacacactgttctgttcatttctcaaataacacatcagtttttggctctgtgtctcccttcaaatctccattgtttcttacaaattctgtagggcaccatgattcctaacctctgaaagcatccatcccctatctgctattgcaactagcacttttctgaccacttttcaccttcaagattttacttgaaatctcttatctgctcattgtcctctgccattctctttgtcattgtgaatctaattcctttgttatcattttagtgatctttaaccagaaactttttttacagaaattcaaaacaataatgtaacattattgtttcctgcctcatgttagatactggacagtgccaataattctcttctagttgggaaggaagggctcataaattttcataatattaagaaatactgagatgttgactaaaacattatcagagcaataaagtaatcaactaagaaccagaattagagattcaactttaaaattactttcataggaaacggcaacaatttctgaaattcagatgcctaaaatgattcaccatatatagcaataatacagagagattgatattaatacaaagtagaatcaggcattctaggagatatcattcatattctcatgaaattctcaataatgtggtctcattattattattaaactgcattgtattatttgtgaattaatgatgtaggattatatttctttcttaacagctacagattagagaaggacatgttattttcatctttctcagatttgttttctctcagttgattaagatgcatattcaaggttagattttatttttattccattgtttttcatttctctgtggatgacctgtttattccacctagattctgtaggaatttaatttttatttcaaaaaatattccatatatggttaggtgaaggtatctttacaatggctttgttcagtttagacagaactttttcagtcctctatattagtttttcacaacctccatttcttctattacatcttttttgttgcttcaattgcatttattctggcctctactgaggaccacctaatttatatatgttcattctttgtagcttgtcctttatatgtaaactcttacagcctccacaaacatctcagaatcttgatgaccattttcacatggtgtcctttttccctaggatgttcacggaagaccagggtgtagatgacaggctgctctatgacattgtattcaagcacttcaaaagaaataaggtggagatttcaaatgcaataaaaaagacatttccattcctcgagggcctccgtgatcgtgatctcatcacaaataaaatgtttgaagtaagtaaagtttattatgtcacaatctggtaaagcagccccaaaataagttatgctttgatatcctagaccaaaacttcagggtacaatttgctaactgacaggtctcctatgagtggggaactttttcaagtgtttctgtaagtgctcctgtaaagtagaaaaggagaggagaagcagaggtcgccggagatggtcccacttccagccgaggaaatggtgttccatggtgtcctctggagttggagtgaatggtactggagaaactggaacggaaacaggtgttctccataaatgtacaatgttttgtagaattcgtacactataacataaactaaaacttaaaaataattttaatgaagtgatttacttgaaatagcagttgacacagcattttcttccagttaacatcaatttaaaatgcctagatctgggaacattaaaacccacagggaattgatgtctagagaggacaaatttggaggtagatgcttgttattctttctccaacacatttgttttctttttctttccttttttttgtgcatttctggagtcttggaatatgggtaaattccacccataggccctgttggagatacagagcagcgagtcatctctggctatgaatatgcttcctctgtggccaagttcacagcaaggggagactggttgcctggtttccttgggcccttcaggccaaatcagtcttgggggaagagcaggggttgtccagccaacaaaacagccactcatcaattgcctgctacgtctatcctaaaaacatatggatcaggctattaaaggactttgagcccacttttatccttccaaatttcccctttttgcatctaatgtaaatgagggtgaagcaatcaggctcatcagtgggcatttttaaggacaagggacttacttctttcattactggctatacaaataagtaaaaattatagaacctcacatgaaaatacctacgtagagaaattagaatacagtaaccatagaattcctttctagagctcttctgtgacttggaagtctttatttatattttctccattcaatattttttaaggattctcaagattcttgtagaaacctggtccctgtacagagagtggtgtacaatgttcttagtgaactggagaagacatttaacctgccagttctggaagcactgttcagcgatgtcaacatgcaggaataccccgatttaattcacatttataaaggctttgaaaatggtaattagatttattatctacctttttatttccagggccaagttttttcaataagtatatactgatctcctaccatgagtgacatgttgtgttgggcagtgggcatagagtagttaacaaaatagacatgccatgagtcttctcttagctcatggcgtatggctatggtaaaacaagtacccggaggtctgcttcactggccacttagactcacaggacaaccagagccacactggcatcagatttacttagaagagtataggataagaaacagaatcccaacagggcagcttcttatcttcagtgggagcccttgcagtggtctacatagcatccaccaaattgactactacctgccctgagtgacagcttagctgtgggtgcaggatccaccttggctcagcaccacatgcctgtgggagtgtatgtctcttgtaacaactccacagtcacagctttcaggatgccctaagaggcaagctgagttacaagagttatcaattgaaggaagaccacaactatggcttccccacaggtatttattgtccatatatagtcccagtcaacctgtcatgggtcatttctaacctcagtgtttgcctagtaacactgcaaaaaaggctacctttattaggtttccagaatatgagcaagaaagttaaccctgggtcaagtttgccttcagtgaagcagaagtggttttgctaaccctttatccacaaggggtgaaacaaagattgacaaaactgattactctgccagggactatttttggtgctataccaaactaaaggtttcattcttgacctttttcctgagaatgcataatttatactattaaaatggtacacgttaaagacgtcctccaattttttttacttgcctggaaaactttttattcccacacagtttaatctcaacccagttctccaaataagagatagagacatcacaagaaaaatgggcacatgctctgaagatggtggatgctatgggaactggaataaaagtgtgaaaacatgtctgcaaaacagggcaaattagatttggctaaatctgagagtgagaagcagtatacaagttgacttagatcaattggaggaagatattgaaaggcctggaatttaaagttaaggaatttgaagtttactcgctaggcaatcaagaaatactgcaggtttataaacaaggaaagaagtgtaagcagtagttgtatatggcttattgatttgtgtcaatactaaccttatctaaattaataataaaataatttctatagcaaaaattcaagtcagaaaaggaataaaaggaaatcaaatacctgggcacaaattttgagtcaatgttatgtttgtaagcaggatggtccaggctgcggggatgaagggaatggtgctacctttactgcccacattctcaggggctctgttcctctccatggactgcagggatcccccttcctagctccagtgcccacaactcacgtcttagtttctggcgctccttgtgcttgggtgacctgccctgaggctcactgtcactgacctgggacagcaccgcccaccgccccacccagcacagcaagcccacccaccatcagggagatgctgctgactctcggaccctgaagtccacacaagctgcccctgtgtcctctgttatgtttatttgagaactgttcatcctccctgacccaattaagacaacattctcctgtttctagcctcatctttaaagatgttgaggtttttctcatttattttttatttatttatgttttttgagacagttccaatctgttgcccaggctggagtgcagtggcataatctcagctcactgcagccccagcctcctgggctctagtgatcctcccccctcagcctcttgagtagctgggaccataggtgtgcaacaccacatccagctaattttatttttcttttcaaagatgaggtccagctatgtggcccaggctggtctcaaaatcctgggctcaagcaatcctcctgcatcggcctcccaaagtgctgtgattacaggtgtgagccactgcacgtggctgattttctgtgattacaggtgtgagccactgcacctggctgattataaaaaagtggaatctctctaggacttgagaccttctccccagggaattccccagtttcttccttacacttgatatatgcctaccctgccatctgacaattttgagggtaacacagctcacaatgtttccattactcctttatccttaaatcttgaatgtctcctttttgtgtaggacaataaagccttcactgttggggtcttctcttctctgtcccaggggatgacgggagaactttaggtcatgtggaaccctctgagctctgagtcacccaagggctggaaattcctaaaagcatgatttccagacattgtccctggtccctgtagatctctaattgcttcttctctctcccactcttcagtaatccatgacaaattgcctctccaagaaagtgaagaagaagagagggaggagaggtctggcctccaactaagtcttgaacaaggtaaaaatgacagaataaaagcttttttctaagagaggttagggatccaaggttctgagtggagattgtgaatcagggaagacatatggaaggactatggagaagtcaaggagagagttatatgagcttctaaccaggtgcagggtcctggagaagtggccatgacaaggcatagttggctcaataaccatgagggaatcagaaccaagcgtgtcagtaggccagatttacagatgccgactacctagaagtaattgtaatttagaaaggtccctgtaggggatcagtgtgaagttgcaaagggttaagaaccacagcccgtggcccgtggtcaacatcaaagaggagacccctggggaaagaaaggctcctgttttacctgtactgtcatattcacaacacttctgacaccaaacatgtcggtgatctccccacatcagtcagttctccaattctctgtagataccatctgatatcttataatttaattgaattctggcactaattgcccagacttggcacagactccgcaggttaagggctcattcccataagaatgccccccacttcagatgccagttgcaagtctcaggttgtggcctgtgcctgtaaattggaggttcccgcaagcccttcattggctttcatactttcctagtagatcacacagatctcatggaaatgttgacttatatttgacatttattataaaggatacaactcaagaagagccaagtggaagaaatgcatagggcaaagcgtggggaagggcacagagcttctgccctctctgggacacgactctcctggcacttccatgtgtttgccaacccagaagatttctgaacccagtcacttagggttctttatggacattccattatacagcctggattgattaaatcattggcacctgattattaagttaacctccatccctcctctcccctccctggaggtcaagaggtggagctgaaagttccacccctctaatctcatgttcagctcccctggcaaccacaccccaatccttaggggctttccaaaagttacctcattaacataaacccaggtgtggtcgaaaaggggttgttatgaataacagaaagtgctcttttcacttgttatgacttaagatgttttagggttttaggagctctggccaggagcagggaattaagactgaaatgtatatttcttatatcacgggagaaacttggtgatggcagaagaggggacaaatttaaatgtgaggatgttgttcaagagcaggaatattcaaagagaaaggcggtcatgtagagagactcagaaaggaagtgatgcacatgggaagaggatgtaagtacctagaggacaaaggaagggaaatgaaaccgtgaaaaggggtaaaagacaacaaaaataaccttgtcattaacagctcactttgattgaacatctactctgtggcggttggtttaatgctcatgacagccattggagattaatattacttatatgcctattttgcagataaggtaactgaaatccagagataccacaaatggagtttacatagggtcagatgaataaggaaaaacccagatgttctaccccagagcctgcattcctaaccctgtgctatccaggcaatctaaaaaaataaaaacagaaaaatgaaacaaaaatgaggaaatatttgcagacaaaaagatccagaaaaaaagaataccaagagctggaggaagtagaggctactcagacactgagtcctcatggaaaagccaatgagaaagcatgaacagatgtggagagggagggtgttgtgtgaaagggggtgggcatgaggcaaccaggacttcaaagaaactgagctaagggccctgggcagggtagctctggggacaaaggcaggatcactctgccatcatcacttaccagagtgtctcacagaggacacgcagcagagttgtctggccaaggcccctgtcatccaggggtgcagctgacccagtcccctactctcaaggctggagtctgacttcagtaattaggtagcatctgccagctccaggtggcctttgcattgagacctagaaggggtctttaactcctacgttacagagaccaaaaagggattaggggagaatggcaaaatccatacctcgatttctgaaataaacttctaatttcttcctgccaggaactggtgaaaactcttttcgaagcctgacttggccaccttcgggttccccatctcatgctggtttgttcctgtttactactctttgagcctctgctattcttgcccctttctggaatgtgctgtggggttgcctctttgtgttaatgattgtccagaattttcaggttttacatctacagtttttccatttctgggatttaaataacaagtccttatcctctaggttgcctaggagggtttcttcctcccacaccccttaatcacacttgctgctggttcctgctgccgctgagcctggtcgttttacccatgtgcctgcttcaccattttctgcctgcatctgcttgaatctggctgttgccttggtgccttgaccttacgtccatcagtggcccgtgctgtagtggttggaggggagtgacaggcagcagagggcaaataaaatacctgtgaatcaaaccatggtttaggtacaaccccacctgaaaatggactctcagagcacccctgtgaaacagaacagataaatgcaaagagaaaagatacaaccagtgacaaagatgattcgctaggaagccaacaaacaaatgaacaatgtgctcaaaaggctgagccaacaggtaagactgactgggttggcatgaatggggaggagccaaggggccctggctggtggcagaggaagagtctaatgcacaatacaaggagacacctgtttaacaagcaggggaaaatcacatagacacagagggggcctgttatacagatgagcctgatacactgacatactgatgacaaagacctggaggaagaaagctagaagcaaaaaactgagagagaaaggggaagagttgcagagtctcaccaaagaagagagacaaacaaaaggcaaaaggagaaagtaagagagagattggacaggaatcaatgaagcacgaacaccttcacgcagcaatatatgcagacaggggtataagtagaaacaggagaagaaaggagaagcagggtgaggtctaaccaaatggaaacaggacagagcaaggctctactggatctcagctgtgatctcgtttatctccagagtcctgcgaacaaattgctgtccaagtgaataatggggatgctggaagggagatgccctgcccgttgccctgtgatgaagaaagtaattattgcttaccttgcctattttctttcctttcttattcagatgctatacatttggttggttggttggttggttgttgttttaccatcgtaaccactttttaaaattaccagattaaaagctggatgtatttatcattacatgttgttttgaaatatgtacacattgtgaaaaggctaattagagctaattagcataaatattacctcacgtacttatcatttttgtggtgataacacaaaacctattctctcagtaatttttaagaatacattattaactatattaatcgtgttgtataaaagatctcttaatgtatttctcttatttaactaaaattttgtatcctttgaccaacatctccccagtcctcttcctcatatccccagcctctgttaccaccatatactctcaacttctataaattcatcttttttacactctacatataagtgagatgtcatatatgtctttccatgcctgtcttattttacataacataatatcctccaggttcatggttgttgttgcaaataacaggatttcttccttttcaaaggctagatagtatttcagtgtgtagatgtatttcattgtgtatatattttctttatccattcacccactgatgggtacttaggttgtttctgtatcttggctattgtgaatactgctgcaatgaacatgggagagcagatatctcttccatatacagatggtccctgatttatgatggttagacatatgattttcaactttacaatgggtttattgaagtattaaatgcatttttgacttatgatgtgttcaatttatggtaggtttatggaaatgtagtcccatcgtaacgctaggagcatctgtactgatttcatatccttcgaatatatattcagtagcgaaattcatggattgtatgggtagttctactttttatttatttgaggacactccatactgtttttcttagtgattgtagcaatttacattcccaccaacagtgtacaaaggttcccttttctgcacatcctcaccaacatttgttatctttagtctttttgataataaccattctaaccagtatgtggtgatgttcattgtggttttagtttgcattttcttgatgatatctgaggcagggcattttttcacatacctgttagccatttgcatgtgttcccttaagaaatgtttattcaggtcctttgcccatttaaaaatctgtttgtttgtttgtttgtatttaatattgagttgtttgagctccttatgtattttggataataatccttatcagacacatggtttgcaaatattttttcccattctgtaggttgtctcttcactctgttgattgtttccttgcctatgcagaagctttttagtttgatgtaatcccagttctttttgcttttgtgattgtgcttctggtgttatacccaaaaaatatttgctcagaccaatgtcgtgaagcttttcctctatattttcttctagtagttttacaaccttgggtattaaatttcagtatttagtccattttgagtttttaatatggcatgagatggggtcaaatttcattcttctgcatgtggatatccagttgtcccaacaccatttattaaagagatagatatcctttacccattgcatattcttggcacctttgttgaaaatcaattgaccataaatgcatggatccaagctctctattttgttccatttttctacatgtctattttatgcaagcaccatgctcttttgattaacatagctttgctgtatatattgaatcaggtagtgtgatgctttcagctttgttctttttgtttaaaattcctttggctagttggagtcttttgtgcctccacacaaatttttaaattgtttttctatttctcaaaaatgccatttgaattttttttttttttgagatggagttttgctcttgttgcccaggctggagtgtaatggtgcaatctcagctcactgcaacctctacctcacagattcaagtaattatcctgcctcagcctcctgagtagctgggattacaggcatactccaccacgcccagctaattttttgtatttagtagagacaaggtttcaccatgttggtcgggctggtcttgaactcctgacctcaggcgatccacccacctcaaactcctagatgctgggattacaggcgtgagccactgcacctggccgccattggaatttttataggtattgcactgaatctttagaggacttcgagttgtctggacattttaacaatattaattcctccaatccatgaacatggggtatcttttcatttctttcttcttcagtttctttcatcaatgccttagcattttcagtgtgtgcatatttcacctccttagttaaatttattcttaagtattttgttgcagttattgtaaattggattgttttcttgatatgtttttcagagagtttattgttagtgcatagaaatgcaactgatttttgtatgttgcgtttgtatcctgccactttactgaatttgtttattagttctagcagtttttttttttttttttttggtggagtcttcgggattttgtatatataagatcaggtcatctgcaaataaggacaatttaaaacttcttcctttccaatttgaatgccttttatttcttttgcctgcctaattgttctggctaggacttgcagtaacatgttgaatagaagtgagaatgggcaatctgtattggtccatcctcacactgctaataaaagactggataatttataaaggaaaggggtttaattgactcaagagttcagcatggctggagaggcctcaggaaacttacgatcatggcagaaaaggggaagcaaacacgtccttctttacatggcagcagcaaggagaagtacagtgcaaaggggggacaagttccttataaaaccatcagatcttgtgagaactcactcactgttgtgagaacagcattgaggtaactgcccccatgactcaattacctcccactaagtccttcccatgacatgtgggggttatgggaactacaattcaagatgagtttgggtggggacacagcaagaccatatcagcatcctactcttgtttctaaccttagagggaaatctttcagttttttgtcattaagtatggtactagctgtgggcttgtcatgtatggccactattgtcctgagatacatttcttctatatctattttgctgagagtttttatcatgaaaaaatgttgaattttgtcaaatgcttttcctacatctattgagatgatcatatggtttttgtccttcattctattaatgtggtgtatgaccctttagatatgtatatgttaaaccattcttgcatcccagtgataaatcttatttgatcatggtgtttaatgtgctactgaatttgatagtattttattgaggatttttcatatacgtttatcaaggatagtggcctataattttcttttcttgtagtgttcatgtctagctttggtatcagggtaatgctggcttcataaaatgagtttggaagtagtccctcttattcaatttttaagaagagtttgaaaaagattgctatttgttccttaaatatttggtagaattcaacagtgaaaccatctggtcctgaacttttgtttggtgggtggtattttattatggattaaatcttactcattattggtctgttcagattttcctgtttctttgttattcagtcttggtaggctgtgtgtgtttaggaatttatccatttcttctaggttatccaatttgttggcattaaattgtttatagcagtgtcttatgattctttgtatatatgtggtatgagaaaggtagtgtctcctctttcatttctgattttattcatttgagtgttttctcttttttcttagtctagctaaagctttctcaattttgtttattttttcaaaaagccagtgctttgttttgttgatctcatttttttctagttttgaactcatttatttctgatctgatatttattgtttccttctttctgctaatttttgccttagtttttcttctttgtctggtttcttgaggtgtaacattaggttgtttgagatctttcttctttctttatgtattcttgtgtttattgctataaacttcccctcttgtaactgcttttgctatatcccgtaagttttgatatgttacatttctatcttcatttgtctcaagatttaaaaaattttttccctttaatttcttcattgacccattggttatttgggagtgtacttaatttccatgtatttgcaaatttttcaaaattcctcgttattgatttctaatttcatatcattgtggtcagaaagtatatctgatataacttcagccttctttactttgttaaaacttgttttgtagcctaacatatgatgtatcctgtagaatgtctcatgtacaattgagaagaatggtacttttctgcttgtagataaaatattctatatatgccttttaggtcctcttggtctaaagtatagtttaagtttgatgtgttcttattgattttctccctggacaatctgtccactgctgaaggtagggtgttgaagtcccctagtattattgtattagtctctctttccttcagatctattaatatttgttttatatatttagttgctcaaatattgggtgcatatgtttacaattgttatatcatcttgataagttgactccttcatcattacataatgaccttcttattttctttctttctttttgtttcttttgttttttgttttagtttttgttttggagacagggtcttgctctgtcacccagactggagtgcactagtgcaatcatggctcgctgcagcctcaacctcctgggctcaggcaatccccccaagtagctgagatgacaggcatgtaccatcacatctgactaaatttttttagttatttatagagacaggattgccttatgttgcccaggcaggtctcaaacttctgggctcaagcaatactttcacctcagcctcccaaagtgttgggattacagatgtaagccaccatgcctggttttatcatgaccttttttgccttgttttatattatttgattcaaactgtatctcatctgacgtaagtacacctgtgctttctttctttcatttccatttgcatgaaatatctttttctatcttttcactttcagtctatgtgtttccttaaaagtgaagtgagtgtcttgcaagccacatatacttggttcatgatttttaaattcattcagccactctatgtcttttgattggagaatttaatttatttacacttaatataattactgataggtaagtactttctaaaaccattttgtttattgttttctggttgtctgtagattctttattcctttctttctctcttactgtcttcctttgtgattaggtgattttctctagtgatacactttgattcctctttatcttttgtgtaatcactgtaagtttttgctttgtggttaacatgaagtttacacaaaacatcttataacaggctattttaagctgataacaacttaattttgattgcctacaaaaactgcacttttactttgctccctcatttaaaatgtttgatgtcagagtttacaagttttatatagtgtatactctaaaaaattattgtagctactattttttgactatatatttactttaccagttagttttatactttcttatatttttatattattagttagcatttacttctttcagcttgagcatttcttgtaagacaggtctggtggtaatgaatgtattcatcttttgttttcccgggacggtctttatctctcctttatttctgaaagacagctttgccaagaaaagtattcttggttgtcaggtttctttttcttcctttggcactttgaatgtttcatctcattctctccttatctgtaaggtttgtgctaaaaagtccactgttgtccttattaaaactccctcatatgttagttgcttcttttcttttgttgctttcaggattctctctttgtccttgaatcttgacagcttgattatagtatgttttggtgtagtcatgtttgcactgaatctgattggagaccattgaccttcttgtacctggaaatttatgtctttcaccagattggcaaagctttatactattatctctttaaattaactttctacttttgtctttctcttcccttttatgaattcctgtgattcaaatatttgctcttttggtgtgtttcataaatcctgtaagctttcttcatgacttttcattctcttttctttttcttctctgattgtatttcaaataacctgtctttgagttcatattctttcttctgcatgatcaattctgctgttgatgctctctgatgcctttttaaatttcattcattgtatttttcagctccagaatttgtttgattttttaaataatttcaatatctctgttaaactttctcattttggtcatttattgtctccctaattttagtgaattgtttcctatattttcttaaggtttgctgagattccttaaaacaattattttgaattctgcataaggcagtttgttatctccattactttggggtctgctatggggagattattgtgttcttttggtcatgttgtgtctctttggtttttatgtttcttgttgccttacatttatgtctgtacatttgagaaagtagaaactattctagtctttgcaggctgactttgtctgggaaagcctttcaccctatttaaagattctaagatggccatctggcatggtacaagggcaggcttgctgctagagtcctcaagcaggctagtctggtgcctaggacaaccagtgggcaggtctgtgctgggggaaaccttgagccagaatctgcagggctctacaccactgatgcaggcttcttcaggcacttcagtaggcatgaagcccagtgctattgaagccagcttgctgctaggatgggcctcaagcccagtgccacttggtccagtttggcactcggtctggtctggatcatgggttcactgaggctgaaatagtgctgtaggaggctgaagactgagttcgcagggctggcctgagtcctggggctgcaggatttaggttggggtcagagtgagcttggaggttcagaccatgggtactggctagagtctggggctttgggagctgggttttactgaagtcggttctgtggtttgggtgtaaggcaaagtctggtgctcacttccttctcctttccccaagcatattgtatcttgctcaatgctgtgcttcctggagttggggaagatgacacagtgaaacttttcttcctgcccttttcaatgtgctctttcttatttctgtgtttcactcaggtgctgtgatctttcatctggtttcctcagctcttgcaaaggtattttcatgcataggtcgttgttcacatcagtgtttctgcaggggatggagggctggagagtcctattctcccatcttgctctacttctccccaattttctaattatatctttatttttctataagggcaaaacttccctttgttttctcatactaactgcctacactcatccaagacacacagactttgttcacagcctctggctgcttttaacaggtatgagatggaagggaaaaagagagtgagtctttttaacagagggactgtccctggttagagaatgcaagaagaaagaatacaaaagaggtcaactagggaatattaaataacaaaacacagttgacccctggacactgtgggaggttaggggtaccaatgccccatgcagtcaaacatttgcacataacttttacattccccaaaacttaacaactgctgttgaccagaagccttactgataacataaacagatgataacacatattttccatacgtattatgtgctgtattctcacaatgaagtaagatctccaaaggaaaatgttattaatacaatcataaggaagagaaaatatatttactattcattaagtggcaataggtaatcataaagaccttcatcctcatcattgagtagtttgagaaggaggaaggagaggaggggttggccttgctgtctgaggggtggcagaggtggaagaaaatctgcatacaagtggactcatgtagttcaagcccctgttgttgaagggtcaactgtgtatgagtgagacagattttagataaagtgacatggtatccatacattgtcatgttgtggagttgttgaatagaaatatgttgcaagttacttttcagaagttatcatgaaaacgtagaaattatgcatgatgctgcttgtcagatttgcaaaggaaggaagcccaggtgaaagaccttcaggaaggaatggcaagtggagggcctctggtgtggtagacaatggcactggaagagacctttcgtaatgatgggaatgtttgagatgaggaagatatagaaagacaaaaagtgatatagcactcacacatcagatgcgaaagtatttttgaaaaaaaagtgacatagaagaagcttgcagaggtaacgttaataattaagaaataagggccgactcaaagcaggtaggaaatgtaacagagatgcaacattacatatgggacaacaggcctggcacgaggtgaggcagggaggcccccagggcacagcatgtaaggagacctcacttggcatgtgagactgagcttccttaaatttcaaggcaccccatagcaccaccttcacctcaccctggttctgtctctaagagacaataatttttaaaaagtgtagataaaaagactatgaatagaaaaaacatagagggaaataaataccaagaaataggaaaaatggagggaggcacaaagagaagtatgcagaaaatgagttaaaggacaatgaatgaaaaattggtagagagtggatcatgcaaagaagggaagagagaagacaaatcaagacattctctgatctgaggagataagagctagaaaggaggcacagggtgtcctattactatggagaaagatcagctgccctcttatcaaaatggcccctgtgactccacctccacccccagattacaataagcctctcctcaggcatcacttcctctccatggctcaatcaccatctaagatctgttgatttctaaacatacatctccagctcagacctgtcctgttgactcccttccccaattgcctgaagacctttatttaaagacctgaagaacatctctctttggaagctgcatctgtcatctattgctgtgtcatgtaacaaactatcctgaaacttagtggcttaaaacaatcatcatttcatttgccacttgtgtcaatcccaactttaaaatatctctaacttgtccatttctcttcatccccagcacgaacaccctaatctagacccctgtcactctcactaaaattagaggaacagtctcctgtctggcccccagtcttgctcctctcaagtctgcacttcagttgaatggacttttccaaaatagaaaccagttgatatgactttcctgtttgaaacccagtgccttcgtgtggcccttagcagtagatcaacactgcttggagtggtgaattgaaggatgtctaccacgcacctgcgcgttccccgtcacccacctctcgccctttcatgccacattcccaccacactaagcttcctttacttactggaatttgccaagctctctttctttcatctctgcctttatatatgcttttgggaaaacagtttggggtaatcttccaaaggtgaaaatatacataccctataacccaacaattatattcctcagcagaaaccaacagaaatgtgtgttatgtcaccaaaacacatagaaaagaatgctcaaggcagcattattcatagaagccaaatgcttgaaattgtacaaatgaataaataattcatggcttatttctataatggaatactatctagtagtgaaaataattatacaaaacgaatacagatgactttcacaagcatgttgagtaaaatatccatacaattttgggggatttggcttcttttgggagatctatatatattgagagagaggtaaagggagaaagaaagagtggagagaaaagagattattccatttttataaattacacaacaagcaaaattaaccttagtgttggaaacctcaatggtagttgtctttgagcaagttagtggaaacagttaatgggaagtgtcaccaggaggtgtctggggtattggtaatctgtttcttttttttttttttttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccggtaatctgtttcttgatcaaagtgatttacttccttcgtgatcattcaaaacccacttttattcatgtgtcttatactgcaattataatttttattttttttaaaaagcaaaatattaaccatcaaagaatgagacgagtaggtaaagggaaaggtaaaaaacaaaacagagccaagagaggcacaaaggaagggacagagttgagcaaaaggaaaaacacggaggtggggtgaaggtctagccccagcagtgaaattgcagagagggggagttattaatgatagtgaaggaggttcactggggannnnnnnnnnnnnnnnnnnntcttttgggagatctatatatattgagagagaggtaaagggagaaagaaagagtggagagaaaagagattattccatttttataaattacacaacaagcaaaattaaccttagtgttggaaacctcaatggtagttgtctttgagcaagttagtggaaacagttaatgggaagtgtcaccaggaggtgtctggggtattggtaatctgtttcttgatcaaagtgatttacttccttcgtgatcattcaaaacccacttttattcatgtgtcttatactgcaattataatttttatttttttttaaaaagcaaaatattaaccatcaaagaatgagacgagtaggtaaagggaaaggtaaaaaacaaaacagagccaagagaggcacaaaggaagggacagagttgagcaaaaggaaaaacacggaggtggggtgaaggtctagccccagcagtgaaattgcagagagggggagttattaatgatagtgaaggaggttcactggggacacaaatgaaaattcttcatttattacaattaggcccagaggcagagctacacaaccatggaatccaaattaattcctgttctgtgcgactggtggatataaaaaaggaaaagccattttctaattcaaaagttgagtgccaagcccaagcaagaactcatcataaccaggcatctgacataataggtaaggctgactgggagagtttgtaactgtgagtcacaggttaccaggtaaggggctcagggacttcatcacggaccatcggggcagtgcaggtagcctgggatggaggcaggaagggaaaggggctggcacctgatgcagtgagtcttcagcttgacagaagaaagtccttaggagttgggaaaataccagaagacagaaatggaggtaatcagtaagaatgtcagagaggctatttctgaagtcagagagggctgggcctgatggctcatgcctgtaaccccagaactttgtgaggctaaggcagggggatcgcttgagtccaggagctcaagatcagcctgggcaacatggcgaaaccccatctctacaaaaaatataaaaattagccagacaaggtgacacatgtctgtagtcccagcaacttaggaagctgaggcaggagcatcgtttgagcctgggatgcggaagttgcagtgagccaagattccgccactgcactccagcttgggcaacagagcaagactctgtctcaaaaaagaaaaaaaaaaggaaaaaataaataaaaaataaaaaagagaggaaggcatgggagaggagttaaaaaaaaaatcagagagccaagatattcacaagaggagatggggagggaaacacatcaagacaaagagaggtataaagagacaccatcgctggaaacagaggcagaagcaggggagatggcagaacaaagaggaaagatgagaagtaaaatgagagtgaaagaaaaaaatagaatgagggttggggtaagaacagtgtcagtggatgggcacaactgccttctgtgtgtcaattttatcagcttttggttaagaacttggaacaaactgcaggtggcatgcattcaaggaacaccccagggtcttgagttaacttagcttcctgggtcttcctagtgctctcattgtggaatttcctggtgcatggactccttggtcacaccctgagactcttaatggtttttgctcctttgtgcagtcatcagcagtgaggactctgaaggatccactgacgttgatgagcccttagaagtcttcatctcagcaccgagaagtgagcctggtaaggaagtttgggagagcaaggcttgggctgtgggaatctgatttaagagctactatttcctgaggcattttattctgagctcattctgtacaatggatccagtttatcctgggatcccattctttgcattaattttacttgacctttttggaaaatgcagggagacaagaaattgttataaacttatttttgagaattagccttctttcttgatggattctattaatcaatattcatacccatacattgattatatagtaggaataggctagccaagtgatgagtttgtttttaaaactaactagttgctatgcctatatagtgttagatttatatagtgatttttatagagaacagaaaactaaatattcctttatgggaagatgttattgtcatctgatcacaaactttgaatagggtcaaaagacatctcatccaactatctggtgttggcaaaaacaaacacctgagataaagtattctgaaacttgaagtattgtttctgatagagttcttcagcaagtcatggcacatttagtgattttttgaaagacttttgcaaattgtcttatttttaaatttacaataaccttaaaggggtaaacagaagagagattctcgtccttgtttcctagatgagagaacacaattgcataaatgtttcaaagtcatctccaaaatctcatggtaaattaaaggaaagacaagactagcatcctggattctgagttacttcctttgtgaaatgaaagagagaaacattattaaaatcttgtattatctcaatcctatttgcagcatgagttgtcataagatttataacataaatacttatcataacataagtatgcaaattggttgatttgttttgccctttactttctagatccagaggatattagaaatatgccactttagggaaaatacactagggaaagacctaagagcaaagaagaacctcatcttgatgttataaaataacaatgtaataatacattcattctaattgctcactgtatctttcaaagtaaaatgtaaatttgcattagtttttagacaatatgtactctaactttgaacttagtgtaagcaatctgctgtaaaaaatagtcccaaaatatgtctttggctcaaatacatgaggagattatttctcagccttgtaaacaattcagcaaggcactgggttggtgggaggtagaaaaagctcacgaatttaacagaagatcttcaaggtccccctgcatgaaaaatagaagcagaaacaaaggaaatgtggaatggcaagcagaagggataagaagtaaaagaagcgtgggaaagcaaaggccaagcaaggcaaatattccctctggggacaagaatggagtatcactaacccacaatgaaggttagttgaaaggcaagacaagcatggcctgtgtacaggcgaggacttgcacggattttcaaggttttccaggttttcttattagggaatttcctactgaactgattccttggtcacacactgagacctctaaagaatcccattcttttgtgcagtgatcaataatgacaaccctttagaatcaaatgatgaaaaggagggccaagaagccacttgctcacgaccccagattgtaccaggtaagaatattagagttgcaacccgagactgtagaatatccagagtacaaatccagagctctgttttcttgattaatttcattctgagtggtctccttatgccttgattccataaattctagaatatcactttctacatttaacctctctggccctgttgagaaatggaagacattaggaaggtgttataaactcttgtttaactggattggttcaatcgattgatacattgaaaatgtagcaaaaatatgctagtaaaataacagtctttttaacaacaaactatcaagagttattatttcaagagttgaaataatgtacttattctctactactaccctttatatttgatagagcatgataagcacagtcttcctttgttcattgataattattgtcttaatcacaagctcagaaagtcttcaaagaatactttgtgctgctatttaattattaatggcaaaaaaaaagtgacttcaactacacccaaacccaaattatagttcacttattggcttacattgtgatttttcacagggcttttgaaaatgaaccttcatttccccatcacaaaaaccttaacagggaggtagggtaactagtttatccctgctttatatgtgagaaaatgggagctagtggtgtttaagagtcatttatgaccaggcgcagtggctcacacctataatcccagcactttgggaggctaaggcaggtaggtggcttgagctcaggagttgagatcagcctggacaacatggagaaactccacctctaccaaaaatacaaaaattagccaggcatgggccgggtgcagtggcttactcctgtaatcccagcactttgggaggcgggggcaggcagatgatgagattaggagttcgagaccatcctggccaatatggtgaaaccctgtctctactaaaaatacaaaaattagccaggcatggtggcgcttgcctatagtcccagccactcgggaggctgaggccaaagaatcacttgaacccaggagagggatgttgcagtgagccaagatcataccactgcactccagcctgggtgacagagcaagactccatctcaaaaaaaaaaattagccaggaatggtagtgtgtgtgcacctgtgatccagctactcgggaggctgaggtgagagagtcactggaacctgggaagttgaggctgcagtgagttacgattgtgccactgcactctagcctgggtgacagagtgagaccctgtctcaaaaaaaataagtaaaaaagaacgagatcatgtattttgagagaacgtaaatggagctggaggctattatccttagcaaagtaacgcagaaacagaaaaccaaataccatatgttctcacttgtaagtgggatcttaataataagaacttatgaacacaaagaaggaaacagcagatgctggggtctacttgaggatggagggttggaggagggagaggagaagaaaagataactattgagtactgggcttaatacctgggtgatgaaatcatctgtacaacaaactcctgtgacacacatttacccatgtgacaaaccttcacatatacccccaaacctaaaatagaagttgaaaaaattaattaaaaagaggcatttccaaataatacacacagaggattatggagagagctgggcaggatcccaacattatgaccctgaacctccagaactggattcactagaaggagagagagaaaaacgctcatcaaaactttgttattggcagggcacgatggctcaggtctgtaatcccagcattttgggaggctgaggcaggtggatcacctgaggtcaggagttcgagaccagtctgaccaacacagtgaaaccccgtctttactaaaaatacaaaaattagccgggcttggtggtgcacaactataatcccagctactcaggaggctgaggcaggagaatcactggaacctgggaggcagaagctacagtgtaccaagattgcaccactgcactccagcctgggtgatagaacaagactccatctcaaaaaaaaaaaaaaaaaaaaaaaaactttgttattaacccaagcccatttgccatgtcagttgtcatagaatttataagtctcttgcatacaaataacgggtttctcccttttactttacagagcccatggatttcagaaaattatctacattcagagaaagttttaagaaaagaggtaagagaaagctttaggaaaagaggtaagagaaaataacttctcttcatggttataaatgaacaatattttctacaaaagagtcagtctaattccttgctatatccttcaaagtaaaatataaatttgctttaaatttcaatggttcctattttagcctttgtattagggaggttggctaactgctataacatatgaacccaaagaagtcaatgaccccaacacaacagaaggttttttatttttttagtagaagtttgtatttttttcaactgaatatttcaaggatttttagatgagggaaaggttgggctctgtttcaagcagttcttcagggaagcaggcaagtagaagatctgccttctcccatcctagactttcatggttgccctgagagagaagcaaatttacaaataaatacaaatccatatacaaaaaccacaacaaaaccataaagggacaagtaaagaaagaaagataatgtggtgtaagaagacagagggccaagacaaagcagagatgcccactggggctaaaattttctcagcctcaggctcaggtgacagtgagggataaaatactaaccttgagccacacaaatctgaatgaaaaggcagatcatgggggtttgagggcacggacattcttgccctgaagtttcagagcatcacaaattttcctagtttccttttcatagaatattattctgacttggttcccttatcatacactgagagctccaaaggacatttgctcctttctgcagtgataggacaagaccacgacttttcagaatccagtgaggaggaggcgcccgcagaagcctcaagcggggcactgagaagcaagcatggtgagaagggtaagaacagctcccttgacttcagggctctgacttcagagcacctcttccctgatgcactgtgctctgagcacacacaacagctatccaggagccagttctctgcatctacctcatctggccattttgaaaaatgcaaagaaagaagtcactctaaattcaggcttaacaagatggttgtggttgagtggcagtggcctgtttactacatactgcctgtattagtccattttcatgttgctgataaagacatacctgagactgggtaatttacaaaagaaagaggtgtaatggacttacagttccacatggctggggaggcctcacaatcatggcagaaggtgaaaggcacgtctcacatggcggcagacaagagaagagagcttgtgctgggaaactcccccttatataatcattcagatcttgtaagacttattcactatcacaagaacagcacaggaaagatctctccccatgattcaattacgtgccaccaggcccctcccacaacacatgggaattcaagatgagatttgggtgaggacacagccaaaccatatcactgccagacctattaactccaaagtattggatttatgtagtgatttctacttctgctcattctctgttttgtaaagaaaagaaagtacactagtctgttattgcctgattttgtcaccaacttgttcaaaattccaaagcttctggtcatactctctagttattgacagaaagaaagcctcctgtttcttaccatcagattcaattcatagcttttgacagatggcccccaacatgaaattggccaaatagtgatatttgaaaatatatttacaaataagatctacttgcatctttacaacaacctaaaaggtgggtgagataactattgttccccccatttgacagatggggaaactaaggcacacttaaggatcttttttctttgcacatcacatatggaaagttataggaggagacaagactaacaacccaaactcttaataaacattcataatcctctataaaaccttcaaagccagatgtacttcaaagttcaaaaaatgttttattattttagaaagacaatgtggtttatattctatatacaacaaaataccccagtaggatccagggaagaatcccattctcaaatatactaatgtttatacagcaaattatataaatattcacaccaaatatgataagattttacacggactcatggcaactcaagtccagattcactgccaaattagttagctgcaaacctatgaaaacaatactggttattaaaatatctttgaggccaggtgtggtggctcatgcctataatcccaacactttgggaggctgaggggctgaggcaggtggatcttttgagcccaggagttcaagaccagcctaggcaacatggcaaaaccccatttctaccaaaaaatgcaaaaaattagctgggcatggtggtggtgcatgcctgtagtcccagtgatgtgggaggctgaggtggaaggatcatttgagcctggaaggtcaagactgcagtgagccaagattgcaccactgccctccagcttggctgacagagtgagaccctgtctcaaaaaaaaaaaaaaaaaaaaaaaagtcattgattttgcaattagggctaaaggattgtgggtctgtgctccatttgatagtaatctctttcccttagatgggaagagacagaaatgatcctcatagaatatttatagtccaaattctgtcaacagtgtaagcagtcataagatttatagatcttttagttagatattattgatttggttttcctttactttctagctcctatgacttctagaagtacatctacttggagaatacccagcaggaagagacgtaagagcaattaaaaactcttgatgtaacaaatgtctttatttgctgcaaaagctacattcactttttatgttatatcctttaaaataaaaaattaatttgttgggattttagatgatttgcattttacattttcaattagatgagttgggctggtataaaacataagcctcaaaatgttcaaaggcacaagtgcaacataagtttatttttcactcacataaataggataaagtagttcctgagtagagggggtgcccacacagtcattcagggcccagctgatgggggctctgacatctttaagatgttgcttccatggttcccttggataagaaactgagatggaagcagaagtatgtgcaaactaataatgaaagcctaagaagcgtaagaaacaacgttgtcctaggattgtattcagaaaagattgaacattatgtatgttccttttatttgattatgcatgaatgagataggagaaaacgatggaaggatccacactgatctgttgacttcactagctgggagaccagagacagaatagggtaggaaaagagagctttggggttatatacatttgcattcattggtcttcttatgacaagcatatattgctttcttaatttgaaaccacccaatgaaatggatgatttataataaatacatatttttcccaaagttaaaaaaaaaaaagaagaagaaacaatgtcatccccagccccagcctcagagagggctcctggagcaatcttgaccaacaggtcagatgatcaaagccaaagggtggcctagtggtgggactatttctccccctcctccacaagcttctcttgttcagttttgcttttaaagaattccctgctgattcctaagactcagactaagactgttaaggaattttatttttttctgcaggtttcagcagtagtgacttttcagacctgagtaatggagaagagcttcaggaaacctgcagctcatccctaagaagagggtcaggtaaagaagattaggatgccaagacttggcctgcagaatgtcaggaatgtgaattaaaagctgctgtttccagacgctttttattctgagcaccttcactaccttgtatccagttcatctgggaactcctttttgcattttagaaaatggaaagaggcaggaaattatgataaactcatgtttaacagaaagagtttcactgactaaatgtatgtaattatattttgttgttgtagaagaaataaatagcaaatttgtggtattcttttttttaaacctgctctcattcctattaacactaagatcttagatttttatagtgataaatgggttgacatcattgtcatttgtaattgtaaagcctcaaaagacaactgttcctactatgtaattatagacagaaataaaaacttcagatcaaacactctcaaacgttagtatagtttttggtagatgtccttcatcatgtaattggattatattgtgttatttcaatgtcttttggcaaataatatcttattttgtcatcacaaaatttttaagacataggcaggctaactatacccattttggggtgaggaaatagatgtacagaagtattagggccaaaaaactaaagaaacaatagaaactagcaacccaggtgtctcacggtgggtgactgttgtatgtaacagacaggaggataagagctgtgtcatttaagtcaaagtccaaagaagatgcgcaaggaactcagaatattcacaggagactataccagtgcctgatgcaagaaagcttatttaacaaccactgtgtgtgtgtgtgtgtgtacacatgcatatatttgttacatataacatgtatacatacataaacacacacatgtgtgtgtgtatatatgtatattggttaatacatataatctttagggggagggaaaaataaaaatcgcaaacagacagagataataggaatggaaccagctatataatatacaaaatacctagaaagacagaagcaaaatagataaacatagaaataaaggagaacagaacatcattgatggaaacagaaaaagcaacacaggagacaagaaaaatcaaagggagatgagctcaccgaatcaaagagacagagacaaaaatgtatagcagcagggcaatgggcagaaaaatgagaagtgagaaggagaacgaagtgtggccagatagagtagggctatgaggtgtactcattgatataggtgtatttttttgtcagtccgtttaagctctgaaaatagttcagcatgaccacattgagacaggttccctggtttcctcgtcactgtctatagtctattatttccttgtttgtcttcattgtcctgtgaatttagagctcctccaatgaatacacaaagagagtcagaagagatgcagcccattagcttgtgatggagaagccgattatgatgttcagttcattattaattatcttttttttcctacttgcatggaggaaaagttcttttttcttttccttacctctcccccaaaacatatgcacacacacatacacaccacacacacaaagacttgtgcacagactcgggctgcttgcgacaggtttgagggagcgaaaagaaaaagaagagctgggctcctgaatggagggaggagacactgagtggataaagtaaggagaaagaatggagaaaggtaggctagagtcaccaaatgaaaagatataagagtcagcttcaagtttttctaagtggacaaggaattcaaatattccaggtaggggaattttgtgggggagggagggataattttcaacacacttctcagaaattgtaccagaaacgtgaaaataaagttgctgattgattgacagccttgcaaggtagaaagctcataaagaacagacaaaggtaatagagatggctatgtggtcagtgtcctaacagcaggcatttggtgatgaaagtaataacctgtgagataaagatgaatatagatgaagaaaatgtggataaagacaaagattgaaattgcaaaaagagtcaagatcaagataagggccaggcgcagtgactcatgcctgtaatcccagcactttgggaggccgaggtgggcggatcacgaggtcaggagatcaagaccatcctggctaaaacggtgaaaccccatctctactaaaaacaaaaaaaattagccaggcatggtggcaggcagctgtagctccagctactcaggaggctgaggcaggagaatggcgtgaaccttggaggcaggtcttgcagtgaaccaagatcgcaccactgcactccagcctgggcgatcgagcaagactccgtctcaaaaaaaaaaaaaaaaaaaaaaaagtcaagacaagattcagagaaacaagctagaagagagaatagaaggaggaagtgatagtagaaagaa

SEQ ID NO: 15923 - DNA, 7223 bp, Human
  misc_feature (1)...(7223): n = A,T,C or G
gaaaaactgtcctccgtgaaacctgtcccaggcgccaaaaaggttaggtacttgctgtagggccacctgatcttttctccagcttctgtgaggttggctggcagtccctgaagactcctgcctgaggcctctgcctgaaccctgtcctcagggggccagaagcaaactccagccctccccgtgtctactgctcgctgaggaagccgcaggtgcacactggatccacaaggcacagaaccatcttggccctcggcaagcccccgcttccgccagggcagacggcctcaggtgacaatgggttttcccttcactggagtttaaaataatccagactcctcagcaactcctgcttccagaatcaaaaataagtgtctctggggcccaaggtagggggtgagggggacataccagcagcttccaccagaggtggggcggggcagggcaccagcagagaaaacatgcgggcaaacacacacggcctggggaaaaccccctgaagccaatggagacttgcctttgctcaaggcctttcctgagagcttagtggtgggacgggtcccacctggctcagcacaccgcccgcaggggcctctgcagctgtcaggtcagctgtgggtgcagaagccgatactcccccggctcaggcttgctgctatctttagcactgtgctcagactccagtggcctgggaaccctctgcagggggctctgcagcccttctcacattcccggtggcctcggggggcctcccaaccatgcttcccccctcggtgtggttctccccactcctgcagcccagcagtgccccttcaggatcacacccagaccccactggactggcagcaggggatgccctggcccttgctcccagccccagggttccacatctggtcacctgacaccttgcagtcggccccaggtccctcctgggcaggtcatgcctccagggtcctcaacctcaggagtcagtgcttcatagaggccgctggacctggggatggcaccaggcagcatctcaggggacgccaactgtgaccatgtgtccctcagggggtaggacctctgctcaagagacatgcaagtggcacctgtctttttagccttgcagacacggtggcgcccccagggatcccacctgctgttgtggctgcatatagtcactcccaccactgcccctgcagcaccgaggggcaggtgccctgggtcctgttacctactgcgtcccacgcagacgcaggcctggggggctccaaaagcttgttctccactcagcctgtaggcctcctccttgatcctgcttggcctgcagaccctcctcccaccccttgaaccagggcatctggatgctgactctgtggtggcctctgatgtctgacaccaccaacagaccctgggccaggtccctaccccagactctgtgcctgaggccatggtatagtggggaagaccaggctcagggccctagagtccccctcccagcccatctgagcaacgtggccatctccatggctcctccaacccagaaatgtcatcacccatgggccaggcaaggagctcccagccatgaggtcagacggggtggtcccagggccaaggctatggactgacttctgtcaccaaggcagggaggggcgtggacacccctgacagacagagtgtgcttggcagaagcccggtgaccagctgcagtcacccacagcagcgttgtgcaaatctagaaaaagtgccccttcctctggctcctgcagttccagggtgcccaggcccccagccaagagcgtgtacaggtggccctgctgacacacagaatccttgggagaacaaagcctccccggggttcggggacaggtggatgggaggtagtcctggccagaggtatctggggaggctgggggccttgcggggtgaggcagggcaagggtgtgagtcactgccaggctgccaaagctcactctgcagctgtccagtcccctggggtagccccaagcctgtccttgtagggagtggcagccggagtctgaactgtcctgggggaccaagcaggagcttaagatgggcaagacctggggccctgggcagacgcatcaaagcaggcagaagcaggcatggtgagcaggccgccgtgcatgcctggggcaggcgtgtgggtgtgagctgtgctgtgcatgtgtacatgcgcacagacaagagcgtgggcgtgtccgtgcttgcgtgtgaatgcaggtgtgggcgtgtgctctgcctgcatatgtgtgtgcatgagcgtgtgtatgtgcgtgtgtgtgaccttgcgggtgtgggctgtgctgtgttgtgggaagtacgtgcctcacgttgctctcctggtgagagtccggagcaggatgagggggttcctggctttcacaaaatcccggtacccagaacaagcccacccagagtccacttgcccctcaagccttcagaggccaagctggctcctgctggacggcgatccctgaccactgtgctctgtgggccttctggaagccactgtccctcccccagtccctgtgctgaagccagacacctgcagccgtcctgcccccaaccccagctacccaggcctgaggctggcatgctcctcagctgtgtggccccctccagcccgaagggctgaggtccacccttcatctgagttaagtctctcaaaactctgggtgccctggagggtttcgtcagccagcccaggaccctcagccatggtgctcccaccgcaggccagcaggaagaccaagaagaaggaagggggtgccctccgggcccagagagcctcatccaatgtcttctccaactttgagcagactcagatccaggagttcaaggaggtgagactttcctgcttcactgggagcccccacccccaggagcctgtgctgggaagaccccatgtgggctggctccagggccagcaggagtggaagcctatcctcagtcaggggtgctgaggaaccgggagcagggggcggggcagagcccagccgggttggcagcacagcagccctgaccttggtccccaggcattcacactcatggatcagaaccgagatggcttcattgacaaggaggacctgaaggacacctatgcctccctgggtaggtacccaggcagaacgcctcagagcccttggaggaggcgaacacagaggtcctccagctccagacgccgcggcccctcctcgaatggagccagggcccgcgcctcagaggcccaccaacggccctgaagctgcaaggtgatggccctggccgcccttggttccatcagagctggcagagagcatcccagggtgagacagggtgggtgggacagcccaagcctggaaactcagagtgggctttgaggcagcaggctccagggaggggctgactctctggtaggacgccacaggcaggcaggcggcttgcccccaggcaggaccacagagctgacagagggcatggagaccctgcccggccagaccacagagctgacagagggcgtggagacgctgcccagcctctgcagcacagcccgagtgtggtggggcacactgccctccccagcttcagtcctccctgcggcacattctgttcccagcagctgcctctgacctgaggcaggagggcagggggcttcggtcctgccctgggagctggggagtgatttctccttggggtgggagggtcgcaagtgacccaccttcctctcggccctgcttatgcccagaattaagaacagcagatcccagcaccttcccaggctctgtgtcacctccctctccctcagcacttagtcctggggctcacggtttggggtgaggtggacacagccagccagatgcacccactgccccacgtgcctgggccaagcgtctccttcccgctccctccccacccttcccatctgcctgcctggccctgtgctggggtcacctgctggtggcacagggcaggcaacaagccctgccctgtgatgcccccatgtctgtaacaggcaagaccaacgtcaaggacgacgagctggacgccatgctcaaagaggcctcggggcccatcaacttcaccatgtttctgaacctgtttggggagaagctgagcggtgagcaccggtggggcaggcctggccctcctagctaattcctaacagttagagatccggacatttcacgtaaaaatctctcttttccaatctctggagaagccctagggcctggcactctgggagccaacaactgtggggccccgtcagccaccccagagccatgtgctcaggcccgccctcctgccccacgtgctgtgtgacccgccgtcgacacctctgtccctcactcatgcagcactcacccccagctccaggcctgggctgaccctgggcaccccaaaactcactacaccccagggcaggagtgcccgacaaggcctccttggggctcaggaaaggagaaggccttcaggcagaggccaccttgtgggcagaggcttggagtctccccctgcttggggcaggggtctcccctcctgccatctgcccttggcagccacgggactgccaccctgacggccctgggctgaaggtgcctttgtggcaggtaccgacgccgaggagaccattcttaacgccttcaagatgctggacccggacgggaaagggaaaatcaacaaggagtagtgagtgcccgggcggccagggcggcccggcttccggggaaccccagtgatctcatcctgtcccaaaagggacagtcagccaccagatgccacgcccacctccccacctctgaccagcttcagggccatgaggagcgaacccaggatcccagctgagtgggaggccagccctgctcacacagggaccagcgcctgtgcccggtgggggtggggcggcttcccctcagcccactcctccatcttcagctcctgctaggcgccggggaaagtaccaggcgctggcctgtaacctccttccggctctgtccccatcagcggctcccccagaagtgatggcccctgagtgtgtgttgggaagggacctgccccagggccacactccagcgggaagggcgggagtgcagtgagcgagtacaacctggggcccctggagcacctgagccccaccgagaaggctcctgcacccccgcatcagcccgcgctgacccctttcctcgtcctcagcatcaagcgtctgctgatgtcccaggctgacaagatgacggcggaagaggtctggcccgcggcttccctgccaagcccacgaggggagggcggggctcccggggtcagctgggtggagggggacgcggagcccgaggagcagcgccgcggttaggacccaggacagaacaggcccccggggggctcccgaagtgcccgtctgagggacggaactggctcagagggatcaggtcagcggttggagacccctcccctccgttagatcagcggctggagacccctccgcggcctgagcgtctgtcccagccggaggggcggggctcacagctgtgcggtccggagccgccccccacccccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggcctatggtgaccccactacccttgaccacagagtgaccccagacggagagcccactcgcagctcttgacagccctgagggggtgtttgcagacccaggtcctgagagaggtcactagcatggggtctgggatatgggtgtgccagccccatctctgatctcggccacacctgtcctggctcacctgtcctattgcccggggactccctgcgtggtgctcacctgtcctgctgtttagggctccccacgtagggttcacctgtcccgctcccagggaatcttcacatggggctcacctgtcctgttccctggggactccccatgtgaggctcacctgtccagtcaagtggatcctccccctgctggcaggtggacaaggacggctccgagcgtcgcacagtcagtgccgtcattgccagcatgatgagtattccctcggcctgcctggacacacgtggccctcagcccccgctgcactgcccaccccctcggagccaggtgccaccttgggaaatgttgacatcggtgctgtcccttgtgccaccaccctcctgaaggcagcacgcagcctcggtcatgggccctatcagccggcccggcctgcacacagcaggtgctcagaacctgctcggcccttgccagagcaggcaggttccccacctccccgaaaaggggcctggaccacatggtgcaaccccaggggtgtaggggtggagcaagggg

SEQ ID NO: 15924 - DNA, 42053 bp, Human
  misc_feature (1)...(42053): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttcagccgccgccgcagctcaccgggcgccacatggacccagccggcccgagcgcgccccgccgctgaccgcccgcgccccgggaaggtaaccgcgccccgagcgcagcgcgcgcccggcctccgctccccgggtctcccctcccggccccggcgtctcctccccggcccccgcttctccccgcttctcccgccggccccggtttctccttcccggccccccttctccccgcggccccggcttcgcccagctcctccccccggcctccgctccccgggtctctcctccccggctccggcttctccccccggctccggcctctccctccggcccccgtttctccccccgaccccggcttctccccgcagcccccgtttctctcccgggctccgcgcgcgcggggtccggggcgggcgctgtccactgccgcggtgctgaagcggcccccgcggtcccggcccgcgcccggcctcctcctcgcttcttcctgtctcgaggctccccctctcctccctcgccctctttctttcctctcctggcgcgctcccgcctgagggccgctcggcccgcccgcaaagccgaggggtgcgggtgcggcggggccggagccctgcgggtctgcggggcccggccgtgccctccttccccgcgccgcgggagccaggggagaagtttggaggagaatcggcgctgcggcaaagcctccgaggggcgctccccgcccgccgccctcccagtccccgcgcgagtctccttcctctgcggagggcgaggggtgaaccgtcaaacagtgtctctccagggacctggggttccccgataggagagaccccgcaaaaccggggggctcactgcggctgctgtgatttcagaaagcggcttcccaagaggggaccagagcgccccaccccaccccatgcacgcccccggggcgggggtgctctgtccccgtccccacgtgtttcctgaaggctgagccccctgaagtttctccccaaccccgatctcttctacgcgggccatgtggggggcacactgactgcagtgccgtcagggatagggtcacccaagcctccctggtcagaagccacaggagcccgccctgaagggtacccgctcaaagacccacccccaacccttctccacggccctgggctcgggaccaccgcggaggcgccgctccagacactgagctgcagagcggagcagtcaccttcaaacgccccctgggccccgcccctgcttccgcagcctggcgccaggcgcctctgagcgatgccccctaagccatcagcagccctccctgcagaggcttcagacaccccaggagctggggagaccattttcaggtcctctggggtcctggtttgggtgtggggacagaagcccctcacgaaggacttcccaggcagccgctccaggtgggggagggtccagcccacaaggtattgcgggtaaggaatgatggtctctggggaaggccaggcaggggcctgcttagggtgacctgtgaccacttcactctcccccaggaagaacactcgctcccggccatacttgcgtgtgagttctgacccctggaggagccactgtggaagcagagcaatcgccatggagtttgtgatgaagcaggctctaggaggtaggaagcgggaggtggggtggggaggggctgaggggacatggagagaccaccacagcagctgctcctcatctggcccaccgcagcagcgcccctgcagccacacggccacccacgcagccctgcacaggagcctggggcagaggagcaaggaccgtgcccagcagcgcccccagcccggcccttttcgaggccccgagccagaactggtgttcctggcgggacaggggctgccctgtaagctcactctgccccactgctgtggtcggggcagagcccatggaccatgctgatgcacgtcctgggggagggtgcacactctggcgtaggctttacagggccaattctaactggccaggctgggcagcccccaagggggcttccttccagatgaggagagccaagcggtgggagagcaggatgcaggtggcagcctcagggacaggcgtggggacagagctggcctgtgcatctggcgaggaccctgtgggtttcacttgggtgaggcagcgccatcctcagggaccagggcttgctggttacgggagcgaaggaaaaggcccgaaacagcttgtgtgtctcgactgcctcccaggcgggacgtgcagccttttttgtgtgtactggggtggggccaggcccccttccaacctgctgtctgctatttgaaaggaacctcgtccccacttgacccaaggctgtcattgtggccagagaccatgtcaagagcagtggctgggttcctagaccaggaggtgggcagggcctgggccatgctggtacagacgtgtcccggcagagctgatgggtcaactcaggcctcggggctgtcgtggcgagtctcagttttgcccagagccgtccatcctgtgttcccccagcaccagtgcccagaactcctgtgaggggaacctgtggccggtgcccgattctaccactagagacgtcttgcttgggtggcctccacgggggagcaccctcacctgatgccattcacaccttggagtgagtcaggcctcctgggagcatttctgcagtgggggagctggccgggttcgaggggccagggacaagggtgtacagagggcaggcgccgcttcccccaggacaggagctgcctgcctggctgtctcccggagggtggctgtgcttccactcaacacaaattaaatgaaaagatattgagcctgtcctggggccacatccctgagatttcgtggtcaagggtaagagtcaggttgagtctaattataatggctgcgtcaccgggctgtgattcagggacaagcctgcatctgcgctgggagggacgcacgttccacccagggagtcccaggctgttacggataattaattagttggctaattcaggccctgaggtgggcttgtaagaaactgaaatatcttatttggctgtctacatgactgaaattagctgggtaattaccagcctgaattccctttttgtttcatggcagcccaaagtttctccagcagcagcaaccgggcaggcgtcgctcagcgtggtggagctgagcgggggcagccagcagaccctgggggggctccacgctgagtgcttcccagagcaccccacattggctttgcagagcacgttgaggctcggagccagagctgctgagggcgggagctggtggggggcttccagtcgagaccttgttttctgcctctgcgcctctgtccctcacccggcgagcctcattgttgctgtctcaggatgcgtgtgagtgagacagagcaagacagagatgggaaatgggggaacctccagacagcacgacagagcttggcagagaccccaagagaactattgagaaacagaccaagccccggacacaaagaagctggcaggagagggagcaggaggcacccaggaagccgttcaaagaaaggcgaacccagaaacagggtcggggagggggagctggagaaagaaaatgacagcccagaaacagacagagaaaaagacaagaatgtgttattcagcacgcacagggacagacaggtgaaaacagagacggcacgtcagagacagaggcagaggggagagagagaaagagggagagacggagacagagatagagggagacacagagacagagggagacagagacagggagaaacagagacagggagagatgggagcagagggagagacagagggatacagagagacagacagacaaaggaagagggcagagagaggcagagggagaggtggaggcagaaggagagagagagacagagagagttagagagatagagatggagacagagacagagggagagacagagatggggagagacggagaatcagaaacagagggagagacagtggtgagagggagagacagagacagagggagagacagagacagagggagagacagtggggagagagacgcattagaaatgaactgctaagaggagtcagggccaggagcgcaggcagcatggcacatgcacacgtgcacgcccgtcagagggtgcagcagagaggaggaagaggtgaggacctgcccagggctctgggcagggggacaggcctggttaaatcaagaccattcgggggctgtccgcggcaggctgggccgcaggtgtgagtcttgctgaggagtgagtggcccagggcctgctcatctgacccaacgctgggtctcaaggaggggcccctgttggggccaccaagggaagggagcatggtggctgccggggtgatcgctcgtgggggagcgggaggctcctctgcagcaaaagtggccttgaactggggccgggcctccccccacaacacgtgggtccggatccagggtcctcaagggagtaatttaaagaaactggtttcctcaggccagaaagttgcaaacacggcctgggagctctgtggacagcgtggaggaacgtggcacgtgtgggtgccgtggtcactgcagaccctcatggggctaaatgtggcagaagcgagcagccacccgctctcccatcctccgccttgatgtgacacacgccctgtttaaacacgctcaggtcctcgggaatgtgtggggcaggcgggccggggcttcaggtgggacacggcttggaggatgcatgtgcggagaggctggggtgcagagtgggaggcagccggacactcaggagagcctctgactgccccagcgacagagcccaaggcaggactcacccatgctcggctctgccacgtgtggggaggtctagcgggcaggtccagtgactccggtggttcagtcacgatggacagtgtccggcagtgaatgcccctcacccagccaggcccaacctggggggcgacagcctggcctgggttcagtggagaagctgtccttgtccccggagagtggtacgctgttgggttctgtgtccagtcctacatggggagggaagcaggtgaacatctggggagaacacaccgtaggggtgcggtcctgggtttggcgtgagggggaggattgtggtcatccaagccggggtggacgagaagtgtctcgtggacggcccaggcaggaagtgcagggttccaccgtgtgggagagcccctccgcgcccccgtggggctgggctgtgagttctcggcaggaacaacccaaggggcttgtgggggccaccggtgtccaccttgggggttcacgcgaggctggtgaggggtgtccaccttgggggttcacgtgaggctggtgaggggtgtccaccttgggggttcacgtgaggctggtgaggggtgcagttgggaaagaatctccctctgtgagcagagaccaccagagccaggagtccaggccagggatgccctgagccacaatgcagccaacaccagcatctcccccagccctccacggggatggagggggcacctccttcctccttcccggcaccaaagtggggctcagcactcaccatctgggacctcaggcagggccatggaggcaactgggatctgggcaatcctgccctgattcccagtgtccacccctgagacttacaccatgggcaaggttgggtgtccaccctgtcccagacagaggtccctctggctctcctgcctctctcttcttgcccagtttgaagctcagccttctctgtttattagggaccccacaggctcctggtggttgaggcaatgggggattctgccagttcctgccccattgggccactgatcaggctctctggacctgggaggacgatggagctgcaggctgggctgagctgggtccgggaggacggtggagctgcaggctgggctgagctgggtccgggaggacggtggagctgcaggctgggctgagctgggtccgggaggacggtggagctgcaggctgggctgagctggacctgggaggacggtggagctgcaggctgggctgagctgcagggacagcagcagatccggaggtgaagctcttgaattccacatggggaagattcttttggctgcaagtaacaatcagaggaagaggagcttgaattggggtgacgatgtgtcaggaggtggcccagctgctcagcgatgctactggggacctggtgccatcaggtgccaccttcgtcctcagtggatctttcatgctcagctgctcctcacaatctcaaagtggctgctgctgctccagcattgcatccatagtcagggaaggaaaaagagaggagctaaggggcaaccccttcatctgtttagtggtggtctttacagactctcatggagggtttccatttacttgccacagctagaagaggaaggtgggggccagggtgggcccgtcctactccaaacagaggccgggtgttgggcaggcgtcccacagtgcctgactcacacccaacttggggagacttggtttctaggtgcagaaccgctaggcaatgaccccccagcagtgtgtccttcccagccttactccttggaacaaggcatgtgctcgaaaggcagtttgcaaacacttaacagtaaaatgccaacatttgttcagaacggacttcacaaacgccgtgtggtcgagaaagcactcactcactttgctgggttcggcagagatgcctcttatcccagatttctgggaggctggaaggacccttcagagaaactgcctttcctcccgaaaccgtgaagggcagtcctttcctccagagaggatgctcttggttgattaagctgcaactcaattataaatactttagccccaacttgggaataaaatggatattatgcacttcaactgacaaagttatttatgtttttgcctcattggttggcaagacgttccagttggggttagagcatttgtttcaatagctcctgcgtgacaggactacttcagtcccgctttgctgccatcagacgctgctggactcgcacggggagcgcagagcgtttaatgctgggacatcagacagaacagggaactgatgaaagcttcagaatgaacattgagtccacgcaaatctgatgctgccaaacttcagagaacctgggtctcctggtccacacggagatcagacgagggggacactgagtgcctggcagcccttccactaggcggtcccccgggatgaggcgaggccccaccctccagctccaccatccagtccagcaccgtccttggccgcgggcactgctgtccttgcctgcggaccgagcgcccagctcttcaatacagcacctggtcctcgctttcaggagaggatgcgtggagacaggcgaggtggacgtgccaataagtgacccaaacagtgccaagctcggcggcagatggcgcagccgccggtttccaggacagttgtaatccttggccctcattcggcctcttcccgtcactcacatggcgcggctttcctggcctcggcggtgtggacggggggccttggccatggttgcaggaccccagctccagctcaggtcagcgtctcatcccaggtgagctaatgaagatctgcaaagccaccagagttgctgaggagagaagaggtgtttgtggcacttcagcgtgggcgcaaaacagagggagcattgcaggacgtgcatcagacgctgggcccggggacctgtgaggccaccatgtcagcctctctgagacggtggcagtcgaggcccgtggcggggctggggctggtccacaatcagcttgacaaagtaaggtggtggcggccagccaggcccagggcccctgggtgtcagcaggtgagcaggtcaggcgggcatggcccggtgctgcaacacctctccagcgcctcggtgcctcccctccccaagggctggggcgaaccaggcttggcttggacctgtgctcagctgcactggggcctctcgggcagcaggctggacacccagctctcaggaggggtgtgggcttgtctgcaatgcaagaacaggagccaaaagccaaccttcttttacaccagattcacctgtggtcattcttctgaccttgcccaatgcgctcagggatgacaggtggacagtgagccacccccgagggcggtggcgcctccagtgtcccctgtcagacttggctcctcagatgctggtttattccttgacaccggatggggaaaatattctgagatactatgtccagcgtgcccacaggacctcccctcacggctggtgggaacaatgcaccctccaatgggcacctggggagggtctctggccagcagcatctccagatggaagtggaggggaagggagccccagggcctggaggaggaaatcctcatggccaagggggcgtgagggaagggggcggtcactgcagtcatcagtgggtagggattcctgatgctccatccttacttaaaatttttctcttaattaatattaaattatcctgattatgctgggtcttgttttaatttttgcctaggagtctccttggactgattttttttttctttttgagacagagtctcgctctattgcccaggctggagtgcagtggcgcaatctcagctcatataacctccgcctcctgggttcaagcgattctcctgcctcagcctcctgagtagctgggattacaggtgcctgccaccacgcctggctaatttttttttttttttttagtagagacggggtttcactgtgttgcccaggctggtctcgaactcctgaacccaggcaatccacctgccccggcctcccaaagtgctgggattacaggcgtgagccactgcgcccggcctgaatttttttttttttttttttttacattcacccagtgtgcccctgctgagccttgcttaacgtttctgtcactttatgtgggttgccattcagaaatacatgtagttggatttcattttttatctaattggagccttaatgcatctgtttaatgtgcactgttttgaccaacatatgtgatctaacctctgtcatctttgttgttgcctttttaaacgctttcttgctgtttcatttattttaacttaatgtagggaccacattttctctttaaaacctctgcagtgctttggaatgtgcgtgctctttgaaaacatgatgtaagctctacttgccagagttgaaaatgatgcagtgtatttccagtccttgccaacacacttccaggacttctgcacactttatactcttccgactcctctcccatcttttggtctttgtaatttttgagacagggtctcgctctgtcgcccaggctggagtgcagtggagcgatcacagctcactgcagcctcaacatcccgggctcaagtgagccttctaccttagcctcctgaataactgggactataggtgtgtaccaccacacttggctaatttttttttttttaagacagggtcccaccatgtttcccaggctaggaagagaattcaaataataagtataaagaagtgatatgagaaaatcactgggaaaattgagatactgcattgttttgaaatcattcatcacttcatttatgaatatttttggccgggcgcagtggcttatgcctgtaatcccagcactttgggaggctgaggcaggtggatcacgaggtcaggagttcaagaccagcctggccaacatggtgaaaccctgttctctactaaaaacacaaaagttagccgggtgtggtggtgggcgcctgtaatcccagctactctggagactgaggcaggagaattgcttgaacccgggaggcggaagttgcagtgagccgagactgcaccactgcactccagcctgggtgacagagtgagactctgtctcaaaaaaaaaaaaaaaaaaaaaaatttcacggagaatgccttcagatccacttgtaaatttaagagacactgcaaagttgctagtgctgttgatttattaggactagtgagtgcagtcagtgagctgaggtctcaggctggtgagaaaaaccagcctccaaggtgaatataacttaaatagctcaacataaacattgtaacaaatataatttcccttaacaggcgtttatattctcaaggacagacaacaaaagatctttgaatgggtggatagttcagggaagtttttgtttattttgcagacatttagacagaaagtcaactttttgatgatgagatatggaatcagtagagacctaagtccaagttacagagttggaagtggtgtgtaaatgtctgcaacttccccacccgttgtaacaagagcctgggcagaagccaggtttgcagtggcaaacactgtatcaacagcctctcacggtgcttctccaagtgccgctgagatttatgacctgtgaaacctgttacaattgcagctgagactgaacaagatactgtggaacttacaataacggacttcttaagctgccccactcagaggtgtgtgtcttatgtttctgagtaagtgccacacggggtcatctcagatgccacgtgttaacctcctgtaagggctccagagcattcggtgcttacaaacctgcccccatgcccctccgtggctgtatgtaaatactgcttagcgctgagccctgcagtgcactgcgattacacttcttataaagtcttttctttgttctgtagttctttttttttttttttttttgagacggagtcttgctctgtcacccaggctggagtgcggtggcacaatctcggctcactgaaagctccacctcctgggttcaagcaattctcctgcctcggcctctcgagtagctgggattacaggcacctgccaccatgactggctaatttttgtatttttagtagagacggggtttcaccatgttggccaggctggtcttgaactcctgacctcagatgatccacccgcctcagcctcccaaagtgctgggattacaggcgtgagccaccacgcctgaccccttatttttatcttctaacacttcaactgaatttttaatttctgcatttatatttttaatttccaagagctcttttctgttttctaaatgttcgttctctttacaagttttcctctgttctctgtgttgtctctgagctctgttttgggagcccccagataaactggggttccagtgtgtgagagctggcagtcttgccctaatgggaaatgaatggggctagacctggtgcctttcatggaatccttctttcacctggtggacggcttgaacgctagttacccgacccatggccggggcccctcacacacgacacttgttcatactggcagatgcccggtggtttgtgtctgctccatgtacaggctctgcctgcctggccatcactctggcacagggactccaaccttgtgttcctcccggactcctggggaaaacctggcctggggtagcccctggttcttcagatttaaggcacagatttaatccaccactgcaataggaaacaagttcgaagatttttgctacagatcctggcagagaggatgctgtgagtcgcgggggccatcctccatctccgggtcgcatgaggcaggaatgaagagtcagggagagggccgggcgtggtggctcatgcctgaaatcccaacactgtgggaggccaaggcaggtgaatcacctgaggtcaggagttcaagatcagcctggccaacatggtgaaacccggtctccactaaaaatacaaaaattagctgggcgtggtggcaggcacctgtagtccaagctgctcaggagggtgaggcaggagaatcacttgaacccaggaggcagaggttgcagtgagctgagattgcgctactgcactccagcctggcaacagagcgagactccgtcttaaaaaaaaaaaatcaggcagagtggggacagctagcatgattataagaggaagtggagtgtgggtcccttgtatttgcaggcagatacctgtatggtcctttcagagcaagtggtgggaaaagcaggggttccacctgctggacgggagagaggcctctgagttcacatgtctggccgccggcttgggtcgcccaggtgtggctctgcctccgatgcccaggcagtggtctttgctgtgtcattttgttacaagctccttttccgtccatttagcttgcagctttctttgtgtcagagactttccctggatgcacatttatgtttcagcgagtcaggaaaagctgttggaagtcttctgtgtgtgtgtgggaattctgggcttacctgtagggcaaacgtggcgagctggcttttatgcttgggaatccgcacaggtcaggccctttaggtcttttggggagtgtggctccatctccccagaaatggattctgtgtggctggatggtggatctatgagcagggcagtggactgggcttgagtgagggctctgtagggtgcagatattccatgaactctctgttttcaaggaatcacttctgccctttaggattggtgcctgaggattggtctgagtctgggggtctctggttcagtttctccaaggaaatgatttcttgatatctcattgccacgtgggtggtgggcccagtgccctttatacagacctttcaccatccctcatgtctgccccactcgcctgacagcagggcctccagtcccagagtcttcctggggttctgcccggctggtcagcttctcagcagcatctccctctgcagagcccatccgtgcacctgctttccatcgtccccaatctgataccgatttacctggcctctcctctcttgttgtgttattcttgtgaaattatactattcactttctctttttttttttttttttttgagacagagtctagctcagccacccaggcaggagtgcagtggtacaatcttggctcactgcaacctccggctcccaggttcaagcaattctcctgcctcaccctcccaagtagctgggactacaggcatctgccaccacacccagctaatttttgcatttttagtagagacggggtttcaccatgttggccaggctggtcttgatctcttaacctcatgatctgcctgcctcggcctcccaaagtcctgggattacaggtgtgagccaccgctcccagcctgttcagtttctttactcccatcttagtggggttgtggaaaggcacgtcaataagcatatatgttcaatccatcatgtttaaacaaaactcagtacactatcatttgtaagggtgcctggcattaggacggccagcgttaggacattaggatagccagcattagagcaggcagcgttaggacaccgggcgttagcattaggatgctcagtgttaggacacccagcgttaggacacgcagcgttaggatgcccagcattaggaacgtgctgggattacaggcgtgagccaccgtgcctggcccctaagtatattcttgagttttgctcttgatatggtcaagtcacttagaaagagtttggtcctttcctctcttattttggaactttgctaggtgggattcgagcggtattctgtctgaagataatttccccacactcaagcccataccctttttattactctgatggacgccctttgatttatgactttttcttctctgtctgttgggaacactctcattaaaaagcagaattgtcagattggataaaaaatcaagatccagttctgtgctacatacaagaaacccactttaaatataaaaagactctgctgggtgcggtggctcctgcctgtaatcccagcactttgggaggctgaggcaactgaatcacctgaggtgaggagatcaagaccatcctggacaacatggtgatacccctgtctctactaaaaatacaaaaatttagcggggcgtggtggcgggcgcctgtagtcccagctactcgggaggctgaggcaggagaatcatgtgaacccaggaggcagaggttgcagtgagctgagatcgcaccactgcactccaacctgggtgacagagcaagactctgtctcaaataaataaataaatatataaagactctagtcaggtaaaagtgaaaagatagggaaaaaataagaagaaaacttgagtggctatattaatataagaccaaggagatttcagtgcaagaaatattgccagggatgaaggaagtcatttcctggtgattaagaggtcagctaatcaagaggacatcatggtctcaactgcttctacacccgacagctgagttccaacatacgtcagcaaagacagaaggaggtcacaggagaaacatacaaacccactgtttgagctggagatactcaactcaaaggacagagaagcaggaaggacagacaggacttgagcagcacagccagccaggctgacctgcttgatgttcacagacgctctgagcagcaacagcagagtagtccttcttcttttcaggcacacatggagcatttgccaagacacaccatattcgaggccctgaaacaagtctcagtgcacgtgaaagggttcaagtcatgcaaatatattctccaactacaatgaaatgcaatgagaaataaagacagaaaggtatctagaaaatctcccaaatagttggaaactaaacaacacacttctaaatagcccacgagccaaggaagaaatcaaagtggaaattagaggctgggtgcagtggctcatgtctgtaatcccaacactttgcgaggctaaggaggaaggattgcctgaggccaggagttccaggccagcttgggcaacagagcaagatcccatctctatgaaaaataaaaaaaaaattggctgggcacagtggtatgcacctgtagcactagctgattggaggccaaggtgggaagatcacttgagctcagcagtttgaggccagcctggacaacctgggcaatgtagggagatcccatctctataaaaaatttaaaaattagctgggcatggcagtgtgcccttgttgtctgaactacttgggaggcagaggtgggaggatcacttaagcccaagagttcaaggctgcagtgagccatgatctcaccactgcattccagcctgggtgacagagcaaggtcccacctcttataaaaaagggaaattagaggctgggcgtggtggcttacacctgtaatcccagcactttgggaggctgaggcgggcggatcacctgagctcaggagttcgagaccatcctggccaacatggtgaaaacctgcctctactaagaatacaaaaattagccaggtgtggtggcgggcacctgtaatcccagctactcgggaggctggggcagaagaatcacttgaacccaggaggtggaggttgcagtgagccaagaccacgccattgcactccagcctgggcaacaagagtgaaattccatctcgaaaaaaaaaaaagaaaaagaaaaaagaaaatgtgcaaaagatttgaatagatattcccccaaagaagatacgggaattaaaggaatgattattaaggatatatgaagatgttcggcagtgctggtcacggggacacaccacagcgagatgctgccacacccactagggtgaccagagtcaacagagccactcacgcatgtggagaaacccacgccctcatgctctccagtgggagcttaaaatggcacaaccgcactggaaaacagcttggctgtttcttaaaaagcaaaatagaaatttaatacacagctgagcaattctgctcctagacgttgacccaagagaaatgaaagcgcagacccaaggccgggcgtggtggctcacgcctgtaatcccagcactttgggaggccgaggcgggtggatcacgaggtcaggagatcgagaccatcctggctaacatggtgaaaccccgtctctactaaaaatacaaaaaattagccgggcgtggttgcaggcgcctgtaatcccagctacttgggaggctgaggcaggagaatggtgtgagcccaggaggcggagcttgcagtgagctgagatcatgccactgcactccagcctgggcaacgaagcgagactccatctcaaaaaaaaaaaaaaaaaaaaagaaagtgcagatccacacagacgtgtgcaggaacaacccacggttcacacacaggtgggcgggtgaaggagccgtgtgcatccacaccgtggggtcctgctcagcatggagaggggtgagctgctggtgtgatggggtgtcccagaaagcagcgaactcagtaaccgggccagtccccccgcctgctgcagataccacgtattgtgtgtgcccctttatataaagttctagagaaagcccataatccatagtgacaggaagtaggtcagtggctggagtggtgggtgggaggggccacacaggccaccatgaaacccgagggctggacgtgtccactgtcttgattgtggtgatggcttcatacacatatacatgcgtcaaaacagacttagggtatgtcagttacctccataaagctgtttaaaagttgggttctgagagttacggaggacgcctacctttgtgatggtcatgaagtggtcacacatgtggcccccacggcctgaggtcccccccaccccctcaggccatgtgtccgtgttcaaggctgagtgagggcagcaggcagggcagaggctcagcagccacagggcccgtttccttgagggcacgaggcagggcagaggctcagcagccacagggcccgtttcagtaagggcgtgagacagggcagaggcttggcagccatagggcccctttctgggggagaatgagaagctttggccgggccccaccccgtgcactcctgccctacccaaggctgaaggggccttggggagtcatcaccgttccactgtctataggcgaggacgtggggtggcgagagccacccgccagccctgagaatagcaaccgcaagatacggttcacagcgtgaggagcataatcgtgtttgaatattgaaccatcctcactttgctaaaatgagccccactgagtactcactgtgtttcccatggaacgccagactctcctcccgctctggcccagcgttcagcactgacattctcgctggagcccggcctgccgcccgcgcactcgcgcgctctctatctctatcgctatctctccaccaatttttggcattgctcttatgttaatttcacaaaaataacccagaggatttccttctttttctccgttccaagaacattctaaatatcattggaattatctgtttcttgaatgtttgaaagaatccatctgtgaattcttagacatcgttctcagattttttacaacgggttttaaagacaatccatttcattcaagtttttaagtgtattaggaaagtgtgtgtaaaatattatttgaccatcttatttcctgtctgggtgtggctagttctcaatcgtttcccctcgttttgtgtgtcccaggcttctttctgtcttctcactctgagcagctgcctgatgcctgttttatgggaggttcaagacccacctcctgaaccgctgactcttttgacatttgtctttctggacggattcgttttgccgttagctttgcaaactcctttcctctgcctgccttggtttgtttggttgctttttctgtggcaattggagtgaggtgttttttgctgtgtatgcctgggcttgccgggagcgtgagcgtttcagggaatgaacagcatgggccacccctgacatgccgctggattgaggcctcgatacatccagttcctggagatgtggtaaccgtggttttaatattttccaactcgtttgttgttagagagatgttacatttacaagggcccaggaggaggatttttatttatttttatttatttatttatttatgtatttattgagccagggtctcagctcactgcaacctccacctcccagactcaagaaattctctcgcctcagcctcccaggtagctgagacaacaggtgtgtgccactatgcctggcgaatttttcataatttttttgtggagacagggttttgccatgttacccagactgatcttgagctcctgggctcaagcgatccagccacctcaccctcccaagtgctgggatgacaggtgtgaccgccgcacccagccaaggattttttattcctggttgtgctgcacctgtgccatgactctgagccaaagcatgcagccttatttctgctctggaaaacatattgagattaatatatcaagaaagacaaatgtcaacagaggtggcctaacatttttttgacaggtgagattataaatcatttaaaatttatgcttctctgttttaaaaaaaatttaaggccaggcaaggtggctcacgcctgtaatttcagtactttgggaggccgaggacggcggatcacctgaggtcaggagtttgagaccagcctgaccaacatggtgaaaaccccatctctactaaaaataataataaaaaaaaattggccgggcatggtggcacctgcccgtaatctcagctacttgggaggctgaggcaggagaatctcttgaacccaggaggcagaggttgcagtgagccgagattgtgccactgcactccagccagggcaacaaagaatgaaactccatctcaaaaaaaaaaaaaattaagttccgggatacatgtgcaggatgtgtaggtttgttacataggtagtaaacgtgtaccatgatggtttgctgcacctgccagcctatcacctaggtattaagcccagcatgcattagctatttttcttgatgctctctcttcccctgctccataggccccagtgtgtgtttttcccctccctgtgtccatgtgttctcaatgttcaactcccacttacgagtgagaacatgcggtgtttggttttctgttcctgtgttagtttgctgaagataatggcttccagccccattcctatccctgcaaaggacatgatctcattcttttttatggctgtgtagtattccatgttgtatatgtaccacattttctttatccagtctatcatcgatgggcatttgggttgattccctatctttgctattgtgaataatgctgcaatgaacatacacgtacatatatcttaaaatagaatgatttatattcctttgggtatatacccagtaatgggattgctgagtcaaatggtatttctggttctaggtctctgaggaatcgccacagtcttccacggtggttgaactaatttacactcccatcaacagtataaaagtgttcctatttctctgcaaccttcccagcatctgttgtttcttgactttttaatcttaatcaccatactgactggtatgagatggtatctcattgtagttttgatttgcatttctctagtgatcagtgatgttgagctttttttcacaggtttgttggctgcataaatgtctttcgtttgggttccttgtagattctggacattagacctttgtcagatggatagattgagaaatgtttctccaattctgtaggttgtctgctcactctgatgatagtttcttttgctatgcagaagctctttaattagctcccacttgtcaatttttgctttattacaattgcttttgatgttttcatcatgaaattctcaaccttgcctatgtcctgaatggtattgcctagattttcttctagggtttttatacttttgggttttacatttaaatctttaattcaccttgagttaatttttatataaggtgtaaggaaggggtccagtttccattttcttcagatggctagccagttctcccagcaccatttattaaatagggaatcctttcctcattgtttttgtcaggtttgttgaaaatcagatgattgtaggtgtgcaggcttatttctgagttctctattctgttccattggtctacgtgtctgtttttgtacctgtaccatgctgttttggttactgtagtcttgtagtatagtttgaagtcaggtatatgcttctcttttttgtggtaaaatatatagcataaaatttaccatttaaattatgttaagtgcacaattcagtggcattaagtacatcacaatgttgtgcaactaacacctctatttccagaacttttcatcatttccaactgaaactctgtctacactaaacactcactccccactctccttcccccagcccctcgcacccaccactttacttcctgtctcaatgaatttggctactctagggacctcatctaagtggaatcttacagtatttgtctttttgtgtctggcttatttcatttagcatagtgtcctcaaggttcatccatgttgcagtttgtgttggaacttaattcctttttaaggctgcataatattccattctgtctacaccacattgtgcttgtccattcatctgctgatggacaccctgggttgtttctccctcttggttattgtggttaatgctgctatgaacaggggtatggaggtatctgtgagagactctgctttcagttcttgtgggtctatacccagaaatggaatcgctagatcatatggcaattctatgtttaattttttgaggaacagccagactgtttccacagcagctgtgctgtttctcattcccaacaacaaggcacagggttccagtttcttcacattgttgccaacacttgtgatttcctggtttttgataacagccgtctgagtgggtgtgagccggtatctcattgtggtgcagactgacacctggcccttgtaagcattccatgagagcttcaaaggaacacctgttaggtttttcagggtttgggttcggtgtgaacctcgtgtgtaaccctccgatcctccttctatctttagataatcctaacaacaggggtatattcatacatgattgtttttcctttttgccttccaaacatgggctctgcggcgcgtttgtctgcctgtggctctccggctgcagcgcccacagcagcccctccctcccgctccaggccccgggcttccctgtgtggatgtgcgatgggcgtatggccacacgcccaagatatcaccttgtctccagccacacgccagggccgctgccgagacagacggtgcgcgagcgtgcgtgggcacgtttctccacagaggagcacccgccctagccggccgccgcgcaggagtgggacgccgggtgaactccgcacgtgctcgcggcgacgcactgcgttccaaaatggctgccgcctgcgttccaaaatggctgccgccgcccacctttcccgtggaggctgagcacgtcgctccccacgcttgccggcctccaggctgacgaccgccagagccgtctctgggactctgcaggcacttcccgagcccccgcaaggtgcgttttcacttctttgtgacacttgggttgagtctcctctgacatcaattctgccatatgaaccttaattttatccaaagccccaaaaagaacaaaagcgttggagtttaagctgaaggtgcgatccggattacatacaattgcacattattgttgatgcggctgacgtcattatgatattaagcctgcccaccaagaatctggcatgtctttccaaaaccgtacgatttaaatccatgatttttttctgatataggttctatagacttcccttttatttctaagtaggttatattttcgtacttattgtgtgttttcctcattattgtaagtggaacgtcattcctgttcctgtttctagcttgttcttgacagtgtgggggaaaactattaattcggaagtatggatattgtatttagccatgctgccacatcccatgatgtgttctggtaggtttttactgcactgtcttgagtttctcagagataggatcgtgtcatcaggaagagaggtgggagagacggagaaagagataattggctgtcttcttttataactcttattaccatcctgtgttgacgggaatacgttcgtggctgtgggactgtcatggaatctcccttcacaagcctagatgatgcagcctcctgcacgcccaggccgtgtggtgcaaccattgttccccggctgcaaacctgcacaacacacatctcactgaacaccgcagtagcggcagcaccagggtgaggctgtgcacctaagcatagaaaaggcaccgtgaggccaggcgtggtggctcacgcctgtaatctcagcactttgggatgccaaggtgggtggatcatttgaggtcaggagtttgagaacagcttggccaaacatggtgaaaccccatctctgctaaaaatgcaaaaattagccaggcgtggtggcacacgcctgtaatcccagctacttgagaggctgaggcacaagaatggcttgaacccaggagtggaggttgcagcgagccaagatcacgccattgcactccagtctggacaacaggtctcaagagaaagaaagaaggccgggcgcggtggctcacgcctgtaatcccagcgctttgagaggccgaggcgggcagatcacgaggtcaggagatcgagaccacggtgaaaccccgtctctactaaaaaaaaaaaatacaaaaaattagccgggcgcggtggcggacgcctgcagtcccagctactccagaggctgaggcgggagaatggcgtgaacctgggaggcggagcttgcagtgacccgagatggcgccactgtacaccagcctgggcgacagagcgagattccgtctcaaaaaaaaaaggaaagaaaaggcaccgtgagaattcggtgctgtcgccttccagggcactgtcgtacatgcggcctgctgttgactgaaacggccttatgtggcacatgactgtgtcttatcttttcatgcgcttcactggacccttcgaaacagcgcagaatcgcagcggcagctgtgtgtcatgccctcggtcttactgcaggcagatttactgtttaccattgtccattttctgcttttctcttcattaattatctcttcctgtcttatttgggattattttgttttgtttcttttaaatttcttaagatggcaatgaagttcctatactttctgctcttccttaaaatgaaggactatgaatttcctcccaaaaaaagttttagccctggaccctaagttcagacgcctagtgtttatctttcatgctttctggaattttttttttttttttttgagacagagtctcactctaatgctcaggctggagtacagtggcgcagtctcggctcaccgcaacatctgcctcccgagttcaagcaattctcctgcctcagcctcctgagtagctggaattacagacatgtgccatcaagcccagctaatttttgtatcttttttagtagagatggggtttcacgatgttggccaggctggtctcaaactcctgaccttttgatcctcccaccttggcctcccaaagtgctgggattacaggtgtgagccaccacgcccagctgctttctggaatttttacactttcagtttttatttcctcttcagttgaagggttacttacgtccttgtttctaatatttgggcttccatacttagtgatttggtcatgtttttagtatttgtaacttgattagattatgatcagggaaaatggcctgtaatatctctagcttttaatttgttagggcttctgatcaatttgatagtggtgcaatttattttcaataaccattgccctcttaagggtacactccaatgagtttcaccatcaccgtggttaagtctgcctggccccaggcaatctacattttctttctgtcactgtagattagtttgcacccaaatgtacatacatgaaattaaataatttgtatctggccttttacactcagcataaagactttgagattctcccgtgttgtttggtgtatcagcaattcatctgtctctgttgctaagtgatgctacctgtgtggacataccacagtttgtctattcacctgttgatggacatttgagttgctttctggttttggctgttacaaatgaaactaccatgaacattcctgttcctgccattgtgtgaacttaagtgtttgtttctcttgggtaaacacctaggagtggaatttctgggtcatttggtggcatgttcagttgtacaggaaaatgctcaactgttggcaaagtggttgtagcatttaccttcccacaagtatgcatgagtgttccagttcctccaccagtgttccttgccaacacttagcacagtcagtctttttaatttcagacatttgagtaggaatgtggtggtatctctgtgtgatttaagtttgaattcccttatgactgacacgtcgatcaactttatttgtaacagccacgtgtgtcttttcgtgcagtcatgcatcatgtaacgaaagggacaagttctgaggactgtgtcattaggtgactttgttgctgtgcgaacatcaaagagtgcactgttgcacacccagatggagcaaccctgcacgcccaggctgttgggggtagcctggtgctcccgggcacaaccctgcacagcacgtgactgcctgaatggcacggaagttgtaacacagtggtgagtatttgcgtacctaagcacatctaaacatagaaaaggtaccacgtggtacaccttacaatggctgcgacatcatgttgctttacatggtccatgactatacttagttgccatctgtttctcttctttggtgaaatgtcttttgtccactttaaaaatcaggttgtttgtgttcctgttattgagttgtaagagttttttgtgtattctgaatataagacttttttttttcttttgagacagagtctcgctctgtcacccagactggagtgcagtggcccgatctcggctcactgcaacctccacctcccaggttcaagcaattctcctgcctcagcctccctagtagctgggactgcaggcacgtgccaccacgcctgcctaatttttgcattttttttttttttagtagagatggggtttcaccatgttagccaggctattctcaatctcctgacctcgtgatctgcccgcctcgacttcccaaagtgctgggattacaggtgtgagccactgcgtccggccaaccttttgtttttttgagacagagtcttgccttgtcgcccaggctagagtgcagtggcacgatcttggctcactgcaacctccacctccagggttcaaataattctcctgcctcagcctctcaagtagctgggattacgggtgcccgtcaccatgtctggctaatatatatatatatatatacatatatatacacacacacacacatatatttatatatacatacgtgtgtgtatgtatatacacatatatgtgtctgtgtgtgtatatgtgtgtgtatatatatatatatatatatttttttttttagtagagacggggtttccccattttgcccaggctggtctcgaactcctgacctcaagtcatctgcccgccttggcctcccaaagtgctgggattacggttgcccgtcaccatgtctggctaatatatatatatatacatatatatacacacacacacacatatatttatatatacatacatgtgtgtgtatgtatatacacatatatgtgtctgtgtgtgtatatgtgtgtgtatatatatatatattttttagtagagatgggatttccccattttgcccaggctggtctcgaactcctgacctcaattcatctgcccgccttggcctcccaaagtgctgggattacaggcgtgagccactgcgcccggcctaagatctttatcagatgtgtggtttgcaaatatattctctcagcctgtggtgtaccttttcattttttaagacagtgtcttttgaagatgttaagaaaaactcaaactgtttttccctttgccctcactccacaaggataatcaacacagaagatgtctgtgaccaaatgtatgaaggttttccccacccaccaagcaagcagtcagtccggcagtggacaacagcagggtgttctccaattcaattccattctgatgctgtctacctggagacagcctcagaaaccccacgttgagggctcagtcccacaaggctgccccctccatcccaccagtcgcaagtccaggaccctagaatgtctgaacgaccggcttcgagttggggttcatgcgacccctcttgggtttaattcctagagcaactcacagaattcagggaaacatatgcctatggtttattacagaggatctttttattttttattttttgagacggagcctgcctctgtcgctcaggctaaagtacaatggtgcaatctcggctcactgcaacctctgcctcctgggttcaagcaattcttgtgcctcagcctactgagtagctgggattacaggcacatgccaccatgcctggataatttttgtatttttagtagagacggggtttcaccatgttgactgggctggtctcgaactccagacctcaggtgatccgcccatctcggcctcccaaagtgctgggattacaggtgtgagccaccatgcccagcctacagaggatattttcaaggatacacatagccagatgaagagacacatggccaggcctgaagggtcccaaggataggagcttccaccctgtggagttggggtgccacccttctgaggagcttccaccccgtggagctggggtgctaccctcctggcacgtggatgagttcttcgccttccttccagcctccatgtgcccagctctctggaagctcctgaaccccgcctcttgaggagactccatcggataggcatggtggaagaagcatggacgtccccgtagaaatgcgaccgatgaaaagggtgtgatctaaacccagcaaggcctgtccagattcctcttggcctctctctgtagcgttccttcctccagggcacggggcagggccccttctgaaatgagggcttatgactcaccaacaggaagtcaggggaagatttgagtcctgccctgcacaggtgaaaagagggcagaaggtcagagagaggggttctgtttcctgattctaaagggccccaacattataacaagggccatgggagtgagaggcaggagccatagatgaaaacatatatatatatctcataatatcgcagaagagcaaaaatgtttaatgttgatgaaattcagtttatcaatttttctttttaagatttatgcttttgtcacttatataagaaatctttgcttaagccaaagtcccagaaattttctcttctgttttcttctagaagttgtataatttcagctttgacatttagatctatgattgattgtgagttcatttttatataaagtgtcaggtaaaggaaaacatttacatatgtgtttattttgcacatggatattgaattgagccagtgcgcttctgaaagcactatctggccgggcacagtggctcacgcctgcaatcccagcacttcgggaggctgaggcaggcaaatcacttgagcccaggagttcgagaccaacctgggcaacatagtgagaccttgtctctacaaaaaatgtttttaaaaaattagctgggcatggtggcacatgggaggctgaggtgggaggatcagttgagcccaggaagttgagactgcagtgagctatgattgagcctctgcattgcagcctgggcaacggagcaagaccctgtctaagaaaagaaaacagaagtaaggactatcctcaccctcattgaattccctctgcagctctgtcaaaaatcgattgacaatatatgtatgggtctatttctggactttctatactttccattgatctagatgtctgttcttttttttttttttttttttttgagacggagtctcactgtcacccaggctggagttcagtggtgccatctcggctcactgcaacctccacctcttgggttcaagtgattctcctgactcagcctctcaagtagctgggattacaggcacacgccaccacacccagctaatttttgcatttttagtagaaacggggtttcaccatgtccatcaggcttgtcttgaactcctgagctcaggtgatccacccacctcggcctcccaaagtactggaattacaggcgtgagccactgtgcctggcctatatgtctgttcttttgtttataccatagtgccttgattatagtaagtctttttgtttttttgagacggagtctcgctctgttgcccaggctggagtccagtggcgcgatcttggctcactgcaagctccgcctcccgggttcacaccattctgcctcagcctcccgagtagctgggactacaggcgcccgccaccatgcccggctacttttttgtatttttagtagagacggggtctcattgtgttagccaggatggtctcgatctcctgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacgcctgtaatcccagcactttgggaggccgaggcgggtggatcaggaggtcaagagttcgagaacagcctgaccaacacggtgaaaccccgtctctattaaaaatacaaatattagttaggcatggtggcagacgcctgtaatcctggctacttgggaggctgaggcaggagaataacttgaacccgtgaggtggaggttgcagtgagctgagatcctgccactgcactctagcttgggcgacagagctagactatttgctgagcacctgctgtgtggcaggctctgctctaggtgccagggctgcagctccgagctgactgcctgctcccatggggctttctgttagcagactggcaatcagaagcaaacaaacaacagatggcaccatttcaggtaatggacaactacaaagggaaatacagctggtgacgggccagagagtggcaaggactgtgtttttctttgcctacatttatttgggattcatgtttagttctacaatcaataagaatgtgtctgtgtgttgtgcaggggtccagttttattctttcccattaagtatcctgtcccatctggggatactgcattctttctccagggtcctgagcctccacctctgtctctggtcccacgtgggggtcctgtgtctgtgggggtctggggatgggctccccactctgggcccgttgtctgtcttcctcccactgcaccatcatcattctgtcttggtatctggtggacctcactctcctctttttccttcaggtgtctgtcctggcaaatgggccttttgcaggtctgtatgcaacactcagcttgtcagatttcacagaattttcttcttaattcttcggagtttggggaggatggacgtctttacgtgtggagttaccctggccagaaaaataacaagtgtctttctttatttagatattgtttaatttttcattcaattctataattttccccgtagttttatttcaagttaaaaagcatttttccattcttaaaaattaacattgggctgggtgcagtggctcatgcctgtaatcccagcactttaggaggccgaggcaggcggatcaggcagtcaggagttcgagaccaccctggccaatacggtgaaacccgtctctactgaaaatacaaaaattagccaggcgtggtggcgcgtgcctgtagtcccaggtactcaggaggcggaggcaagggaattgcgtgaacccgggaggcggatctggaaaagtggtgaggcccacatgaagtcttcagtggggtggtcgctggtaccatgtccaggtctcagctttgacgaacactcggtggctgcaatgtcagcgtctagggagccctcttatacaatctttgtgactcttccgtaaatctacaattatttcaaaatgaagctttaaaaatcaactttaatggatgtagtatttacatatacattatgtataacgtatactaaattgaatgcagccattgtcattgtacttaccgtgtaagggaaccctgggcagggttttgacctcaggggcggctgctctgtataagcagatccccccagaaactgcctgggcgtctcgggagcgtgggtgccactccagcaaaggtctgggaggtgggttcccgggaagagcctcagggctggaaacgcgcggccctgaccccaccctccccgatgtctgcagaggaaacgtctctgcttctgccccttctgctaccgggaggtggggtgggcggtggagtctcagcagggccagagggcagggaggcgccgcgatctgcaccccccccccaccccctctccacccggtttggggcgagctcccgggtgggaagggcccctcccgctgggactgaactccctccccagagggtttatccgcctgtgccgctgtggggggcgttgccagccccgtcattgccgcggggtcgtgcccggtgcgcccccccaccgcctccacctctcacggggggaagctgaggctcagagaacgaggtaggggtggggtcggcccctgtacgtcgaggccagtagcggaccccagccagactgcgggacccccagcctcggatccgacccccctgcaatcagagtcggggtgtcccagcctcaggcaccacgtgggaccgccccgcgccgcagcggcctcctctggaaacgggggcgggggtgggtcgcagcgccgccctcctgcggatgcgggatgcagctcatgcttccagggtccggcggggtcgcggggtgtcgaggtcgaggccggcggggtcgcagcagtgctcggggccgcccgttctgcgccggtctcgccgctccggcgtctgtgccgggagagcaaatggcactttgggtttctgtgccaggaacaagcttcccgcagtttctgttgcgctcctggctgcgcccaattcccagcttttggaagtggttctggaggcgcctccctgcagtacccgggccgaaaagcgggggggcgtgggcggcatctgtgacgctccccaggttcgcggcgggtccctctgagcctagtggctttgcagcctgcggggagcacgaatcctcggctccttagaggtgggccttccagaagcctttggcgcctggaccagcccagggctcaagtggggcctccacactctcagagcgggagggccccccacaggcacccctggagcagagcgcagcacacctggtgctctataaatgccggctcccgcgaccagacccagagcctatgggatcagctggaggggagggaaggggcagcccactgagctgcagaagccctgcagctccccacccctgccaggaaccccttccatcaggagagcaatgtggggagagaccaggctcacccacctccttatagacgccagtcctttccaggagggagaaagagccacgggtcactcactttagggtgaattagcttttctcatgggggttaagatttgcacaaaggcagtcaggactgtgggggctgtccttgcctcccccacacacctgctagagacagcccgctggaggcagagagattttggtccaatgactggggactgttagaagaatccaggagcaactctactgtgacccagtttcccttgagtcatgggcctaaaatctgctttgcaaaacatggcagatgcggctgaaaactgaccacaagcctcttagctttctgttgaggagtccagatctgtgctatcagccaagtgcctagcataggctgcctgcctgtccccagcagcgacgagggcagcaagaggggctcgttctccccacaccccactgcctgtgatagcttcagacagccaggatatggggggcagggaaacaggtgcagtcggcggcgcctgcaggatgcaggcatggccctgtctgagtgacaccttcagcccagagcactcaaccaaaaagctattctcctcccaccaacagctcgggccttccaaatgacagctcctgcccaccctcgacagggagctcactcctgagtgactggcagaggcagcactggcacagatagctacaggcgagggcgtcgccccaggctccgtatagcacggagcttcccggtatcagcatagtaatggcgagggggaacccagagcgccagggacatggagctgctgaatccacagaaacgaggtggggggcacacctggacccaggtggaaagtggctgggtggtgttagtctaacccacaatttcacctgacatctctacccgaggcatgggctcagctggtcgggggcagtccttaggaggtctggcatccagggggcagagcccagaggcaagaccttcaaggagggggcagagccagtgcctcaccactgaggagcacctcgagagggggccgggtggccgcggggggagagcggcatttgcaggggcaacgtgtggccggagtcccctcacacacacgaggctggtccaggagcacccctgcaacgctgagggctataagtggccatggaggagcctggccgctctgccaagtcacctccctcagtgacacctgtgtgctgggtccagccagcttgctctgctctctggagctgccgagggccagggctccccgcagtgcctgctgtattcagagcccgtaattatgcatatctgtcctgtgggctgagttgcagagctgtttagggaggtgtttgtggggcctgtgaatcagcagctcatgagaaaagtagtgactagcaccgcagagcaattagggcctgggtgccagtaacaagcggtcccctgcagccccagcagggcccctgccaacccccatgccagctcctgccccagcagggcccctgccagcccccatgccagcttctgccccaggggtcagacttggtgaccttgcctctgacagccagccctgcccctcaacccactgcctgcatagatggctgaaccgcaccacctccaggaggccaggcctctgctggacacatgaccagagaagacgcttcaacccctggaagctcacacacaactgcacgcgcaaccacaagacgacaagcctgatcacacaaccgcatgcagtcaaccacacacacatgcacaaccacacagccaggcatgcatatgacacaaacacagaaccacatacagatgtacgaccacgtggtgcacacacaaacacaaccacaacagccacacgtacgcataagcacgcagtcacacacaggtgcatacagacgcgcaaccacagcgccactctccctccccccacggagttgcctgtgtctcttgaggaacagaaagcaaagcaggagaccccagcacactggatggagggtcccgggcaggagggtcagggccagatggaggtgggaggagcggctggagggtggtgggggcagccagagggtcgagtggatggagggtttggggggtcggccagaaggtgggggagtgtggctgagacactagcccggccctggacatctgaatggggcggtctgaatcaccaacttctgtaccaggggccaccaaggacatggggaagatgctggggggtgacgaggagaaggacccagacgccgccaagaaggaggaggagcggcaggaggcgctgcgccaggcggaggaggagcgcaaggccaagtacgccaagatggaggcggagcgcgaggccgtgcgccagggcatccgagacaaggtgcgcgccgggccggccccgcctgcgggaaggcggccctgagtccagcggggacccagatcccgcctgggtggaaggggctgcccggaagaggggcgggcgtccccctgggcctcctaccctttgggggcttcagagtggcggaggggtgaggggtgggggctccgggttgggctccctctgtggggcccagcccctcctgctcctgaccacagcgccagccctggcgggcttcctaggcccgcattccgatgcgcagccctgcgtggagcctggctggctgcctggggccctgggccgaggggtcgtggggcggccacctggcatggggggtgcgctctcaggtgagcccggcctggagtgaggactcagggaggggggcacccactgggattcacgaggcggcccagagtggctgccagcaccaggacagccacgcaaggtcactcccactcagcccggtcccctcagcggccaggtccgaggggcacgaggcacagggagcagcctgggtcccgacagccgctccggcttcctcggtggctccagcacggccctggctggaagccgggtgggcacagacatcagcctggaggagtctccagccaggggtgagcgggcatggtgggagatgttcacatcccacgtagaaggggcctggggtgctgcctggggcgcagtgctcaccccgtgccctggccccgagggtaggggccgcagcaggcccagcaggccggaagctgtgtttcccagaaggtggcctcagtcccctgccctggatgggccaagatggcctggcttcggggtgggaaggttcagactcccgggacccctccctgctgccggcggcacctggagcaggtggagaagccgtttcctggccttgtgtcagccgcacccagggaagggtgggcttcacggggtcttgtggggaagctggagctcctgaagtggacagaggtggagctgggagggcaggggcggggcaggtggggcacatgcagccgctgtacccaaaaggccagctcctccccacccacggattctccccacaccctccggtccctcgcagccccccgcccaccgccatgcaccctggagggtgcagagaagccgctgatggggagtgggggccgggcgccctggcatcccacccagggtcactggacgtttccagggatctcctgttgatcgactttgctgtgctggctcaagcctccagcccacccctccgccccccgctccccgccccccgccccgcagctgacccagggcttcaggaggaagtcaggagaaaatgcaccatctcagccaggcagccacagtccactgggatgtgctcgggagactgtgggtatcaggagcgggagacggggacaggaggagaaggaagggggagtcagagaacagagaggaacagagacacagagataaagagacagagagaagacagagggagagacagagacacagagagggagagacagagaaaaagacaaaaagagggaaagagagaggggagagagacaaagagaggagagacaggcacagagagagggagagacagcaatcaaggccgagacacagggaacagagaggagagagccccaggcagagctagagagagctgacgctgggtagaagtggaggtggcagtgggtagcagctgagggaaggacacaaagcgatggtgggctggggtctgggagggctatgtgtgggtccgtgtatccagggaggtgtctctggagtgggtctggtcccctgggctccggcctctgctggcatgatcctacagggacgctggctgttccaggccatgtcattcctcagggtccccagaggcaggatagggcaggctgaggggaccccaaggaggtggggacagggccagcagcgtcagggaccgagtggcccgggcaggatgcagcagctgcaccctccagagactgggagatgccagggagagtgaggcccaggagagggggaagcgtaagcacctcctcagcttccatgtggggcccagagctggcagctggggtgcagggctcgccggtcaggcctatggggagctggcccgaccttgctgccaggcaccaacctgtgatcctgccttggtctaaggccctcagagaacagcaggtggcagggattgaggccacacacttgcccacaagaacagccccctccgcaacccactggcccctcaggccttggaagcaccagcctctctgctctggaggccctgccacagtggacccccccggaccccacgtccacaccttccccacagagtcctcctccacagagcctttggggtgggggaaccccgccctcaggcgtggccacctgttggggtgggggaaccctgccttcaggcgtggccacctgatcagaacacctgctgcctccagcctcctctgggccgtggcacccccaggcatcttgggggttggttagagaagagacgctgagctgccctgtccaaggcctctgtgcagatggggactgggtccttttggagtgtccagccccctaggcagttcccagaggagcagcgcgcctgcacctcctgtcaggcagccatctggacaggcccgggcccagggagcaggagggagactgccccgctgtgctccgcacactgacccgcccttggcctgcataagcttccagccacccacgttgggcagcccacacctgggccttcctgcacgggccttctgagggcccactaggctccctcaatacactgcatccccctaccccccgcagctcccacagcggctaggaggtgtccacctggttgctgaatgctggctgtttggtcctatcattcctattgttggttctcagcattgattagcacccactgcccttttttctcacgaataccgtgttttcagggttcagggtctcacctcagacgtgtcagggcctcctgggcgcccccagcagccactcccatcctcaggtgttacttcctggagagctgctgcccagcatcacggtgggcctggggctgggtgtgcctgggcgtttgtctctggagcagacgcctcagaactgggtctcagccagaccacgtggaagccaggctctggtgtgcagcccagccccggagcctgttttcccggcagagtgaccctggccctcaggccaagtccggcgtgacctcagcctcagaatgacctggagcctcactgcagcaactggcacttcaggccaagctccgagtgtcccacaacctggtggcagggcctggggtctccttcctgggcccagaaggaaggatcccacaccgtttgcagacagggtcccacaagccccaagggtcactcccctgacctgggaggttcctttgctcacacaactcatgttccgccgttacaggcatgctcctctgagcacacacatgttcctgagtgcttttgctgtgggcagcacagcctcctgggctggatacacatgttgccgccacatgcacagacccccacacccctggctggagggaggctctctctggccggacctagcttccagtggcatcgctctccccagcacacccctggccccacaggacgaagagcacatgctccctccacttccgtgcctggagctgctgcccttcccgctgtggatggctaggacgagaaccaatctgctcttgctgccccacagggtcagggctttgttctgggcctgcagggccctctgggtgtcgcccctgttgtgcggagaacgttcctaccctgtgctcttcgttttactgaggagacccctggagtcccggctctgtcaagagtgtgcaggggctgctgaggactagggcgagcccacggcccctctctcctcagtggccaggtggtggtctggccacaggcggctgggaacgtggcgccctcctttccatctcactgaaggtggccctggccccccacacccagagccacctgcagccctaggggaggggagaggtgccgagactgccctcggtggggttggggagcacacaggcagccccccctccatttgggaggaaggaggggcctccttggagatccagggggtgcccagcaccaggagcagaaccaactgcttctatggggaggggctgctgagacaggagcaggagatggcaggggaggggctcctcctgggcagaaaggcccctccctgtggctggtgatcccgcggtgtgctcctccgtcctgtagagtgctggtgcccactcccctcctaagttttctcctggacgcagctgctgacgccttcactactccagagcacctgtaatctcagatccaggaccttggacctggcccgggggtcctgttcaggggatggaagtccagctccgtacaacaccaggcccccaatccttccaggccagcccaaccccactggttcccaccttcctgggcagcaggaggctgttccgtagttccgtggcctgaccatgaccacaggcttcctgggctggtggctcacgggagggctggaggagtgtggcgtggggaggcgtattgatctagaaaccaaaaccccggggcctgacaaaaacttagaggcctggagggcagaagaacaaaatcccacactccctctggaggctctgggggagggcccttccctgccccttcctgcgtctggcggccccgaatccctggtgtttcttgaccactcgcgacctcctccgctttcgtatgcccgcccccatccgggtgtctgtcctttctgtctcttacaaggacactctcactggacttgaggcccctcaaatccaggatggcctcgtccccatccttaccattatgagatcaacaaagacctgtttccgaatgagatcacctttgaagctccaggcaatatgaatttgagggggacaatattcagctactacggagggcagacgcactcacgggagatgagaaacgcgggtgggcagggggtcggtgaggcccaggcatactggctgagggcacgactaggcgggattccaggacacccagtgcctggaagtgaccgcagcccaggaccctctgccggctgcccacggagctgcagcggcctgccagggagtggccctgctggggccgcggccgcatccaggcagccttggccaggcccgggagtgtgaatgcaggtcgtggaccaggcactgggcaggagggtcagctgcggggtgactgtttctccccacctctgccacgcagcatcctgcccacccctccctgccccgggccggaggcttcctggaaggcaggatgccaggggctgggctgggtttggagccagaggtggggccacagccctctctcctctcaaggaagatgggagcctccccctccttgctcccccacatgtcagctcctggcccccattctccgtgggggcttcccattcctccagggaccccccggggtggggtctcttctccttctggggtccttgtgtgcctggtggggtagggggccgcacccacgccttcgggggttcctgggccagtccctggcgcaaggaggctgcggcccgcccgggagccgccgggacccccgccctgacccccgcctcccccgcagtacggcatcaagaagaaggaggagcgcgaggccgaggcccaggccgccatggaggccaactccgaggggagcttgacgcggcccaagaaggccatcccgccgggctgcggggacgaggtggaggaggaggacgagagcatcctggacaccgtcatcaagtacctgcccgggccgctgcaggacatgctcaagaagtagccccgcgcgggacagcggccccgcggagcccccgcccctccccctacagatcctccgcggaggcccctgagggacgagcagagcgcagcccccacgccgatataagccatagccccaggcccgccctgcccgcgcccgccgcctccctcacccggcaaggggcgcgcgcccccaggacccccccagtccgccccgtgctcctctgcccgcgggtggctggagccccatcgcctgggacgcccctttctcttgctgtttaccgcccacccagcagcgcccgaggccagggccgccgaagggcagccccgcgaccacccctgtgcgcgcgttcgcggcggtgggcgcctgtcgggcccgcactcaggagcacagccatagcagacggggggctgcgggcggggcgagggcggcggggcctgggtccccctcctgcacgcggactccggggttcggatcgctccgccgtgagtatttgcgtccgcacgcggccgctctccgccccccggcctggccccctcgcgcccctgtccatccgtctctgtccgcgtcctttcctctcctctctggaaggttttgcttcttacgaacgccacggccgtgttcacttctaaactaaaggaaacaaagcaataggtttgggggacgcccagcccccacccccgtcaccccgctcttcccaagtcctcgccccccgcccggcctcctagcctctccgcccacgcggctgctgcttctccctggggaggacccctgccctcggccattgaacactgcaccctccacaggagccgcagaggcccgaggcaccggacgctggagaccctgcgcccctgcccagcacctcctccgtgggcagctcctcgggtggggcctgcggggttccctgcgcgcagctggcgcgtgtgtggcctaatccacctggtggccctgcggggcggcatccgagcccctgtttctcctccattcatgtttaatttgcatcacaatttgttgaatctcaggtaaatgaggtctttgcatttaatgagttttatcttgacaggcgccgcctcgcccccgggccctttcgtccacatcaaaaatgcatcaagtctccacgtgtttcgggccagggcgtggcttggcattgaccttcatgaccttacatagctttagagaagccataacgttagactgcaatactaacgaccgacgcccctccgggcagagaccaccgcgcccctctgcgccccagcgacgcggcccgcggggacgtcgctgtccgtcctgctcgccctgtgccctctcactgacttctcccgggtcgtgtcttttaaaaactcctgttttcacaccttacaaagccagctctgagcagacagggcgtcctctcgtagaacctgcgcaccccgttcccagcgcatggcgccccgggccgcgagcttagcttagaccgtggtgtcctctgtccgtctgtcctgcgcctgcgcctcctcctgcatgtcggggcccctgcgtgtgttctctccggatggaatcacagccaataaacaccagtgatttcacaccgtgtggccattccttccagaggtccatttcgccagccggaggaccggggctttcccccgcgcatgttctctccacggcggctgcagggcctcccaccattctcactcagctccatccagtcagacccattttccctaggccgtccagccagcgcaacctccatctaaacacaaacctgcgccttcagggtctcccgccccccagggtggttcttccacccgcaaagcatctgccctctgctctccctcccacctaggacccccgaccacaggcctgtccctctcctcagctccaccgggcccagggccccaggtcaccctgtgctgcccttacctcggcccacccaggaattcctgccccccagtacccccgtgggactgtccctcctcctgagtcctggacccggatccctgcagggaaatgtctgccaacctgggctgaggccagaagaggttcctga

SEQ ID NO: 15925 - DNA, 18478 bp, Human
  misc_feature (1)...(18478): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagaccgcctgacaaaaagatattcacgaaaacaacaaagagacagagacaagggcccggaaaaggcaggaacagagaaagaaaagaaaaaaccaaaaaaaaaaggagcggcaagacaggaacaagcgcgaaaagacaaaaaaaaacgcgacagacgagacggaacgagcaaggacaagacagaccaaaaagaaacaaacgcccaacaaaaagagagaaaaaaggccaacaaaaaacagaaagagacgaaaacaagaacagcacaaacgagggggaggaggggagagaagaagccagaaggcgacacagaggagcgagaacacaaagagaaaaaagggccgagcgccggaagagggcgcaaaaaagaaaacgggccaaggggggggaggccgccccagcgggcccccgtccggccccgcccccgcccccgcgcccaaagaggaggaaaacccagcgcaaagaggccggcgaaaggcgcaggcgaaaaccagcggggcgcagagagcagagagccctgcgggcacccccccagaaacaagcgccaggaatccagacggaaaaaaaagagggggggcggcgggggagcccggtaattagtgtaaaccctttgtctgcctttgaaacccacagcttctcactcgctgcggcttcctccgcctggagcgcgggcggggagggcctgtggggagggcggccagacccctgatccccgcggcccgggaccggggagggcggtatctcccagttccacgtgttagtgacggcgcccccaatgtccccaggtccggacaggccgagatgacgccgagccccctgttgctgctcctgctgccgccgctgctgctgggggccttcccaccggccgccgccgcccgaggtgagttctggcgcccagcccggccagcctggcctccgccagcgccgcccccttcccgcccggccctgaaccctgccacagtgcccgcctggcacgcgccatgccccgcccctgccgccccgctcgccaggcccccttccttccagggccccctcacccatgggctgtccacagcacccaccggggctcccctagctggctggaggggttcccctcatgcgtgcttgctggccaggtgggctttagtcctggctccccaggacatgctcctggtcttgcaaacactttcatactcgtacctgcagtccagggcagctaatcacctgtggattcttggggagtgggcggtttgtggccacagtggacccgataaggactctgggaacctgcagagacccccacggaaggcaggatgggctgtgggagatattggtaatatacttggtgtctgggactgaaactgacccccagacccccagtcccccagccgacctagccgtgtgccctgggcctgcccagctctaggcaggcagtgccgggcggttgtgtggacaagtccccagagccgtgacgcaccccaggactgcgtgcctctgggcacacgctgtgctggcctggtacgtgctcatggcaccgacatctaagtggcagccatgccctgggacccagccccagcaaggacatccggagccgatgggtgacgtgtgcccgcagactcatgcccgccatgttccaggatccgggcacagcgctggctgcccccatggctaggcgggacctgtggccaggccggccctttgggcgtgttgaccactcaggattgtccgcgctgtgtccaccagtcctgaggcttcgcacccctcccctgccgcccagcaagcgcgccgcatccaacctggccttatatgggcacgttcgggtgctgggtggcgggcggtgaccaggtgggccttatgccacagcacccccccctaccccccgcctgcccacatgggcctggctgagcggctgctctgagggcccggcagcgtcctgggctgtgtgggcactcaggccatactgggcgagcccctaccatggccagcggcctggacttgcattctctttgatctgtttggcctccccaatccctacacctgcctgtcctctggccactcggccagggaggctctggaggcctctgtcctgccatgtttcctggctggggctgaagctgactggtggatggccacggtcagccatggcagtgggcggcagagcccgcctcttcgtggagacgccccagcggccacccccttcgccttcgtcctcctcagctgcggccttggggctgaggatatccagccctggctttgcgtggcaaaggccctggcggcactggggagctgggatcaagctgctttccaagggcaggggcctctgtggtttgggtggaggtggggaggaggttcttccggactgtgctgattttcctagcgtggactagggcgcgaggtccatccaagtgtgtttctcctgctctgaacagcccactgtgcaccttcgttaggccaaggaccagcatgcagagggcttgggttatttttgaaaagccatttcccgctgggtcataagttctggaatcggcacatcgctacactcagatcatattttaaaagttcctcttttcccaaactttcacaatcttggtggatttgtcttaaactgctttttttttttccaatttgaaaaaatataggaattggctttctccctttccattttatttctcacagtgggaacttgagaggttctgcatgaaatgtctttcacaaataactctgaaggaagtcgtttcagggctttctgagaagtgccacctttgaacttttgcaagcatggccttgggggccagctctgagtggcctgcctaggaggccactcccctgtcctctgcacccggccagctgcggtgggcaagctgagccctgacccaggtgggcagggtgcctgtccaggggtgccccatgcctggggggtagcggggtcagtgtcggctccctgtgggggcaagagtctgaagggttgtgattcggggaagcaatagccgtgggtgtacggtgctgacctcggcccccagccaggcctcagggccttcctccctcgccccaggcccttccgggcagtggctggcccgtgtgcagcgggctgaggtggacgtgtgggagctgggcccagcccctgcaaggtggggaatcgggccagccgccccgtttccatctcggggccccactcctggaagggaaaataaatcactgtccccttggggggagggagggagccgtgaacaaagtcgcctttggctgggcctggaaacgccgaccgcagactcctttatccattgtgcgggaatcaatgggcctccgggctccctttcagccgcaggccccgcgctgcggccctgtcaggggaaatgttggtttttccccagtcgtggcctccagcccctggcttgcccagccctggctcaggaactgcggccgtgctgggagaggcgggctgtgcccgcagactggaccccggctgctgcatgctggccctctgtgcggcccgggcttgctgctcggcccagggtggactcctttgccccatcagggcctccgccagtgactccaggcctggtgtgtccaggtgacagcctcagcgggtcagcacaggagggagagggatacccacacccctctccccagaggccccctccagggctgcactccctgcctgcctgccactctccctggcggccatccctggagctgctggtcaagccccagggtgcctggctgccctctgcaggcggctccaaggtgggccgcagccccagagccatgatccaggatggctggggcaggggtgaagcaggggatgggagaggaggggcttcacgggccaaggcatacctagcaggagaggtgggtaccagtccccttggagcaagtcagcgtgggtgggggtctccttccaggtcattgcccctgtgtggggcaggggggtgctgcccatcttggcagaaggctcaattacttcttgcctggtgctgttaaggggctgaggggtgaacattggctgagcagtgacaggaaagagggagccgggctgttgcccttgtgtgtggcgtggggcccgctgggcacggtgacaccctctgggcttctaagactgagccccaggacagcctggtggccccgtggagagcttgggttccttgtccaggcccaccagccagtggcttcaaggccctctacactccctgtagccttcctgccctgttcccagtggtgactgcagggcttggtgtggagcgcagtaccatgcaccagggtgcctgacgcaggcatcactgtgtgtcctggagggtctgggcggctgtgccctgtggcctgcaggggcctggggagctgcagcggacaggcccggtgccctcctgtccccagctctgtccttgagaagtccgccatgtgagtgggagcaagggcccctgacctggtggtgcccggtgtgcctgggctgctccgtggttggggcagccccacctgggggccaagagccctggcaggggacagagcatcagctcacccctgatctctggcctcaggggttctgggctcaggaaatgttcttgttgatgcttctgaagtggggaagggctgccaaggtctgcaggcagagcccctctggggagttccgggcaggggaggcctggggactgcagcccggcaggctggggttttgaggtgggggtgggggccacgtgaagctgggtgggcctggtgaggtctggactgggatgggtacggaggaatctttgcctgttttagtgctgtacaaggttctctccagggcgtgggactgcctgatgatgctctggtgcccgctgtgtgccctggtgtgtcgaggagggggagcagtgccctggggctggggttgcagaaggttcccccgaatgcttccagggctgggcagcatggtgggccacatgctgcatgcagcttgctggggcacagcctgtggggtagccacctgtgctgcaggcccccagttcccccgcacgtcctgtgggtctgctccccgagggccgcctcgctagctggtgactgtgtgtgccctgggtctgtgtatgcaggtgcacatgtatgtgcctgagcgtcccggggctggggcagagcctggccctggcacctgatgggcagcaggctgcgtggcggtcacctgttctctggctcctgggggcggccactcttgcacttggcttcctgaggaggggactgggccctggcactgactctggggtttcccactcactcctgccctgggtgcccctgggggcctggcacagccacatagcggccatctgtgatgggggcactgtgtctcttctcggtaaccgggtggggggaccaccggctgcagaaggctcagcacctggattggctctgcaccccactaggggttcgacacagtgtgtcctgattcccctcccctcccttctggtcaaggtgagcccccttcccccaggccactcagcttctccaggaggacttggggcctggccacccccaccccgtggccaggtcctgggtcaggccagagaattcctccagctggaaactttgggccatgcagggccccccagttcgcaggcatcctcactccactctggcctcgttggctgccaggacgctcttggtccagctcctccatgcgggaacttgggtagccggtcagggttggggttgagggggccacacagccagctcctcagcggtcagctccacctgcccctccctccccagcgcacactggctccgtctgtccccacagacgccccaccctgctgtgttgttgaccagcatcagcccctgccgcagtgagtgctccttccttgggaagcccccgttgtccctactgggtcaggagtcccgtccgacctgggcaggtgctgcctcgggctctgtagaggggtggataccactggcctgggctgtagaggcgtcctgggaggtgcagggtgcactggaaagttggaggaggccgtttccagccagtgtcctggtcctagctcgtgtcttctcccaacagaggggtcatgacgctgcacgtgtgtccctgcctgggtgtctctccctgtgctgagggctgtgttctggggaagcaccccctccttgctccctgtaggagccaggccccatggggaggagccacctggccacaggagggaagccgggcagccccagccctgcatcctctgtacctgccctggccggcccccacacccacaccgttctccctacgaatgtccactgagtatctgctgtatgccaggcctcgggacaccacgagcacgggagaggggcttgggtgtgggtttggaccacgtggccaggacgggcccttccagaagagatattggagcccccgaggagctacggggtgaggggtgtcggagagggcacttcagatggggcaggtgttcggggagctgatatgagggcctgtgaagacggggaagggcaggccgcagggggttcctgcctccgtccctccagactgcagcttcttcccctccatcccagggcctgcccacctccaccctccctgggccctgggaaagaggagcctctgtctggggacagtgtgtgtgtgacaaagcgtgtaggcagagcggcctctgggccttgctgctgtgggaagcccctgctcctcctccttccctagttgtgttttttacagctgggcaggggtggggggggcggcgggaggatttggaggcatccgccttcttggcgcactgcctccgagtctagtcctccatacctgacagcagtgaggccctgtctcagactcagtttactctcatgtctcgctcccatgtggcccttggtgtcctgcctgtgctgggggcctctcggctgtggctaagtgtgtgtgcagggcaggggctgtgctggaggaggaggctggggggtgtcttggcagggtgcacggccccggaggtggcacagtgctgctgtcatgccccggcgggggttccctgtgtttcttcctggctgcagtgcgaggcagccggtcttcccaccaggtgcctgtgccctcaggtcctgactcagtttccccataggctgcgtgggttggacgcccgtccaggtggcgtggtgccctggccgctgtcctggtgtgatcattccccaggaatctggggggatgggcttcctcctgggcaggccctcctgcggggggtcttgggccggcaacagcagggggtccggggagcccaggtgggggtgggataggcctggcgagggggagggaggctgtttgctttaggataagcctggctcctctggcccagctgcctctgcccgtgcctacagcgcttgcaggccggccctgggggccacgcttccggccatccagcggtcatttgtctctgccccctttctcagtggtgaccacaggcgggggtcccgcctccctgtctgtgcctgtcatcctgcacctcccgcatgcctttggggacccttacctcaccaagccttgcttgtatctgcctggggcagggtgggggctgggaaaccttcccgaagtgtagctggggctttcagcctctgaggtgggctccctccccagatgtggggggctgggtcagtgtgctcccacccaggacagggccaggcactcgctctcttgcttcttctggacagttgtgtgggtgaacacttgtgtgcacccatgaacatgcacgtgtgaggcctgtgcccaggtagccagccaggaggcccaggcacccctgcaggctgtgggccacaggggctgggctggccaggggccttggccactcccccttggtcccgggaggccctgtgggtggtgggatttcaggcagcgacaggtgctggtggggtcaacctggggtgcgtctgggacctgggccggctgggaaggggtcaggaggccccagtgctgtgggccctgcagccgcttcctccccgggacaaatttgccagagctgcccccagccctgggcagctcacagaaccacactgagggggtggtgggctggcagccccccacagccgccgtctcatttcctctccggggagctgcagggagggtagggaaggaggggcttcagggctggggcccatggcctgggtgggagggtcctgagttgagggagagacgtgagtcagagaagagacccccacatgttttctcagagaggccaaggactgggatgggccgggtgagccagggctgagaagaatccctccctccagagcctcagcccaccctttgtgtttctgggcacagcagggaggcgccgtgtctccactcccagccccagcggccaatgatgcctgtgggctcagaacctagaggccctgggcaacgccccctgtgctatcagcactgattgggaggcctccagagaggtgatagggattctctgtgagggtccctgtccccagacttgggggtcagaatgggagctgctccctgagtgtctgaagacgccagtgggagacgtcacagggccactgttaactgtgtattggaggaacacgcggccccaggccccatcgagatggcctggagcagctgctacctcttggtgttctgcacgcagcctggacgctcccagacagcagtggctgcagtgcgggatggacactgtcacccatgggctggcgagagatgccctgggaactgtggggtgcctgcggccgcctctccgacatggagagcagtgagtgggctgtggtcgccgctgcaggacttgggagcagcacgtggggagtggggcacgcagggccctcctttcccaggagctccatccaggtacaggccctgcggtgccccgagtttctgaggcctgcagggtctgtgtgttctaggttcatcttcctggccggcttggcactgcccactggggctggtcacacacacacagaaccctggccctgccttccagcccagaggcacccaggcaggggatggggtggggtggggactgaggcaggggatggggtggggacccaggcaggggatggggtggggacccacccagggaatggggcgatggggcaagggtggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggtggggtgggatggggacccaggcaggggatggggtggggcggggacccaggcaggggatggggtgggttcctttctgccaggaaaggaggcctctgccaggaaaggagggctcggcttctccacatagggtgggatggtgcaggtggccatgtggagccgcagcctttctgctcctgtgggtttcacaggtggtgggaggacatactggctgccccccagacaggagcggcagtgcccgtggtcagcccgagctacgtctctccagaggcttgctctctgaccccagggccttggggtcatgccccctcaaggctaaggtgcctggcagggtacggcccttgggggtgggcagacagacctgggcatctgtggtccctgaactcaggtctgatattgacacagacgtgggtgctgcacagactctcatccacacattgcacaggctcaggcagcccgccgtgctcggttgcttgtggatagctgtggggtcgctggcccatgcccaggcccggctgggccctgggctgatggttgggtgggaattaggtgaggggcctggggctctttgggacccaccaggccccccatccccctactgcccttgtccttggggggccactgtcccctctgacctcgggtgtacggctgcttcctgtatgaccagaaggagactctgcccttttggttggtggttttcgagagttaccaagcgcagctgttttgcatcctctggggaccctgctcccttctcgtgtctcaaagagccagcctctggggccacggggctgccccggccatgagaggctgctgacgtggtgtttgctgggccagtgctcagggctttggtgcatgtgggcagctgaggcctgggtcaggggcactgcacctcggcccctctgctcatcttgggcaggtgacccaggtggagctcaggcccgaggtctgtgctgggccgtgggtccccttttgaccgcccccccggctccggaccccaagcccctcctcgctgactgttcctcggtcccacccgcaggccccccaaagatggcggacaaggtggtcccacggcaggtggcccggctgggccgcactgtgcggctgcagtgcccagtggagggggacccgccgccgctgaccatgtggaccaaggatggccgcaccatccacagcggctggagccgcttccgcgtgctgccgcaggggctgaaggtgaagcaggtggagcgggaggatgccggcgtgtacgtgtgcaaggccaccaacggcttcggcagcctgagcgtcaactacaccctcgtcgtgctgggttagtcgctgctgcggtcagaggtcatgggctgggttggagccaggcaggggtgtgcaggagggcggacggggacacacctggggcccgagagtcagccagcccccggcagaaagccttccttcggtgccctgccccacctcagctggctgcacctctgccaccatcccccaggtatcctgtcccgttcctgtccccgtcaggctccagcctcggggccttcctcccagcggagggcggagggtggagggcgggagccgaaggcagtggtcccacagaagggctggggcccgaggccttggcagggtgtgccggccgtcggctgtgactttgaggctcgggtttcggagttcagaggagccgccgggatgcgtggcctttctgttctcttctgcgcctggggcccgggcgctgggcttggacaggtgtccagagagacacgccctccatacctagggacccggcaccccgcctgctccgctgggctcctgggtgtggggccctcgggtggagctcctgggagctgggctggcccgtttcttttttttttttaattctactttaagttttagggtacatgtgcccgttttctgaatacaggagcctggcccaggccccagcagggtctgggggtgcggcctgagacagcctggtcctgggctcagtgaaggagcggctgtcacagggtggatggaggggacattccacagcacgccctgcccctcggcattgtgtggaatgggaaaactggctgtcccccacccccaccccacagtcctttcaaaggggacgatgaccgggtggtatgagagtctcgtctgttcaccagccctcggccccttgatgtaggctagggttactgcagctgctggccgggcccggctccctcctcccccggggcctgcagaccccccggagccagaatgggggccggccctccagccccacccgtgcccatcagggtcacctgcgcccagtgtgggccagcggcccttgcccagctgtccctgggattctgggctgtgggtgtgtggcgcagccccctgcctgggtgtccagggctgtcccggctggggctgggggagctagaggccacgggggagttgggggagctcctcagggcccccctcacctgccctccctgtgcacctccgtctctctgcagatgacattagcccagggaaggagagcctggggcccgacagctcctctgggggtcaagaggaccccgccagccagcagtggggtgagcagggggtgacgggggtggggggcgtccgtctgtcccggccccttggctgcatccccgtcctctgacctccacgccaccccaccccgcagcacgaccgcgcttcacacagccctccaagatgaggcgccgggtgatcgcacggcccgtgggtagctccgtgcggctcaagtgcgtggccagcgggcaccctcggcccgacatcacgtggatgaaggacgaccaggccttgacgcgcccagaggccgctgagcccaggaagaagaagtggacactgagcctgaagaacctgcggccggaggacagcggcaaatacacctgccgcgtgtcgaaccgcgcgggcgccatcaacgccacctacaaggtggatgtgatccgtgagtgtggccccgggcgctggcgggcggggggtgctggtgggcgggggcgctggcgggcgggggtgctggtgggcgggggcgctggtgggcgggggcactggcagggcttgggggtggtgggctgggggtgctggtgggcccagggtgctggcggggtagagtccggcgcggcccaggagccatgcccgcgtgccacgttcccacagagcggacccgttccaagcccgtgctcacaggcacgcaccccgtgaacacgacggtggacttcggggggaccacgtccttccagtgcaaggtgcgcagcgacgtgaagccggtgatccagtggctgaagcgcgtggagtacggcgccgagggccgccacaactccaccatcgatgtgggcggccagaagtttgtggtgctgcccacgggtgacgtgtggtcgcggcccgacggctcctacctcaataagctgctcatcacccgtgcccgccaggacgatgcgggcatgtacatctgccttggcgccaacaccatgggctacagcttccgcagcgccttcctcaccgtgctgccaggtgcgcggctgccacgccacgccacaccatgctggtgcccggacccgccccctgggcccggcgtcccacccaccgggtggggccccacccttccctcccgggccgtgctggccaggtcatctgccgagggagggcagcccaggggcaccgtctccacagcccctgggatgggtctggggtgctctcctggtctttgtgtcggcgttcccctccctacctcctttcctctcgctcttgcagacccaaaaccgcaagggccacctgtggcctcctcgtcctcggccactagcctgccgtggcccgtggtcatcggcatcccagccggcgctgtcttcatcctgggcaccctgctcctgtggctttgccaggcccagaagaagccgtgcacccccgcgcctgcccctcccctgcctgggcaccgcccgccggggacggcccgcgaccgcagcggagacaaggaccttccctcgttggccgccctcagcgctggccctggtgtggggctgtgtgaggagcatgggtctccggcagccccccagcacttactgggcccaggcccagttgctggccctaagttgtaccccaaactctacacagacatccacacacacacacacacacactctcacacacactcacacgtggagggcaaggtccaccagcacatccactatcagtgctagacggcaccgtatctgcagtgggcacgggggggccggccagacaggcagactgggaggatggaggacggagctgcagacgaaggcaggggacccatggcgaggaggaatggccagcaccccaggcagtctgtgtgtgaggcatagcccctggacacacacacacagacacacacactgcctggatgcatgtatgcacacacatgcgcgcacacgtgctccctgaaggcacacgtacgcacacacgcacatgcacagatatgccgcctgggcacacagataagctgcccaaatgcacgcacacgcacagagacatgccagaacatacaaggacatgctgcctgaacatacacacgcacacccatgcgcagatgtgctgcctggacacacacacacacacggatatgctgtctggacgcacacacgtgcagatatggtatccggacacacacgtgcacagatatgctgcctggacacacagataatgctgccttgacacacacatgcacggatattgcctggacacacacacacacacgtgtgcacagatatgctgtctggacacgcacacacatgcagatatgctgcctggacacacacttccagacacacgtgcacaggcgcagatatgctgcctggacacacgcagatatgctgtctagtcacacacacacgcagacatgctgtccggacacacacacgcatgcacagatatgctgtccggacacacacacgcacgcagatatgctgcctggacacacacacagataatgctgcctcaacactcacacacgtgcagatattgcctggacacacacatgtgcacagatatgctgtctggacatgcacacacgtgcagatatgctgtccggatacacacgcacgcacacatgcagatatgctgcctgggcacacacttccggacacacatgcacacacaggtgcagatatgctgcctggacacacgcagactgacgtgcttttgggagggtgtgccgtgaagcctgcagtacgtgtgccgtgaggctcatagttgatgagggactttccctgctccaccgtcactcccccaactctgcccgcctctgtccccgcctcagtccccgcctccatccccgcctctgtcccctggccttggcggctatttttgccacctgccttgggtgcccaggagtcccctactgctgtgggctggggttgggggcacagcagccccaagcctgagaggctggagcccatggctagtggctcatccccactgcattctccccctgacacagagaaggggccttggtatttatatttaagaaatgaagataatattaataatgatggaaggaagactgggttgcagggactgtggtctctcctggggcccgggacccgcctggtctttcagccatgctgatgaccacaccccgtccaggccagacaccaccccccaccccactgtcgtggtggccccagatctctgtaattttatgtagagtttgagctgaagccccgtatatttaatttattttgttaaacatgaaagtgcatcctttccctccaggctggtgtttctgcccatgtctacatgcacgtgtgcatgctcgtgtgtgctcacatttgtgcctgtgtgtcaggcctggtctccagaaccagcagcctaaccctcttggagtcccctcgctgggccagagccacaggggctgagaactgcacctcccggcgggagagtttgggtatactgggcttcggtggtgttgggcgtgagcactgcccacatgcctggccaggcctgcgtcctgcacccctgtcccagcggcgccctctctgtgtcctggggctggcacctatggccctcagtgcagggcctggccactccccagcccctcctcaggctttggtgggtggccctacaggaggcagcagactggcctcagagctggggatggggccaggctcaggtcacctctgacctcagggctccgtccgagtgccctcccagccaccctgcggtgctgcgacggtggccgaccccatcttacccggtcagcaggaggggtggggctgccagctccacccggggcccttgcctgccgggggttccgttagcctcgtaagaaaaggcacgggggcccctcgtgcattcagcaaagcgtgaggcccactgcgtccccggagcctggtcctgctggcgtgcagcgcgcttcctgacccgctctggttctgagagcttttccctggaggaagctcaccctgcctggcttcaaagacgacaggtgggctctggggagaggtgtcagggacctctccccaactggagcttctggggaccccatggctttcaagatgtcccctttttgttctctgtcctccccagggtagaccctacttctctcccctgaggaagtcctgactccttggacggtgacagcttcaggcatggccctggtaagggctgcgtgtggctgatgggtactgtgggaggcctggccaccctgactgggggacagtgggggctccacgcggcccacagctggcagccaaacagatgttccccagacaggacaggctgcaggccgacgcctggtcgggtttcagtctggagtaggggagggtggaagggagacctcaggcgtctggccaccttgggcagcagggaggcctcaggcagcgggtcatggggttgcagaggacaggctgcccctccccagggagtgggcggagggatgggcagtccgagagggctgtcccctagagcctctgaaggagacactgggaccgcagaccccacgcctgcaccctgcctgctgtgaggtccaggcccccactcagggccacccttgacttgtggtccagcccatcttgcgcctgcccacaggaggtgctgactagtgctgtgtggtcctcaacggacaggtctggcacagcctagcctctgggtcttgggctctggactttgtcatgctgtggccacgttggatgccaggctgggcagggggaccccaaggagtcaggacagacccatctcctgcctatggggccccagccacccccgggccaatagcctggagctcagacccctcagtccttccctagccttcctcaggggctgcctggagcccctgctttctcccctgcgacttccagacccttcccccttggccgtccagtcccgagagccttgctcccgcccccacgcccctctgttcggcggtctccagcctgagcctgccggggccctgccctgtggacgcctggcctgtgttcctggctgtctcttgcctggccctgccccgtggactcctgtccccgtggctcctgtccccccaccagccacacggccatcccgatgccgtttcccgcatctccgtcacggcagcacgcgtctgtgccctgcgccggctccctcgtcacatctgcacgtccacactcccaagaacaaaattgcgttcccctcccctccacgtgcaggaggcctgggagcacagaggccccgtgtgcttcgaggacttgaggcaggaggcgggcagaggcgcccagggcgtgagtgtggccagcaggacagagg

SEQ ID NO: 15926 - DNA, 41435 bp, Human
caccttccagccctgggaagcagcatacaattgccaagagacgttagaatgctgctggaggattccagggtctcacagtctggattttagagtcctgaattttagacttttcaaggacatgtgctcctctggggttcaggcataatagactatatttaccgatggtgactgtgtgcatgacgccataacatgttacactattaactcacttaagggactccatgaggcaggtactgctatcttcactttacagaggacactgagcacaggcaagtaacttccccatggtcacacagctggaaatagcagagcagctgggatgtgcacccagagtctgtgtacttagccacagtgcaatcctgcataactacaaaacaaacttatgtgtgtgagcatctatccgcccaagcagacaagtgtcaaactacgcgaatgctgtccaagcactgcgtgagcatacacttctctgaaagcgttctgctcatcaacagggccagccagtgacttttctgatcgcttaatgcacctatccagtctcttcacaggcggctcctggggtctgccgggggtgctggcgtcgggttggccctggcgctgtccccagcccccactccccaggccctgcagcgccatgaggtcggactcctgggcgtgtcctgggttctgacccacccgcgacgccagctgcccgcgcccggagcggatgggcctggcccggctccaccccgcggggctccgcggctcaacgggtcgcccaggggcgcgggcccggcttcgtcctcgacggtgtccgccccggccctggctaggccgacggcagccgggtccgggtggggctcgggctcggggcgcgcccctcccatctctccagggtccgcgtcctcgctgccgccaggtcccgccgagatccccggtggccccggctccagcggctgcagcgtcgccatcgccgggcagaccccggccgacctcaaagcgaccgcgcggtggggccggcggggactggggctgcgcagcgcggcctggggtgggggcggcggggcccccaggagctcctgggaaccgagggtcctggggcggtcccgccccgcacagctccgggtgagcttggggagggagacacactctcagcccacctcgccccgcccgacagcgctccgagtcctgagtcccctcacccccattctacagacacgaaggtgaagccaaagacgggacgctcacttcctgagaatttgctgcctgctgcgtggacaccaccgacctattgtttacagcggtcagggacccgccccccagacccccaggaccgcgcttccgggggaggagggtgtcctcagcaacggtgacccgcaccaaagccctcctcaccggggtcaccgccacagccggtgcgaggcccgcagggcgctggggatgcgcgaccgactcccgtgaacctgctcctcgcgcgtcagggagagctgtgcacccaactaggctctgtgaggacggactgaggtcggcctgcaggctgcggccccgaaggcaggatttgtggagagatgattcgcgagccttggaggaaggatgggctgtgcgtgcgtgggtgcgtgcgtgtgtgtgtgtgtgtgtctgtgacttttgtatgtttatgtgagactgcgtacgtgcgcgcgtctgtgtgtgcgcgcgcgcgtatatgtctgtgtgtgtgcgtgcgtgtataatttctaaatggacgtcaccttacacatcacaaggttaaaaaatgacccctgggctgtgccaggccaagcacgaagagaaagccccgcctgaaactgcctggaggccccccggctgtcactctcgccacattccgtggagtatgtggttgcaacttctgtcactcaaggtctgatggcggggagattggagccgtatccaatcagcgcactggagtgaaaactgcccaatcaggcacgcagccagagaggaggcggtggcttccgggatgtggcgcgggtctttgcgtctggctactaccagaccgcgggttaggggcttcatctctctgcgttctcagttgtgggaggccttggtgattcggccacagcctcagcctccgtcgctctgtgacctgcgggtattggatgattggtagctaagactcccgaatacttcagaagtggggaaatggtgagtgtgcggggcagggcgtcccaaggctgaggaggtctcatcggagctggcgggaaatggcggcgggaccgagtctgcgaacggagtccccgctgccgccgctcagccctggggcctcagtaccctccggtgagggacctgggctcctgtcggtccccgcacagcggctctggcccagcctgcagccctccttgtgcagctctgcgcccgcagccccgcaccttccccaggctgtggggtgaggagtagcttatctggaagccgcccgcgcggcgtgcgcgatgccggcgtgggaggagctgtgggagaagctgtggtctggggatcccgtccctgctttaccctgttcggaatgagatcgaggccccatcaaaacagagttcatgtgagcaaatggggactcattaatgggacagcgccggccgtggctcgtggtttgggggctgccagcgggtcttgaaggaaaagcttttgtgaggtgtgtgaggaagcgaagcaaatcacccgcccgctccaacttgcccaccagtctccttgccctgtgcgcctcctccgcgtggctgttcctgagtggcatcttttagaatacgctagtgtgggcgcgcacagcgcttcgctgagttctgtgagtagttctgtcatattattgaacttgaggagggtgtgggcccctggtttgtagacaggtgttcagaaatgaagacgggtgtccagaggcagggactggcgtctgcaggggggcagctgcgggaagagcgctgagcttgtggggtctgtgctgactccgggtggtgtcgttagtgagttgttggacagcccgttggggtcggagcattgactggtgttgagcaaactcctcacgtttcctgtcagaagaaagacatggctgagcctgggctggagggagtcgcaggtgtccgcgggagaccagccgggttctgcacatgcactgtcctgctgcgcactgttctgttcctccaggtctcctcccggggagagagggcgctgagaacttggaggaaaggagttctgagaaacatcccttccctgcaccctgctgccagcccccacccaatgctaacccactcctgagcccgcccattgggcattcgcacggccacacttgtcccaggacagggttctaccctcaggaattgtgcccatggcagctttgctcctaggtttttctcccaagaacacacacagtgcccagaagactcctggttcattttaaccccagatctgtagcaggaatctgttttcttcacccacccaggcttttggaccacctgatcctaatctcctctgcctttatgggctcaggaatcagttagagcttagccctgcctgggcctgaacttgtagcacaaaccagtcctttcgtcaatcctgccttgcccccactcaaggctcttgatagcacctttcttctgctcttttcttccccacaaatcctctttcctgtgcacacagtttgctcaagtgcatccctcatgtgctacaagaattcaacgttagtgagttcaagaccatgcctttagacctgcctgttgtaggaccaaatacaaatcagaagaggcttaatgctttctctttagaatgaggaaagaatttttactcttctcccttaaagcatttagtttgaaaacttttatatttaaatattttctctgcttctttgaaatatatataactcattttaatctgttaactaggtgatttgtcttttttgactcaaaattgtctttaggacatggaaactattgctttgaaatgtgcatagcaagaatatataacctattccgcaatttctgtagcagagtaggaggctgccttcagcaggtacctgccttcacatatcaaatctacctcctgtcctgaagctgtgggaagtttattttccctttgaatattaccaattaggaaacccggatgacctcccaaattactaggtgaaagtgtaataaactatgtatgatacatggtactgtcaagtcttctacttgagagctaattatggtgactttctttgttttggcagtctcttagtagactgcctgtaatgcacaccacattttgtttaattctctaacaacacattttcttgctgttctattattttggacagtattttaggattgtagatgattttgctgttatattttccacacgctgtcaagaattactagatgttatacacaaagtgcccaccaggcttcgttttagagaagaaccttctttctcaggattccagtcacaacccacagttgtgcagcaaagtgcacgaagtgcagcaaagtgctccccaaagctgcaaacaaaatgatctctctatttgggatctacaatcccttctatagcagtttgactagatttctacaaaaatgactttttaggatagcgatcagtttttccacctctttcagtgtgccaatgatcttcagatctgacactgattcagaaatcatggggcccataaatccagcgaggttcacacatgtgcattgattaaacctgagaacttccattctctcccttctccccttgcccaaatgcccacaaatgtgcttaccagccctccaagtcttaaatgtgcagttccaaattctgagtttatgtcctgggatttgagagaagaacagaacttttgtttgagaaatacaagttcttttaattacgagaccaagtgatgtgttaaaatgagaccacagtcctaccgttcccctctttgaactgtttgtcttttgaagttgtttgctattgccacaagtggatataaattaacctaataatgccatactggacactataacccacaccttatagcttaacaacgtacatagccaatcactaaccaatgttacttctataaaccaataagaatttctgacagctttctatcagttccgtctgcctttctttttgcctttaaaaatatacttgtaactgcttctaattggagtgtatattcagggcagctttatagtccagggttgcaatcttcaagctttggcccaaataaactctcttcttatattatgtttaccccacctttttccttttaggtcaaaaaaacatttttcttttttttttttttgagacagaatctcgctctgtcgccaggctggggtgcagtggtgcgatctcggctcactgcaacctccgcctcccaggttcaagcaattctcctgcctccgagtagctgggattacaggcgcacgccaccatgcccggcggattttttatattttgtagtagagatggggtttcaccatattggccaggctggtcttgaactcctgaccttgtgatccacccgcctcagcctcccaaagtgctgagattacaggcgtgagccaccgtgcccagcctgttttgtgagttttgatgccattatgtgaatggctattcattgacagaagagaagttgttattatttgtattgtgtttaccttgctaagaataaatatttagcttctaatataattgttctagagaaacataagggttttggttaaattccttgttactgtatgttatacaaaagacagagaagtggctaaaatagattaaaatttcacaaattctgggaatcaaatttctcttgggcaggcttagaaaagacaaaaccgaaagtacttagtgacatagagagcagaagcctagggcccactttctgtcccatccctgcccagatctaccctcttctgatccttgtccaggtctgagccaacactgaaatctctcacagaactgattaatagaggagatcagagtttagggtggctactccagtctcctctccagagctggtgcccacaattttctgaaacccaaaagccaataaatagggaaaagctatatactttggggccttaaatcttttctataaaattaaaactaatgtttctagagacatcccacccagcaacctgttctctatccctgcagtttcagtggctttttcttacaagtctcaaagtaaatacaaacacaaaaataaaaaaattcctctgaattgtacttaacactttctttggctctctcccatctatttatatttagctattattctatacatttttttaaaaagtcaggggaaacagaaaggaaatggaaattctgggccctgcctttaaatctgggaagtatgggacacctagtgtctacctcccaggatgttatgagaattaacacacataatatgagcttcccatcacagtgctctgtgacatacatctgagcacatattacatgccccataaagatggcattaatgcagatgcacatgttgtttttcagatacagacttactcagacattgccaccgtctccaacttctgtaaccttatagggtctgcagagaatgccatgtttgaagatgatgattggtggtcttgggatgaaaagtatttgtgttgtgataacggtgttggggtaagggactctgtgtgctgtgtctgctttctctaactgagtggtactataatgggtctagagggaggagcgtcagcattaacaggagacttgctgtaaaaagctaattcatggacccttttcaaacctgcagaattttgttacttacagtgaggcctacaatatcaaataatgtatatgtacaatgaagcttgagaggcagtgcttagctaagtgactctcagcccagtcttccagtaggatcacatggacagtttgaagagaaaccatcagctgtgttctgcccacagatcctgtccattgttctgggtgaaaagtccttatttattttatttttgattgttgttgtcccagatttattgaaaataatacagcactacagaaaaaattcaaacaggtccccgaggcattttgaaattcatcccaactgtaggctgagtgacctgaaggttgaacagactgccgaagtccaaaagcttcagcatttccttagtgtcaggatctacttcaattatctcctgatccaaggctgagaccttattttttaaaatcagttccttgcgtggttaaaaaagtattaaaaaagttccttgcatgattaaaaaagtattaaaaaagttccttgcatgattaaaaaagtatttaaaaagttccttgcatgattaaaaaagtccttatgttttaaaatcagttccttgcatgattctacagcaaggccagggtgaagcatgagggcttccagatactttagtgaaaggtgagttcaccctttgttccaggaggtcacagggcctactctgcttgattttggtaggggaaggtcagtgtagcccattatttttattgcagcaacagaaactcttggaatgccatcctttttctgcagagctatagaatactttagagaatattactgcgttgaaagttattttatcagataatcccagtcagtcacatgtcagaactagcgctctcaactcatttcacctgtagtcaaattaagaactatgtcccttcggctgggcgcagtggctcacgcctgtaatcccagcactgtgggaggccgaggagggcggatcacaaggtcaggagatcaagaccatcctggctaatatggtgaaaccccgtctctactaaaaatacaaaaaatcagctgggcgtggtggcgggcacatgtagtcccagctacttgggaggctgaggcaggagaatggtgtgaacctgggaggcggagcttgcagtgagccgagactgcgccgctgcactccagcctgggtgacagagcgagactccgtctcaaaaaaaaaaaaaaaaaaaaaaaagaactatgtcccttgatatatttgtattttcaggaactcttaacattcagggatgtggccatagaattctctccagaagagtggaaatgcctggaccctgaccagcagaatttgtatagagatgtgatgttggagaactacaggaacctggtctccctgggtgaggataacttcaatacataattcctaatttttctcagagctttattttattcctttgaagaatttctcctgggaacttttatgttttatctttacataaaccttctcttttcttgagctaatttgagtccttcactctaggttagtggtaattctagaaattcaatgacataaaatattgtttcccacatcttaaaatccaatttgcaccacttattttttattcggtagtacttggtagtggaacttagaacccgcagatttaaaatacttaaatattctaaagattctgtcaggaaacaatttttggattaattttctagaatcttccataatatctctattctgcttagcgtagtactaggttggtaattggagaatccccatcaatagtcatgttattattttttttaaaataaaacaggtgttgctatctctaacccagacctggtcacctgtctggagcaaagaaaagagccctacaatgtgaagatacataagatcgtagccagacccccaggtaggtgagagtgaatggaggagagggcacaggcaaggggaccaaaggtcaagaaggaagccaggccttaaaatgtggtttggggccgggtgcagtggctcatgcctgtaatccaaggactttgggaggccgaggcaggcggatcacgaggtcaagagatcgagatcatcctggccaacatggtgaaaccccgtctctactaaaaatacaaaaattagctgggcatggtggtgcgcacctggagtcccagctactcgggaggctgaagcaggagaatcacttgaacccaggaggcggaggttgcagtgagccaagatcacaccactgcactccagcctggtgacagagttagactccgtctcaaaaaataaaataaaataaaaaataaaccaggtagtttgggaagctctgctccagtgaaaataatttctgaaaaagctgcattttttctcatgttcacaaataggggcatcttctgttccatgctgttaaatccaagaattctcttttttctttagtgatctccctttaagtttacagggagagctaatgtccactttatcgcttataaggggctgcatgatgtgactgctgttccattgcttttggagacactggaatatttgtgttactgaggagctgtatgtcaaagtatttttttcaagtattcttttcgtattatgtctaaaatgtgtaacgtgagtagtggacatagtgggatttggttcagaaatcccaggaacaccaaggacagatgttgcctcttttctacttagtgttttttaatcctatggaggctgcaaatgtaattctacaaaaattcttacttagcaattttatcagaacaataagcatttcctaaatatgaaaaaaagtaatgttattttacttcaaaattactgttttagtataaactcgtttgtaatgtaaactctatatgtgcaaattttgaaattataatatagtttaaagcatggatttccaacattttggcttccctgggccacattggaagaagaattgtcttgggccacacataaaatacactaacactaatgatagctgatgagctcggatcatctgagatcgggagtacaagactagcctgactaacatggagaaaccctgtctctactaaaaatacaaaattagctgggcgtggtggtgcattcctgtaatcccatctacttgggaggctgaggcaggagaattgcttgaacccaggagacggaggttgcggtttgccgagattttgccattgcactccagcctgggcaacaagagtgaaactctgtctccaaaaaaaaaaaaaaaaaaaaagtttttgaaaaatttttgtgatatcctccaccacagaagataagcaaaaaaagtccttgcattcaaagggttggaaaccactggattaaagtatctactcaccttctatatttcttaaatgcactgtatcattaacaagcataaatgtgctatgtcattaaccagcatagaacattactaagtgtatattaagctctcaattgttctcttatttgttaatagctattataattttgtcttagtaggaagtctgttgagattctgtcattgagatgtatctctctgtagctatataaaaatgtgtgtctcacacacacacctatataacttatttaagtgtgtagtaaattctcacttaacattgttgataggttcttggaaactgagggaagcaacatattaagaaaactaattttaccagagtttaattgataaccagagtttaaaagataacgagttatgtttgaatggcatatagcaacattatttcatttaacaatgcagtttttaagaacctaatttgaacattaagtgaggacttactgtacatctgtgtttgtgtgacatggatttttctgataaataaaaattatgtaactttatatttaatgtgtacaatgtaatgatttgatatgcatctacattgtgaaacaatatagtcaagttcatgaagaaatctattacttcacctagataaccattttgtttggtagtaagaacacttaaggcctactgttgtagcaaatttaaagcatacattatagtattaactatgaatacaatgctattttggtaatctaatgctaatatacattaggtttctcagatttactcaacttataactaaaaatttgtgctcttgaacaacatctcatattcccaccctaggcactaacaactaccattctgctctctgcttctatgagtttacgcttttagatttcctatctaactgagaaaatttagtttctttgtctttccgtgtttggcttatttcatttagcataatgccctccaggtctatccatgttgtaaatggctagatttccttctcttttatggttgaatagtgtcctgtgtatgtgtgtgtatatatatatgtatatacatgtatgtatatatatgtatacacacacacacacaccgccccccccatatattggctactgtaaacggtactacaataaacatggaggggaagatagttctttgaggtactaattttatttcctttggtagtatgcccagaagtggtattgctggattatatgatacttctagttttattctttttttttttttttgagatggagtttcactcttgttgcccaggctggagtgcagtggcacgctgttggctcaccacagcctctgggtcctgggttcaagcaattctcctgcctcagcctccgaagtagctggaattacaggcatgtaccaccatgcctggctaattttgtatttttaatagagacggagtttctccacgttggtcaggctagtctcgaactcccgacctcaggtgatccacccgtctcagcctcccaaagtgctgggattacaggagtgagacaccacgcccggccaagttttttttttttttttttgagactgagtctctctctgtcgcccaggctggagtacagtggcaggatctcggctcactgcaagctccgcctcctgggttcacgccattctcctgcctcagcctcccgagtagctgggactacaggcgccttccaccacacccagctaattttttgtatttttagtagagacagggtttcgctgtgttagccaggatggtcttggtctcctgatctcatgatccgcctgcctcggcctcccaaagtgctgggattacaggcgtgagccaaggagcccggccgcgcccagcctagttttattctttactgtatttttgtaagtttatcaatttgcatctcaccaccagcatacaagatttcccttgtatgtatttcttctttgggaaaaaaaaaaaatctaaccttttgcctattttcgaatgggttattcattattattgttttgcttttttgctttgaattgcagaagtttgttacacattttggatattaacttttttttttttttggagacagaatttctgtcgcccgagctgaagtgcagtggcacgatctttgctcactgcaacctctgtctctcgggttcaagcgattctcctgcctcagcctcccgagtagctgggattacaggcacgtgccaccatgcccagctaattttttgtatttttagtagagacgaggtttcactgtgttagccaagatggtctcgatctcctgatctcatgatctgcctgcctcggcctcccaaagtgctgagattacaggcctgagccaccacacccagctggatattaacttatcagatatggcttgcaaatgcttttctattttgtagggtttttaaaaattttgtttttattttttcctttgatgtgcagaggctgtttactttgatgcagtctcacttgtttatattttattttgttgctgtgctgttgatgtcatttcaaaaaaagttattgccgagaccaatatcaacaaggtttttccatatgttttcttcatgagttttaagatttcatgtcttaatttcagtctttgttttgaagtctgaaattagaaagcatgatgcctgccagacaaggtggctcacacctgtaatcccagcaccttgggaggccgaggtgggcggatcacttgagatcaggagttcaagactagcctggccaatatggtgaaaccctgtctctactaaaaatatacaaaaactagctaggggtggtagtgggcgcttgtaatcccagctactcgggaagctgaggcaggagaatcacttgaacccaagaggcagaggtttcagtgagcctagatcactgaacctagattgtgccactgcactccagcctgggtgacagagctggactccatctcaaaaaaaaaaaaaaaacaagtatgatgcccccagctttgttctttctcaagattgattgctcaggttattaaaagtcgtttaaggttacacctaaattttacaattgtgttttctattagtgtgaaaaatgccaataaaattttgatagggatcacattgaatctatagatcactttggataatattctttgacaatattagttatcctaatggaatatgtttccatttatttgtttctacttcactttctgtcattgatatcttattgtatttagtgtataatactatatgttttttatgtcatttggttaaatttattttgattaactttcttatttttatactattgcaaatggaaatggtttctatttttggaaagtttgtttttactctatggaaatgcaagaaatatttgtatgtggtgccaggtgcagtggctcatttctgtgatcccagcactttcagagcccaaggcagttgtatcatgtgagtacaggagtttgagataagcctgggcaatagagtgaggccctgtctcaaaaaaaaaaaaatcccaacaagcatctatatgttgattatgtatcctgatactttaatgaatgcatttattagttcaatcaatttttcttattttactctagggttttatgtatatgcatgatgatattatccacaaacagtaacttttttatttcttttccactctggagagctttattctccttttccttgtctaattgttttgatacaaacttccagtcacatgttaagatagaagctgtggccctggaggcaggcctgcaagtcttgtccccggctgtggtctctgaagcagccctgtgtctgcatttgacaaatttcacagtttgtataaactatttttggcaggtaaagatctccttttgttgagtcccaggctgatgagattacctctggggttgcagagaagaagggttgtagctgggtcacaagggtgctgctgggtctgctgtggggtctgcctttgatgattgtattaccagagatttggacagtcatggattatttctgggccctggagagattagatttccttgaggatattaatctatatggcaggcagtagactagggttttgaagtttgtctgcatatgatgggccaaataccaggtgtatgaatgggtttggcttctactgacaacctgggaacagtttccacacttttctctttgggtccctgattgtgtacaactggccatggactgtgactgtgagggctagaactgagtcacagggctcaggagcacagctgaggccaggatatacaggcctgcctccagggccatggctgggtgtgtatctccctgcaggtctcttgatgggaaggaccacgtctggactgtagctgagattgaatttgagagaggttacagaactgcttcagaatcctcagtaagaccaagctcagtgtgccatttccttgtctgtagccatgtctatgggctcttgagttggccatctgagtgagggcctgcttattctaaataaccctcgatctctggctccactgaggtttcacaaccctaaccataggcaagcacctttctacttctgctttctatgtgcttactacttaaaatattgtataaaaatggaatcatgcattgtcactttgttagcgtcttatttcactaaaataatggcctcaggatttatccttattgtagcatctgacaagacattttcatttgaagctaaagaatatttcattgcgtgtataagccacatcttttaaaatctttcattcattgaaggatgtttgaattttttcactttttcacttttgtaaattatacggtttggatctatgtccccattcaaatctcatgtcaaatgtaatccctattgttggaggtggggccttgagggagatgattggatcgtagggttggcttttcatgaatagtttagtaccagcccctttggtactgtctttgccatagtgagtgagttctcccgagatcttattttttatttatttattttttgagatggagtctcgctctgtggctcaggctggagtgcagtggcatgatctcggctcaccgcaagctccacctcacgggttcatgccattctcctgcctcaacctccagagtagctgggattacaggtgcttgccaccatgcccggctaattttttgtacttttttttttttttagtagagacggggtttcaccatgttagccaggatggtttggatctcctgacctcatgatccgtccacctcagcctcccaaagtgctgggattacaggcgtgagccaccgcgcccggcctgagatcttattttttaaaagcatgtggcacctcccctctcactcttgtcttgctcctgttcccactgtgtgagatgactcactctccctttgctttgtgccgtgactggaagctttctgaggcctccccaaaagtagaagctgctgtgcttcctgtacagccttcagaactatgagccagttaaacctttttttttttttttgagacagagtctcgctctgccactcaggctggagtacagtggcgcgatctcggctcactgcaatgtccgcctcccaggttcaacttattctcctgcctcagcctcccgagtagctgggactacaggtgcctgccaccaagcctggctaatttttttaatttttagtaggggcggggttttaccatgttagccaggtggtctcctgacctcatgatccgcccctcggcctccaaaagtgctgagattacaggcgtgagcaaccatgcctggccggagaaacatttatacttccatatacttgttgaagtataaaatgtaagtgccttacaattttctttcctcctaaaacataagcactgagtttgaggcattttcctggatttttcaaccactgagttctttttatataaaactaagtgaataaccttgactgggaatccgagacctaagcctgttgactgcagggtaaggtcaatcttgattctgccaaagcaggtcatcaatagccccgtaatgtgttgctggtgaacctttctttcaggtgtctcagcctgctcaaattagacagggaaggagccctggaaagctgggtatccacaggcagaggcagtgagggtttggatgagaggaggttgtgatatcctctgagagggtgtaattgttattgtcatggggctgtttctacatattgtcaagtaaaataaattttgatgtaggtaagaagtgagtttattctaaggagtattgcagtggggaaagcatcaagcataagacctgaagtcatctccaaaatgaggcagaaaaaggctatttttcatacagaggagcaaacaagattagaaacaaggtaggagggccaggcatggtggctcacgcctgtaatcccagcactttgggaggccgagacgggcatatcaggaggtcaagagatggagacaatcctggccaacatggtgaaaccccatctctactaaaaatacaaaaaattagccgggcgtggtggtgggcacctgtagtcccagctactcagaaggctgaggcaggagaatcacttgaacccgggaggcggaggctgcagtgagccaagactataccactgcgctccagcctggtgacagagcgagactccgtctcaaaaaaaaagaggaaggtgggagagggagaaggcagaatggagaatggcaaaatcagattcaggattggagaatgtttcaccctgaagtcagcctgttcttgggaggggcatcaagaggggttgtatgctagctcagactgaaggtggagcagagtccaggggcctgggggaatgtagagtttgtgaatttgtgatatctaagagggagcatcttcaaaatcatagtgaaaagggtatttctttgcaataagcgtttcttgcggatcacaaaggattggagagaccttagtcatagctatttaccaagattcactacccacctcatcttttcccccactttcctttgtcctatacattttttccctttggcttttactgagctgtattcaatataataacctggaaaacatataaatcgtttttgctaagttctgtgagtagttttatcaaattattaaatttgagggagggagttagggaagcccatgatttatagtcagttgctcagaagtgtaggtgggcccctggagtttgtgactggcatgtgcagcggaagcagtgttgtggaactgggtctgaacttgtggggtctgtgctgaccctgggtgttgtcagaattgagttgttgggcacccagtttgtgttggaggattggttggtgttcagcaaactccatatatttggtgttggaataaagataatcaggctggatgtggtggctcacgcctgtaatcctagcactttggaaggacgaggagtgcagatggcttgaggtcaggaattcagcaccagcctgggcaacctggtgaaatcccacctctaccaaaaatacagaaagttagccaggcatggtggcacgaacttgtattcccagctacttgggggactgagtctggaggattgcttgaaccctcagaggtcaaggctgctgtgacctgagatcatgccagtgcactccagcctgagtgacaaagtgagaccctgtctaaaaaaaaaaaaaatcacagcagacttggtcagaaggagatggtgggtctgttgaagaatggagagtttattaatttattattattattattatttttttttttttggagacagagtctcactctcgtccaggctggagtgcagtggcgagatctcggctcactgcaacctccacctcctgaattcaagtgattttcctgcctcagcctctcaagtagctgggactacaggtgtgtgccaccatgcctggctaattttttgtatttttagtagagacgaggtttcaccatgttggccaggctagtctggaactcctgacctcaggtgatccctccaccttggcctcccaaaatgctaggattacaagcatgagccaccactccccgctgagagttttacttcttttgcacacaagttgtcacagttaggtgtaatgtgattctacgtctcctccataggggactgaggacttaaagggaaggacttctgagggcagactcttctctccacctgctgctacaatgtgatttctgctcattcacacacatgcacgctaagcaatggtatggccgtgcttctctcatgacaaagcttcactcaggaattgtgctgagagcacctctgcttctagggttttccactaataggctacataagtgcccagaagactcatgggctctttctacctgccagatcttgaatctgcaccagtaacctgttttctccagtagaataggcttctggatcacctgaccatctcatctccctgtatgcacacatttataagtcagaggtgccctgcctgggtgaatatctagagcactaaccagtccttttaccaactgtgcactgatcctcacccatggttcttgatagcaccttttcttattctgcattttccccccacagaccctctctcatgtgaacacagcatgcccaaggtcaccctgcaggtgcctaagtccagggcctgctggaaatcaggtttctatgagttcaaggcaaagtttttgggtgtggttattgtaaatgtaaatgcaaaatagaaataagaggcttaatcctcacattggaaaataaagagtatttactctcctcccttttcttaaaacctttgatttagaaaacttttatatgtaaattctttctgtgccttttatcttttttgttgtcttttaattctctaatttgtttctggtctgatttttgttattttgtttattatgctaacattgggattatttagttatttttcaagtttttgaggattaaagttggtttatttgagatttttaaaatataaaatatattactataaaattcccagaactgcttttgttacattcatttttatatattatgattctattttcatttttctcaaatactttatgatttccttttaccttctttgacccattggttgttcagaagcatgttgtttaatatccatttatttgtaagttttaaaatttccttccggtgttgatttctagttttataaaattgtgatttaaaaacttgatatgatttcagtctgtttaaaaatgaaaagacttgtttatttttgttgtgggccagatttatgacaggtcttggagagtgttccatgtgtgtttgagaagaatataaattatactgttactatcatatttgtttttttctccagtttagttaacatatgtttatatatttgtgtgctccaatattggatacataaatatttttaatcgttatattcttttgacaaattagcctcatcactatataatgaagtttttttaatgacgaatttttttctttattttattttatttatttatttatttattttttgagacagtctcactccgtcacccaggctggagtgcagtggtgcaatcttggttcaccacaacctcggttcaccacaacctctgcctcccaggttcaagcaattcacctgcctcagcctccctagtagctgggattacaggtgcccaccatcacgtctggctaatttttgtatttttagtagagacagggtttcaccatgttggccaggctggtctcgaactcctgattgcaggtgattctgctgcctgggcctcccaaagtgttgggattacaggtatgagccatcgtgcccagctatgacagatttttttctagatgtctatttagtctcatataaatataggcattcctacactttttaagttattattggcatggaatattcttttcatttttgaatcgttaacctatgtatttccttaaatctacagtaagtctctagtttgcagcatattgttgatttttaaaatcgattcagacattctgtgaatgttttagattgttttttgcttaataacaatattctagggttggtaatttataaagaatagaagtttacttagctcacaatcctggatgctgagatgtccgagagcatgtcattcccacctcatgagaatcacatttccacatcacaacatgaccaaagtcttgaggatgatggaaggtgtacaccagagctcacttttgtaatagacccactctcatgatgactaacgcactcttagaattataatactaggctgggcacagtggcttacacctgtaatcccggcactttgggaggctgaggcgggtggatcacaggtcacgagtttgagaccagcctggccaagatagtgaaacccccatctctactaaaatgacaaaaactagccgggtgcggtggcggctgcctgtaatcccagctactcaggaggctgaggcaggagaatctcttgaacctgggaggcagaggttgcagtgagccgagatcatccaccgcactccagcctgggtgacacagcaaggctccgtctcaaaaaaaaaaaaaaaagaataatactattaatcctttcataaaagtagagccctcatgacctaataacttcttaaaggcctcacttcttatttgtttgtttgttttttgagacagagtcttgttctgtcacccaggctggagtacagtggagtacagtgatctcagctcactgcaaccttcacctcccagattcaagcgattctcctgcctcagcctccccagtagcttggactacaggcgcgtgccaccacacccggttaattgtctgtattttttgtagagttggggtttcactgtgtttcaatctcttgacctcgtgatcctcccgcctcagcctcccaaagtgctggaattagaggtgtgagccaccgcacccgaccaaggcctcacttaattttatcacaatggcagttaaattttaacacgaattttgaggggacactaaaaccatagcagtgtgtttttattgcatagctaaatctttctatatttaaatgaattaccgattgataagaacttattactgccattttattcattgtttactgaccatttagtggtttctgttttttaattccttcatgctgtcatcttttgtgttttcttgaatttttgttttgtttttgttgccttctttttcttgtatgtgcatctactagttttttttttgtaatttccaagagacttacatgaaacctctcattttaaaattttgccttcaatttaaccttttgttttgtacagatagggtcttactttgttactcaggctatagttcagtggtgcattcacagttgagtgcagcctcaacctttgtgggctcaagcaatcctcccatctcagcctcttgagtagctggaactacaagcacatgccaccatattcagctaattttgtcagtgctttttgtagagacggggttttgccatgttgctcaggctggtcttgaactcctgacctcaagcacttgatttgacctcccaatgtactaggattacaggcatgagccatcaggcccagtcatttctttttttaaaagattgaatagctttctgagatctttattttatttatgtatttattttagagacagcgtcctgctatattgacccaggaggtggaggttgcagtgagccgagatgtcaccactgcactccagcctgagtgatagagtgagactctgtctcaaaaaaaaaaaaaaaagaatctctctttgtctttgaattctggcagtttaattataatgtgtcctgagcaatttttatgaggttcttgctatagagattttaagcttcataaaactgaatgtctattttccttccaagattgggaaaatttaagacattatacctttacacaattaaaaaaatttttttttctctgtctcctgaacctcttaagagatgtacattcctacagataattatgcagtgtgggacccaaatgcttcagtcactctttcttttttcttttttctttttttttttttttttgagacagagtctcactctgttgcccaggctggagtgcagtggcacgatcttggctcactgcagcttgcgcctcccggattcaagcaattctctaccttagtctcctgagtagctgggactataggcgcgcgccaccacgcccgactaattttttctttttttctttttgtatttgtagtagagacaggatttcgccatgttggccaggatggtctcgatttcctgacttcgtgattcgcccgcctcagcctcccgaagtgctgggattacaggcatgagccaccatgcctggcctcattctttaagttttaattaggaactttcaaatgacttacttttaagtttgcttatttttttttcctgtagaactgagtcttctgttaaagcttgttgttaaattttttagttctattgtgtactccagcatatgtatttggttcttttttaagtttctcgttcttttttttttttttttttttaaagatggagtttcgctcttgtcacccagactggagtgcaatggcacgatcttggctgactgcaacctctacctcccgagttcaagtgattctcctgcctccgcctcccaagtagctgggattagtcatgagccaccacacctggctaatttttatatttttagtagagatggggtttcaccatgttggccaggctggtctcgaactcctgacctcaagtgatccgcctgcctcagcctcctgaagtgctgggattacaggtgtgagccattgtgcccagctctccttcttttttataactcattttgttcatgcattgttgcaaaaaaaaattagtaatctgtgtacttttgcattttatttttcttttgttgtttttttgtttgattgtttgagatggagtcttgttctgttgccaagctggagttcagtggttcagtctcggctcactgcaacctccgcctcccgggttcaagcaattctcctgtctcagcctcccaagtagctaagattacaggaatgtgccaccacacctggctaatttttgtatttttagtagagacggtttcaccatgttggccaggatggtcacgatctcctgaccttgtgatccatccgcctcggcctcccaaagtgctgggattacaggtgtgagcctcctcgcctggactcttattgagattttttaagataattactttgaattctctgttagacattttctagatctgtgttttattgttagttgttcctggagcatttttagtttctttttgtgctgttaggtttgcctgatccttcataatctgtgaagccttgttttgatgttcttgcatctgaaggagtaaatacttctttcagtcattacagactagtttagggaggtaaatatcttctattggttttctgggctgatgagattttcactaggatcacagtcaactgcattggatcctggtcacgtaactactactgggtctacagtgaagttaatgcttggcagacctgttatttaagcatcagacagttgaggattccattttctgaggagactgaactttctttaagatcttgatcaataagactggtgctgagaaaaaaaaaacccagttaatatctgcaaatggagatgctgatacaataaatatgagtaggtgtggctcctgctgtttggctcttgcgagatgtttggaaatgctctaacctagtcattggacaggtttctagatgaccgttactgagcgttgatcacagctgagagggtgtgaaactaattcatagggctgcttcaggatacacagctgagaccaaagtcttcaggtttgttctgggttcatgacatttctccctccagatttctaggtgggcaggacttctccctgcctctagctgccagggactggagcttggttataggactgcttcacaattcacggtgggaataaagtcagccagcatgcctacagggacacatgtagctgtgcttttgggcaggtcacaggtcaggaaaaactcctcctggattttggttgcatggacttggagccaagttgtagtgccacgtcaagatccaccatcaaataaatattggcaagcctacatccaggggcagagatggatatttctgtctgtgggtccctgtgtgagtaggatttcttccacatcatgactgacatgtgcaaggggtgcagtttggggtaattcagagatcacagacagaagcaacatctaaaggcctttcacctgagacacaggacattatgaatcctcctaagtgtcttggcagatggtgctagtggcataaacaaaaccaaatgatagctatgtttacaatgagaattaattacatttcattctgtattgtgggcaagcatgccactcaagcaagggcacaccctctcaatacagccctcctcagtcttcggttcgcagtcttacacatggattccaaagttgccgtaaaggttgttttgtcagggcttaactgctgcatttttgttactgtagaaagtgtgggtagggagcctcctattctgccatcttgctatgccatatgttccgatatgttctatgtcaaatttatctgattacagattcagaatttctgaaataaagtactcagatttacacattgtgtaataagtaaatgtattgcaatgcttcattctcattagagcattttattaattattgaaatgcatttgcttttattgcggcgcatggcatgtcaaagattcaaaatgccagctcttcataagtcacagttgaaaactagttatttaaaggattgtttttatgatacgtctgtattatattcaatattttataggtcagaattttctcttgttttcaactgtattttactggggagtctcttttcatgtaggttctccttgatcatttacttttttgtgtgtttttaatcttcatatttgtatggtaattttcaactttgtaccttttatgaccatgtattgtttaattccaataaaaatcattggagcaagttaaaaaaatatacataaatatatatgtgacatttctgttgcctataaaagttatctatgtggtatttgcctgcaaaaatcactttgggcaaattttaaaaaatatataaatgcgaattttctattgcctataaaagttttctatatggtatttgcctgtataaatattgacctactttgtttataaattactcattttcttgggtagtcatcagtatttccttgtgtagatgagcagtcaaagaaactgtaaatttaccatctatttattgtttgattatatattattctgtgagagaagcacttgttatttgaaggtgatttttgaaaaatgtaaccgttttaggtagatgtaaatatttaattgtgatgaaaaacataaaattgccatcttaaacattttcaagtacagtctagtggagctaagtacatttacattattttgcaatggatctttagattaattttatcttacgaaagtaaaatgtaataataaataaactgcccttttcctctcttcagctcttggaaaacaccattttacttactgtttctatacttttggctgatttttatatttgtatcactataattatataatgtctctttttgactattttttttaacggaatgatctcaggctttgtttttgtaagatgtgtcagaatatctttctgtttttttttttttttaagttctagggtacatgtgcataacgtgcaggtttgttacatatgtatacatgtgccatgttggtgtgctgcacccattaacttgtcatttacattaggtatatctcctaatgttatccctctccccgcccaaccccacgacaggccccggtgtgtgacgttccccaccctgtgtttgagtgttctcattgttcaattcccacctgtgagtgagaacatgcggtgtttggttttctgtctttgtgatagtttgctcagaatgatggtttccatcttcatccatgtccctacaaaggacaagaactcatccttttttatggctgcatagtattccatggtgtatatgtgccacgttttcttaatccagtctatcattgatggacatttgcgttggttccaagtctttgctattgtgaatagtgccgcagtaaacatacatgtgcatgtgtctttatagcagcatgatttatagtcctttgggtatatacccattaataggatggctgggtcaaatggtatttctagttctaaatccttgaggaattgccacactgtcttccacaatggttgaactagtttacagtcccatcaacagtgtaaaagtgttcctatttctccacatcctctccagcacctgttgtttcctgactttttaatgattgccattctaactggtgtgagatggtatctcattgtagttttgatttgcatttctctgatggccagtgatgatgagcattttttcatgtgtcttttggttgcctaaatgtcttcttttgagaagtgtctgttcatatcctttgcccactttttgatagggttgtttgatttcttcttgtaaatttgtttgaattctttgtagattctggttattagccctttgttggatgggtagattgtaaaaattttctcccattctgtaggttgcctgttcactctgatggtagtttcttttgctgtgcagaagctcttttgtttaattagattccatttgtcaattttggcttttcttgccattgcttttggtgttttagtcatgaagtacttgcccatgcctgtgtcctaaatggtattgcctaggttttcttctagggtttttatggttataggtctaacatttaagtctttaatccatcttgaattaatttttgtataaggcgtaaggaagggatccaatttcagcttttacatatggctagccagttttcccagcaccatttattaaatagggagtccttcccccatttcttgtttttgtcacatttgtcaaagatcagatggttgtagatgtgtggtattatttctgagggctctgttctgttccattggtctatatctctgttttggtaccagtaccatgctgttttggttactgtagccttgtagcatgatttgaagtcaggtagcgtgatgcctccagctttgttcttttggcttaggattgtcttggcaatgcaggctcttttttggttccatatgaactttaaagtagttttttccagttctgtgaagaaagtcattggtagcttgatgaggatggcattgaatctataaattaccttgggcagtatggccattttcatgatattgattcttcctatccatgagcatggaatgttgttccatttgtttgcgtcctcttttatttcattgagcagtggtttgtagttctccttgaagaggtccttcacatcccttgtaagttggattcctatgtattttattgtctttgaagcaattgtgaataggagttcactcatgatttggctctctgtctgttactggtgttataggaatgctcgtgatttttgcacattgattttgtgtcctgagactttgctgaagttgcttatcagcttgagattttgggctgagacgatggggttttctaaatacacaatcatgtcatctgcaaacagggacaatttgacttcctcttttcctaattgaataccctttatttcttttctcctgcatgattgccctggccagaacttccaacactatgttgaataggagtggtgagagaaggcatccctgtcttgtgccagttttcaaagggaatgcttcctgcccgggcgcagtgggttacgcctgtaatcctagcactttgggaggccaaggcgggcagatcatgaggtcaggagatggagaccatcctggctaacaccgtgaaacctcgtctgtactaaaaaaatggaaacaactagccgggtgtggtggcaggcacctggagtcccagctacgcgggaggctgaggcaggagaatggcatgaacccgggaggcggagcttgcagtgagccaagatcgtgccactgtactccagcctgcacgacacagtgagactctgtctccaaaaaaaaaaaaaggcgggggggaatgcttctagtttttgcccatttagtatgatattggctgtgggtttgtcataaatagctcttattattttgagatacgttccatcaatacctagtttattgagagtttttagcttgaagggctgttgaattttgccgaaggccttttctgcatctattgagacaatcatgtggtttttgttgatggttctgtttatgtgatggattacgtttattgatttgtgtatgttgaaccagccttgcatccctgggatgaagccgagttgatcatggtagatgagctttttgaagtgctgctggatttggtttgccagtattttattgaggattttcacatcgatgttcctcagggatattggtctaaaattctctttttttgttgtgtctctgtgaggctttggtatcagaatgatgctggcctcataaaatgagttagggaggagtccctctttttctattgattgaaatagtttcagaaggaatgataccagctcttctttgtacctctggtagaattcggctgtgaattcatctggtcctggactttttttggttggtaggctattaattattgcctcaatttcagagcctgttattggtctattcagagattctgtttcttcctgctttagtcttgggagggtgtatgtgtccaggaatttatccatttcttctagattttctactttatttgcatagaggtatttataatattctctgatggtagtttctatttctgtgggatcggtggttatatcccctttatcatttcttgttgcatctatttgattcttctctcttttcttctttattagtctttattactcttgctagagtccactccagactctctttgcctgggtatcaccagcagagactgcagagcggcaaatattgctgcctgatccttcctctggaagctttgtcccagagggtcacctgcctgtatgaggtgtcagtcgactcctactgggagatgtctcccagttaggctacataggggtcagggacccacttgaggaggcagtctgcccattctcagatctcaaacaccatgctgggagaaccacgattctcttcagagccatcatacaggacgattaaatctgcagaagtttctgctgccttttgttcagctatgccctccccccagaggtggaatctacagaggcaactggccttgttgagatgcagtgggcttcgcccagttcaagcttccctggctgctttgtttacttactcaagcctcagcaatggtggacgctcctccccctgccaggctgctgcctggcaggtcaatctcagactgctgtgctagcagtgagcaaggctctgtgggtgtgggacctggcaagccaggcgtgggatataatctcctggtgtgccgtttgctaagaccattggaaaaacacagtatttgggcaggagatcccgattttccagatacagtctgtcacagcttcccttggctaggagagggaaatcccccaaccccttgtgcttcccaggtgaggtgatgccccaccctgtttcagcttgccctcagtgggctgcactgcacccactgtccaaccagtcccaatgagatgaaccaggtacctcagttggaagtgcagaaatcacccgtcttttacgtcagtcacgctgtgagctgcaaaccagagccgttcctattcagccatcttggaacgggaggtctctgctctatttttaaattgtgtgttatttttgttgttaagtttgttaaatattctataagtttatcttttgttgtgtatatttcacaaatattttctttcattctgtagattatctcttcactttgttaacgttttctttgctgtgcaaaacatttttagtttgttgtaatcccatttgcataatgttacttcttttgcctgtgcttttgaggtcttacttaaaaattctttgctctgtaatatgtggtaaagcattcctctatgtttatccaaatagctttataggtttgggtttcacatttaaatctttatttgcgattgagttttttatactgtaagagctaggggcctagtttcattttttgattatcatgtaggtaatcaattttcctagcaccaattattgaaaagactgtctttttccaaatgtgtgttcttgacatctttgttgaaaatcacttgcctctagtttcatgaatttattactgggctcactggatagtttgatctgtctgtttttatgccagtatcatgttgttttgcttattatagctttatagcatatttcggagtcaggtagtgtaatgcctccagcttgattctttttgcccaggattacctttgctatttgggggtctttggttggtcctggttaattttaagcttgtttattccattgctgtgaaaaaagtctttggtattttgatagagatggcattgaatctgtagatcaccttgggtagtatggccactttcgtaatgttttttcaattcatgaggaaaaatatctttcaatttttatgtctttttcagttttttatcaattttgttgttgtttgctttttgagacaaagtctcaccctgttgcccaggctggagtgcaatggcacaatatcagtgcaccacaacctctgcctcctgggttcaaatgattctcctgtctcaacctcctgagtagctgggatgacaggcgtgtgccgccccactaatttttgtatttttagtagtgacggggtttcaccatgttggtcaggctgctctcgaactactgacctcgtgatctgcccaccttggcctaccaaagtgctaggattacaggcgtgagccaccacacccagcattatcaatgttttataattatcagtgtagagagtgttcaccttttcaattcggtttgctgctagacatattttattttatttatttaatttgggatggagtcctgctttgtcgctcagactggagcgcactggtgcgatcttggctcaccacaacctctgcctcctaggttcaagcaattctcctgcctcagcctcctgagtagctgggagtagctggactgcacctggttaatttttgtatttttaggagagacagtgtttcgccatgttgaccaggctggtcttgagctctggacctcaggtaatcctcctgcctcagcctcccaaaatgctaggattacaggcgtgagccactgaacctggccaactggtggatgtagaagcaacactggcaaaattgaacatggctttgtgatttaagaaactcaacgaattaggtatagatcatatgtacctcaatacagtaaagaccctatatgacagattaatagctgatatcatactggataggaaagagcagaaatcttctttttttgagatctggaacaggacaagtatgtttttattttatattataattgtgtatgacagcattcagctgtgtacactgtaagactggagcacaagtgaaatatggatcactgatatgtctatttccaatatgagtctatctgtatgtgtattggttttgtattgtttatgagttgtttacttgttctgtttatgtgtgttcaatggtggttttgaatagtcattgaaatcctcctaattttactttctatttatttgtaaatctatatttgtgtgtgggagaaacacttttgcgacttgaagataagttcaaaaactgtcatatgtctgtatctcagattttagatactatttttaattgtcaaaaacacataaactttacaatctttttttttttttttgatgtggagtctcactctgtcacccaggctggagtgcagtggtgcgatatcagttcactgcaacctctgcctcccaggttcaagcgattcttctgcctcagcctcctgagtagctgggattacaggtgcgcaccaccatgcccaactaatttttgtattttttgtagagacggggtttcaccatattggccaggctagtcttgatctcctgacctcatgatctgtccgccacggcctcccaacatgctgagattacaccgcgcccagccaaaactttacaatcttaaatactgtttttttccaaagtttgttgtcataatttaagttctggggtacacgtgcagaacatccagattttgttacataggtatacacgtgccataaatacttttaagtatttaccttagtcatattatatcgatattcttatgcactctgtctggaatatgtttatcttgcaaggctaacactcatacacattaaacaactacctactttttctgttttctggccctttacaaaaacaattctgttttctattttagagtcagactgctttatatatctcatgtaagttgactcatgcaatttttgtctcttcatggctgacttattttgtgttacacagtgccatcaacatttatctttattatacatattaggatactttttgctttttataaacagtaatgtttcatttttttaaaggattttttttttgagacagagtcttgctctgtcacccagtcagaatgtaagtgcagtggcaccatctcagctcactgcaacctccacgtcccaggttcaagcaattcttgtgcctcaaccacccaagtagctgggattacagacgtgcaccaccacacccatctaatttttgtatttttagtagagacagggtttcaccacattggtcaagctgatctcgaacacctgacctcaagcgatccacctgtctcggcctcccaaactgctgggattacaggcatgagccaccatgcctggccaatcggccaatgtttcattattttaatatttcaaattatatttatccattgatttggtgagagaaattttcattactttcatttatttgctttcagtaacaatgctacaataattgtgagtgtccaaattactctttatatgaccatatgtgtgagagttcatatttttgccggattttattgatttaggtgttcaccttcatactcataccaaattgctttaattctttagctttgtatgttttttgaaatcaagaactgtagtgtttctgacattgttactctttttgaagattgttgagtgcttcattgtttcttgaaattccatataatttgggggttgctgtttctttttctggaagaatttaattagaaatttgacagggattgcatttaatctggagattgcattaaggaatttagacatcttctttttaggcaaaattgttttatactgctttcaagtcttctattcctttatgaatattctgtcttgtttcattattcattatagaaattggggtattgaaatatcctactacaattacattgctccctatatcttgctttaattctgtcagtatttgctttgtatattttgaaccctagtgtaagatacacacacacacacacactcacacacacacattaatatatgtatacccacatttatcatgggttctaagtaaatgaacttgtttattattgtttaatgtcttcctttgccccttatgagcttttagttaaagtatattttatgaaatagagtttttgacttaagatgtactttgtgttatataacttggacctgttctcctcttatttggttatttccatgaaatgtcttctttcatcttgcctttttcagtctcctttaatcattagacctcaagtgactcttgtagaaaaacaagttggatcttgttttttaatttttgcaatcagtccctttatttggtgcatgtattttgaatggaaagtttacttcataaatatttgaataatttgctgaaatagaaaggcttacctgttttataaattgttttactggattattttatctctgtcccttattttctttttctgtcttcctgtttgtcttttagatttttgtgttgataggactttacttcttatacttttgtgtatctatacctttgtggtatcttgggaattctgaaaaatttcttaaagagatatatatatatatatatatatatatattttttttttttttttttttgagagggagtctcactgtgtcgcccaggctgaagtgcaatggcatgatctcagctcactgcaacttctgcctcttgggttcaagcgattctcctgcctcagcctcctgagtagctgggactacaggcacacgccaccatgcccagctaatttttgtatttttagtagagacggggtttcaccatgttggccaggatgatctcgatctcctgacctcgtgatccacctgcctcagccgctcaaagtgctgggatcacaggcatgagccactgggcctggccaaaataatatattttaaactcttaaaaatgtaacttgaattgcatttgaaaattcttcctctttacatctgccctgaatgttgttattgatgtcactaatcatatttttttgctgtatatttattaccagattatgatgaatagtttataatcatttttatgcttttatcctttaaattttagagaaaaacttttttgcactattataatgatacagaactttatatttgtgtttgtgcatatgtttttcagaaagttatgtattttcatatcatcatattttttttcttgcatcctgttattttcaatggaagatagttcagcatttttttttataaggcaggtgttgtgctaatatacttttcagcatttggttatcttgaaaggcctttactttttcttcatttttaggactgttttactggttatattattcctacttagaagctatttttccttcagcacgttaactatatcgcaactttctcttgtctgaaaaaatgttgacagattcacttgttatcttataagagcatacttacaaatcacacatcacttttatcttgccgcttctaagattccatttttgcctttgacttttaaaactttgcttattatgtgctttgttataaatctccttgtatatcctagttgaagtttgttgagctccttcttttttttttgaaatgaaagtcttgctctgttgcccaggctggaatgcagtggcacaatcttggctcactgcaagctccgcctcccaggttcacaccattctcctgcctcagcctcccgcatagctgggactacaggtgcccaccaccacgcccagctaattttttttgtatttttagtagagacagggtttcaccgtgttagccaggatggtctcactctcctgacctcctgatccaccagcctcggcctctcaaagtgctgggattacaggcatgagccaccatgcctggccacatctttttttaacttttgaaaatttctcaggcattatttttgtatttttcacctccatgttttttatatttttaatgttttcatttatatatatatatatattttaattatatttagttttgttaccatttagctcattgagttttattcaggtcaaattttaaaactttgtacatcttcatttttaatttttgttctggaattttttttttttttgagatggagtctcattctgtcacccaggctggagtgcaatggtgcaatcttggctcactgcaacctccacctcccgggttcaagcaattctcctgcctcagccttccgagtagctgggactacaggcatgggccaccatgcccagcacatttttgtagttttagtagagacagagtttcaccatttgggccaggatgttttcaatctcttgacctcgtgatctgccctcctcggcctcccaaagtgctgggattacaggcatgagccaccatgcctcaccttttgtgataatttgtgtgtgtgtgtgtgtgtcagagtctcgctgtgtctcccaggctggagtgcagtggcatgatctcggctcactgcaagctttgcctcctgtgtttacgccattctcctgcctcagcctcccgcatagctaggactacaggcacccatcaccacgtctggctagtttttttgtatttttagtagggacggtgattcaccatgttagccaagatggtctctatctcctgacctcgtgatccacccgcctcagcctcccaaagtgctgggattacaggtgtgagccaccatgcccgttcccttttctgaaaatttttaaattgttggactgtgttgttctaatattttgtatacattgtcatgtttggttgttatttgtacattaacaaaaagctatttgtcacaatctttacaatgtagctttttcctgacatagtctgaaaccaattgtccttgatagagattatggtaacctctcatacatgttctaaggatgtgtcctctctggaattttgtgtttatttttcagttaaaagggtttgttcatgtttcttcttaacagtctctaatcacttgttctacgtgttgcctgtatttagcactgcagtctgctcctgaaacatttacatttgctttcagcagacccaatccctcccaaagtgtatcaccatttctatcagcactctgtggtattggagacagaaaccaggttttgtaaagacactcaaaagccagaagtaaggatatgtgtatcagtatttttcttctctttaaaggaagaagccaggagttgatacttcactcctaatggcacagtgctatattggggaggaggaagagctgttggtgggtaaatgtaacaaacattccttcctgttctatgtggctcttggcattttgcttacctgaggcattgcatacaattaactcatttatagatttcacagaaaggtgtctttgttagtatatgtttgctacatgtatatgtctgtgaagaagttatggcctgtgggattttgttatgccatcttactaatgtattttgaataatttcataagatttgtaaagtatatttatatgaatctactaagtgggataatttgtaatttttatttctttcagctatgtgttctcatttcacccaagaccattggccagtgcagggcatagaagattcattccacaaacttatactgagaagatatgagaaatgtggacatgataatttacaattaagaaaaggctgtaaaagtttgaatgagtgtaagttgcagaaaggaggttataatgaatttaatgaatgcttgtcaactacccagagcaaaatacttcagtgtaaagcaagtgtcaaagttgttagtaaattttcaaattcaaacaaacgtaagacaagacatactggagagaaacactttaaagaatgtggcaaatcatttcagaagttttcacacctaactcaacataaggtaattcatgctggagagaaaccctacacttgtgaagaatgtggcaaagcctttaaatggtctttaatatttaatgaacataagagaattcatactggagagaaaccttttacttgtgaagaatgtggcagcatctttaccacatcctcacactttgctaagcataaaataattcatactggagaaaaaccctataaatgtgaagaatgtggcaaagcctttaataggttcacaacccttactaaacataagagaattcatgctggagagaaacccatcacatgtgaagaatgtaggaaaatctttacctcatcctcaaactttgccaaacataagcgaattcatactggagagaaaccctacaaatgtgaagaatgtggcaaagcctttaataggtccacaacccttactaaacataagagaattcatactggagagaaaccctacacatgtgaagaatgtggcaaagcttttagacagtcctcaaaactgaatgaacataagaaagttcatactggagagcggccctacaaatgtgatgaatgtggcaaagcctttggacggtccagggtcctgaatgaacataaaaaaattcatactggagagaaaccctacaaatgtgaagaatgtggcaaagcctttagacggtccacagatcggagtcaacataagaaaattcatagtgcagataaaccctacaaatgtaaagaatgtgacaaagcctttaaacaattttcgctcctgagtcaacataagaaaattcatactgtagataaaccctacaaatgtaaagattgtgacaaagcctttaaacggttctcacacctgaataaacataagaaaattcatacttgagagaaatcctacaaatgtaaagaatgtggcaaacctttggatgatccacaaaccttaatgaacatgagaaaatttatactgtagagaaaccctggaaatgtgaagaacgtggcaaagttctttacctcattctcaaaccttgataaacataagagaattcataccggagagaaactgtacaaatgtgaagaatatggcaaagcctgtgaatggtccacaaacctgaatgagcagaagaaaattattactggagataaaccctgcaaatgtaaagagtgtaacaaaacctttaaacagccctcaccggtgaataaacataagaaaaatcatgctggagggaagccctacacatgtggcagaatgtggcaaagcatttaattggtcctcaatgcttaataaatataattcatgctggagagaaacttcacatgtgaaccgtgtggcaaagcctttaaatggtcctcaacccttaatgaacgtaagtgaattcatgctggagcaaaatgcttcacatgcgaagaatgtggcacagtctttaccacatcctcaaactttgttaaacataagagaatttataccagagagaaaccctacacatgtaaagaatgtggcaaagccttcaataggttctcaacccttactgtgcacaagataattcattctggggaaaaaaatgctacaaatgtgaaaaacgtggcagagccttcagaccatccacaaacctttatgaaaattcatatttgagagtagaagattcattccacaaacttacattgagaagatatgaaagatgaatataagaattcatcctagatataaaaccatagaaatgtaaaagatgtgacaaaacctttaagccatactccaggcttcttaaacataatgagaactcatactggaggaaagtcttacaaatgtgaagaatgtggcagtctttaaatcttcctcagtcttttctaatcataagataattcacactgaagagaaactgcaaacgtggaaagtgtgacaaagcttgcaaccacactcaatctattctaaatataagagaaatgatattggtgagaagccacaaaaatatgaaaaatgtggcaaagccttcaaatgcttgtcacatcttactgtatatatataattcctactgaagaaatcccctggaaatgcaaaaaatgtggcaggatttttaccaatgctcatctttttgcacatgatatcctttatattcgagaaaagttatagaaatataaaaaatatagaaaagtcatatctcctcacattttactaactagcaatgttcatacttaataaaaacattataaatgtaatttctgttgaaagacttcagaaaatataggcctttaaagtgaagaagagtattcttaagacaaacaatacaaatataaagagggttgtagtacctgtacttctctcatggattttgttgtacacattttataataggggaaaacactgaaggagactttcttcaacatcagaaaatttatattggagagaaatcctacaaatgtaataaatgtggaaaaacatttgttcaaaaactgcagcttaaacagtttacactagaaaatattttgtagatgcagtaaatgtgaagaaatatttagtctaaaaagaagagtatgtaaacatcagaggatttacagtagaaagaactaaggaactaacactttagacactgcagtaaatcagagtattaagtattaaaaaaatccaaagttgaacctattagagaatttctttgtatataagttgaaaagaagatttttgaagagatactacatttaaagtatattttttcacttgaaaaaagtatagattttttgaaaagcatataatagttaattcaactcaaattatttcatactgtttcaacattcctgtttatgtgaaagcatgtgatgaattgttgctgcatcagagataagagagattctttttcattaggtgggcattatttgtgaatttttacaagaaagagtgaggacagaaatgaaagatccatgatgaaaatctagcagagaggcttttttgtagttgacaatattgagtgatgcatgaggtaggtgttcagagtaatattcttctgcattatagtgagagaaaatctgttttagtagtaaattgttttaccaattatacatttatgtaataagatacagtaaattttaaaattattttaagattatgtgggaacataattttttaactaaacaaaatttttaacgtgttgaaataattgttgcttgaatgaagtgtcattatgccaccaacttaaacctatcccaccttactcaatggtgtaggtaaaagatggtaacaatggtaacatagttgaatgacatttttagtattctctttttccagtggctttaaatagcaaatacattgaagaatatcattcccatatgttgtattttcactcttgttattttccgaaatttttgtgggtacatagtatgcatatttatctatggcatatatgggttattttcttatacaggcatacaacatgtaatataccagagtaaatgagttattcatcacctcaagcattcatcctttgtattacacacaatccaattatacactttaattatttctaaatgtacaattatgattgtagtattatatcagtataattataattcatacatttatgcatcctgaatacttctaaaaaatgttttacatttctctttgaacatgtggcatcttttcctgcaaacttatacaaactttagttccatttacatgaagttaagtatgtaaatgtgttgctgtaaagataaaccttaggtgtaagaaaattatagagcaagcaattgtgtttatgtgagtttgtacctattttccaaagaaaatagcaatattagaacaaagaagattatgttaataccatggataatttactggaaatctagaagcctgaaacattctatattttcttctttttatttaatgactctagaatctaatggattgtcgttgagaatctccccatacaaactccttgtttttatttgtctggtgctcatgctagagctataatttctttgattctcttttttgttttcacttcatgaagtgtttattatgtgagctggtcagaaattataagaatgatttttataaaatgtagtgaatgtaaaatttttagatgtaatttcataatatatgtattaagttattttagttagaacatttcattttgttgttttaatttaagaaccctatataagctgttttctttagttattgttcctttcagtttttgtaattgacataaatgagtttattttgccaatttgttcaggtaagtacttggaaaactttgtcagtcatggggatgttttgatctattattgtagtgaacaaacaa

SEQ ID NO: 15927 - DNA, 20975 bp, Human
ggtgggacatactcagataggggctgggaaggctgggagcttctgctgagggtggcaccagcagcagctccatgactgtgactgcggccagggcggctccacgacggtgactgcggccagggcggctccacgacggtgactgcggccagggcggctccacgacggtgactggggtcagggcaggagagtgtggaggccagtgaggagggtccacacccatcggtgaggcaggagtcagggtaggctgcagacccggcggagattgcgaggcaggggtcagggtcactggagaaacatggctcaggaaaggcttcagggagaaaaaggtgttggacgagagaggctggtgctcaggggctgcaggggggccgggcctcagcagggagggagggagggactctgggaacagcagagccggcactgaggatgctgccagggaagggcactgacgtgcatggacctggaggatgccactggccaaaagctaggatctcactcacatgtgggatccgaaaaccctgaattcatggaaacagagagtggaaagggggttgcaggaggccggggcaggaagagagatagagaaagcagagacgttggtgaaagggtgcaaagcgttcgttagctggagctgtgggcttcaaggtcagccgcgctgtgtggcggccaccactgccgttaaccacagtacacagggtgctcggtaagtgcagttctgcttccgaggatttatgatgtgggaaaagttttaaattaaaaataagaataagaatgtaaaacaatacagtagaacagccgttttcatggccttgccttgcactgggtgctaagtcatcggagatgatttgaagtcctgggggtgcgtgtgcaacctctgtacaaactctaggccatttcacatccgggacttgaacatcctcggattttgttatcagagcggcgtcctggaaccaatttccctgaggatgccgagggatgactgtattgtataccaaattgctagaaaatagacttgtaatgttctcaccacaaaaaaaacaagttggtgaggtgatggatatgttgattagcttaattgaatctttctgcaacaaatacttacatcagaacatcacgccaaaccccataaaacataaaccccatcaatacacacaattattcaactgaagataaactaaaatcagtaaaatcaatgtactgggaaataaagctacgaacatctcactgcccttggcaacaggagagcctggtcctgttcccaccatgagctgagtgccagggggtggaacttcagagggcctggcagggagagagctgggctaggacaccgcagcggaggagagggagctggcaccatgcggtagaagacccagcggccgccgcgagtgtgaggaggcagggcctggtggggcctgggtctgggccttgaccaaggaggcagagaaaggtggcccaaggagggccctggggtgagtctgagcctggtggcagcgctgacccagcaaccaggggcctgtgcagcgggatgtcctgagtggggtctggccaggacctcgtggagtgcgtcagcaatgcttcactctcagacgcttggcggaggccacaggcggcctgacgtgcggaaaccacggcccgatgttctcaaagccctgctcgccgcaggtggttctggagcagccgggcggaggaagggctggtcggatgtttgcctgtcaagctcaaagcgacagattccactttccactcgtccactcctgagtgatcagggacacgaccgcagcctcgaggcctcaccgccagccagctcccgggccccacaagctcagatgaaacctggccacggagccaccaatcagggtctgtgccaggctccacggctgggcaggtggtcagatcagggagcgcacctgtgtcaggcttgagttaaacccctgctgctgtggtcagaccggcgtgagggtgggagtggccacaggcccacaggtgtgcccctccctccaggtgctgctgtggtcggccaacaaggtgtttgaggagctgacggacatcgagaggcagttccacaaggccttctacacggtgcgggcctacctcaactgcgagcggtactccgtgggcctcctggacatgaccaaggagaaggtgaggcttccgtggctcagggaccccctgcctggcccgacccaggtcccgcagtgaccgccccaccctcacctcttctctgcccaggaattttttgacgtgtggtctgtgctgatgggagagtcccagccgtactcgggcccacgcacgcctgatggccgggtgagtcttaggggaggggcccagggcctgtccacacgcctctgtttccctgactccaactccagggcaggagagggagggataggggtggggtttagggaggtgggaactggccggtgggaccccgggtgcctgtctgtggtctccaccaggctcccctgctgctgcactccagggatggggtgtccagggctggtccctgaatgagggccgccaggctggtcgtgaagacccacgtcggctctgattgtgggggctcctgctgccccatctccccacgtgggacctcctgtgcacgtgtaggatgcgtgtgtgtgtgtgtgtgtgagagtacgggcccagcttgtgtgtgggattgtgcggaacacagactgggaagacagatgtaaaccgcggcgtgtgatgcgtgtcccgtgagtattggggacggtctgcatgtgtgtgcaccctgagcctgtgcatgtgtggacatgggtgtgagtgcacccgcattcgtagaatacctgcgcacggcggagacatctgttcacgtgtgtacacatgcacggttacgtgtgtgggggtgtgcatgcgtgtggctgtgtgtagctgcatgtagctgtgtgtgtgtgtgtgagcccctcagagcttggccaggcagccccccgaccagtgtcttctgcttctcaggaaattgtcttctacaaagtgatcgactacatcctccacggcaaggaggagatcaaggtcattccgtaagtgcaggattttaccagaagcgtccccgggggagggaccgcccctcagaccccggctcagcccccagggccgtcctcccagggcttcccacggtgcagtcagcagcaccggcctggcctggccccacctgtggtgctctgtgtgccgtggggcatagtggagttgggggtgagacagaagccgactcactgttctgggagatggtgaggaggacgtgggctgctgaggagcccgagtcactgtggacatccagagtggacatacaggggaccaggcaagctgtccaggcggcctcgtcagcaacaattgagcatgaaggccccaggatttgaccctggcaccaccagccccacccagacagtggagcctccagccaggaggccgagtcttggccccgtggggctggaagaggaggggaactccagtccggaggtcagggcaggactccagccaagggaggggcagctggtggcccagtggccctgtgatcccataagcctattgggaccccatccccaggccccaagcaggaaccaggatccaggtgccaggcttgagcacaagtcagggtcagggtggcagggcaggcaccaacgctgagtcctagaaagcaggctgaagcctatacggcctccggagagggaggggttcccaagagggaggggccccagcacggcagcctggggaggaggaagaaggcagcacagccgtcctccaacccacgccctggcctcctgcctcctgaaccccctggcactcagagaagagagtaaatgctgaggatggcacatgagccagagacccccagacccctgcacacaggcacatgagccatgagaccccagtacccctgcacacacgcccagtccatctgaccccagtacacctacatccagcgcagcctggcccctctgacccctgcacacacacgtgcagcccagaccagcccctctgacccctgcacacacacgtgcagcctagaccagcccctctcacccctgcacacagacatccagtccctctgactcctgcacgcgcacatccagcccggcgtggcctatctgacccctgctctctgcccacagcacaccctcagccgatcactgggccctggccagcggccttccaagctacgtggcagaaagcggctttgtgagtcccgtgctgtctggagtccccacagccttgccctcactgggtgcggcgatgtgtgcttctccttgtctctgccacgtcccgccctcccggccagctccacgtgcctcagtgaagcccccagctgccctgctttacctacttaaaagctcacctcagggccacagaggccattttagatcataacagaccttccgctgttttggatgaaatcgtttttctgatgctttttcagatttgtaacatcatgaatgcttccgctgacgaaatgttcaaatttcaggtatctgtctgtgccttggtagaaattatacttacttacaaaagaggagattttgattcagcgatgatgaagtgaattcgtttttgccacttaaaaaacaacttcagccaggcatggtggctcacgcctgtaatcccagcactttgggaggctgaggcgggttggatcacctggggctgtgaccacagcccccacacacgcccgcaaggccgtgaccgcggcccccacacacccctgcgaggccgtgaccgcggcccccacacacccctgcgaggccgtgaccgcggcccccacacacccctgcgaggccgtgaccgccgccccacacacatgcccatgaaaccactcctggtgggaaaacggcctctacctcctccggtgggaaaatatcatgacacaaaaaccatggacacaaactccaaatgcagagagggagagagggaatgcagagagcagagacaggaacacgagcccagccgtcacggctctaggggagaagacatgaggtcactctccccggccacacgcccgggccagggccagcctcagggcggagctcagctctggacaccgctcccgcaggaaggggccctggacgactccgggtggctcatcaagaatgtgctgtccatgcccatcgtcaacaagaaggaggagattgtgggagtcgccacattttacaacaggaaagacgggaagccctttgacgaacaggacgaggttctcatggaggtaagcacctgggcagacgtggttccgccggggatgccctgcgaggggtggggcctgtgcggtgtgggggcctccccgccaagcattcggctgtgtgcgtgtgctcatgtgtgtgcggtatgcatgcggccagggagaggacgacaaagggcccccccgggagcaggagcctctgcagagcacccgggagaccccacacagaagcactgcgacaccatggtggcagccccaggacctgcccgccgagccacggggcctggcacacaggcacatgggagggggcgcgccgggagcgctgagcgccagtgacactgccatcccctccagtccctgacacagttcctgggctggtcagtgatgaacaccgacacctacgacaagatgaacaagctggagaaccgcaaggacatcgcacaggacatggtcctttaccacgtgaagtgcgacagggacgagatccagctcatcctggtgcggcggggcaggacgtcaggggtcaccaggggtcacggctgtgtggcagggggcaggtcgtcaggggtcaccaggggtcacggctgtgtggcaggggcaggtcgtccaggggtcacccaggggtcacggctgtgtggtgggggcaggtcatccaggggtcacccaggggtcacggctgtgcggtgggggcaggtcgtccaggggtcacccaggggtcacggctgtgcggtgggggcaggtcgtccaggggtcacccaggggtcacagctgtgcgctgggggcagggcatccaggggtcacccaggggtcatggctgtgcagcagaggcaggtcatccagggctcacccaggggtcatggctgtgcggcgggggcaggtcgtccaggggtcacccaggggtcacggctgtgcggcaggggcaggtcgtccaggggtcacccaggggtcatggctgtgtggcacaggcaggtcgtccaggggtccattgaggggtcacaggggtcatggctgtgcagcagaggcaggtcatccagggctcacccaggggtcatggctgtgcggtgggggcaggtcatccaggggccacggctgtgtggtgggggcaggtcgtccaggggtccatccaggggtcacccagaggtcatggctctgcggcgggggcaggtcaccaggggtcacagctgtgcggtggggacaggtcaccaggggtcatggctgtatggtgggggcaagtcgccaggggtcacggctgtgtggcgggggcaggtcacccaggggtcatggatctgtggcagggacaggtcaccaggggtcacggctgtgcggcgggggcaggtcgtccaggggtcacaggtgtgcggggcaggtcacccaagggtcatggctgtgtggtgggggcaggtcacccaggggtcacaggtgtgcggggcaggtcgtccaggggtcacggctgtgtggcaggggcaggtcacccaggggtcatggctgtgcggtgggggcaggtcacccaggggtcacagctgtgtggggcaggtcacccaggggtcacggctccctctgtgcagtgggcggccaggttacccaggggtcacagctctctctgtgtggtggggacacggccctggggccagagctgagtacagccctggcatgcccccgaggtccctctgtctgcacggccctggcatcccttccctgtgctcaatctccccagccaggggccttgcatggccagagccctcctggtcatcatgagagagtcccatcattatacctgaggactgcgtaaggcagtgcccgagagaggacaggtgggaaagtcagcaggccatgcacacggtcatttgtctccagatcagaggccgccagggccttcccagggtgaaagcacaagctcttgacagcaccttcctctagctcacacggggtggacgcaccgccgtcaccttgtcccacatgcgaagctctttctcgtgacacatctgtgtctctgtgtagccaaccagagcgcgcctggggaaggagcctgctgactgcgatgaggacgagctgggcgaaatcctggtaagaaccttgctcccgtccctcccatggaggccggccacgtgtgaggctgggaggaagagttctgcattctccgggacccgacggtgctttgcacacacggtcatcagggatgttggtgctgtgtgtgtatacttgtgtatctaagcaccttagtgtacgtgtgtgtacataagcctggctttcagtctcagccagtgtgtccctgagtgtgtttgcatggccagaatgtggctttgatgtctgcactcctgagtgtatcttcgtgtcttcctgtctcctctgtgctttgccagatgtttagttttcaccggatgtttagtgggcctgacttggactctgtgtccatctatgtcatctctgctctcagagtgcctaggtgcctgcaactcccagtgtgtgtgcatccgcatgtgtgcacgcacatgggtgtctgtgtgcatgtgtgtgcacatgtgggtgtctgtgtgtgcacaagtgtgtacgtgtgtgtgcatgtaggtgtgtgtgcacacgtgggcgtctgcacaggtgtgtacatgtgtgcacatgtgggtatgtgtgtgcacatgtgggtatgtgtgtgcgtgtgtgcattgtatgaatgtgcacatgtgtacacatgtgtgtgcacatgtgtgcccacgagtatgtgtgtgcatgtgtgtgcacatgggcgtttgtgtgtgtgtgcccgtgtgtgcacccatgtgtgtgtgctcacatgtgcacagggggtgtgtattgtgtgtgcatgtgtgtgcacatggatatatatagacacatgcttgtgtgtgtctcctagagacgattgctggatcaatgtggggattatgtggtgtccccatcaccctgtgtctgcctatgcaatttagccagaatctcccggggccacgagccttgtgagtaggccttggactgagcatgggaatgtgcctggtgggtctgaaagtccactgttgtgtgtgttacctcatggctgtgtgtgtgagcctacatgcgtgagtctgcacgtgtgtgcctgcatgtctgtgggtgtgcctgggtgctcatgtgtgtgcctgtgtgtccacaccggtgcctttgtattcatgggagtggccgtgtatccaggtgtgcctgtgtcacgtgtgtctgtatccgtgtgtgtgtgtgtttcttttcatgtgcacacctttgtgttttcttgtctcaacaacatcaccctgtccacccaactgggcaagttcttcactgttgggccacagggtacaagaggggagagtgaggctgagccaggggggcgtgtgagcagcctgggatacaggctggagcgccaggaatgacacatctcctcagagatgcctgaggtgtctgaggcttggcaggggatctggagagaagaaaggatgagaagcaagtgggggctgtggcaggccaacctccctcagcccacaatccctcccacagaaggaggagctgccagggcccaccacatttgacatctacgaattccacttctctgacctggagtgcaccgaactggacctggtcaaatgtggcatccagatgtactacgagctgggcgtggtccgaaagttccagatcccccaggaggtgggagacaccgcagggcgcatagtcaggtccctgaggccgcccaggacatgggggtggggatgtgatcagggcctcaggtgccccagaaggtgagggggatgggattgggggttccagatcccacaggaagtttagagggccgacatgttcatcacagaacaggtaaaatgcacacgggaagtaagcataaaacaaataattggatggctgggtggatggctggattgatggatggctggatgggtgaaaagcagggaggaaggagggaggttaggaaggaaggaaggccaacaggcaagcagaaagaaacaaaggaagaataaatgaatggatgggtggatgccaatggtagttggatagttggataaatggatggatgggtgggtgggccaatggtagttggatagttggataaatggatggatgggtgggtgggccatggtagttggatggttggataaattgatggatgggtgggtgggcgggccaatggtagttggatggttggataaatggatggatgggtgggtgggccaatggtagttggatggttggataaatggatggatgggtgggtgggccaatggtagttggatggttggataaattgatggatgggtgggtgggtgggccaatggtagttggatggttggataaatggatgggtgggtgggccaatggtagttggatggttggataaatggatggatgggtgagtgggccaatggtagttagatggttggataagtgaatggataggtggatggatggagaagtgggtggatgagtgatagatgagtaggtgggtcaattaatgaattaatagatgggtcaatgaatgggtgaatggatgggtggacagcagatggatggtgaatggatagatttaaagttttattattaggagttccaagcaatttgatcattaggcacatcatctggcaataacaggggatttggtgtggggtgctgaggagatagaagcatcccatcacctaaacagaaagcacaaagtggcccccctggtttggccacagcagcactcctcggagaccccctggggaggcgggatggctttcccagccctcgtccacagctctgtgccctccctgggttctcctgccctgccctgcttccaacatctcaaggggcttcccacagccctaggaagagaatcctcttttctcatgcccctctgagaacaggtgcagcaggccagcattttcaaaagaagttttactaaatactaagggaaaacactcaagaaaaaatgtatagaaaatatttgcagaataaaaaatatttccaaataattttctgaccctaaaaatcacaatggccgcaggaagagcctcctgggcttgcgcagggcaagagagaccagcattctcttgcctgcggacatcggttctcccaccccagcctgcagcccacacattctgctcattcaaatgtccatgcctaaaaccaacatcttaaaatatgctgcatccccaggggtcctcctcccagcttgaggccaggcagtcggatggaggctgggcggcccctgaaggctggggctgttctcagctcctgccctgcctggctccaccccataggtgccaatgtggcagcccctacccaggaaggccagcagaggccagtgggaaacgcagggatggggaagatcgggaagtccaggagacggtgtggggatgatggcacggagcagggcttccactgtgaagtcagccacaggtgccgctctggcgggacttacacgcttgccgccggagccctgtgtcctctcggctcccccaggtcctggtgcggttcctgttctccatcagcaaagggtaccggagaatcacctaccacaactggcgccacggcttcaacgtggcccagacgatgttcacgctgctcatggtacgtggctgccagaatcaccagggttgtgcaggccctcctggtaccaagggcagcactcaagcaccccgagggatgagatgggggtcctcccagggcagaaggatggaggagggcaacgccctctgacaccgtgcaccgcgcaccccagccctgcggtggtcggaggtccaacctccaacccgacgcctaggtcatcccaacccctcaccactccccaccctgctggagccaggaccggtgagcaaggtggccctgtctctacagaccggcaaactgaagagctactacacggacctggaggccttcgccatggtgacagccggcctgtgccatgacatcgaccaccgcggcaccaacaacctgtaccagatgaagtaggcacctcagggcgggcatgtgaattagccctaaatcaactccacgcccttggcgtgaattaggcttcgcatagcaggctatgtagaaagtggagtccacggccaggccccgtactccagcactgtgggaggccaaggcgaggggattgcttgagcccaggagttcgagaccagcctgggcaacatggcaagagctctcctctacaaaaacttaaaaaaaaaaaaaaaaaaaaaagctgtgtatggtggcgcacacctgtggtcccagctacttaggaggctgaggtgggaggatcacttgagcccaggaggtcaaggctgtattgagccatgattgcaccactgcactccagagtgggtgacagaggcagaccctgtctcaaaaaaaagaaagtggggcccatctgggggggctgcagagcgcagggtgggccaagggcaggtcccacgggcctcacctccaccacctgtgtaacaggtcccagaaccccttggctaagctccacggctcctcgattttggagcggcaccacctggagtttgggaagttcctgctctcggaggaggttggtatactcaccctcggtttctgctgtgggcgctggggacgcagcgtccgcaggacggcagggccgtatcctgcggagcagggttctgatgcagcgggtgagcactgggtgtgtgagcactgggggagggcggcagagaaggcggagggccgaggctgagggcaggtgcatcggaggccctgggaaaacgcttgtggggaagacaactggaaagggcccctcatggggtggggtggaagccgaaggggaagcggcccgggacccaccagcgggggaatgaagggcagccgagccctgagcggcccccaaggacctggacactcagtggacccctccctgcgctccccggtggtgacctctgaggccatctgcgtcccaagccgacgatggagccgctggtggagagctgggcaccctgaggagggccctgagcagcaggcggattaggggtcccgcccaccgagggcccgagggcgggggcgtgagaggcacaggcagccgaggcggaaggggcggggtccccgggcaccctgagaggtggccgcaggcgcctgacgcgctgggcataacctccgcagaccctgaacatctaccagaacctgaaccggcggcagcacgagcacgtgatccacctgatggacatcgccatcatcgccacggacctggccctgtacttcaagtgcgcgccttccgggagggggcgcctcgcggggcgggcgggtagcctgggacccccggcagacacgggggcgcagcggcggcacagcccgggggacgcagccccggattccgtccctgcccgccggccccgcgcaccccggatggggcctcgctcgggctccgcgcctccctgcagacgggcgcttggggcggggtctccacacttgctcccacctgcacctcccttgttccctgggttcaggaagagagcgatgtttcagaagatcgtggatgagtccaagaactaccaggacaagaagagctgggtggagtacctgtccctggagacgacccggaaggagatcgtcatgtgagcgcgggcggagggggcacgaggggtccttccctcgcagggaccgggcccactcaccagctggttaaccctgcagccctccccagacgctctggagcaggaagagcccgtcgcggcagcttgtcgagggctgtgaaacaaatgcgccgtccttatttccccccagctctcagggagatggtgcagagctggggagcacacaggccctgcattggtctgtagcccttggcagtaacttacttcattttgaccttccactttttcacctgtaaaatggtgattcacaaccagcccctccccaggctggtcccagggacccagtgagaaaatacacataaacccagcacttgggaggccgaggggagtggatcacctgaggtcaggagttcgagatcagcctggccaacatggtgaaaccccgtctctaccgaaaatacaaaaattagccgggcgtggtggcgggcgcctgtaatcccagctactcgggaggctgaggcacaagaatcgggaggcggaggttgcagtgagctgagattgcgccattgcactccagcctgggcaacagagcaagactccatctcaaaaaaagaaaacacatataaaccacctgccctcaggagacgcccatcagcactcgtgcccggtttgtgtctgcagggccatgatgatgacagcctgcgacctgtctgccatcaccaagccctgggaagtccagagcaaggttagaacagagggccctccagacccagagtcagtgcctctcagcacatgggactgccgggcgggcgggagcctcggatggcaacggaccattgtttgcagggagctctgagggccacctcggggccaggccagggcggcaaggatgggggtactgcagtgtgtctacatggctcaaccggagccctgtgtggtggggaccccgggggtctggggcggagaagaccgaggctcggagcctcacggggcgggcccgggcccttccgcgtgggctcagagctccacagacagctgccttcctgtgcctccaggtcgcacttctcgtggctgctgagttctgggagcaaggtgacttggaaaggacagtcttggatcagcagcccattgtgagtgctgcttctggaaccttccactcctgaaacgggtgttagagacccctcttggtcctcaggagcctcaggtcctggcttggtctcaggcagggggttctgaggtcgtggggtccttatctcactttgtgggatcatgtgacatgcgtgtgggtggctcggacctgggtacagctgtggcttgggtgatgcttatgcagaggtgacgtcgttggcactggaggaaccagggccacccgctcatcaccaggagcctctgggtccaggcagctctgcaggtgaaccccagcagggccgcgagccatgcaccaagaaagccctggggagggtgctggggcagagaacgcatggggggcgtcccgggcccacacagtggtatgatggacaatgccagggtcctcaggtcagcagcggggtctggatacctcctggcagcaggagaggtgccagcaaatgggagagtcaggataggcgccaggaacaggagaggcagggctgccccagccccacgtggaccaggtgggagctgtggtttctcacacacccgctctggtgggcggcgaggggctctctggagcctgcagtggagagggcttaggccaggtgcagcctcggcaggaaagggggcattggttggtcagcaaagccccacaggggaaggacaggcagcaggtccatcccccgcgcccggcctctagagtcctgcatggttcaccctccaccaggacgctgtgaggggacggacagcccagggcactcggggtctgacactagaaacagctccagagcacgtctgtgtctgccccaggcgagtgcacagcgaggtcctggtcagccgagtgtctgggcagtgcagcccagcccggctcagcactgtgtacagcccatccccctccccgcctctccccagctgcagtaagggtccccagagccaagagggggctgccctcaggggaccacgggctggagccaacagcagctgtgggaagaagctgcccacagttcctaggagctgtggagccgctggccaagggagagggtgtcagcttcccctcccgagagccagtttctgtcaggcaggctcgtcccaggctgtgtctccatgagcacatctgagtgagggggtcggggggctgggcggggccccaggagctgcctccctggtcactgttctcccgccctctgttcctcccaccagcctatgatggaccggaacaaggcggccgagctccccaagctgcaagtgggcttcatcgacttcgtgtgcacattcgtgtacaaggcgagtggttcacgggtgttccgagctgactggggcagggtggctgggagcaggcaagggggcgcgggctggagtcgcgtggactcacacgggcccggcggtgtcctcactggagtagggatgccagtgccagcttcgtgccgctcttgagtggggcaaatggggaggaacatcagtttccggacccccacaggtgccccagcccatcctcaccctgctgtgcccctggaagctctgagccctttcccagcccagaatgtcctctgctagcctccaggcctaccccagaagttctccctcagtgccctccgccgtggccagcacactgttttgggggccttggctgcagctctgtgggttcatttgttccatgtttgtgaaccctcgaggcggggctgggtcggcctgtctgctggtgcacccgcccacaggggcgtttggaacagcagaaggagccacatccctgccaatctgccacagtccgatgccagctgagtctctgaggacgcaaggcggacatggagggggagactcgatggggcaggggtctgaccgtggggccctgtgtgatgcccataagagccagctgcctccggccacactccctggtgatggaatccacgccccaaggaggatgccacgggttccacatgaagttgtcccggagtgggctgtgcccactccccgccccatcctacccaccccgggtcgtcagtgctggggagaaggtgggacaagggtggatatttgggcctgaagtggccacaggtcacggccccactgcaggtgccccccactgccttccccaccccgccacactccatgtgtgatgtgcgcgagtgcacgcgtgtgctgtgcttgcatgatgtgtgccgtgtgtgtgtgggagggacgggagaaggcactgcaggggctgcctgctgtccgcctgtgcccaccacccctctgcctggcaccctgcccccaccccctgagctgttctgctcattcttgggttcctctccctgcaacactgcaccctaagcatgcataccctaaagctcccggcttcaatgtcaccaacacagcccccgaggtttctcccttcacagggctctgctgggaaggtgccccctccgtggcgctccctcctcctgccaggcagttcatcccctacgagggggatgagctggggaagggctatcttactctggagagagcaggcaggacaggactggtggtgacttctcgactcccctcaggagttctctcgtttccacgaagagatcctgcccatgttcgaccgactgcagaacaataggaaagagtggaaggcgctggctgatgagtatgaggccaaagtgaaggctctggaggagaaggaggaggaggagagggtggcagccaagaaaggtctggctctgtgtggcctgtggggcagggactcggtgactctcccaaggcaaaatgaaaagacagggcacagagcagagttaaaatggagaaaagcagagccactttcaagaagcctcgaggtggacagggccacagtgcagggagagaggccacggcgggggagagtggcagctgactccacctcggtagcaaacccggactgaaaaatttcctctgttcctagccagtgaaccccatttttcaagaaagaagtaaccatatcttatgtcctttataaaggacttagttgcaacaagtcagcacacccccaagttcaaatcccaaaggcatcgtggtcttgccattggcccgcacttggctaccttagctctgaggtttggcttgctattcccgctgctcccagtatcccatgctattcccgctaccccatgctgctcccactaccccatgctgctcccactaccccatgctgctcccactaccccatgctattcccctaccccatgctagtaccactaccccatgctattcccgctaccccatgctattcccctaccccatgctagtaccactaccccatgctattcccgctaccccatgctattcccctaccccatgctattcccgctaccccatgctgctcccactaccccacgctattcccctaccccatgctattcccgctatgccatgctattcccctaccccatgctattcctgctatgccatgctattcccctaccccatgctattcccctaccccatgctgctcccactaccccacgctattcccctaccccatgctgctcccactaccccacgctattcccctaccccatgctgctcccactaccccatgctattcccctaccccatgctattcccactacgccatgctattcccactaccccatgctattcccgctaccccatgctattcccactaccccatgctattcccactactccatgctgctgccactaccccatgctagtcccactaccccatgctattcccgctaccccatgctattcccctaccccatgctattcccactaccccatgctattcccctaccccatgctatccccctaccccatgctattcccgctaccccatgctattcccctaccccatgctattcccactaccccatgctattcccactacgccatgctattcccgctaccccatgctattcccgctaccccatgctattcccgctaccccatgctattcccgctacgccatgctattcccgctaccccatgctattcccgctaccccatgctattcccgctaccccatgctattcccgctaccccatgctattcccctaccccatgctattcccgctacgccatgctattcccgctaccccatgctattcccgctaccccatgctattcccgctaccccatgctattcccgctaccccatgctattcccctaccccatgctatccccctaccccatgctattcccgctatcctatgctacataaacaaggcgacttcaggactatggaaggccaggatgagcataatcagggcacagtgtcaacagaggctaaagcactaagaaaggctcagcccagctaatcggcttgggctggtcacagacccaggtgctgtccttcctcctgcaggggttggtagaggtcacaccaggcaggagggaaggaatagggctggtgtgcacaggtggttccactcaccatcttctgtcttctcttgcagtaggcacagaaatttgcaatggcggcccagcacccaagtcttcaacctgctgtatcctgtgagcactggtcccatggggaccctatggctccctcaatcttcacccactaggatttgggttctgcctgtggctatttgctacaagaggttaggaagcccaagaaaatgactgaagatcattctggatattttaatttttttttttttttttttttgagatggagtcttgctctgtcacccaggctggagtgccgtggcacgatctcagctcactgcaacctccacctcccaggttcaagcgattctcgtgcctcagcctcctgagtagctgggactacaggcgcccaccaccacacatggctaatttttgtattttcagtacagatggggtttcaccatattgggcaggctggtctcgaactcctgacctcaggtgatcacccgcctcagcttcctgaagtgctgggattacaggcatgagccaccacgcccagcctgtttttataaactgaagccaactgtgaataaactgtagcctacattactcatccatttttggatagttaccactgggagacctttgaaaagggtccatgaactctgaaatcactgagaacatttgcagccacacatgtacatatgtgtacacaggtagacagatggacacaggccgtttctcatccagtttaggaaaacacacatgctcaggaattcagaataaaataaacagaaaactacttgcccattatctgtggtaaaatgatagcggaagccacactacatttgacccatcagaaaattctgccagagaggtcaaggccatgagtaaagcggccatccaacttcagtggtctgagcggaaatgatctgtaataaacaccatgtagagtggctctgatggccccagacggcaccaggagggcagtgcagggctggatgccgaagcccgtgcacccccatgattaaatattggtgagcctggagtgaaggacagaggcaaagaaacggacttcccagttgaaatcggtattatgttaaattcaggatgttcaactcatgatgtgagctccaaggcatttgctcccaacactagatgacgcttaactagatgggctcattggggtgggcgtgggagagcagcagacatgcccagcacagccatggggctgcaggaagggggtgctgggttttttgcttgagacagtctcactctgtcacccagcctggagtggagtggtgtgatcttggctcaatgcaacctccaccttccgggttcaagcaattctcctgcctcagcctcctgagtagctgggattacaggcacccatcaccacaaccagctaatttttgtatttttagtaaagacaaggtttcgccatgttggccaggctggtcttgaactcctgacctcaagtgatctgcccaccttggcctcccaaagtgctgggattacaggtgtgaaccaccgaggtgctgggattacaggtgtgaaccaccgtgcccagcctttcatctcactgtcagagaccctggtatccagagcctgggtctggatgaggggctcttaagaggttctgagggatcctgcaaacagcccctctggacgccaggacaggatgtgaaagtatcttgctcactcaaagctcaccttaaccaaaatgtcctgaaaagcttataggctgcttctccctttggccttatatttgcaaacgaactcattttacaaactggggctccaagcctagatttgctcaaggcacatagctggaagtagaattcaatctgtccattccacgccaccagaccaagggtttgggttgttgtcaagctgcacagccaggagggacgagaagcccaggaagcctgctggggagggaagcgtctcagacaccacaagaccacctccctgcacaacctcaaacagcacttagcccgtctgctcaggaggccaccagacttttagtcccaagtctgacctggccacttcctgggatcaaagggaggatttgtgaaacggcaggttggggcgaggggttattgtggaggaggagccagcttcccttctgttaggcgtcagtcagtgcctaccctcccatccagggtctgggctctgagagcagcagcctagaactcagaatcaagacaaccccagtactcatgaggcccccagctgactgactccattacagacggcctttggggctccccacctggatgccccagacagaacaggcagcgcgcatctgtccttcccactgtgtttacatgatgcattctgggtctgtgaatggtaatgtggattcttttaaaccccctccctgtcttccacctcacgtgaactgggaggtggacagaacttcaacctaggaattccacaaccagcgacagcaaatgaggagccggagtatcacacaacacaggaagctttattcatccgctgctggtccaaagagtgggtcgcagggtcactcactttaatatgctgtcatcttgggccggaaggttagaagaaaagcacatgttaccactcaggcaacctaaaaagaccacttcagcttcccagttattttttttttttttttttttgttttgagacggagtctcgctctgtcacccaatggcgcaatctcagctcactgcaacctctgcatcccaggttaaagcgattctcccacctcagccttctgagtagctgggattacatgcac

SEQ ID NO: 15928 - DNA, 10713 bp, Human
gaaacgagcctgggcaatatggcaaaaccctgtctctaccaaaaatatcatagaaaaaaattagccagacgtggtggcgtatgcctgtggtccgagctactctggagacttaggtgggaggatcacttgagcctgggagacagaggttgcagtgagccaagatcacgccactgcactccagcctgagcgccagagtgagaccccatgtcaaaaaacaaaaaaaaaaagaaaaagaaacttgcatgaagcccatagactggagggctctctgttatggtagtgggaccaccctgaccaatacgcccctggaggcagccagccacaaatccccactctcttgcgcagcctgtcctgattgtattcaaacgagataccactcgctgatttgtttaatacatactgaataacaagcacgtttcagttccaccttcctgaggttctaccaaggtcactcagttcccagtctttggttactcatttttacacagtcttggtggactcccatgatggcagctgtgtttgttgtactgacaaggacttgaggccaacagaaactacataaatccttgggtaaccttgagtgtggcattagccaccttgtatctaattctttttttttttttttttttgagacagagtgttacctggccaacatggtgtcaggagactgcccatcccagggaccaggagccaggacaccctcagctcagtcacatgtttaatggccacatgtttaatggcctcacactcccattccagagtgcagcggtgcaatcatggctcactgcagccgcgacctggtgggctcaagcgatcctcctgccccagctttctgagtagctgggaccagagacatgcaccaccacacaaggttaattttttaatttttttgtagttatggagtcttactatattggccaggctggtctcaaactccagggctcaaaggatcctccctcctcggcctcccaaagtgccaggattacaggagtgagccaccacacccagccccatctcttttcatcatggtactaattcctgcccgtccacccacaaaagcactgtagtgcttcccgagtatagaggcctgtgagcctccactagggagagggctcctgcagagatcagataaattgatcacaatggctggggtggtggcaatgtgctaatgctctctttcttccactcaagatatcctctgtctccctcagcctgtgagctttttctccagtgtgctctgccagtgggggccctgcctgagagcccctgcagctgcagaggacagtttctttctgctgaaccatcgcagctatgccccagcccctaccctggaggggtccccaggggccatgggcagcacctcctgtatagggctgtctgggagccactccagggccacagaaatcttgtctctgactcagggtattttgttttctgttttgtgtaaatgctcttctgactaatgcaaaccatgtgtccatagaaccagaagatttttccaggggaaaaggtaaggaggtggtgagagtgtcctgggtctgcccttccagggcttgccctgggttaagagccaggcaggaagctctcaagagcattgctcaagagtagagggggcctgggaggcccagggaggggatgggaggggaacacccaggctgcccccaaccagatgccctccaccctcctcaacctccctcccacggcctggagaggtgggaccaggtatggaggcttgagagcccctggttggaggaagccacaagtccaggaacatgggagtctgggcagggggcaaaggaggcaggaacaggccatcagccaggacaggtggtaaggcaggcaggagtgttcctgctgggaaaaggtgggatcaagcacctggagggctcttcagagcaaagacaaacactgaggtcgctgccactcctacagagcccccacgccccgcccagctataaggggccatgccccaagcagggtacccaggctgcagaggtgccatggctgagtcacacctgctgcagtggctgctgctgctgctgcccacgctctgtggcccaggcactggtgagtctcccccagcctcccctctcctaggcagctccaccactcactgagcactgctttgtgctaggcattaacccaagtctgtcctcattttaaagacaaggcagctggggttcagagagggttcagagcttatccaaggtcacacagctggcgggtccaggagcaggtggaacccagagctgtctgacgtccacatgtttaatggcctcacactcccagcaaaactgggtctagagggtgggtgaaatcatgatgccaggtgtgtagcctggatcctgattaaggttgctctggccccaaaccacagctgcctggaccacctcatccttggcctgtgcccagggccctgagttctggtgccaaagcctggagcaagcattgcagtgcagagccctagggcattgcctacaggaagtctggggacatgtgggagccgtgagtaccaccaaggatgcatggcaactgggggtctgaaatgaagggtgctgggtgggctctggatgggcaggaggagagtggagcccccataggggatggatgagatgaaatgggatgagatgaaatgagataggataaaatggaatgggatggatgcgatgggatacgatgacatagaatagatggagtcggatgaatgggatgggatgggatggatgggaggggaagggataggataggatgacatagaataaagatggatgggatgggatgggatgggatgggatgacacagaataaagatggatggattgggatggatgaatagaagagatggatgggataaattgatatggatgagatgggacaagttgggctggtgggcagctgcatgtgccttggagtgctctgttggcctcttcctaagagaacctccccattggagctgggagcctcccccactcatgtgtcctccaccttggggcccctccctccccaggatgacctatgccaagagtgtgaggacatcgtccacatccttaacaagatggccaaggaggccattttccaggtaatgatgcccagatcctggatgaaggttggggcccaagagatgagggacagagcagggaagagctgagccccctaaaggggccatttccaggctgaggaggaggcctgggtgcctgggaagtcccagctcctcctggctgggagcaggtcatggccctgagctcaatagcacagccagagatggtcttccctgaggggaagggcccctacatgtgcccaactacttaactccttggcactcgtgaactccagcaccctgggggattaggggtcagtctgccctggtggggccttgtgtccagggacttgggcggggtagacctcagagaggcccagctgacggccccctctggcctcccaggacacgatgaggaagttcctggagcaggagtgcaacgtcctccccttgaagctgctcatgccccagtgcaaccaagtgcttgacgactacttccccctggtcatcgactacttccagaaccagactgtgagggctgcaagctcacctcctgcctgcctccccacgcaggcccctgtgcccacccatggggagccacacacacagcaccccagccagccagacacacacacacacacacacacacacacagcacccaagccggccagacacaaacacacagcaccccagccagccggacacacacacacacacacacacaacaccccagctggccggacacacacacacacagtaccccagctggccggacacacacacacacagcaccctatccagacacatacacacacacagtaccccagccagctggaaacacacacacacacagcactccatccagacacatacccacacagtaccccagccagccagacacacacacacacacacacacacacacacacacacagcacacacacagcaccccagctggccacacacacacacacacacaccctgtccacaaagggcctaggaaactacgtgcccttcagccatgcacccgaccatgggcccccaggttcaggtgcacacggtgggcctgtacgctcacacacccttacaccctcactctcacacacatgcttacacacttattcattctcacatatatgctcatgctcattcacacacaatcccggccacctgccctaaagtccccacacagccctatctttgccttttgtccccccacatagagttctaaaccacagcacccccactaggcctgcttcctcccattccagtggtccctgagcccttgggccggcctgaataggggtgggcttccctcccagaccctaacactcccaccctgtgctgtgccccaggactcaaacggcatctgtatgcacctgggcctgtgcaaatcccggcagccagagccagagcaggagccagggatgtcagaccccctgcccaaacctctgcgggaccctctgccagaccctctgctggacaagctcgtcctccctgtgctgcccggggccctccaggcgaggcctgggcctcacacacaggtgagggaggcccccacagccagtaaagtggagatccagagggctagagccacctccgaagcccatgggcactgggccctgggagaggcagagccgggaaggtgataggaagctccaggcagggcctaagggaggagggagagaaagggaggaagagagaggggaggagagcctggaggactcttctcccagcacccagcctggcctccacctgattctttccccaggatctctccgagcagcaattccccattcctctcccctattgctggctctgcagggctctgatcaagcggatccaagccatgattcccaaggtgaggcatccagggcctcacagagcccaggagcacacgcatacctgtagctccctgcagctcccacctctctcccaactcacacccccgtcaggacccagctggctgccagaagttaggaggggagagagccgcttgtgcattgcccccacccaggggaccctggggctcaggctcaggcctggtaggtgccaggcctacagttcatgcaacaaacattaagcccccactgtatggaggtgccacgccaggagccaaagtacaaaaacggacaagacgcagctttgtcctccagcagctcaccatctgatggagaaagatccccagaggtctctgtagaaaggttgctttgatctttcaagaggggaatttccacagatagattccccatccttgcctgagtccaacttggagtcttccagacctgcagtggctattgtccaatggccccgccagcccagggctaccttgcccaaattggggcccaaatgaggaaaggccctgccccctcagcctttcccagatagggttgcgtgggccaccaggggcacaaggcagcaggtgaggttcctgctgaggcaggtggttcacttgagcccaggagttcaagaccagcttgggcaacatggcgaaaccccgtctctactaagaatacaaaaattagccagatgtgacaggtgcctgtagtcccagctactcgggaggctgaggcaggagaatcacttgaacccaggaggcggaggttgcagtgagccgacatcacgccactgtactctagcctgggtgacagagcaagactctgtctcaaaaaaaaagaaagaaggaaagatcactgcagagattgcagtgagaggtgatgggacagggacggagctgagggctggcctggggatgcatttgggaggtgggcccactgctattgggcatggatgggcctggagcgtgaggaccagggaggactccaaagtgacttttacacactggccagagcaaccagccctctgtaatgccagcagctgagatggggagactaaagaagaaaacaggtttgagcaaaaaaacagagagctccctcctggccatgttgagttcaagatgcctgtgtgaagtgcaggagaggagagtcaggcaagcagctgaatcccaagcattgggggaaggtcaggtccaccatgtcagtctgagagtcactagctgtgggccagagcctttggggccagacgtaggtctgaagctggctcctacactcagtgaccctgtgtgagtcccctgcatcccctggactctctgatccccagtgtccttatttgtgaatagccttgccctcccttctagaagagaatgagggaatgcgtaggaagtgcccagctgggtgctgggcagagagtggaggcttgccaagtgaaggtcccatgctggcctctctccgcccccgccccagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaagtgagcccactgccccctccttagcccaatgcctgctctcctcctccccctaccctgccactgcatgaccctctccctctgtggtcccactgcaatgcaccaaggaggacagaaaccaaacacctctgtagggtggccttgcctgctttccccctaatgctcacatctccagggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaaggtatgggctgggcacatggggactcatggtcagggcccgttcaaggcagaaggctgagcccaggaaaggctttgcagccagagacacctaggatgggccagaatggagcacagacaggcagacaggatgtggggcagacaatggtgggactgtaagttagggcagagcctgctaaaggttaggagtcgcctctggacaaagggctgtgggctccagaggaccagcaggccctcttcacgggctgagtgagcaccaggcaagccttcagaggcctggttatctaccaggagatgagtaatgctagggccagttcaagccaggaaagggactagccttctctccagggtcctgatccctttactgcccccacactcctcaaggtgtgactcactcaggacaaacccattggcaaaaggagagggctggacttgaaggtcctagggcccttgccaatactcagtcaatgacaggaaattcccttttttttttttttttttttttttttgagatggagttttgctcttgttgcccaggctggagtgcaatggcacaatcttggctcactgcaacctctgcctccgggttcaggcgattctcctgcctcagcctcttgagtagctgggattacaggcatgtgctaccaggcccggctaatttttgtatttttagtagagacaaggtttcaccatattggtcaggctggtctcgaacccctgacctgaagtgatctgcccgccttggcctcccaaagtgctgggattacaggcataagccactgcacccggacaggaaattcccttcttaaagcgagatcctgtcctgaggaaagccagctgatgctcttcccaggaggcagctgtccacactgtgctccctgctcagcaactcccaagcctcccgactgcccatcacatctggtctcaaggaccagatgaacgttaagtttccttctagaactgaaatggaggtggagggaggggagggtggtggctgagattccacccctctgcctgagtcctccgtctccagtgtcgcctgcttttctgatggaagtcctccatttcagctggctccagtttgttaagggtttcaactgcagccagaggtgttccgtgagggctgatggaggagtcgggagggagccctagagtgatccagagatgtggagaggccaggaccacacgacaggagagtcctgcaaagggaccctccacagctgtgtgtctccttcctcagtgcaagcaatttgtggagcagcacacgccccagctgctgaccctggtgcccaggggctgggatgcccacaccacctgccaggtacacccacccctcccagttggtcctaggacttcccttggctcccagagcccccaccctttgggcccgtgatcctcagaggcctcactcccctgggtccaaggtggtcccaggtgcacgggccagggactgggaggcacccctctctgtttcagtgtaaaaaatcatgagagcatggaaaagggggatgggaagggagggatggcctgaggagtgcggctggatgtccattataggatggggctgtgttccctggccagtgtgtgctggtggggtgggggtacaaagtgggtgttctggagtgaacatctcacctcctcaggctctaaaccctaaggcctgtggctcagggagtggcccgaggggtctacagagtcacactggtagcacccactaggcgggaggtggagtgagtgctgttctttcccggaagagctgggtgtggggagctgagggggcccaggcctcagccctggtgctgtccctgtgacaggccctcggggtgtgtgggaccatgtccagccctctccagtgtatccacagccccgacctttgatgagaactcagctgtccaggtgagtccaggcccccagttgcggggaggtaagggggcaggtcctgaccatcagggcatgggaggcccttctgctccccaagcaggaagaggcggccactcctgccggctgctccatcctccctctcaccgcacagctggaggctcctgagggcttctggctggccatcaggaaaacaccctttccggaccccgagcactgccccgcccagaaccccagtcactgagtgcccaacccccagcttcccccccaaccccccgccctgccctgtcccaggcctccctctcagagcttgccccagggactctctggccctcagggttcaatgtattctgaccaaggccaagctttcctggggctcagggaaaatcacactttgctacccgaagctgtatcccctcagatgccaggaaggccgtgatcatctgactccaccctcctgagacacattctctccctgactgtcctgttctaagtcagcggagcaccttaggatggaggggtggaggcgaggccagatgcagcctctgtgaacaggtgcctggaggctgggaaatgaccctgagagggcaggacacagcaaccgtgggcttaaggtgaccttgagagcaagcttggcccactttacaattctgttcagagccagcccctaacatggtggtcatttattcatttgttccctcattttaaaaaatgtaaggccaggcatggtggctcacgccggtaatcccagcactttgggaggccgaggcaggcagatcacctgaggtcaggagttcgagactagcctggccaacatggcgaaaccctgtctctactaaaaatattttttaaaaattagctgagcatggtggcaggtgcctgtaatcccagctactcaggacgcttaggcaggagaatcacttgaacctgggaggcgaaggttgcggtgtgccgagatcgtgccactgcactctagcctaggcaacagagcacaactctgtctcaggaaaaaaaaaaaaaaaaaaaaggtatttctttgctgggcgcagtggctcacacctgtaatcccagcactttgggagaccgaggcgagtggatcacttgaggtcaggagttcaagaccagccttaccaacatgatgaaaccccgtatctactaaaaaaaaaaaaaaaaaaaaaaaaaattagccagatgtggtggcacacacctgtaatcccagctacttgggaggctgaggaggagaattgcttgaacctgggaggcggagattgcagcgagccaagattgcgcctctgcactccagcctgggtgacagagtgagactccgtctcaaaaaaaaaaaaaaaaaagtagtgggtgcctgtggccaggccacatcctagggtaggggctatggctgagccctgccctcctggagctcacagccaagtccacttcttccatctgaggcggggaagccagccctgttcctgaaaccctgcatcacaagcccctgtgggaggcagtggggaggggaggtcctcccccactcagacctgacccacagggaccagtttaatgtgtccttgccccagtgatgacagctggggatctgggggtggggagtcacccaggacccgggcagtcgcctttccccagctcctagggctcccggccttccctgctgaaacagcaagaccagtgggttggcgtgggaggcctgggcttcaaaccacctctgctatcacctggctgtgggtccccaggcaggacatacacacagtccctctctggccctcatcctcctcagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcgggagtcacttccactggtggaccacgggcccccagccctgtgtcggccttgtctgtctcagctcaaccacagt

SEQ ID NO: 15929 - DNA, 15666 bp, Human
ggccttttttttttttttttttttttgagacagagtcttactctgtcacccaggctggagtgcagtggttcgatcttggatcactgcaacctccacctcccgggtacaagtgattctcctgtctcagccttctgagtagctgggattatagacgcctgccaccacacccggctcattttttttgtatttttagtagagacggggttttaccatgttggcgaggctgatttcaaattgctgaccttaagtgatccaaccgcctcggcctcccaaagtgctggaattacaggcgtgagccaccgcgcctggcctcaaaaaaaaaaattttttttttcaggacggcgtcttgctctgtcgcccaggctggagggcagtggtgcgatctcggctcactgcaagctctacctcctgggttcacgccattctcctgcctcagcctctcgagtagctgggactgcaggcgcctgccaccacgcccggataattttttgtatttttagtagagacggggtttcaccgtgttagccaggatggtctcgatctcctgacctcgtgatccactcgcctcgtcctcccaaagtgctgggattacaggcgtgagccaccgcgcccggccaaaaaaatttctaatacggcaaatattgaaagatataatccacataaacaaagcttttagggtcttctataatttctaacactgtaaatggttcccaagacccaactgtttgagaaccgcttctctgggatgccttcttcttttcctgctggctaatcccagtggagagatttaggtatttaattctgctccagactcacctctgagaaccttccctgatgggccacactctactcactgcccttgctctgtatcccctcttcagttatgttgttcctgtttccctggctgcttttaattttctttctttcttttcttcccgccttttcttttctttctctttctttttcgttttttgttttttgagacggagtctcactctgtcgcccaggctggagtgcagtagcgcgatcttggctcactgcaacctccgcctcctaggttcaagcgattctcctgcctcagcctcccgagtagctgggattacaggcgcacgccaccatgcccggattatttttgtatttttagtacagacggggtttcaccatgttggccaggctggtctttaactcctgacttcaagtgatccgcccgccttggcctctcaaagtgctgggattacaggcttgctgccgcacccggcttgtttttttttttttttttttttgagacggggtctcactgtgtcccccaggctggagtgcagtggtgcgatcacagctccctgcagcctcgaactactgggctcaagcgaacctcccacctcagcctcccgagtagctgaaaccacaggagcgcgccacgacacacagctaactttttttttagtgttttttctttttttgttgttgccttttttttttttctttatcgatcctcccgcattggccttccaaactgttgggattacaagcgagagcagtgcccggcccctactgctttgaaacctcggttctttgcaggtcctggaaaagaaagtgaaggggtcgtgcaatggctcaaaacccaggcaacatttccaggcgcgtcctcaactcggcgtcactctgacaaaaagtttgccctttgcgcccgatccctcacaccagagagcaccgcagggacgcagggacggagaggactaatggggtcggggaggacccaaggaagttggggaactcagactcttttcagtgtttaaaaagcagaggccccctcggaaggcataacaggcgagtctaacaatgcccctggagatcaacggcactaaggggtacctttgccccgctccaaggctccttgttccgccccctgccgccaagcaaggaatccggcgccgccggtcgtgggtagtatttacgacagtgctggcgctttgcggccggccgcacagccgctgacgcgtcgggaggcggagcctagggaagcaaattctcctggcggcctccgttcagacgcggcagctgtgacccacctgcctcctccgcagagcaatggcggtgtctgccgggtccgcgcggacctcgcccagctcaggtaggcttaggaccccgccctccggcggagagttcctaggagcgctggtctcagaggggcgggggcgggaggacgcccagtgtctcccggtgaggcggggggggggtcctctgtggggaagggggcgtgctgtgagacatttgcagcctgcggcttctgaatgatgatgacattcgggaacactgcggttaggggactgtagtctgaggggttctgggacattaggggatcgtggagagggggctgcactgcagggatgtttcctatagtcagatcattgaggcaacctcattgagccgacccgggtgggcggaagctctgagctgttggtgcagtgatttctttgatttgaggtggagcccacccccgcacacatattttctccatttattgattgcagataaagtacagaaagacaaggctgaactgatctcagggcccaggcaggacagccgaatagggaaactcttgggttttgagtggacagatttgtccagttggcggaggctggtgaccctgctgaatcgaccaacggaccctgcaagcttagctgtctttcgttttctttttggtgagtccagtttatgggtgggagcaatttggttgagagtggagaatgacaatctctattttttggttgcaagtagacttagctcccttttcctcagagctgaagacattggtataaaagaagaggtctttgcgaagtttaggattaaacctgctttgtctcctacagttaggatttacttggtggccagaaatgcttttttttttttccttagacggactttcgctcttgttgcccaagctggagtgcaatggcgctatctcggctcactgtaacctccgccacccgggttaaagcgattctcctccctcagtctcccgagtagctgggattacaggcgcccaccaccacacccggctaattttttattttttttgtatgtgtgtttttagtagagacggggtttcaccatgttggccaggctggtctcaaactcctgacctcaggtgatccgcctgcctcggcctcccaaagtgctgggattacaggtgtgagccaccgtacccagctagaaatgctatatgatatgtagaggcgaggcagcagtgacccattttgcttgtggcatgaagttgcccagaagactcagagaaacagagcagggggccacagggaccataccttttggctgtgactccctaatcaagagcttcttaactgaggccgcagcatggtgtgcttggaatggtttacagatgtgcagagatattagtccccttagcccagtagttctcaactggagggagttttgctccctgggagacatttggcaatgtttagagacatttttagttgtcacaacttgggggaggaagaataggtggctgctggcatctctatagaggtcagggagtgctcctaaatgtcctgtagtgcattggataatcccctcaataaataattaaccagcccaaaatgtgactagtcctgaagttgagaaaccctgctttatctcaagctggcttcctgatctgagtagcctcttctgtttattcccagggtgttgacgaaatgcaactgtttttggagtgtgccaggaagcagaaaaggttgagaagcactcccagagcactttctttctttctttctttctttttttgagacggagtttcgatcttgttgcccaggctggagtgcaatggtgtgatctcggctcactgcaacctccgcctcccaggttcaagtgattctcctgcttcagcttcccgagtagctgggattacaggcatgcgccaccacacctggctaatttttttgtattttaagtagagacggggtttttccatgttggtcaggctggtttcgaactcccaacctcaggtgatctgcccacctcagcctcctaaagtgctgggattacaggcgtgagccaccgtgcctggcctcccagagcactttctgaagctcaataggatggatctttatagctgtcaagaccctaacagtttttatagcattttgtgcatttctgtaatttaatcctctctgtagtcctgtgatgtattccccttctcacaaatggggaattggttaaccgagctgcaggggctgttctagatggcacaacagatgtagtactgtgcagagtaggcactcaataattaatactgaataaatggcagagccaagattagaaaagaagtctgaccctggagctgcacactgtcaactgtgttccactgtattctactgcttccttagctgaggcccaatgaccaactcccctattgccttcttagggttcttgatggtgctagacattccccaggagcgggggctcagctctctggaccggaaataccttgatgggctggatgtgtgccgcttccccttgctggatgccctacgcccactgccacttgactggatgtatcttgtctacaccatcatgtttctgggtgaggggaactgtgggaaatattgactggcctgccagaaacacagaaatagaagcatgctggtgaatggtcaaagtctttggcaccttatttcacttctgctgtgatcaatttcatgctgttgacctgtgtgtcacttaagctgtgatcccataattctttttaaaatattaaaataacatttaattttcatttagttttatgtgattatacaatgcttgatttttcttaattccaaccatatcctggtccagggaaactgggcctgtggtgatctcttgacctcttaatcctctccctacaaatcccaggggcactgggcatgatgctgggcctgtgctaccggataagctgtgtgttattcctgctgccatactggtatgtgtttctcctggacaagacatcatggaacaaccactcctatctgtatgggttgttggcctttcagctaacattcatggatgcaaaccactactggtatgagtcaggggggacaaaggggaggggttggctgggtcaggatggttatcagagataggggcccagtgaggttctggaatttttcagtcatgtttgcaaagtatggttacaaggtcactttgatctaggtggatttgggaggggaaagggccaactagttggagcgcttgggatgacacaaagcaaaatggctccatcccaccccttcagtctttccctatctccccaggtgccttgatttattcacctcttgtaaccctcttagagagaaaaacagaatactaaagccagacatggctgttttcagatactttaagggtggttatgtagaagagggagcagactttctctgtgtgagtccagaagggcagagttagagccaaaagtagaagttgctgtgaggcagagatcatgtcaggagaagagggcccaccagggctgctcagcattgctgttctcggaggaggtaacccttccccatttctggcttaggtgactgtctctaaggggaggtggagaagggatttggagataaggtggtggggcagttgaccttaaggattctttatatgttgagtgaaaagtaataaaataggtgtcaataacatgagtatggggaaaaaaactcaaacattgaattcattaacagtcattaagttttatttatttttctttttatttatttatttttaaatagagatggggtctcgctttgttgcccaggctggtcttgaacttctgggctcaagcagtcctcccacctcggcctcccaaagtgctgggattacaggcatgagccactgtgtccggcctatttgttaatacacacatacaaaacccctttggtaaaacttgaaactcattcagaatggccagctctgatcatagagaattaagaggcagttttgatagaatatctctgaaaagttccgttgtggggatatttgttgagatggcatctcactgtgtcgcccaggctagagtgcagtggcgtgatcatagctcactgcagcctcaaccttcttgtgtttaggtgatccttccatctcagcctcctgagtagctggaacaacaggtgtgtgccaccacactcagctaatttttaaaattttttgtagagatgggatctcactatgttgctcaggctagtcagaagttccatttttatgactttatgcattttgaaaaaatcacttatcatttattcagggttttccacatcgcaggcactatactaaatatttagagtttttcctcattaaaaccctgtaaggtcgatggtgctgttcacattttatgttttttggagtcagggtcttgctctgtcactgaggccagaatgcagtggtgcagtcatagctcactgcaacctcaaactcctgggctccagagattctctcgctttagcttcccaaaatgttggtattataggtatgaactactgagcctggcctgttcacattttaaagataaagaagctaagtattattgacgagtgaagaatttgcctaaggtcagctagcagttaagaaacagaagtgagtccaggtgttcatgactgcagagtccagtgctcttgaccacagtgtaagctgcccctttcccagcttctacttcttgaaaacttgctttgcttctgcttccccagagtacatctggtgttagtagcctgggtctaatcagttctcttccagaatacaagctgttagcaggaaccctcttatactggatcctggcacccaggtctatgaaatgttagtttatgttgtgtgttactctgctgttgagggttttcatttttttttaaagataatacaccgcatatttatttacacatacatagcttttcaaacactccatcaaattcctcccctttttcagtaattttctagtattgtagtccttttttcctgatttgatccattagaacaaactcaactgggagctaacaagaaatactgaactttttgctgttataacttagtagcaatatttcttctatgacttgtataatcatgttagaatttgctcatataattctaaaaggtctcagaataaccagggaggatatgggagatgtgcccaggatagataggattatcgtgtataaaaggaaggatggagatgtagctgcattaagcagctcccccctcaatgtttacctccctcggtgtaggtctgtggacggtctgctgaatgcccataggaggaatgcccacgtgcccctttggaactatgcagtgctccgtggccaggtacagcattttaggacagagggaggagctccttgacagccatgtggtcagcatggccatcccactgccagactacactctccgctgcctccctggatcttctgtttttagtttttaccctttgctggaaagctaggctggcttctcattttttccaatcccttaatctctgaattatcttatttgtcaaggaaagactagagctttgtccctgctagattggaatcctcatgacaaagagaaaggattcagtctgtgctttatgacttcttccttggtgcctgatactgtcgctgacattggttggatgtcaataaatgctgtttggatgaggcgaatttctgagatgaatgaatagaagatggggtctattcttccttgggccctggactcagatcagtatttattttattcatttaaaaaatatatataagtagattatttgggtcaaggactgtaatatttgggtcaaggactgtaactcaggagcatggattcaagttgtcctaactatatgctccttattttattcttgcctatctgtagaaaagattctttttgcttgaactttgtgtcacattttattttcagatcttcattgtgtacttcattgcgggtgtgaaaaagctggatgcagactgggttgaaggctattccatggaatatttgtcccggcactggctcttcagtcccttcaagtgagtggcagtcatggtggaggcctctttgaggcatgggtacagagcaggtgactcatctctctcagtaatggcacctgttcctactttgcctgaatttgccacatgccttcctttgtccactcatttccctattcagcagaagcagagtcagtggtatcaaaagattgagccctagctgctcttgggagatatatggtatagataggcaagaaaggaaaagaaatttaaaaaggaaaggaaagagccggaactggctgacttggtgagtgagccagtgccctcagcagctgccttggatggtgcctgtgtccttgccttgccactctagcctcccatcagagccctgcagctgatgtactgagaagatgggcactcactgttcaggctctgacaaaaccattattatcacttccacaaaacaaagggtcacctttctgatttgtcttcttcccatttcttctttcctcttgttttactttattctctttcttcttccctgttattttccagttcctgaagtttgacttcattatgatgttagccaagcattcaccttttaaagtgtcctctcactcatgacctccgtggggaacgtcccttccacaacacacacacatctcagtcaaattttgtcctaggagatctgcccttgcttattacataggatatgttagaaaacattgaacacctaaagtgtgtgaaaatgtagagggggctgggcatggtggctcatgcctgtaatcccggcactttgggatgctggggtgggaggattgcttgagcccaggagttcaagaccagcctgagcaatataagacactgtctctacaaaaaaattttttaaaaaaacagctaggcgtggtggcacgtgcctgtggttccagctacttcggaggctgagacaggaggattgcttgagcccaggagtttgaggctacagtgcaccatgatcatgccattgccttccagcctaggcgacagagtgaaacttcgtttcaacaacaacaacaacaacaacaacaacaaacaacctagaggagtgtcttcatgggtggattatgtaccttaggcatctacccagccactggagtagccaaggcacattcgtgctgtgaatgtgctttgatgtgttctccagtgggctggtgcttgaactttctccatgtgtttgcagactgctgttgtctgaggagctgactagcctgctggtcgtgcactggggtgggctgctgcttgacctctcagctggtttcctgctcttttttgatgtctcaagatccattggcctgttctttgtgtcctacttccactgcatgaattcccagcttttcagcattggtcagtacctgtagcctgggaggaaacaggaaccacagttttgcaggaagggactagccagaggcattgtttgggagtgggagagggtggtgtgagcaggagctaaattgaacccagggcagtcactatgaagtaggcataaatggggataagaggactggggcttctgggctcagttagtatgttgtacagtagggaatctccaggaagaacaaatatcttacagttaagaactactttgtggccgggcttggtggctcaggtttgtaatcctagcactttgggaggccgaggtgggtggatcacctgaggtcaggagttcgagaccggcctgaccaacatggtgaaaccccgtctctactaaaaatacaaaaacttagctgagcatggtggcgcatgcctgtaattccagctacttgggaggctgaggcaagagaatcgcttgaacccaggaggcagaggttgcagtgagctgagatcacgccactgcactccagcctgggcgacagagaaagactgtctcaaaaaaaaaagaagaactactttccttttcagtggaacacctgggagaagtctcctaagggaacggggttgaagaggcccagccaaactcctgaaatatgtattttctccctgctttcctaggtatgttctcctacgtcatgctggccagcagccctctcttctgctcccctgagtggcctcggaagctggtgtcctactgcccccgaaggttgcaacaactgttgcccctcaaggcagcccctcagcccagtgtttcctgtgtgtataagaggagccggggcaaaagtggccagaagccagggctgcgccatcagctgggagctgccttcaccctgctctacctcctggagcagctattcctgccctattctcattttctcacccaggtttgtaggggctgtggagtgtacagcaaaggctggacttagaaaggaacggatgacaatagttgggaaagaatggggctggttttgcagccccttcttggtaggggatggggtcagtgtgagaagcattgagctgattcccctctgtgctgccttcccagggctataacaactggacaaatgggctgtatggctattcctgggacatgatggtgcactcccgctcccaccagcacgtgaagatcacctaccgtgatggccgcactggcgaactgggctaccttaaccctggggtgagatgtctgatgctgacaatttactgttcttcagagcccccttgtgctttggggtctggttttgtcttacacacaccataaagcaaaacaaatttgagtctgctttgccttttctcaagagccagattgaactatcttttatgtgggttgagatagggcaatgcattcatttccttgaactgagattagattcaggaaaagtaagcaccactagcccaacaatgaaaaattcattcccaaaggcaagttccatttttttctagccagaatgggcagcaggcagggatctcgttgtgccattggcagtgcatgacatgtcttggaagttgataatgatgaggtgggactaatatgggggtttggggcaggtatttacacagagtcggcgatggaaggatcatgcagacatgctgaagcaatatgccacttgcctgagccgcctgcttcccaagtataatgtcactgagccccagatctactttgatatttgggtctccatcaatgaccgcttccagcagaggtgggcaaggggagcagagagtgggaaaaaatgaagcacagttctttttaccaagatgaacagcccttgcttcctggtattgtcttgcttaaaaagctgtccttcctctagtgcatgtcccccttgatctggttgtgggcatagctggttgcttccagcagggggcaccatcatccaggagaaaagtgagttgacttgttcttttagacactgttgacataataccttctcaggtagctactaacccccattatacccagtgctccagatctcttctgccttctttctctgccctggactggcaataacatgctgacacaggccatttcttcttctattccctgtccttaggaatgatgatgaaagggagagaactggaagttctggtgggtgggtggctgtgatgtccttagaacatggttttctttcctaaggatttttgaccctcgtgtggacatcgtgcaggccgcttggtcaccctttcagcgcacatcctgggtgcaaccactcttgatggacctgtctccctggagggccaagttacaggaaatcaagagcagcctagacaaccacactgaggtggtcttcattgcagatttccctggtatggaggaaagtgaggagaggcttttctgtctttccttctggcttccttggccagggacattccatgtggtgggaggggagagggaatgtttttgaaacctaaggggatgatggtggtaaaggtgtgatgtctctgttctggctgggagtgagttcactctgccatggggtgggatgatgaactctgttggtctggcaggactgcacttggagaattttgtgagtgaagacctgggcaacactagcatccagctgctgcagggggaagtgactgtggagcttgtggcagaacagaagaaccagactcttcgagagggagaaaaaatgcaggtattttgctgggattaacaacagcagaaagaactgagtgcagtagctcacaccagtaatcccagcttcttaggaggctgaggtgggaagccaggaattcacagtgagcctgagcaacagagtgagaccccatctctaacaatttaaaaaacaatggcagaaagcttagatgagcaagattcacttattatagactgaaaatattttaccatagcagtaatgcagtggagctcaaaaaacaagggcccctgggactgtgaagagcctcatccaggattctagaggtccgttactttcgattccaaaacacaattgagtagaaagaagccaagagtcatagagtagggaggccataagctggctagagaaaagctgatgaaatttatccatttcttctcccttgtcagttgcctgctggtgagtaccataaggtgtatacgacatcacctagcccttcttgctacatgtacgtctatgtcaacactacagagcttgcactggagcaagacctggcatatctgcaagaattaaaggaaaaggtggagaatggaagtggtgagtgtatgaacatttgggctgagatagcctctggtttcaagaagtcagggttatgaatgatgttctagccattcaagaatgaacttgaagtctctagctggcagaagaggagttctaaggggagagagtgatccatctcagtgattcctcttttttctgtcttccgggcagaaacagggcctctacccccagagctgcagcctctgttggaaggggaagtaaaagggggccctgagccaacacctctggttcagacctttcttagacgccaacaaaggctccaggagattgaacgccggcgaaatactcctttccatgagcgattcttccgcttcttgttgcgaaagctctatgtctttcgccgcaggtaagttcacaacaatatttgtcattgccatcatatgttggcaagcttggtaactttcccctggggagagtaactctagagactgtcatacaggaaaggacagtttagctctaggtatcttttcctgccattcttcttgatttactggaagaataagtggcctatatctgatggcctgctttcttgttctgcctcagcttatctccagcctctctgtgggctgttcctaccctatcctggaatcctctaccagactgtataaagagtggtgtacccttccagctgggagatggagggtcacttggggggagattcccatatatgcctgtgtgggaggagtgaggaccaggtgccttctaagggctttagctgaaattcttctggtgaaacaggagtttgaacttggtcggctttttcctgtttttcagcttcctgatgacttgtatctcacttcgaaatctgatattaggccgtccttccctggagcagctggcccaggaggtgacttatgcaaacttgagaccctttgaggcagttggagaactgaatccctcaaacacggattcttcacattctaatcctcctgagtcaaatcctgatcctgtccactcagagttctgaagggggccagatgttgggtgcagatgtagaagcagccagtcacagacccattctatgcaatggacatttatttgaaaaaaattctcaaaagttttttttttttttttgggggggcggggttctaaagctgtttttaactccgagattacaacttagaggaaccaaggaaataaagcaaataagatttaacaacccaagattaagaggccaggaagaggttagacgcaatgtgaaactgtcctcctaggataaggtttaaagtggctttttgggggctgggtgccgtggctcacgcctgtaatcccagcattttgggaggctgaggtgggcagatcacttgaggccaggagttcgagaccagcctggccaacatggcaaaaccccttctctactaaaaatacaaaaattagccagacgtggtggtgggtgcctgtaatccaactacccaggaggctgaggcatgagaatcgcttgggcccaggaggtggaggttgcagtgagccgagatcgagccactgcactcctgggcaacagagcaagacttcgtctcaaaataaataaataaagtggctcttggggaaaagcaatttaatgtaccacgatgaatagctaactgttcccaagtgtttgctatgtgcaacacaccgcgtgagcagtgttacctgcattattacattaggctgagaggtaaaataatttgcccgaagacatacagctagtgacgaatggactgatggtttgaacttaacgtctatttgacttaaggtcctgcaccctgccacttgtaattttcagaatcactgataatctgaaataatgcagcttaaaacatgttttcttaattaaaagtataattggatggtggtcaggttgtaaatgcacacaaagtaatttatcttcattgcaattttggttccttctttgttcctattatctatatacacccagtgtttcactagcagttatgagagcagtcagaatagcagcatcaaagttaaataaggaaatctagatgattgctagattttctctaaaaataagcttagtatttggtattattctagcctttggtgagcagaaggggaggtaaagtaagaattaactaaatttagtaagggattagggaatgcttagacattttgtaggttggggtatacaagggtaactcaggaagctcctcagttcagtgaaaattcaaagggttggcactgagctaggaagcgagaatgcagggttatgaaaaaggatccctgctttgggagctcatggacttgtagcagagaccggtagtaaattggcagtctcagtaacttctgtaaatgattgcatctctttgcaggcttctcttcccatactctcccccactcctccttggacagtgttccgggggttctttcctaagcaactgctttttcagtatacatacttcagatgattgtgtctactccaggatttccaacgatgctaggtttctttcctgtgccctagacgtataggtctaagttccacctggatatcccacagggctatcaagctcagttcatcctaaacagaacttacattcatccccaactcagacttccttattctttattattgaatggcagctctgtaccttagccaagctgttatctctaggtcatcagccttgactcttcctttttccttgcatttcttaaaattgccaagtcccatcaattttacctcctggatacctcttgaatctatttttttttaaagacagggtttcactctatcacccaggctggagttcagtggcacaatcttggcttactgcagccaccacctcctgggtttaaacgattcttccacttcagcctcccatgtagctgggactacaggtgcccaccaccacgcccaactaatttttgtatttttagtagagacatggtttcccacattggccaggctggtctcaaactcatgaccttaagtatccacctgccttggcctcccaaagggctgggattacaggtgtgagccaccgtgcccagccaaatctgttttcattactacctatatctgtattttcaacctttgtattagcatctagttagggata

SEQ ID NO: 15930 - DNA, 8581 bp, Human
acactattcacaagtgagagaagtaggtaagcaactatgtacagctaaatctcatctccttggcaggcctagccccactgtggagttggtagcacaggggtatcaggatttaatgagccaatcattgactttacgctccttgttctgactccctaataaaataaccttctagttatattctggcttcccatatagatttttctgctgggagataatgcactgaccagcctacacacgcattttgttccagttgacaattttattacacattgtaagttaataaattggcattctcctttaaaaaataacaaaaaaatttaatagtcttatacagttactttcccatgaagggttagcttgaaaagtaaaaagcaacgaataaaaatatcatcacctattgtctcttttgtggtcgaaccttttcttgctgcctgctttgagcgaccgtggatgtggtcactgagtctggggaggagccctttatcttctttgtggatgcccccagcacagcccaagtgcttcctttgtttcccactgagcctttagcaaatcccacctttcctcctgcaccgacggagaggattgttcttgggaatgcaccttgttctactgccgccagcagtaggcagctggagactgttactaggggtctccttcacctccccagcgtaaagtacatcccatgctaggagcaggccgttccctgagaacctcattaaacccggcgttcttgtcacgcgctccgctcagggccaccaggccaccagcccgaccagacctgcaccgaggcccagccccagaacaggctgcagagacccccgcccccaaggcgggctccctccaaacgggactccatactccttgctggctcaagttttgtttcgctctttttccctgtaattcctttattgggcaaaactgggacaaacgcaggtggacattttaaagtgaaagcttcatgaaacagcccattccacgccgtcaagagatctgcttaagcacattcaagggaacgaatagcccccacccaccaaaaaagaaatgttcgttccatattctcctgaacagaggattgaaacatcgattcccccccccttcaaaggaacaggaaggccacggggcaaggacggacttgggagcggcctcctttctctctggagggaaaggctggagcgctgcctccacttttaagtccacgaaccacgaagggtgaggatccctcagaaactttagcgcaggggagcgggcaggagggcgattgtttaaatcgatggcagcaccttcattaatctgctttccggccatcttcagcagagccattcaccaggaaacgactagaaggtgggcctgcgcccctcagatatcccggggccggcaacgagccgggcagggacgccgaaggaaggccgtgaggagccctcgctggccggccaagatggccaccttcacatggccgaccgccaccggctccctgccacccggcatctagaggcgggacggccagaaagaccccagccgcagcacaaaacctccgcgattcccgccgcctccgctgggggacgcgacctccgggaaagctatcccggccaacggtcggaagggaggtgccatgtcaccgcacaggggagcgggtccagcaagccccagtcgctttttctcccacatcaaacaaggaagagcaatcccccacgtctcctcgcgtctgcatttttctcctagctctagcggctcaagatagctgaacggtctctggagggccggattgccacggcacctcccgcggccgcgcagtgtggttcagcccggactccgcggggcgagctgcccttcctcccccgacccccgcgcaagtggtgcattggcgcgcggcgccgaggggcggggcccgagccgggcgcgcgcgggcgctgctctataaataccgggccgcaccgcccgctgcttcgttcgctccgcgccgcccgcctgctacgagtagaacgctgtccgcagcttgcgcatttcgcagccgctgccgcctcgccgctgctccttcgtaaggccacttccgcacaccgacaccaacatgaacggacagctcaacggcttccacgaggcgttcatcgaggagggcacattccttttcacctcagagtcggtcggggaaggccacccaggtgaggggacggcctgaagcgaagcgtggggcggggcagaaggcagcgccaaggtccggctggctgcggccggccggtggtggggcccgcgcgggtcgtcctcgtccgccgggtgatggaagagcggcgaccgcgcgctttcctcgtggcgccgccagggcctggcgcgtggccgccgctcctcttccccctcccctctccacccttcccttcccccctcccttttcattcggtcgcgcgcctaggcatgcggaaggttccagaaaacgtgaagggcgggggctgtggtcgctagtgagttctggccgggaagggagggcactgttaacccctcccggccctgccgtctgacaaacctggagtgggcgacccgccccgcgtgctcgcgtccggccctcgggagcgcgcgccccgcattgcagcggcgaccacgtgtttgccgcatgtggtatctgggcgagggggagccgtgagcctccccggctgtcctggccctcagtttgaggggtggggggcctatgccttgggacgtcgtctggctccactgcctcagtggttaggtcttgactacacactggagaatacgcacatgcccttcggcggatatggccttgcctccaaggtgacggcctctgactaaatatagctcatgtccaagaaggcagtccttatttggaccccttgtgaaaaggatgggaagcatgaattaggagctgccattgctttgggttcgcatttaaagtcttcggtgcagggttttacttgaggctttgtccgctcaaccgccattatggggatcaattggcacgtgaaggaggagtaaagctatatttccaggaactgaaaatctcagcctgagcatatcggctagtaaagatgattatttggctcttttggctgtttctgcccttaggatgaccgcagtagttatctatctggtggctttagggtctggtcagtttactgtgcccatgatgaaatcccacaagtaacttagtggtatgagaggacaaacccaggatcttgatgagtgctgaaggttagctgttacaccagttagtagtagaccgaagttcagagcctgcagtctggcttccacattatgtttggattctgttttaggcggttatagaaaattcagaaaaacgaacttgaattagggagatatttgttctccctcctaacaatagatgacaaagcagggagacatggattcggaatacgtttgagcatcttctacactgttgagcttttgtttcctgcgcaactcctaacagcaaaatcagataattgccattttagtcagaaaatgcttttcatttaattgtttaatcgaattatcttgttgctcattataattggtgttccttaagattagggaaactggcctacctgtggcctcagttctaccagactcccaggtgcagaggggtttggtacagttgtggaagtgaatatgatatagggcaaattctgttctttaaaggatataggactaacagttcacctttctggtgattagatttataatgcaaactttgaattttaggaggaaagtgcaaacacaatgaattaagatgtattaagcatgttttttaaaatctccaaagattttacagatagtaacagggagggagcttgcatacatacatacatactttgtttaaagttaaagaaactgagccaggaatttctcttttccagataagatttgtgaccaaatcagtgatgctgtccttgatgcccaccttcagcaggatcctgatgccaaagtagcttgtggtaggttcagaatgtgcttatcaactggtggaaagatagcataaaaattatttttatagaagtgatgtttgagttgaatgtctctttttattagaaactgttgctaaaactggaatgatccttcttgctggggaaattacatccagagctgctgttgactaccagaaagtggttcgtgaagctgttaaacacattggatatgatgattcttccaaaggtgtgttttaatgattttgctcatttttttctaggtaacagctgtgaggtttgaagaaactcctagaatgttcctgctaatcctaaactccagttgtatcttactatacactaagccctattctgttcattctctaaaaggtccgatggtttaggtatatttgatttcttcagcagtgtttagaattccagataattgctgtaaacagcaggtatttctaggacgtaaacaagatgttgtgttttttgcttataggttttgactacaagacttgtaacgtgctggtagccttggagcaacagtcaccagatattgctcaaggtgttcatcttgacagaaatgaagaagacattggtgctggagaccaggtatcttggtgtagaggctgttttaatctcttctaacattaaattctggagcttgatcacattggtgacttttctttctttagggcttaatgtttggctatgccactgatgaaactgaggagtgtatgcctttaaccattgtcttggcacacaagctaaatgccaaactggcagaactacgccgtaatggcactttgccttggttacgccctgattctaaaactcaagtaagtgatgatcataaagcttggttgtctcatttattacatcagcacagaagatccataattttgataatagctaactggaaaaaatagcatttgttttcctatattgtaacttcaggtagagaaacaaatacaaagttattgtttggtatgatgttctgatgacctgtgttgccttcaaggttactgtgcagtatatgcaggatcgaggtgctgtgcttcccatcagagtccacacaattgttatatctgttcagcatgatgaagaggtttgtcttgatgaaatgagggatgccctaaaggagaaagtcatcaaagcagttgtgcctgcgaaataccttgatgaggatacaatctaccacctacagccaagtggcagatttgttattggtgggcctcaggtaatgtcattttgttgcatttttctggatttttgatggttacttaaaattttggctactacatttttttcaggctttctgaaacctacatgtgaatcatcggaggatatttgctgaatgaattcagaataggcaacctaatccacttggaaagcactaggcgtaaagtaacttaaatcctgtaatttcagggtgatgctggtttgactggacgcaaaatcattgtggacacttatggcggttggggtgctcatggaggaggtgccttttcaggaaaggattataccaaggtcgaccgttcagctgcttatgctgctcgttgggtggcaaaatcccttgttaaaggaggtctgtgccggagggttcttgttcaggtatacactctttatataacgaacgattaaaagtcatgtaagtgggagggtatttagtagtaatctacttaactacttgttttataccaacgtattatacaagtatatgggtctttgcaatcactgattcttacgacatttgaatccttttaggtctcttatgctattggagtttctcatccattatctatctccattttccattatggtacctctcagaagagtgagagagagctattagagattgtgaagaagaatttcgatctccgccctggggtcattgtcaggtaaagatggtaaagcctgttgctagtcaagtattgagggtgttgggtgtgtgtgtatatacttaaggctgaggaggtgaaggtgtgaaggaagactcctcaaatgggaatatattttaattcctggaacagttttgaactgctgccttagtgaagacttagttatttgagaaatttaaaattacggtgctccatggcttaggctaaccactctagagaatgttccagatttgatatttgagctttgtgctcttctacttaagggtgttaagaaaatagagataaagtgggttgctcaaggtttgttgcaatgtaaaaaccatggtagggtgtgggcggcgggaccttggtaagtattgtgtgatctcaggtgagctttttgacaattgaaatttctcagaataatgacaagttttcgtatttgttgagccagggacggaaaaacaactatagttactaataaggactgtgcaaggagtttggacaccagggaagtaacacttttgccacaaatttttttcctagcatatcccagagaactcatttgccagagctcttgaaaatgagtcttgctgattgttttgctttattttaatttaatgctacatattaagttacggacttgtatattccagggatctggatctgaagaagccaatttatcagaggactgcagcctatggccactttggtagggacagcttcccatgggaagtgcccaaaaagcttaaatattgaaagtgttagccttttttccccagacttgttggcgtaggctacagagaagccttcaagctctgagggaaagggccctccttcctaaattttcctgtcctctttcagctcctgaccagttgcagtcactctagtcaatgacatgaattttagcttttgtgggggactgtaagttgggcttgctattctgtccctaggtgttttgttcaccattataatgaatttagtgagcataggtgatccatgtaactgcctagaaacaacactgtagtaaataatgctttgaaattgaacctttgtgccctatcacccaacgctccaaagtcataattgcattgactttccccaccagatgctgaaaatgtccttgtgatgtgcacgtaaagtacttgtagttccacttatagcctctgtctggcaatgccacagccctgtcagcatgaatttgtaatgtcttgagctctattatgaatgtgaagccttccccttatcctccctgtaacttgatccatttctaattatgtagctctttgtcagggagtgttccctatccaatcaatcttgcatgtaacgcaagttcccagttggagctccagcctaacatcaaaaaaggcagttaccattaaaccatctccctggtgcttatgctcttaattgccacctctaacagcaccaaatcaaaatctctccactttcagctgtcttttggaggacgtacgtaataaggttttaatttagtaaaccaatcctatgcatggtttcagcactagccaaacctcaccaactcctagttctagaaaaacaggcacttggcagccttgtgatgtcatacagagaagtcacagggcagtacctgagggtctgtaggttacacactttggtaccagataactttttttttctttataagaaagcctgagtactccacactgcacaataactcctcccagtgttttaactttgttttattttcaaaaccaggtccaatgagctttctgaacagctggtgtagctacagagaaaccagcttccttcagagagcagtgtttttggtggggaggaggaaatcccttcatacttgaacattttctaattgcttattgtattctggggtatggcgtaagtacagagaagccatcacctcagatggcagcttttaaaagattttttttttctctcaacaccatgattcctttaacaacatgtttccagcattcccaggtaggccaaggtgtcctacagaaaaaccttgggttagacctacagggggtctggctggtgttaacagaagggagggcagagctggtgcggctggccatggagaaagctgacttggctggtgtggtacagagaagccagcttgtttacatgcttattccatgactgcttgccctaagcagaaagtgcctttcaggatctatttttggaggtttattacgtatgtctggttctcaattccaacagtttaatgaagatctaaataaaatgctaggttctaccttaactgtgtctgttactcatttgttaaagtgctttggggccataggtacgtgcctataatcccaacactttgaaaggctgaggtaggaggatcactttaacatagaagttggaggctgtagcgaaccattatcaagccactgcactccagcctgggtgactgagactttggctcttaaaaaatgctatcatatgaataacctgagaatactatatgtgtatctttaaccttgaattgtaatccataattagccataattcaggaaaataacctcaatccctagacccagtgggtgggcattttttaaaagcctaagcaagatttagtcctcctagtccacttaagccaaaattcatgtgtccttattgcagcagccattcaatgccatttttaagttttcaactaaggttgagggcttcaaaccattgaaggcataaaaaccgctaaaagtattaacctggaagtggtaatgtctatctaaagtcctggcaatttaagcctattaatctgcatacatttttaaattatgagct

SEQ ID NO: 15931 - DNA, 22539 bp, Human
  misc_feature (1)...(22539): n = A,T,C or G
cagtggcttgatgtccagaatacctggggagcactgcagagggagtttcagaggagggatatttaagctgagtctgcagagtgagcagagttggtcaaaggaaggcagatagtaggcagcgggaggtggtttccgaggactccttgctggagtgtgcttgtctgaggtcacccagatagaaagattgtttccttaccccaggccccacccatggacttcagagaaactcattctggttgggattttcgaagctgcctcccacaaaaggatcttaccactgtgtcacaaggccatggcctgatcctcatgctctttgtcaactgacatctctcatgggttggctatgccacattcaggagccaaggcggaagtgtggacccatcgctgtccaacacatttccagaaggcctggcctcctggtgcagatgcttgctggcctgttttcctctgaataaagaagagaagggtcaggtgttgcaggtcagatcagcctgggttagaatcctggttcagcagttgggtgcggtggctcatgcctataatgccagcactttgggaggccaaagcaggaggatcacttgagcccaggagtttgagaccaacctgggcaatagagtgagacacagtctctccaaaaaaaaaaaaaagtttagctgggcgtggtggcatatgcctgcagtcccagctactcaggaggctgaggctggaggattgcttgagcctgggaggttgaggctgtagtgagctgtgatcacagcaccgcactccaggtgccgcgacagagtgagaccctgtctcaaaaaaaaaaaaaaaatcttagttctgctactgaactagcaatgtgacactctggacaagttagttaccctctctgagcctcccaaagacttcatgtttccagcaggaataatgatagtagatgtgaggacgcaccaagcacatagtaggctctcacagaacagtagctgttcacagggtgattgaggccgggggcctaacgattgaatggaagtgaacactgcaattctctcgcaaagtttacagcacagtaagcttgtccttagcttcccctataccctccttcccacgcccaattctaggaccctttcgggcgccccagcctcccataggggctccccgccagctcagaccggccgggcccctccctctgactcaccgggggcggctcctggccgcgcacctccagggggcggggggcggctgagacagcgcccagggcctcggagcaaggcgttggcaggcaagtagtgcgcttcggggtccggtcgccggggacctgggctccccatgtaggggtcgaacgggcttagccggttcgggggcgccccgctccctcctcttctcccacagccggggtcctctcttaggggcgcgccgtctcctggcttcctgtaagaaaaggcgggagagggtgggtccgtgctaaagaaatactttattttacttcatttgggacaaactaagcagtagtgctcaggggagaccacaagggtaggaacactgtgcgtctggtaaaaaaactagttctagagcgtcgttaccagataactcattagcatgtgcattgagttcctagccgctcccgagagtcctaggctgagcgaccggcccttttgtttcgctgttgttgttgtttgttttttgagacggagttttgtttttattgcccaggctggagtgcagtggcgagatctcggctcaccgcaacctccgcctcccgggttcaagcgattctcctgccttagcctcccgagtagctgagattataggcgcccgccaccacgcccagctaatttttgtattattagtagagatggggtttcgccacgttggtcaggctggtctcgaacttctgacctcaggtgatccgcccgccacggcctcccagagtgttgggattacaggcgtgagccactgcgcccagccagttgtttcgctgttaatgtgtaaacctctccccttttttcctgtggtgataggagaggctttagcctagacagctgagtgtgaggaacagtgattcccattgatccttgttccctccgtgggtcacagagtccagaacttaagagccacccaaggtatgcgctgttgtgaccaaaatctatgaagctttccagcgctggggctggggatggaaataggagagtgctctgtggtttaactttctttcctcctgtggagaaaccgggagctaggggagtggccaggcacatttctacctcaggtgctgatggcacattgcaaactaaagggaagagaaagaagtctgggtttatcgagcatgtattatttgctcattaatcataggatctcatttcatcttcacatttaactgtatgcacgtgttacagattggggcacagggaggctccaggaggttaagtcacttgcacagctagtaaggagccaaattgtctagctcttatcactctaccaggttaaccgcccagcctgtggttttgtggggactaggccctactgggattctcacccagactatccttttttttcttttttaaacttttaagttcaggggtacatgtgcatgtttgttatataggtaaactcgtgtcatggggctttgttgtacagattattttgtctccccggtattaagcctagtacccattagttattttcctgaatctctccctcctcccaccctccaccaaactaccctattattattgttattattattattttttgagactgagtcttgcccagtcacccaggctggagtgcaatggcgcaatctcggctcactgcaacctctgcctcccgggttcaagcgattctcctgcctcagcctcctgaatagctgagattacaggcatgcgccaccacccccggctaattttttgtgtctttagtagagatggcggtttaaccatgctggccaggctggtctcgaactcctgacctcatgatccacccgccttggcctcccaaagtgctgggattacaggcgtgagccaccgcgcccggcccatattaccctatttttaagcctggcagtttggccatggagacacttggatgctagctacaggccatgttctttggggagaagatttaacttcccgtcttgctctagtgaaattttatcaatttcgtttcaatgagaaacattcatccagtattgctttttttttttttgagatggagtcttgctttgtctcccaggctggagtgcagtggcgccatctcggctctctgcagcctccgcctcctgggttcaagtgattcttctgcctcagtcgctccagtagctaggattacaggcacccatgaccatgcccggctaatttttgtatttttagtagagacagggtttcaccatgttggccaggctggtcttgaactcctgacctcaggtaatctgcctgcctcagtctcccaaagtgctgggattaccggagacagccaccatgcccagcctatccagtactgtattttctccagacttttcccacgcagtcaaataatgaggttttgtttgaaggtctgctaattaggaagatttgttccagattttgctccagggtccccaggccttgaccctgaacctggagccttgtctcaagccagcctgctgaccaatacctttccaggacaggccggctaggttctgggcagaggaactacgcttgtgtggctgcataactgggtgctcactttctcctggagcctcatactgagtccgctcatccttcccccagggattcagaagggaatgggagcctcccttgcaggggcttccactccctgtgtgtttgtgggcagtctcttgtgctctcaggacctcggtgtcctccagaaagccagcgagttggaggagacaagctctagggtctagtgactgtgatgtaggcaggatagttgccctgggtcaacccaggatgggctgtctctcagagggcccagggcccagaagtcatgatgataaacatctggtgaatgagaagcagaccaaagggtagagacctgagaggcatcagcatggcatgcggaagatggtgaagaatgttttatggcctcagccattccctgagaactgagcttagccaggtgcagtagcccacgcctgtaatcccagcactttgggaggccaaagtgggaggattgcttcagttcaggagttctagaccagcctgagtagcaagactctgtctccagaaaaaataaaaaaattagtcgggcatgttggtgcaggcctgtggtgtcagctgctcaggaggctgaggcaggaggatcgcttgagcccaggagttcaaggctgcggttagcggtgataatgccacggcactccagcttgcgtgacagtgaaccctgtctcaggaaaaaaaaaaaaacaaaaaaaaccaaaaaactgatcttaaaaaaaatcaaatacttgcattcagggcaaggagaaagacaaactgagggaggaggaaaaagtaatgtgaagccagtgaccctgcccagaaaatgtgactaacccagcagcggtgggggctgtgccgcgcctgccccaggccctgaatggagaacatggctttccttgctggtctcagactcagagatgccctccctgatttgccttggctgtgacctgcagcgggctgaggccactgtggtggggctgtgtggacctccagcctccctgtgtgcccctctgaggagacggcctggcatacccactgcccaccccagtgactgctcttctgcttcaggcctgctggcctcccagcactgcctgcccctccctgtcgggggacatcgcctccacaccggctggggaaggagcccaggggtggggctggtgggtggggctggtggttggggcagccagagaagtaagagggaagtgagaagccgggtggggcaggctggaaggaagacgaacctacgaagcagaggtaggaggaagaaaggaaagtaggagtgttgaaaggtgaaggtggcagggtggctgccagcgcggctggctggtaccctcctgggtgggcaggcgagggctggctgtggtggcctgggaacagagacccacatttctggataccacattgtgccagggtggagttcccccagcctgctgtcctgccagccttatgccaggctccaggcacctgatctgatggcagctgtgaagctgcccgggaggatgggtgggctgtgcccatgctgcacatggaggaactcttgggtcagggcttgtcccagctgtgccagacctcctgacggaggccaccacactgctcctgaaggccctcagccagactggaggtgaaatcagattagaagctgcctgtccccaagacaggactgtggtgtgatgctatttgggtgggagtggcttggggagggggcagggcagtcctagccatttgaattcaaatgcaagtggcacatttgattattttgcaaactctggaagaccttggctgagggtctaggtggactgtctgaggtaggaggtggggagggaggaagtggttgaccctggggaagggtaggagacctatttggtatcaggggaaaaaccatttggaatccccaaatgaggcctctggacctagattctgagaatgccatgtcccaggctgggagattcagtttggtttcgagggtgggcacctacctccaccaggagaagtggaggtgctgtttcatttcacacctaggggcaagcagggactgtgaagggaagagacctattgggggtcagtggaatcagggtctgaggaaggcaaaggtaccactggaccccggcaggatttttgtccctctgatggctgtcaagtctttccttaaaggtgtgtgtaacggtgacctcctctccgaggtcccccagtgtgtcctcaaagacagcctaagtcaggaccatgggacagccagcaggacttgcgtcctcccctcccccagccccatggcagtctgggacccctagcccctgctctctgcctcctggggctgctccagcctgtcccagccttttgaaatcctgggctatcccttaggtgccaccccagtctaataatcagagcccagcaggtccagttaatcaaatgcattctttgagcacctgcatgaggttccagctagatccagaggcaaaatacacttcctgccctaaaggaccctacagtgtagtagtggaggtaggtgggtccataactcaccacactatggcagagtggggaaaagtaaaggctttaagaggtgtagaagaggctgtttggtaaggtggtgagtttcccatcactggaagccttcaagaagaggatggtaagggatgctatagaagagatttctgcactatgcgtgtatgggtatgtgtagggcggtgcaggcagagcaggactagataagaactttagcgctttcttttttttgttttattcctcccccccggccccagctcccctcttcaactttagcactttctaatgctgacatctgtgattctgtgacattccccacttagaggaagttcgtctgcggtttcactgggtatggtggctcccttgttcactgcaccctgcagctaaaccataaaacatgggctattctttgtctctgtgcatgtcacccccagtgccaagcccccagcacagacgttgagtggaatggaatagactctttgctgggctgcttgaggaacagaggcatcaggtgtgtccttgctccagttgagatgtgaagcagccagtttatgctataaaacaggctaaagtatgtgctcccaggggagagggctgggagaactcccagagaaggcggaggccacttaatgtcctggaagtttccttggacagctggggcttgatacgggcctggaaggataagggggcttgtgtgtgtgtgtgtgtgtgtgtgtgtgtgtgtgtgtgtgtgacagattcttcctctgttgcccaggctagagtgcagtagtgccatctcggctcactgcaacctctgcctcccgggttccagcaattctcctgcctcagcctcctaagtagctgggactacaggcacgcaccaccatgcctggctaattttgtatttttagcagagatggagtttcaccatgttggccaggctggtcttgaactcctaatctcaagtgatccacccgcctcagccttccaaagttctgggattacaggcatgagccactgtgcccagcctaggatgagggggctttaatggatgtaagggtgaacatggacactgaggaagctcaaggagctgtgggcttggacagagggctgggataggggaaagaatgaaaggccagaggtcagggtggacccttccccaggagagactggaacaaaaggtctcgggacagagatctaatgaggcagcaggagtttcaaccctgaccaagcattagagtcatctggagcttctcaaacactgacatccaggctccacctagagagtctggttttaatgagtccaatatggaagctagtcactggggtttttctttcttatttttctgtaaattactttttttttttttttttttgagacagagtctcactctgtcacccaggctggagtgcagtggtgtgatctcggcttactgcaacctccacctcccaggttcaagcaattcttgtgctgcagcctcccaagtagctaggatgacaggtgtgcgccaccacgcccagctaatttttgtatattttgtagagacaggatttcaccatgttgcccaggctggtcttgaactcctaagctcaagcattccacctacctcagtctcccagtgtgctgggattacaggcatgagccaccatgcctggctggcactggggtttttcaaaagcccccaaatgattctaatgtgcaggtgagcatttgacactgttctggacagaattcactggcactactaccatcactttgaacatatgttcaaaatatgggtgatcaagccccattccagacctgtggaatcagaatccccagaccaggggcttgggcactgttaaagaaaaaaaatatggcccaggcgcagtgcctcacgcctgtaatcctagcactttgggaagccaaggtgggcaatcactggaggtcaggagttcaagaccagcctgactgacatggtgaaacctcacctctactaaaagtacaaaaaattagccagatgtggtggtgcacgcctctaatcccactacacaggaggctgaggcaggagaattgcttcaactcaggaggcagaggttgcaatgagctgagactgtgccactgcgctccagcctgggcagcagagtgaaactctgtctcaaaaaaaaaaaaaagaaaatttctaagtaggaaacatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctcagcctcccgaatagctgggattacaggcatgagccacgaagcccagctaattttgtatttttagtagagatggggtttctccatgttggtcaggctggtctcgaactcccgacctcaggtgatctgcccgccttggcctcccaaagtgctgggattacaggcatgagccactgtgcccggcccctaacaggattcttgctgaatacaggccagagtgatcagacatcactggggcggcgggggcagggtgttgaggaacccaatcagatatccacgattatcagatcgaccagatatcaagggtagggggttctaggtaaatggccttagcagggttcttttgctaaaaccggattttacaagcacacagatgggcctacggggtggttcagaagcctagttaaagtttggccaagcaaagaatctttgtcagtaccgacattttaataaggtcccaaggtcattctaatgagcagccaaactcctttcttttctttttttttttttgaaaccgagtctcactccattgcccaggctggagtgcagtggcatggatcttggctcactgcaacctccgcctcccaggttcaagtgatttccggataatttttgtgcttttagtagagacggggtttcaccatgttggccaggctggtttcgaactcctgacctcaagtgaactgctcaccacggcctcccaaagtgctaggattacaggcgtgagccaccgcacccggcctgccaaacccctttcatccaaaccctgatgtggctctctggcatgtaggctgcctgattttgagttaaacacagaatgaaaaatagtaaaggtgacaattggcgcactccgtgtctcattcttgagcgctccctgatggcttgagcttggggcagccacttcaccagctcaggcctgagtcacaggctgggctgcctgttgcaggggatgtgggcacagcatgtgatcctctgtgggatggagaaacgttaaagtttccctccgcaaacctctgctctctgcatgtcctcttccggaatcgtggtgccaaaatatgccttccactattttgtaggttgggaaaggaaaaggaaagtcataattcacacagcatttcacatccattatcactgcccttgacctgtccctctttgtttcctactcagacttaataccttctgctctgtcatctgccttccccctacccctgacttccctggcccctgcgaaatattgcacttcctgatcctgctgccccagcccccaagaatctcctaatggtgccagcttgcatttttaccctccaattccccaagcccttaccctgtgccactggggctcatcttacacaaactctgtccaaatggatgcacagcatgaattgtattatgtacgaagtgcatgctggctctgtgatctctgcattttgagccaaaaaaagaaatcctctagtgatgggaacctatgaaagcgacagtgagtggagccgtagctgttgcattttctgaattttttaaaaagataatatctttttaaaaaatacttgcgtttagcattttttcccttgaatgacttttgtccagaaaaagtgttcatcattctggcatttgagggaagctgggcatacagaattgatagctgatgcctgggagtgggtgaaatttctcagggagggagtttagaattagagcagccattaaatataatgttaggtgaagggtttttgtttgtttgttgtattttaatagatgcctttttaacaggttaaggaaatttctttctattcctagtttgtgggtaaaaaaaaaattttttttttttttttgagagggggttttactctgtcatccaggttgcagttcagtggcatgatcttggcttactgcagcctctatctcctgggctcaagcgatactcactcctcagcctcctgagtagctgggatctggaattacaggcttgcactaccacatttggctgatttttatttattttattttattttatttttttgagacagagtcttgctctgtcacccaggctggagtgcagtggcacaatctcagctcactgcaacctctgcctcctgggttcaagcaattctcctgcctcagcctcccaagtagctgggattacagacgcatgccaccatgcccagctaatttttgtattttagtagagacagggtttcaccatgttggccaggctggtctcgaactcctgacctcgtgatccacccacctcggcctcccaaagtgctggaattacaggtgtgagccactgcacctggccttggctgatttttaaaatttttgtagggttgtggtctccttatattgcccaggcttgaaaaaattttaaactaggaatgaatgtagaattttgctaaatgctgtttctgcatctattgaggtgattacacatacatgtttgttaatagggtgtatagcattgattttcaaattttggcctgttttttttttttttgcgttgtgagcggctttatttatttattttaaatttataattgacagataataattgcacatacttagcaggagcagtgtgatgtttcattgtacatatgcaatgtatgtgtatatattgtataatgatcaaatcaaggtaattagcatatccatcactttaaacatttatcatttctttgtgatgataacattcaaatcctctcttctggctatcttgaaatatacactgcattattattagctatcatcaccctgattttcagatattaaaccaaccttgcattcctgggataaacctcatttggtcatcatggtttattttttatatattatttgatttcatttgctaaaattttgttaattttttttttttttttttttttttgagatggagtctcactctgtcacccaggctggagtacaatggcatgggcttagctcactgcagcctctgcctcttgggttcaagcaattttcccgcctcagcctcctgagtagctgggactataggcacgtgccaccacacccagcaaatttttgtatttttagtagagatagggtttcaccatgttggccaggctggtctcgaactcctgacctcatgatccacccaccttggcctcccaaagtgctgggattacaggcgtgagccaccgtgtccagccaaattgtgttaatttttgtatgtgtatgttcatgagagatactgatctgtaattttctttttgcataatatatttatctggttttgttatcaggagaatgttggcagcataggatgaattgagaagtgttctgtcatctctttttttgaagattttgtgtacaattggtattatgtcctttttaaatttttggtagaaattaccagggaagccatctgggcttgggttttttggcgggggaacgagttttttactacaaatttattttctttaatagatatggccactgttcagataatctgtgtcttcttgaatgagctttcataatttgtgtctttgaaggaatttgcccattttatataagtggttgaatatattggcataaagtttttataatattccctttatccttttaatatctgtaaaatctatggtgatctcacatctctcatttctgtattgatatttgtgttttctctttctgttaatcagtttgtctaaagatttatcaattttatcggtttaaaaaaacaacttgccaggcacggtggctcacgcctgtaataccaacactttgggaggctgaggcgcgtgaatcacctgaggtcaggagtttaagaccagcctggccaacatggtgaaaccctgtctctactaaaaatacaaaaattagccaggcgtggtggtgtgggcctgtaatcccagctacttgggaagctgaggcacaagaatcacttgaactcatgaggcagaggtcgcagtgagctgagatcacgccactgcactccagcctgagtgacagagtgagactctgtctccaaaaaaaaaaaagccaacttgaggccaggcatggtggctcatgcctatactctcggcactttgggaggctgagatgggcaaatcacttgaggtcaggagttcaacaccagcctgggcaacatggcaaaaccccatctctactaaaaatacaaaaattagccaggtgtgatggtgttgcctgtaatcccagctgcttgggtggctgagaccggaggattacttgaacccgggaggcggaggttgcagtgaggcgagatcgcaccactgcactccagcctgggcaacagagtgagactcagtctcaaaaaaaaaattcattgctcttctctcttgtttctgttttctgttaatttctgcttttattttaatttctgtgagatctcagcagacggaagaccctggcccaggggtcagagaccttatttccatgaaccactcactagctgtgtggccttggactcatttctgagactcattttctttgtctgcataatggaactagggctcctagaggtggagtagttgatgaatatgaaagtacttggccactggaaagggcctctccagccccacgtgagaggtcctttttgtggcatttgtaataataatggcttcttctttctttccagatctgaagacagcatgtacacagccattccccagaggtaagctgcatgccccatctcctttcacaacttccccttctttacctccaagggctgcccctccccactgctctcctcatccccagactgcagtcgccaggcctgcccagggctgtgcttgggcaagtgggtccaggctgctgtcaaccctctctcttctcgcagtggctctccattcccaggctcagtgcaggatccaggcctgcatgtgtggcgggtggagaagctgaagccggtgcctgtggcgcaagagaaccagggcgtcttcttctcgggggactcctacctagtgctgcacaatggcccagaagaggtttcccatctgcacctgtggataggtaaggggatctggatgggggaaggttgggcccaggaaggggagggagggggctggtatggatcacaagggccttgccctgccctctcccacttgtcccaggccagcagtcatcccgggatgagcagggggcctgtgccgtgctggctgtgcacctcaacacgctgctgggagagcggcctgtgcagcaccgcgaggtgcagggcaatgagtctgacctcttcatgagctacttcccacggggcctcaagtaccaggtcagagcccacctctaggcacccccaccctgcagcttccctcagagccagccctgcttctggctggttctcaccctgcagaagacccgggtgcctttggagccgggtccccacctttctgcccgtcttccagtgggatggggtgcagagggctctgggtctcctgtcagtccactcagatgggccgtctgggctgcaggaaggtggtgtggagtcagcatttcacaagacctccacaggagccccagctgccatcaagaaactctaccaggtgaaggggaagaagaacatccgtgccaccgagcgggcactgaactgggacagcttcaacactggggactgcttcatcctggacctgggccaggtgggtaggctggccagactgagcactccgtattggcaccatcctttataaggacggaggggcaggaggccaggaaagagggagagaagctgagaagccgtaaacccattccaagtgagatcactctgaccattggagaatgtccctatatttgtaaggactgatgccagcctccttctgccatctagacattgcctctgatgctctggagctttttccctcctcttggaagcctctgagttcactgcctgccagaccattcattaattcagtcatttatctcttcgttcagtgaatctatgatgctctctctgagccagcacagggaccataaaagctcgctctggggaggcagccaagatgggccagtcacttgccataacctgaggcaggatgtgatgagggctttaagggggacagctgccatgtgctgggggggtcttggggcagggaggggccctctagcctgagccgaagccagttgtcccaggaaggtgacattggactagacctataggaggggagatgccactccaggcaaagggagaaggtgagctgagccaccaaggtggggaagggtgcagacatgcacacaccaggggtctagtgagactgggacccgggctgggggacaggagcagggggagggaaattcctaagcaaggtggaaggtgagccctaggtcatgaggagattggctggctgaggagtatgggctgcgtcttgtggcgctgaagatttggggcagggagatcaatccaggagctcttggtgaggactacacgtgctgagacaaggaaggggacaggtgaacagacctcgccattaccagaaaaggagaggtgacaggggctctgcctggcagggcggtgggtagaagtgtgagatgctgcgctcaaggagccattcagccattcacccatccagtccttcactcagtcagtcaatatttattttgcgcctaaatccatgccgggctctgttttagcagtgggcccacagtggtgagcaaagccaaacaaaaccttcatgtcctaatgaagctcactttctagtaggtggagataggtggttaagagacgtttaaacataggagatatgtgatgggaagaaaaataaagaggtgctgggcgtggctgctcacgcctgtaatcccagcactttgggaggccgaggtgggcagatcacctgaggtcgggagttcgagaccagcctgaccaacatggagaaaccccatctctactaaaaatataaaattagccgggcctggtggcacatgcctgtaatcccagctactcggcaggctgatgcaggaggatctcttgaacccaggaggtggaggttgcggtgagctgagattgtaccattgcactccagcctgggcaacaagagcgaaactccatctcaaaaaaaaaaaaaaaaaagaaaaagaaagaggcttgagcccagcggtttgtaaccagcctgggcaacatagtgggaccccatttctacaaaaaattaagaaattagccaggcatggtggcaagtgcttatagtctcagctgcttagaagctaaggtgcaacgattgcttgagcccatgacgtcaaggctgcagtgagccatgatcacgtctttgcactccagcctggatgacagagtgagaccctgtctcgaaaaaaagaaaggaagacagatggcaggtgggcagagaaacagttgcagtgggtggtcgtgggcattttcagagagccctctgtgctgtgctctgccttcctggttgtcctgcctcagggacagttcagagaggagagagggagagctgtgcgcccttctctgagctggggagcaggacacaggcatctggctctgacccggactttcctgcttccttgcagaacatcttcgcctggtgtggtggaaagtccaacatcctggaacgcaacaaggcgagggacctggccctggccatccgggacagtgagcgacagggcaaggcccaggtggagattgtcactgatggggaggagcctgctgagatgatccaggttgggggacattggagtgggtggctgggagcctctgcttgaaagtggccaagagaggtggtgatgagctgagggctgagagtggccggtggagggtggcaggggccatctggtgtactgcctagggctgtggccagctcacagggtgcccctctgggtagatgctcgtcctcgaggctgagcagcctggctggtggggtgggctggactcagccctcactcacctcacctctgctgggtgccctagtgcagggcgcagtttgccccaccagaagcagtggccctgggcatgatgggctgggaagttccagggcaggggtccctataaacctggcctgccctggcccctgcaggtcctgggccccaagcctgctctgaaggagggcaaccctgaggaagacctcacagctgacaaggcaaatgcccaggccgcagctctgtataaggtgggccccccaagcctgccctgggacccggcagcagggagggtgggagcctgcacagcacagctgcatgcaagcagggtggaggggagaaggcagggggaaggtggggctggaaccgaggtgggaggtggggagttatacagggctgggagtgagacaaggatggggagtgggcggaaggcaggccctcctgaggagatgagtgcacctcacttccagcctatgcttggtgaaggcttgaagccaatgctgagcttttctttcttgaattctgtgcatttctttgtaatttggaatcctcctaatttccaaatgggttcggggcccctgtgctgcagggattggggtgatgagagggagtggggctgcctggaatttgcttttcaggtcttcactctcttgtctgctcctgggacctgggcagtgggcagcgaggcacagtgggagggacctagggaggaccagcctccccctcctcaggctgaggtgagggctggtgtgtggggggtgagatcaggcactgtccctcctccccaggtctctgatgccactggacagatgaacctgaccaaggtggctgactccagcccatttgcccttgaactgctgatatctgatgactgctttgtgctggacaacgggctctgtggcaagatctatatctggaagggtacgtggctcctctgtaacagcctgagatgcctgtagctgctctgacccgggcaggcttccctttgcaggactcagcctgtctagctgcttgtaaaagacagcctcaggaagcctgcatgcttctggctgaccattttctctctttaaaaattttttttaaaagatagagatgggttctttctatgttgcccaggatggtatcaaactctcagcctccagtgatcttcaccttggcctcccaaagtgctgggattacaggcgtgagccatggcataggccttgctattttctttctttctttctttctttctttttgagaaggaatcttgctctgttacccaggctggagtgcagtggcacgatcttggctcactgcaacctctgcctcctgggttcaagcaattctcctgccttagcctcccgagtagctgggagtacaggtgcgtgccaccacacctggctaatttttgtatttttagtagagatggggtttcactaccaggctggtctcgaacttctgacctcaagtgatgcaccggcctcggcctcccaaagtgctgggattacagatgtgagccactgcctcgccattttctctttgctgttcccacctcctaaattctagacaatggctctgaaactacagcaagcctcagaatcaccccacggcctgtttagatggctgggctccacccccatagattctgattcactaggtctggagtggggcagaacatgcatctctaacaaggttatgggttatgtctgtgctgctggttccagggatcacactttgagaaccactgccctagcccagctctagacctttggggcttctgggacccctgatcctgggattctgtctcaaggtttgacagaaatgaattttagacaaattaaacatcattttatgcagtgagtggtgaacctgtagaacttgtttttccaaaagattctatcttctggaaatagaaacactgttgggcagagcctgttctgcttggtttgactgaaaatgaaacaaacttgttctcagtctctgcctggggtctgagaattttcagcaatagcatttgctcaacacccagttgtggggtcaaccaaggtggagaaaatgccagcccctagcctggtcaggaaggcagacaagtaggtgggtatctacagatagctgctaccaggcatttcatagtattgcttctgaaactcagcagggatagaagtgaaagggaggagctgggagcagcaaaagagtggaaagcgagaggcgtgtgctgcagggctgccttttctctcctgccagagggcacatatcccatggaaccaatgccaagcagaggggggttcacagaggcccacagaagcatgtataaaccggagcaaggaacccaacaactatggaaagagaaatcagaggaaaaacaggaaacttgggaggccaggaagagaaggatctcatgggtaggggggcagctggtcagttgacagaggaaggaatccagcatattaatttcagatacattgtagttcatggcattttatagcctgcctagagagccaaccacatcacggcatcgtttcggtatcatttccttggaaaaatgtctggcagcctgggcaacatggcgaaatatcacttctctacaaaaaaaaaaccccccaaaattagctgagtgtggtggcgtgcacctgtggtcccagctacacgagaggctgaggtgggcagattgcttgagcctgggaggttgaggctgtagtgagccgtgttggtgccgctgcactccagcccgggcgacagaacgagactgcgtctcagaaaaaataaaaataaaaaagcctggaatgagcagtttgagttctcaggactgctagcagaaatgactggattacgtggggtcttcatttttgtaagtgcttagttagcataactgttaggccagtgtagccctgctggcattatgggagtaaatcacctctataataaattgtaccctttgtcttatttagtttttcagaaaaggcttgatgaattcaagaggtgaggggtcctagaggaaaaggagacctgcggcctcacagtctgatgctagggtgaacacctgttcccctccctgaaatattccaggggcccaggtcagagcagagttttgcatgatcagacccgggcagacgaggggttttcatctaccttggtgctgccggtttgggaaaattcttaagggactgactccacatctccaaagagcccctcggcattcttgggacccctggtccatttattgtaaaaattgctggctcttctgtggactcccttaaatttcctcaagaaaaatgggatggcagctaaagagggtccctgctctttttaaaaatctccttcctatgatctagggcgaaaagcgaatgagaaggagcggcaggcagccctgcaggtggccgagggcttcatctcgcgcatgcagtacgccccgaacactcaggtgaggagatgcgcacaaccacagccctcttcctagggctcttcctgtggcccctgacccctcaaattggccaggaagggcaggagagccttgggcactgtcaggaacaaccaggcctccctcttagacccatccagtgggaaagcccatctcaatccttcaaaatgtcaaaatacttattattttcaaagaggatgttgggcagcactctcctgggtgcccagagaactgggtactcctcctctgggccgttgtccctggctggtgccacccctcctgccgcagcacagtgtccacaagtcatcccgtggggagctgacagggctcagctaccgttggtggcatttattaaactgtgcacccacgcccttgaagcagtctgttgcctctgtctgtgtccctgaaatcttggttctcatctcatggctcatccaggggagctttcccagcctggactgcacatggattcaggccaggcgcccacaccctcctccctggctctggccccctcctgtcctcctgggcagaggcagaggtggcaactttgtgaaccagacttctcccccgctgtccctgcaggtggagattctgcctcagggccgtgagagtcccatcttcaagcaatttttcaaggactggaaatgagggtgggcgtcttcctgccccatgctcccctgccccccaccacctgcctgcttgcttctctggctgcctggtcagtgcagaggtgccccctgcagatgttcaataaaggagacaagtgctttcccagctcttttcctgcaccacctgccctgggctgattctcactgtcacccacctattcacctgggttcatccccatgctgggggtggagtagcacacagatgacaattggacagccttggaggggccagagctgctttgcatgacagaggagtcccagccaggcttgcagggactgccatgaacccaatagggaggtggcacagtgccaggcctcaggatcagttgcatccgggtgttcagttcagtctcacattcccaacagggagaaggttgtggcaatgggcttgggatgcagttccatttaaggcagtatttcttcggatgccctaataaagcactgccaggcagcttcaagtgacatatgcccactgagcaagagaggacagcctttcacaattgtaccaagcctggcttattacttcgtaggcacattgcccagcatgtttggctggtgagcccagggccactgcagggctgtgcgaaaagcaccaggctagcatggacagtcttcagtctggttcttaccctgcctctgtgatcctaggcaagttactttcctttgctagaccttagttcattctcttgggtaatgaagtggtggtgggatgtcagaggctagagagctaaatagcagggagaatgcagtagccaagaagaggtcccatctgagaaggcatgcccaggggccaagagcagggtgtgagtgagcctgtgtcagcttggaccagaggccgtgaggcctggcaaggctgcaaccaccctgactcatcctcacccccaggtcctctggactatgtggcttctgagctccagaaattggattctttcatcccaaaacaaaaattctgatcaattggcaagttgaacttgctgatttgtgccaagaaccataccatagataccccagccgggtgcggtggttcacgcctataaccccagcactttgggagggcaagacgggcggatcatttgtgatcaggagtttgagaccagtctggccaacatggaaaccctttctctactaaaaatacaaaaaattagccgggcatggttgcgcatgcctgtaatctcagctacttgggaggctgaggcaggagaatcgcttaaacccgggaggtagaggttgcagtgagccgagattgcaccactgcactccagcctgggtgacagagactccgactcaaaaaataaaaataaaaaagaaatgagctcctctgtggatctgcctccatgtcttctccatagacttcttagccctacttgacagcctacacaaagagcaggtgccagggatggttttttaaaggggagagaataaaggttgcactacattagtggttctgacaacctttgtagagacggggagtattttaagtctcctatgaaaggcctagcccctttccctataaatatacacagattaagatttttgtggctgggcacggtggctcatgcctataatcccagcattttgggaggcagaggcaggcggactccttaagctctggggtttgagaccagcctggggaccatggtgaaaccccatctctaccaaaaatacaaaacttagctgggcatggtggcacaaacctgtagtcccagctactcaggaggctgaagtgggaggatggcttgagcccgggaggtggagattgcagtgagccgagatcgcgccactgcactccagcctgggtgacagagtgagatcccatttcaaaaaaaaaaaaagatttttgcatctgctttcagagggttcaggtacccctcacaaccagttcattaacagaactgtaaatttaaaattgccagactacattattgctaatgttccagggtctgaagctgtgagtactctgtcatctggggggcactaaacaggtggatggtgggcagaaaggaccctgcagagggaagaatcacccaacctgatactccaaagtggaggccgagctgcagcttttctcccctgcaattcaactcctgccatgccatgcccagcaa

SEQ ID NO: 15932 - DNA, 4973 bp, Human
ccaccatgcctggctacaaaatttatgctttgtaacgtaattctctcaaagatagaatgatgagatgactcagattaatgacaaaatatgggatcatggaactatgtgtcctggtttaaaactaaaaggacactaagatgattttttacctcccctgtgaaattcagaagactgaggtatccgagagacagcactgttggctcagccctggctttactctacatttactctgaagtcctgtggcatccgtgtctatttcttcaatattacgttggtgtgcttcgtagaagtcaacaagatcagaaggactattggttagaagataaaaaccactggccctacaaatgctattcaaggttgtcaaacaatccatagttaggaatttattctatattgtggaaaaaccttattctctcagaagacaatgctgcagggaaaaatgcccactcttacatcaatgcagccccaagaccttcatggaagcatctgtagctaaaaagaacccattctttgagtcgctttgtttgtccaaatgttatctcctgccaagctatctcttattgtgtttcctgctactcagatgttcaggttttttgatctggcatgttcttaggaaaaaaatgagtgaggtgtataatcgtatgatgaggattatttggtttgtgacgaaaaaagcaaaagcaaaaactctatccaaccttgcttaagcaaaaaggatttatttactcacgtatatgggaagtccatggagtaggttttgcttcaggtgtggctgatggagatagttcaatgacgtcacagggacctggtttttctttctctatctctcagctctgtatcttcatcctcaggctgaccctcccctcatggcgacattatggctgctgcagctcaaaaattatattcctcccaggtgtagaagcggcagaagagagaatttctcttcatccagtttgaacaaaaaccctgggcctaactttcactggcctgaattaggtcaactgcccgccccgatctaatcacattggctagggaaagggaagacagagattgtttcaaatctaggtcacatgctatcattttttaaaatcatgttaaaattggcatcaccaataacggaataaaccaacattacgtacttcctgatatgatacactgaaatgaattcagcatcacattcatgatactgctgacaaaaaatgcatagcctgaatccaatcatgaggaaacaccagacaaacccaatttaaaggacattatataaaacaactggcctatatccttcaaaaatgtcaagattacaaaagacagcccgggcatcgtggctcacacctgtaatcccagcactttgggaggccaaggcaggcagatcacttgatcccaggaattcaagaccagcctggccaacatggcaaaagcccgtctctacaaaaaaaaatacaaaaaataggctgggcgtggtggctcatgcctataatcccagcactttgggaggctgaggcaggcaggtcacctgaggtcaggattttgagaccagcctggctaacatggcaaaactccgtcctactgaaaatacaaaaattagccgggagtggtgtctcacgcctgtaagcccagctacttgggaggctgaggtaggagaatcgcttgaacctcaaaggcggaggttgcagtgagccgagatcatgccattgcactccagcctggacaatgagagcgaaactccgtctcaaaaaaaaaaatgtcctgccagatacaatggctcaaacctgtaatcccagtactttgggaggctgaggcaggagaatcacttgaggtcaggatcttgagacgagcctggcaacatagtgagacctcatctttacaaaatattttaaaaatcagccagaggctgaggtcagaggatcacgtgagcccaggaggtcgaggctacagtgagccgcgatggtgccactgtactcctgcctgggcaacaaaatgagatcttgccccaaaataaaataaaattaaattaaaaattgcttcttctccgagaaaacaccaaatggcggatgacgccggtgcagcgggggggcccagaggccctggtggccatgggatagggaaccgcggtggcttccacggaggtttcggcagtggcatccggggccggggtcgcgggagtggacggggccgtggccgaggccgcggagctcgcggaggcaaggccgaggataaggagtggatgcctgtcaccaagctgggccgcttggtcaaggacatgaagatcaagtccctggaggagatctatctcttctccctgcccattaaggaatctgagatcattgatttcttcctgggggactctctcaaggatgaggttttgaagattatgccggtgcagaagcagacccgtgccggccagcgcaccaggttcaaggcgtttgttgctatcggagactacaatggccatgtcggtctgggtgttaagtgctccaaggaggtggccacagccatccgtggggccatcatcctggccaagctctccattgtccccgtgcgcagaggctactgggggaacaagatcggcaagccccacaccgtcccttgcaaggtgacaggccgctgcggctctgtgctggtgcgcctcatccctgcacccaggggcactggcatcgtctccgcacctgtgcccaagaagctgctcatgatggctggtatcgatgactgctacacctcagcccggggctgcactgccaccctgggcaacttcgccaaggccacctttgatgccatctctaagacctacagctacctgacccccgacctctggaaggagactgtatttaccaagtctccctatcaggaattcactgaccacctcgtcaagacccacaccagagtctcggtgcagcggacccaggcttcagatgtggctacaacatagggtttttatacaagaaaaataaagtgaattaagcctgaaaaaaaaattttttaaataagaatccgaatatttcatcattcacagaaaatagatttttaaaaaagaaagagtggactggacacagtggctcatgcctgtaatcccagcacctcgggaggctgaggcaggtggatcacttgagtccaggagttggagaccagcatgggcaacatagtgagacaccccccgcccactggcatctctacaaaaaatagacaaaaattagctggccatcttgacacatgcccatagttctagctgcttggaagactgaggtagaacgatcacttgaacctgggaggtggtagctgcagtgagccatgatcgcgtcactctacttagcctgggcaagtaagtgaaaccctgtctccaaagagagagagagagtaatatataagtagtactcagtccaactctgtggaagatcacgcatgtggtctaaaccaacaatggatttaacctatcatgaaattattttatcttgtgccctaattttgaagaaataaataaaagctagtaaactgggctattcaggaaacatttacctttagaacgatccattaaagtgaatagaaaaccaaaccatggacacaataatagttaccgctcacacagtctaggctgaaagccatggtgcatgcaacccagcaacatggcttgggggctgagtaaggaagctgaatttcagggattgtgtaaacaggccttggaatgtgttgacatcaatagtaatagctaaagtggttcctgagtccccaaattattcgttggttctatcagggttttccagagaaacagagccaataggagatacacacacacacacacacacacacacacacacacacggagtgaaagagattttaagaaattggtgaagtgccgttgttgtttttgtctggggtaaatacttggggttcctcgtctcatgccaaggacacggacacacacaatgagtgagtttaggagccgaggtttactaggcaaaagaaagagaaaggagaacagctctctatcttgcgagagagagggaattccaaatgggaaatctggcccagaatgggagtgctccgcaggcttgcagaggtggtgtctgatttgcgtagggcccacagattggttggaccaggtgtgacgcttacgtagtgctcaggaaggctggccaccccatcctaatcttattgtgaaaatgggctttccatttggtggtcaccatgttgtctgctccttactgtacacatggctggcaaagagaagggaaggtggagcgccattttgaatttgcctagttccaggtaacattttcctattgtcataactgccagcattcacccacgcaggcttctggcttgcttgtctatgtctgcagctcaattttacaggctgctctttgttagaaaagaaaatgatatgggggctgcttttcattaaaaggaaaaccttaccgaggacttccttcccctcactctctgcctaaataatttctttttaactcctgtatcattgggtcagatgattgcaggggttaacaagtctgaaatccataggacaggtcatcaagatggaaattcaagcagttcttccatattatagtcgtaagatagaagtccttcttctcagagaaactgcagttttttctctgaagaccttaaactgattggatgaggttcacccacaaagactatctccttttcttcaagtcaactaattgaacatgttaattacatctacaaaatgccttcacaacaatatctagacagtgtttgaccaaatagctgacaccatagccaagttcacacataaaattaaccatcacactgtttgaggttttttttttttttttccatttcatctgcacaggcacctggcttctagcagacattttctccttggatctgggcaccagtacatcccatgccaggcctggcccaccacaaggaccactgaatgcagaagcccagctcccactcccacccagggccacgaaatgacactagggatggaaact

SEQ ID NO: 15933 - DNA, 23130 bp, Human
aggccctcaacacttattgaaactattttgatagaattatacataatgataaaaactcttgctacacagaattagaattaaggagttaaggaagagattgtttacagtagcagaaaaaaaaaacttgaatgcctgtttagtttaagataaacagatttttttcaaagaagatggtaaaaccctaacgggaaaaatgaagtgaataatgaatgagatataacttcttccatccaactaaaaactatagtgaagacattatttcttaaattaatatatgcatttattataatagtaactagtgcctatattagttaagatataattttgcctttaattaaccattccttaaacaagacagaagcttattcctctatcatagaccagtccagaagtagagtggcagctctctgccctatgggattgtcccaggggccccagctccttctcttgttgttccaccatccttgagtaatgtcctctctgtgtggtccagagtggcagatcatggtccatatttcagtcaggaggcagaggggatacaggagaagccagagtatgccaagggaagcaccttgagaattgcacaggatgcttctgctcatatcccattggctaaaacttagtcttgagtcctagctccaagggagactgggaaatgtagtcttcattctgggaggtactatgccccactaaaaatccagagctgtattaagttgagttaggggaaagcgaatatgggggagacggaccaatccctactacagtactattggaatattatttagaacttgaaaattgctaataaaattatttcaaaagaataaataggcaggcacacaacatattttttaagaaaagtgtttttaaattgccatattctctctttttctttttttttttttgatgtaacacttctgcttttaatgtaactttctttttaaacttttttattatataaattttaaccatacacagaagtggggagaattgtgtagtgagccctagacccatctcccaggtttagtaagttatcagcttaaagttagttttatctattctccctggccctccacttatccccttcctgagttcttgaagcagatctcatttttgctatttgatctgtagatatttctgtatgtagctctaaaaggtaaaaggtcctttttaaaaaaaataaactttaaagtttaggataattgtattcacatgcggttgtaaaacataatctggagagattttgtgtatgctttactcattttcccccatgatagcatcctgcaaaactatagtaccatatcacagctggaatctgacatggatacagtcaagatgtagaacatctccatcctcacaagagtccttcgtgttgcccttttatagccatatctacctatctacctccccttccacaacccctgacactcactagtctgttctccctttctataattttgtcattttaagaatgttaaaaatcagccgggtgcagtggctcatgcatgtaatcccagcactttgggaggccgaggcaggtgaatcacgaggtcaggagttcgacaccagcctgactaacagggtgaaaccctgtctctactaaaaatacaaaaattagcctggcatggtggcatgcgcctgtaatcccagccactcaggaggctaaggcaggacagtcactcgaacccaggaggcagaggttgcagtgagctgagatcacgccactgcactccagcctgggcaacagagcaagactccgtctcagaaaaaaaaaaaaaagaatgttgagaatcatacagtatgtaacattttggtatcagctcagcatagttccctctagattcacccactttgttgcatgtaacaacagttcattcttctttattgccagttactattccatggtatggatgcaacatataaaggctctttgaaaaccataatccatcctcctaactctctcctctctttttccccactgccctcttcgcctctcttcacagcaatgccaagtgagtacacctatgtgaaactgagaagtgattgctcgaggccttccctgcaatggtacacccgagctcaaagcaagatgagaaggcccagcttgttattaaaagacatcctcaagtaagtaccgcccctgggactgtagatccccctgctttgggtcaactgtgtagaactaggagaaaaattcagtgagagccctcaagatggctaatgttggagaggcatgcttggtcaaaggatgcctcagacattcaaaggcacgtctgagtaaagactgagtgcacagccggagtgagcctgtacagctggctgtatttggtaagtgcacagtgcccagtagctgctcaggctctctaccttggcctggatgcctgggagagcagctctcaccgtgcactgctcttcatgcccttatttaacaaaagagggcttttcccttagctattgtaagttaatctaaaatatggttaattaaatttccctgaaggcccttgaatactgttaaatatcgaatactaaaaatgatgacaggtgtttgagccaggtcacccttatatcctaataagtgatagaattaatcaaggaggaacttggcaggtgtctttttttacatatataccagtcaaacctagttgaaaattgcccttttttcatgtctaaacatagaaatccaaccttgcaatctagtcttctgtctcactttactgacttaggaagtgtaggggaaaaggaaatttataagaataaggcttatgttacattcagcctcccttgagtcaccaaccaatatttattgaggcccaccacgttcatgacgtcatgctgggcgccagccacaaggcagcaggggagatagacctgcgccctgtgctgcttaggctgtgggtgaggtggactcgctccaggaattaaggcacagtctgatatgtgctacagacactgggcttgccttcacacccttttcttttattttttttttaaatcaaaataagggaagtgtatgcactgaatgtaacaccttttctggggctgaagagaagaataggtaatattaggttttcaagattgaaaattcaaaaggtattaaagagtctcagtgaaacaccttctcatccctgctccccatttaccctccatatttaaagataaccagtgtcaccggtttcttgtgtatatgagaaatattttgtgtgtgtgtgctctgccatgccccgtgcccaaacccacttttacacaaattgatagcatcctgttcacttatcattatacataatcccaacttgtccaagttgtcatgggaagcctgttttaaatgagaattttaaagtttttaaaacactcccagcaacacttcattgtattctcatcctcaaatattaagaaatattttgcatctattatgtataatatattatgctagatgcaatttttttgaaaaaaaaactgcccctttatttagaaaatggattactttctctttatttcttgcatttgttttttcaagaacagaattgtttaaagcagtggttcttaaattttggttgaaactttttagcttgcggtttgtgtcactggagaacttagtaaaaatgagatttctaaaactaagactagactcagctcttttctccaagttgtgtgtgtgtgtgtgtgtgtgtattaaactatataatagtgtgaatttatcagatctgtaaaaaatattttttaggtcatcttaagggtaactaatggtcctgtctcatttcccagtcggcctcacttccgggtagaattctttagacgtactgtgaataaactgtttcttttcttttcttttttttttttttttttttaaggactgacagaattttcaggtcacaaaagattgaagccgagattctgtagttcaagtctattacttgattttaagttcaataattgacattgtgattcagattttgttacagtgctcttgcaaaaaaagttttttctgtgtttgcttataacaaagacagtcataaatgactagtttatcttgtcaggaaaataggaaatggccccttcctttcaccccaatgtcaacttaaagattgtagttttatgctgcatagcaggcagactcatttaggattccgttttcagtttcacattgcatctcatgattctcacatgactacatcataatacctaattgatttttttccagatgtacattgcttgtgtttggagtgtggatcctttatatcctcaagttaaattatactactgaagaatgtgacatgaaaaaaatgcattatgtggaccctgaccatgtaaaggttagatatcccattggtgtggtttaaatgaaaacattgccaagcatatgctcaaactataatatcattagtctactgtgtgacaaatatatgttaataaaagtttgaactcagaggggaaagcacttaatctcagcactccaaaaccaaagacaaccttcttctaaaaacccaccactaactactccacagtatccttctcccatttactgcagctggggtgtgggatgaggtgggctcaacccaacaggctctagggctcctctcctggaattaatttgccctgatgctataaagtaaacaacaaagaaattctttcttttttcttttctccctttttttttttttgagtcagggtctcgctctgcacccagggttgagtgcagtggcaagaacacggccacctcagccttctgagtagctgggaccacaggtgtgcaccaccatgcctgactaatttttttattttttgtggagatggggtcttgccatgttgcccaggctgatcttgaactcctaggctcaagctatcctcccgccttggcctcccaaaggtcggggattacagacatgagccaccatgcctggccagaaattctcttagtatcatctgtccttcctgtgttttatttttaattttaatgaattcacattgcattgcaagatttttctttcagcttacatttatgtttccaaatcaagtgacatatcaaatgcttatgtcactgattattttagtggctggattatctgataacatttagcccaggatggaggaagagatgattttaaataaagtagcatgagagggatgataactgacatgtatggatgctttatatatattatctcctttagtcattgtgactgggagatatcccagtatcatctccatcttacagatgatggcttgaaaggttgagctgctcacccaagttcacgtctagtttagctagtttataatgtggtttagtgctcccgtgtgccaggaactgttctaaaagtgtattagtaatattagctcatttaactttcatcacattcctggggatgtaggtgctacaatcatccccatctcacaggcagggaaactgaggagcagggagatttagtaacctgcccagggtcaccagcggcagtacgtggtgaagcccggcttgaattcagtggtgtggtttcagagtctgagctcctgaccactctgctctctgcctggttagggagtgtccacagagaagcccaaagttaaaagcagcatggtgcagagaggaaagagcttaaatgttttacccaattcaaatctaactgccacttagtaatggtgaaaccctaggcaggtgacttgattgttttgagtcccagttttctcaactgtgaaatgtagaagttgagtaagagaatatatacaaaattcctttcttgatcctaatttttattcatacgtttctactttaatttgtacatcctttgaagtgcctccaattttttttgtggtacagacaggtataaacaaataaatgaagagctcagttagcaaaggcacagcttggctcctgcaaaactattgagtctcagggtcttgctggtcgcagggccagccttcccagcataggtgtcctcaggtgtctgctggctcatgtcatttcatcagcattaacacatctgctttggtcgagtaggatgtgtccagtaccctctgctcaggcttccctttcttcctggactgtctggccttgcagacatacctcccccagtcctttgcaattccacggcgcttcacagctctcttggataaaggttttagacatcctgtctctgtttttgtcttctgagaaagtctttaaatgatggcacttggtatggcttactgatggactgggaactcttccctttgtttctctgctgcccttctccactttctctttgcatcctctttttcctgtccattaccatctgaccaactgtaaagtgattgttctaaagtctgggtcagctgaggagagaggtgcgctctcctgtacaagggccaagaatactattccacaagcacagggtggagaaggtgtgttttagtaataccctgggggaaatcaacttagtagttttcctgtccagccaggcacatctgtgtcaacctgtgccccggctgcctgtgatcattttgaacttaagccacgtggtctgcttgtctctgcagtggtcagtcaagtgctctggttgttaggctgttacttgttaaggctcccctaaggaatcctagtgatttctaagaatgaccagaggagaaactcaagatcacctccctgaggaatcatggaagggataggaacatctgtgtagccttaaggagagaagacctggtacagggcacatggcagtcagtgtcaatgagccagaggttcagaccgcagaaggatgggcctgcccaggtggccttaatggcagagctctgtatagggatggcagccaatctcaaaggagaaaggtttgacggtcccaggcatccaaagatgggataaacagaccacctttgtggtgactctctggggatctttaagaaagtcaggggtctgaccgggtgtgatggcgcacacctgtaatcccagcaccttgggaggctgaggtgggcggatcatgaggtcaggagttcgagaccagcctggccaacatggtgaaaccccgtctctactaaaaatacagaaattagctgggcgtggtggcaggcacctgtaatcccagctactcaggaggctgaggcaggagaatcacttgaacccaagacagggaggttgcagtgagccaagactgtgccattgcactccagcctgggcgacaagagtgaaactctgtctcaaaaaaaagccaggggtcctgtaggtagaattcagacattagacagggaggggctcaggggcctttctgatcccttccaggtctgagattctgtggttctcagcaatttgccagtgcctgactggaagatggaggctggtttcgtaacctggggctttcaaagttctgaattctgggtggagttgtctcaaacggtaggctctcaaagaacacctgcatgcagcctaaccagtccccaactcagtgactttcagactgaacctcactgctacttccaagctcctctgaagcttgccacattccatcggtattatcctaattcatacgagcctctcatcctgccatctaaagtataagttacttgagagtagggactatgtctgtaaaaatacatagtacgtggcattctaaggaaaggtgtagtgagcgagggctgccctttagagtcacctgctcttcctgtttccctggttgtgtgtcttctcacctgccttcctgcatccagccatgccccactgtggccggagtagtcgtgttctacaatttgaatctaatatattgcttccctccttaaaactctttggtgcctctcctttaccttcaggaaaatacccagactccttagtctggcccagaagaccgttcatgacttggttcctactgatctctccagtctttttgtgccacctccattgtcccaactctatgtattttaggcacactcaacccctcacaggtccttgggtaaacctcttctcttctttccttttctcttttttttttttttttttgagacggagtctcactctgtctcccaggctggtgtgcagtggcatgatctcagctcactgcaacctccacctcctgggttcaagtgattctcctgtctcagcctcccgagtagctgggattacaggcatgtgccaccacacccagctaatttttgtatttttaatggagatggggttttgtcatgttggccaagctggtcttaaacccctgacctcgggtgatccacccgcctcaaactcccaaagtgctaggatgacaggcatgagccactgagcccagcttcttttcttttcagcagggcctcacgctgtcacccaggctgaagtgcagtggcccgatcattgctcactgcagcctcaacttcccaggctcaagcaatcctcccacctcagcctcctgagtagctgggactatagcatgcaccaccatacgtgcctaatttttttttttttttttggtagaggcagggtcttaccgtgtttcccaggctagtcgcaaactcctggactcaagtgactcaagtgatcctcctgcctcagcctcccaaagtgctgggattatagacatgagccaccatgccctgcccttaaaacatttttattgagatataattaacacaccacatagttcacccatttaaagcatacagtacagccaggcatggtggctcctgtctataatcccagctttttgggaggccgaggcaggaaggatcatttgaggccaggagtttgagaccagcctgggcaacataccaagacatcatctctattaaaaataaaaacattagccttgtgtggtgtctcacaactgtagtcttagctactccagagactaaggcagaaggatcacttgcgcccaggagtttgagattacagtgagctataatcatgccactgcactccagcccataaaacagaacagaacaagacactgagaaaaaaaaaagggatacagtgcagtgattttgtgcaatacactatggttttagtgatttacagaactgtgcaaccatcaccatgatctaagtttagaaggtttttagtatcccaaaaagaaactccatatccattcatagtcactccctatttccccctccccacaaatcctaggcaaccagtaatctactttctgtctgtatagatttgcctattatggacatttcatgttattcatttcatggtctcctgtgactggattctttcacttaggataatgttttgaaggtacacccatgttgtagcatgtatcggtacttcattattatttctggataatacctcattgtatggatatacctcattttgtttatccattcatcagttagtggacatttgggttgtgtccacttttggctattatgaataatgctgctgtgaacatgtgtatgtaagtatttgtgtacctgttttcagttcttttatgtatatactaggaatatagttgctgggtcatatggtaactatgttttgctttttgaggaactgccaagctgttttccaaaatggttgcattattttacattcttgtaagcaaggtaccagagtttcagtttctccgcatctttatcaacatttgttattatctttccttttttactactgtcatcctgatagatgttaagtgatatctcattgtggttttgatttgctgatagctaatgatgctgagcatctttcccatgtgctctcattgaccgtatgtgtgttttctttggaggaatgcccattcagatcctttgcccatttttaattgggctatttgactttttattcttaaattgtaagagttctttctgtgttctggataccagtaccctatatctggtatgtgatttccaagtattttctccactctctaagttgtcttttcactttctttagggtatcatttttagcacaaaagtctttaattctgatgaaacccaatttacctatttttcctttggtcatttatgcttttggtgtcatatctaagaaactattgtttagtcccaagttttcttctagtatgtttataacatactacctcttacatttaggtctttgattcattttgcattaatttttgtatatggtatattagtccattttcactactgataaagacatacctaagactgggcaatttacagaagaggtttaattgtagttacaactccacatggcaggggaagcctcacaatcatggcagaaggcaaggaggagcaagtcacgtcttacatgaatggcagcaggcaaaagagagaaactgtgcagggaaactcccatttttaaaaccatcagatctcatgagacccattcactaccacaagaacggcacaggaaagacctgcccccatgattcagtcatctaccactgggtccttcccacaacacatgggaattatgggagctaccagatgagatttgggtggggacaaagagtcaaaccatatcagtgtgaggtcagggtccaaggtcatccttttgcatgttgttctccagttgtcccaggaccatttgttgaaaagaactttcctctatttgctgcattctttctttctttgctgcctagagcctttccctgcccttcgcccttctgttactcgtattttaagtcaagtctcagctcagcggttaccccttctaagaggctatccctgatcgtccctctgtgtgtgtgagagagccccctcatgccttaatcctgatgtttatcattgtaggatttcagctgttcatcttccccacttgttttccaggccaggtcttgggagacaggggctgtgtgcttaacatcttacattacttaatatgcacttacatatattcaacttcagggggaaggggagatagtacttgaatcacagtgtaatcttccattacctgtgaactctagattgtacagaaaatccggttataacttgtaattctttgagtacatcagtaatgcaccttaggtttaatgtgaggaacaggactgatagttctcttcaacctaaacatccactggtagacagggaaaagcccagcacccgctccctgccccttctccctgaaccatggaatgtaagtcctttcattaggctactgggccaatttttagacctaagctcatggctggaccaatagtagccttcatagatgccaatgcccttccttgatgggcttcagtgaggactcctgaccaatcactgacgaggggggttgggaggacttctgatgggggagttggcctccctggtcctacacctacctgcctggagaaggagccaaagccacttaagcaaaactgagcagcagcccacagtgtccatctaccatgtcaccccagtgctgagcgatttctaaaaggttacttttttcaattatttaaaaaaaacaccaaaaattcaagtaatacggaaataagtaaaggagaaagtcccctgtaatttttcatagagaaagaggaaggaatggggggcagctgtgtaagtcaaacatgtttgtaaaactccgtgagtttgaaactagtaaaatagaaagtgaaagcctgctataattatggtggaattgagggtgtcttattgtgttactagagaatttttttaagtaggtttttaacattttgaccttgttaaaatgctccacttttcaaaacggtcctgacaggatatcctgcttccttccacgcagaagaggtggtttgtgcagaagtgcaggcctcagaatgctttgcacatgagaggaatggcaagagttgcctatcactgaggatttggggaggagggatcacaggatatgggactgaaaatgagacagggccagatagcaaaaggccttgaatgctacactaagcacgaagcagctccttaatttgtgcatcactgaagcaagaatagagtggaggacatggcccgtgtggtcctcgtgttctgagtggctatgacatggagttctgtgtgagctctccatgaagaaaatcccgtctccaggcagtcagtggagatttgatccttaccacaagagcacgtggacaaatttgaattatcgtggatgtatatgggcagaagaaggtctcagagccataagggtggggccctgttagctctgttggttccactcagcagcccacagtgtgagtgggaccctgccagccctgctagacttgagcattgtctggtgacgctggtccccgccttcattactgcagcagaggaagtgtggctgtggcagttgtgggttttgtattttctatttaaatatgtcccttaatgtgccagttgttaaaaagactaccagtgggctctgaagggatgcctggacactttgaaagtgtggttcagatgtgaaattgcactcaaaagatgttttaagagagacgagggcacgttgatgtcagtttcggtttgggctgtgtagtagcagcattttgaacttggccctctctcctttctgagagctaaagaccttatctccctgcggatggcattgcgtgcagttaattatggccagatggactcagccgcttcttcatcgtcttctctcggactctgcagacctacaccgtgcctttaaaggaagcagggccctccctgctgaagcattcagtgagcccaggcaccagcatcttcaaaccgagtcttttctctccttagtgctgctccccgctttccaggccttcctgggatatcttagaggtaagaaaactgaagcctcgacctagggagaaatgctttaacaaagacgacgctgctagttaaatcaatctagaactgagtccagcctccagatctcctgattatttttttttctaacagttgatgggatgaaatctacataagatttaatcctttgaagcccattgtttgatgagtattaaaaacttatgcagccacgcctctgtcaccacaatcccgctttagcacattcccatggcccaagcgagttccccggagcccctctgcagtcagtccccaccctcaaccccaccccaggcttccaccaactggttgagtttatagtgtagtgttatttccatgacttggttatttaaatttttttctgcttctaactgggtaagagttataacttaaatgtgagtaaaatatgtcaataacgtgaccctcagttattgtccttgtgtgatatcatacaagtctccacacatgccaggtactgggcaaaatgcttagggcatcagagcaacctgcgaagaagcgaccagcaccagagtttacaggtgtgggaaatgaaagttccacaaggtcactgatgcccccagatcacgtgatccatggcagaattgagctccttcccacatctcattaatgccagacacaagttttctttcaatctgaatgctctgccctgttccggatttttaaaaaataataagtgcaatagaacattgccttttactaagaattatgccacttacttgtatttctgagaagggttgtccttaagatttcagagtggaaatgaaagtggggattttgctgaggaaaattactttgattgtttttaatacctttctgtgaatttcacatgatgtttttatggcacactgccacagcattaacaattggcactaccagatgtctactttgtcttaattgtgggcaacctgcaagcgcagcctggaagatgttaaaaactgaaacctttatttttgtccctggatataagacgaacgggagttcttgtattttacgagagagtcaccagctcctggcttccagtgagcctcatctggatgaatgccacccaggccccagctgacgcctctgaggccttcctgggagctctggagtcctcacagcctagtcacactgcttcctctcttcattgcagctcctgaaggtgcggcactcgccttgaggcactttcttctgagctgtgagctatgggcaagcagtggagggggaagagagcagctgaagcagatgccggttcaacttacttaaagatgtgggacaagctctgaggaagcccccaagacaatgatgtctggttgtgcaccattgaagcaagaacagaaaccatcccagagtggaggacatggcccatgtggtcctcctgttctgagtggctatgagatggagttctgtgtgagctctctacagaaaaagccctgtctccaggcaatcagtggagatctgttaaacgagttgaaacaaaagaggacaaggaattgctgtggctttagacgttgccaggacatgtagaaactcactcaggatttactactgcatccactgtcacttaggcgcaggaggggtcacagtcagaaggtgactactgagaaatgtgccctacccacagtctagaaaattaagtttgggctgggcgtggtggctcacatctataatcccagaactttggaaggtggaggcaggtggatcactaggtcaggagtttgagaccagcctgaccaacatggtgaaaccccgtctgtactgaaaatacaaaaagtagccgggtgtgtcagtgcacgcctgtaatcccagctactcaggaacctgaggcaggagaatggcttgaaactgggaggcagaggttgcagtgagctgaaattgcgccactgcactccagcctgggtgacagagcgagactctgtctcaaaaaaaaaaaaagaaaaaaaaagaagaaaattaagtttgaaacctgaaattaacctcttggtgagaatggaaatggaatgaaatttcactcctttccagatgcagcttctgaagaggagacctggcagcctggcgagcatccagctcgctcacgcacctctttctagtcccgtggccatcagtgagcttctccgggtccctcttgccacttctcagatgttcctttctgtcctaggagatttgtaaaaccagatacttaggatatgattctctagtggagggttaggcctttaggtctctaaaaattgccattcatgaccttcgggcctagggttttgagatgaatgtgcagtgtgtgtggccgctctgtgtgtcccgcttccaccagcttggcattaagcacccggagcatcacctgctgggcaggcctggccaggggtgagcccctccattcgggggctcagggtcaaggcagattccttgcttggctttcctgctgatttcctcatgaagatgccaattcgtatttaaacatttgttatcaatggtggtgtttgtgtgctgatttctataggtagaggctgttgttttaggagccaggtttgctgggccagctcagacctcttacaaagtgaagatactaatgatcgtcttgcaaggtgccatagtgtcgtgagggtgaactgaggcagtggctatgcatggtgtctgcagcagcgtttctgaggctccaagaatatcagttcctttttcagaaatggggccagattcttcggatgtagacagtgttctcttcacggatgctaacaacttatcaaagctataatatattaagtatctctgttataataggatagatgcattcctaaaaaaatgtgttaagcaaaaatcagaaaatgaaaataaaaataacaaggccttgaggaaaagcatagttgggatgaacatttaaacctataccccagtaataatcctcataatgatactgacaaagttgaaaagatatgttgaattcctaataaatatcccagtaaatataggattacacacacacacacacacacacacacacacacacttctgcctgtgagaaggtagtgaataggaggagtaatgcagggccaattccaaggctgctaaatatggagacaaggataaaaaagcacaaagataggaagaactacctgacaggggttctgagtcagcatttgtccagctgagccaagaggaagactggggtgaatggacacgcataccatattcctccaaggttgcgtttttgttttttggggggttttttgtttgtttttttgttttttgagacagagtctcgctctgttgcccaggctggagtatagtggcacgatctcggctcactgcaagctctgcctcccgggttcacaccattctcctgcctcagcctcccgagtagctgggactacaggtgcccaccaccacgtgcccggctaatttttgtatttttagtagagacgagtttcaccgtattagccaggatggtcatgtttttgttcttgtttttgttttagagacagggtctccctctgtcacccaggctggagtgcagtggcacaatcacagctcactacagtgtcaaccttccaggttgaggatcactcgatactcatgcctcagcctcccatgtagctggggccacaggggcacaccaccactcctgacccattttttaaaaaattttttgtataggtggggtctcaccatgttgcccaggctagcctcgaactcctgggctcaagcaaccctctcaccttggcctcccaaagtgctgagattataggtgtgacccgccatgcccgcctttcctctgagttttgttgcattcacgcagctcctggctgaggcaaaacattaaaatgcatatggaaatgcaggctgggaaaatgctttgaaaccaatgcaatttctgtgttaaggggacattccctgattctttcaggtaatttgcattctagactgtgacattctgtatctcaactgataaataagcctgtttgtcatcctgctagatgagaacctgatatatgaaaccttttttttaatcgtggttaaaaaaaacataaaatttaccatcataattatttttaaatgtaccatttggcagcattaagtatatttaaactcttgtgaaacaaatttctagaatgttttcatcttgcaaaaccgaaacgctgtacctattaaacaactccccttttctccctctcttcaaccctggtaaccatgtttttatgaatttgactactttagatacctcatataagtcaggtcatacagtatttgtctctttgtgactggcttcacttagcataatgtcctcaaagtttaactatgttgtagcatgtatcagaattttatgaaacatgaagtcttagacaccccgaagtacattttcaccccaaatgtatttgaacagtgttaggctgggggtgggaggcgggagtccttcttgctttgcctgtgcaatgaaatgaataccctgctgtgtttatctccttgtcatgtgattctcccaggttgtttcttcaagtttctgagccaaacttaactctaaaaagcaaatattctgtgttaaaagacagtaatcaacacgggagctacatcagacatcataggacaaattgtcatctagaagagtatatttttaatgcaggagagtttttaaaacccagattggtgtgatttcattccagagagctcagaaatatgctcagcaagtcttgcagaaggaatgtcgtcccaagtttgccaagacatcaatggcgctgttatttgagcacaggtatagcgtggacttactcccttttgtgcagaaggcccccaaagacagtgaagctgagtccaagtacgatcctccttttgggttccggaagttctccagtaaagtccagaccctcttggaactcttgccagagcacgacctccctgaacacttgaaagccaagacctgtcggcgctgtgtggttattggaagcggaggaatactgcacggattagaactgggccacaccctgaaccagttcgatgttgtgataaggtacattggttttttttgtttgtttgtttacttatttttattgtttttattttattttattttttgaggcagggtctcactcctgttgtccaggctggagtgcagtggtgtgatctcagctcactgcagcctcaacttcccaggctcaggagatcctcccaccacagcctccccagtagctgggaccccaggcacacaccacgcgtggctaattttttatatttttagtagagatggggtttctccgaattgcccagactggggtacatcgcttttaaaaccaacctttctcctctagaactcagtgcactgctcttggtcagtgtggctccaggaacagtgagggacacaggaagctcttcacagtccctgcccacaagggacttaacgtttgagaagttgaaacaaaaacacaaaatggttggatgctccaaactgtcatactgaccctaagttggaggagcatgctgctggctacagtaagtggcagaaccttgtcagaggaagtgagatttggaaggtgggtagattcaagtaaaacagcaaaggaccacaactcccagacaggggcaagaagaggacacagcaagagacttgagtcaatgaggggcctggcttctggagaaggggcttggggccagtgagtcctggaaggcagtgctggctgggacatggaaggcacacagagaagttcagactcaccatgatagccaataggcagtcatcctagattcttttttggtttcactgtttaaaaattgttttctggccaggcgcagtggctcatgcctataatcccagcactttgggaggccaaggcaggaggatcgcttgagctcaggagttcaagaccagcctgggcaacatagagacagcttgtctctacagaaaatcaaaaagtcagccaggcatggtggactagattttcccttctgattccttttttgaaattctggcaagaactaacatctgagcacaatggaaaatttctgaggatattttactggcacccagagaaagtcccaaatgtaatatgcttagattgagtaaaaatattagggctagatgaaattgcttgacattcagggattagatacaagtgttcgctcaagtactaaaggctgcattcctcgaaatcctagaaagacagagctgggaggggagatgaggctgcaaaccatgcactcattcttagtcataagaagacgtggaggacatgacatggatactgcctggtgtacagagatggttgatggcctgctttgtcagtgtgtctttgtcctttttatttaaataggttaaacagtgcaccagttgagggatattcagaacatgttggaaataaaactactataaggatgacttatccagagggcgcaccactgtctgaccttgaatattattccaatgacttatttgttgctgttttatttaagagtgttgatttcaactggcttcaagcaatggtaaaaaaggaaaccctggtaagcactaatacttctattaaatctgccttagtaaaaagtgaaggagtcttacttagttgtaattatagccttttatttttaaacacgcagagcggaatgcatacttatgtgttgtctttcaaatgatgatcactctctttgtagaaacccctcagcaattcttttttttggggatggagtctcattctgttgtccaggctagagggctggagtgcagtggtgcagtcttggctctctgcagcctccgcatcccaggttcaagcaattctcctgcctcagcctcccgagtagctaggattacaggcgcctgccaccacgcccagttaatttttgtatttttaatagagatggggtttcaccatgttggccaggctggtctcaaactcctgacctcaggagatccacccgcctcagcctccaaaagtgctgggattacaaacatgagccactgcacctggccctcttccagtggttcttgcacatgggcaggttggagaattcctggtagagacagtggtgagggtgtttataatttaaactgaacaaatactaggagctagtgggagatttgttgggtgcggtctcagcaccggcacttcctcagtgcttttgatttcatgggtgaaatttcacactcctgagagacaaatgagaccctgccccccagttgaaatcggaaagtaccatacagtgggagtatttttccttttggtggcgggaatggagtgagatggttataaagaggccctgctgcagttgtgtcaatccaggagtgggtgctttcctcctatgtctgtgtacagctgtacactctgcatggatgggccagacctaattaagagtcgcatgaaaatggtgatcattgcttaatgggaatatccagattgtgaccaaaattgctgttactgaggttgttcacccaccttgttctccagacatgaacttgcatagcttttggctagttccagaaattagacttacttagatggatataagcctttttgagggtattcaaaagcatataaaaatcaaggaatactctaaagagctccaaaaatgctttggtcagtggttcccttgttggaataaattcatggcattccagaagggcagctatggaggagatggccctcacttggtcatattccttttgtctttattggtcacattactttatagtctcacccattatattcaaatacatttcagaggtcagctgtcgaggagtgtatgcacatgtatagacatatgcacaaactagctgtctgtgaaactaatgggacgtattcaacttttcacgtaaactccatgtgatgacaaatttgtatttccaaagctgattctatatcagtcatcatggtcttctggattttctattgggcagaagttctagttggaagatgaagcatatatgaaacgacttcatgggactaggaaatagagtaagtgagagaggatgcgaggtgagggcagtttcagcacttaatagccttaaattggacctattcacttgggcttccctagacaaaatgatggtgttagcaccattgaggaatgtctacctcaaacaaatacaagctggttctgcaattcatctctttgtccagtgccgcctgtgtgaagtggctatttcagagttacttttttgagttggagtgccggatttgcgtagcttttgcaatctataggagtagattgcttcagaaggcagtgcacagggccacatggggtcacacccacagccttggtctgatgagtgggaatgctttctcccctcccctagaaggatgactaacaactgcttgcttgctttccttagccattctgggtacgactcttcttttggaagcaggtggcagaaaaaatcccactgcagccaaaacatttcaggattttgaatccagttatcatcaaagagactgcctttgacatccttcagtactcagagcctcagtcaaggttctggggccgagataaggtatttttgttgctactcaaagttaatcattccctgtttgaggggcgatgtgtacaaatttcactttggctcaactgtatacccagaagcatctccagtggagaaacccagcctgtgattagatgctccatgtgtgtttaccactctgcacttggctgcagggctcctcattgtttaattggccttctctccagtgactcttctctttagtgtaggcagcacattaacacttgaatcactgagatactattttaaggtattcttactccaggactccatataactgcaggacactgaaaggcactttcatgatctgaaaagttatttacattttattttttaattttttaaaaatttaaaaaattttgtaccccagagaaaagtcatatttacattttcactctgtgggccattcaggtgagtattgatttttatcatcactttgtaggtgatagttataaaagttaatcctcaagaacagtgtttttcagttaatgcctgggtctcatctcagacattctaattgttttgtgttttaagattttctaaattccgtggacgatttttattttgcagcctaatttgggaactttgtgctctaggctgtttattgcagtagagattctttacctgcaattagcaagtgctgccaccaggggcgtgggggtgtgcatgcctttattacttgcggcttcttgatctgaataacttgactggtgtctttaaaacttaagacctgtgtggaaattatcacatgtacaatgagaataaacactctcagaatacaaagagctcttactaaatcaaagagaaaaagatgaaccaatagaaaatgggcaaaaaataggaatagacatttcacaaaagaagaattaaaatagccaaagaatacatgtaaaaatgttcaactttaccaataatcaaataaaagcaaattagagccacaatagtatttttgcccattttcttagcaaagacttaaaagtttgataatgtccttgtttggcaggaatgtaggtagaatgatcagctggcactttttctggaggatattttggcaatattaaaccattttaaatacgaatcatctctgacccaccaattttacactaaaaacattattacaaggaaattagagaaatttataaagatggatattctaggatgtacactatagcattaacagcagaggactaaaaacagcctaaatgttcattattatgggattgtttaaacaaattatgataaagtcaatgcagtattgtctgttaaggatgaagaatataggaaaacacctccatagtatattaagtgagaaaataaacatacaaaacactaggctgggcgcggttgcagacgcctgtaatcccagcactttgggaggctgaggcgggcagatcacctgaggtcaggagttcgagaccagcctgaccaacatggagaaaccctgtctctactaaaaataaaattagccaggcgtggtggcgcgtgcctgtaatttcagctacttgggaggctgaggcaggagaatcgcttgacctgggaggcggaggttgcaatgagccgagatcgccccattgcactccagcctgggcaacaagagtgaaactccatcttaaaaaaaaaaaaaaaagatacagaacactttaacaataaaagtatgtgtttagtataaaagcttggaaatagacaccagcctgtgaagaatgcccttcttcagaggggaagtctatagaagacttctactttctgctttataatctgtctgttagttgaactgaatattttcctatttttataattgataaaatggcatttttcttttggataaaaacagtaacttaaaagaggacttctgatctaaagttgcagtatcagaaacttcctcatgtatatgtccttccagcagatgaagaagcctgttgagcagtaggagatgtgatctcaaagggcatgctatagagatgacatgctttggggagtttttcatcggttttttagttctctccatatatcaccccaatggacagttgatttcacacactccttcg

SEQ ID NO: 15934 - DNA, 94135 bp, Human
agtaaagtataattccatatgtagtagcataaaaaatgtctagatgtccagggtctcttctaaaattctatcactctggaagattaacaacagtcttactaaataactttacacatgaatgaaaaatggagaaaaattctattaagatgccaatcttattaaaatgaaatgggctattccctcctcccgccagaaaaaaaaaggctgggaaaataaaattcacaagttggtttttttcttttttctttttttacgagttggttttaaggttatttctaatattcatttttcctaatgacaccaatatatcgccatttacctgattttaaaactgcaactggttagttttaagtgaacacaagtgctatgtttttgtagctttaccatattcaatctgtaacttacttaataaaagaccttaaattcataatgcatgcacggtgatcaaaatatgagcactcctccaagctctgctactataacgtttgctcctttgggagcataatgatatggttttcttttttttttttttttgagacggagtctcgctcggtcgcccaggctggagtgcagtgatgcgatcttggctcatagcaacctccgcctcccgggttcaagcgattctcctgcctcagcctccggaggaactgggactacaggcgcccgccaccacgcccggctgattattcgtatttttggtagagatggggtttcaccatgttggccaggctagtctcgaactcctgacctcaagtgatccacctgcctcggtctccaaacataatgatctgttttaaggttgcaagtatttccattaggtatttatggggtgagtagggtggggcagatgtgtcccggaatggggcacagcggacaggaagtaacggtttataacaacgtgaacgcttctgacgtgtagcgggagcttcagaaagcgtggccgaatctgcagctcttaacaaatggctcgttcccaaaccttagcctcaactccttctgagcgataggggcatgctaccagcacggggggaaatgagatacaagaaacgcccgaaagggaaaaacaaggctgggctgtttccttcctttggggtcaagacagaggcacagaaggcccaggtctgggaggttggatcacctccggctggatgttgagccgggtgggagcccaaacagcagggggcccacaggaggccggcccaggcagcctcgcgtccacttaccaggccaggcccaggcacgtccccagcgacagcaggctcaggcacgttcgggggtctgcccagcccccgcctccgctgctccgggccacgggggtcttcccgccctcgctccgcttcccgggctccgcagcaggggctcccttgggccccgacttcttccggctcttcacctcagacatgtctggagaccctaggacgacaagcccagggcagcttcttcaccagggggagcaggacgtggccgccttggcgttcgtgggaaccctgggcggtgaccgcgccccctcacagacttggcaccgcccagagcccagccccttccctctccccggcatcctcgttgcttcactgagtctttcagctgccagctccatagttcccctaggagaggtgggcggcgacctcaacccacagcgccttccactgcgatattgctccaaatccgaggaaattcaaactcccgggcgcgcgcaggccgacgggacccgaggaggaggggcaggacgaaggggtcgcgcgcgccacgtcgggcgcgccgccgctgcccgagtccggcattggtgggaacgcggcgcgtccctgaggcttagccacgccccgtccgcggggtaggcgggcacttctacgcgcgcgggcatgagccgtggcaggagtgcgcggcggcagcggtggccgccccttggggcttggggtgtgtttatttgcataagcgggcgcgcgccgtccgggctgggtggatccggcgggatttgactgctccgctgtccagaggcggagaagaagaggtagcgagtggacgtgactgctctatcccgggcaaaagggatagaaccagaggtggggagtctgggcagtcggcgacccgcgaagacttgaggtgccgcagcggcatccggagtagcgccgggctccctccggggtgcagccgccgtcgggggaagggcgccacaggccgggaagacctcctccctttgtgtccagtagtggggtccaccggagggcggcccgtgggccgggcctcaccgcggcgctccgggactgtggggtcaggctgcgttgggtggacgcccacctcgccaaccttcggaggtccctgggggtcttcgtgcgccccggggctgcagagatccaggggaggcgcctgtgaggcccggacctgccccggggcgaagggtatgtggcgagacagagccctgcacccctaattcccggtggaaaactcctgttgccgtttccctccaccggcctggagtctcccagtcttgtcccggcagtgccgccctccccactaagacctaggcgcaaaggcttgggtaagttgacctcctcgcttttctccccgagccaggttctttggaggcttggtagctgatttcagggactgagaatttgaggacatggaatatttgataaccatcctgctcctgtaccaggaagagaaattctgtaatgaggaagtagtaaacttggggttttcgtggataaacgtgcgctgttttctgttttacgtccatgaagagttttggctttccattttgttgtgggttacaaaaggttttgagacttagttcagataagttgtgcagttttaaaacgtatttaagatttgcatattttagtttaacaggactaggtgaaattggaaattagtttcagaaaaccagagtgtcttatttgcttagctattggacatcacctaaaaaattcattcattcttgttttttcacatcgaatttcattactataaattaaggaacattttatgtttaagaggacaaaaacgttattaacattttaaaaaatgagagttttgattcgaatcaataactttttatcagttttgtgcccctgctgggcattttgtaagccttgacaagcataggcaaatgccctacgtccgtccctgtttttccaagtgctacatttggtgacttcaaaaacagtcattgaagcttgataattattgcccccttctgtgagctccaagttacttgtgctctgtttttgcacttcgggcattcacattcccactctctctctctttttcttctttgagtagactgtgaattatttcaggcaaatgactcaatcttttctgtagtcttggtgtctgacatatagggaggggcacaaatgtgtattgaatgaatgaattgataaacccgtttagactctttcactctatacattgtgtaaagttctgttaatgttttgaaaacttgcagatattgtgaactgggttttatgcccatggaaaaatttgcattatatttgaaataaagttgctagaaacgtcaagtattttactataaaggctgttattctttcctcatgtcctcctggtctgagaaatcacatcagaaagtgtttcctgttgctttgtgggaaatgtgtttagcaaggaggacctagagctgacatcctccttgaacgagaactaatactcaatagtaacaatgctctattcactcttatgtttgataaggaaaacaagaagtctcttaatattaggacttcaatgtaatcactattttatacaatcttaattaaaaaaggaagtattttattgtaagaaatgataatgtgtgctaaaaaaaattgacagtagaggccgggcatggtggggctcacaagtgtaatcccagcactttcggaggctgtggcgggtggatcacctgaggtcaggaattcaagaccagcctggtcaacatggtgaaaccccgtctgtactaaaaaaaaaaaaaaaataagacaaggtgggggagaaatcccaaattttgctactcagaagtaactcaaacatttcgatgaataaacttctaaacgtctatatatattcatatgataccaacacttgtttttttttttgagacagagtctcagtctgtcgcccaggctggagtacagtagagtggtctcggctcactgcaacctctgccgccctggttcaagcagttctcttgcttcagcctcccgagcagctgggattacaggcacctgccactgcatctggctaattttgtatttttagtagagacagggtttcaccatcttggccaggctggtcttgaattcctgacctcgtgatccacccgcctcggcctcccaaagtgctgggattacaggcatgagccactgcgcccggcccccacgttatgtgttgtatgtgggatcatgtttctgttttttttttttttttttttcagcaacagtattatgaacatctttccatgtcaatacatggagatatgtgtcataattttgaatggctgcataatattccattttatatacataccctaatttttaaaatctatattcagaatgatggacatttaggttgcgttcatcactgaaacatcctccattaattcttttttctttttattttttactctagcctcccaatgtgctgggattataggcttgagctaccacacctgattggaaactcattaattctccttgtggatatttttacatatgtatttgaatgtctccttgaagtaaatccttagaaatgggatttctgggttagagagaaagcttattttaaacaattccatatcttactgctttccagaaaaattgcattcattttctagtttccccaattagtgcataagaatggccattttctcatacctttccaagcactgggttttgtccatttaaaaatttttgccaaggaaaaaaaatcagttttgttctttttacgtttcttgtttattagtgagattatgtatcttttcatatttttattggcctgacaaatattttggtgttttggctgtagctcatggttgacagctcagagagagaaagatctgagggaagatggatgcaaaagctcgaaattgtttgcttcaacatagagaagctctggaaaaggacatcaagacatcctacatcatggatcacatgattagtgatggatttttaacaatatcagaagaggaaaaagtaagaaatgaggtaaagctctctgaagcagtccacacttccttaaaaatttttagaatttcagaacttgtactggtctccactactttatgttgcatacatattcattgttgtatactaaactacttaattttttttagcccactcaacagcaaagagcagctatgctgattaaaatgatacttaaaaaagataatgattcctacgtatcattctacaatgctctactacatgaaggatataaagatcttgctgcccttctccatgatggcattcctgttgtctcttcttccagtggtaaagattcagttagtggaataacttcgtatggtttgtatccattataccttctatcactttgctatcaaaattgctttgggtttgtcttattgtagatgtaatcttttgaagagagtgtgaccagttcactgaaaactgcatgttaaaaaaattgtagtgatgttttcaatttaaatattttttatttgcatccacattaactctcaacttttcttcttgcccagtgaactgtactgctgagataataatatgtctaccctaatttttagagacaataagacaatttataggcccttgtttattttccagttctatgtgtttatagagtttataggaaaaaataagaatctttagaaatatatgttcttgaaaggtattccataaatgttcttccttttacacttgccttcccagtcttcaatatgagagggaatgaaaagtcaggaaataattgggtgagtaaagcagatatagatagaaacttccattttctttagtcatcttgaaggatatatgtttgtctttgctctctgttgtctgagaaatcagaaaattgaagttaatatgctagccacattttcttaacttctcttggaaattttcaggctaagcctcagctttgctctttgttttttatggtattacttcagtaattattccaaagttctattcattcatgcttgttttgttttggattttagtaaggacagtcctgtgtgaaggtggagtaccacagaggccagttgtttttgtcacaaggaagaagctggtgaatgcaattcagcagaagctctccaaattgaaaggtgaaccaggatgggtcaccatacatggaatggcaggctgtgggaagtctgtattagctgcagaagctgttagagatcattcccttttagaaggtaagtgtcttagtccatttcatagtctagtaaggtagatagacatgtaaaaatattatgatatatcaatacgtgataaattgaatggtagaaacaagtataaggtacagagttagaacaaaggaaggatatgttaactctctgaagggaggggatggataggacaagcttcctgaatgagatgacatcttagcaggagtttggagaaagaataaaagttagctaggcagtgaaggtagggatgggagactagggaaggtgggaaaggtagtgggtggttactggggtggggaagggcatactgggtagaagagggtttaagaaatgttggcaggtataccactgaccttagcgatcctggtaggttctcagggtattcatcaggaatagttgtatagctccatcagttctaggctgcccccattcatcagtgtgttctcattcatcagtgtgttctctctgtatgacacttctaggggaattcaaagacagttcccaacttctagtagttaataattttttttttagtaggccaggcacggtggctcatgcttgtaatcccagctgaggcgtggatcacctgaggtcaggagttcaagaccagcctgggcaacatggtgaaatcccgtctctaccaaaaatacaaaaaaaatcagctgggtgtggtggtgagcacctgtaatcccagctactcgggaggctgaggcaggagaatcacttgaacctaggaggcggaggttgcagtgagctgagatcgcaccactgcactccagcctggtcaacaagagcaagactccatctcaaaaaaaagttttttgtttttttttttttgatatgtatgtataacatgatctacggttaagacagtttagacagaatgattggaataagtagtaagcctctaagagacttagaaatatggaggctagggtatatctatgtgtacacatggcctcagtttaatttcatagcctttgtaagtggtatagactatactcttgtcagaagtatgcctgattcctaacccttggtttttcccctctatcattacagagaagtttcctgagacttagctcctttcaagtctcagagccaaggatttttttaagcccctactgcaaagttgatcactaaggatatttcaggataaatttagcttaagttcctttagtgtgaaggaatgagttttcctttcaatattatgaactttctttgtgtatttataatattccaatttataggtttaaaagaacactccctctccccatttaaattgctctacattattgtgatgaattttcaattctagggattaaaattgactaacaatctatggaattaaatattcaggagtcatattgtataaattgttatcttggaacaggttttaactactttgttttgagaaaatcctagagatactggcaactgtacatgtgagcttaattcatattcctcgtacttttgtgggatctcaagttcagaggactgagttattcatattccttagttcacggcttattatagtagatctgtactaggctgagcttttcactgtatttatttatttccatttcaaaatttcctattcttatttcctttcccctctccatggacaatcctaatgtatttaatgtatgttctttgtaaatgtctgtgtaaagtgtgtactcttgtaaaatatgtatgttgttggtatgcaggtattttaaatttgcatagatgttatggtattattctgttttttatctcccatgacacaatgtttttaagatttatccttgttgctatgtatacatgttatttgttacacctgattgccaccaacccattttactgctcattaccctaagtaaatggatatgtagattgtatccaactctctgctgctgcagcaaagctgggttgaacttctatgtgagtaagaatttcttgggtatttgtagctaggagcaaaattagtaattatttatttatttttgtttttttttaaagagacagagtgtcaccctgttgcccaggctgagtgcagtggccatatcatagctcactgcagcctcaaacttttaggctcaagtgatcctcccaccttagcctcctgaggagctgggtgcacacgccaccatgcctggctaattatttatttatgaaacagggtcttgctttgtcacccaggctggagtgcagtggcacaatcttggctccctgcaacctctgccttctgggctcaagtgatcttcccacctcagcctccggagtagctgggaccacaggtgcatgctgacacacccagctaatttttgtattttttgtagagttggggttttgtcatgttaccgaggttggtctcgaactcctgagctcaagcaattcacccaccttggcctcccaaagtgctggaattgcaggtgtaagccaccatgcttggtgtgtttttaaacatttttttgtagagacaggtttttgctatcttgtccaggctggtctcaaactcctgggctcaagtgatgctcccgccttggcctcccaaagtgctggggttacagatgaaagtcaccatgtccagccaaaattactaaatgataggatatacaaataccaaatttgattcccctccagtctgtacatttcccccagatgagtatggggactccgataattctacttgtgcagtgacggttggtatgatccagctttgtaatttttgccaggcaaacttctataaagttgtatcttttactttgcatttctctggtaactcaagtttgaacatttcttcataagcttgttgttagccttttgggtttctttttttatggattttgtttatattatttgtctattttccattggggtttccaatttttttttctttttgctttttaggagtttcttatatattctagacattaaactttgttggttttagacttttattttattttattttattttttttgagacggagtttcgctcttgttgcccaggctggagtgccatggcgcgatcttggctcaccacaatctctgcttcccaggttcaagcgattgtcctgcctcagccttctgagtagctgggattacaggcacccaccaccacgcctggctaattttgtatttttagtagagacggggtttctccatgttggtcaggctggtctcgaactcccgacctcaggtgatccccctgcctcgcctcccaaagtgctggtattacaggcgtgagccactgtgctcagctggttttagacttttaaataccttattttaatttgccatctgattaatttttttcctgggtgttctcagtagacgagaactctgatgtagtcaaactaatcagtttttttttttgtcttctaacttgtgtttcctgagttttgttcaagtagtcctattacagtcttattattcatatttagttctttattctctggagtctgcctttgtatgtccactaattcaagaataggtgctttcccaaagataaattttaatctctggagttcacttccattctcaaatacaggaacattggatttttgacatttaattgtattgcaaaaccttttcttttaaaagtacagataatataagagatctaaatttgattaaaattgtggttcctatggaaatgttttctttgggtggtgattggcataaattaaagaatattaagttgttaacttttagctgggtgtggtggctcgtgcctgtaatcccagcactctgggaggccgaggtggacagatcatttgaggtcaggagtttgagaccagcctggccaacatggtgaaaccccgtctctactaaaaatacaaaaatttgctgggcgtggtggcgcatgcctgtaatcccagctacccaggtggctgaggcataagaatcgcttgaacatgggaggcagaggttgcagcgagccaagattgcaccactgctctccatcctgggtgacagagtgagatgccgtctcaaaaaaaaaaaaaaaaaaaaaaaaaaaaaaaaaaaatatatatatatatatatatatatatatatatagtttttaactatttatgtctatacagttttaagtaacccagttgtcttttgaaatttcaatgctttaattttttcttatttgtagggaaatagtaaagaattgacgtatctttaaatacagtagtgacattttacattactgtattcgtatgttggtttttaatcatggatgctttcttcataggctgtgttcctatttgtttctgtcctttccaagatttctttgtgttattagattattaattgctaccaggataagcctcctgtgaaagtagtgtggagttttccctgaataaaggcaacttttctctgaattagtttctctgagtgaattgtaaatacagcctcctcatgcaaagctaaattgctccctcttgtgcccatagtcaagatgtttagattctttctgaaatgtggaattaatggttcagtttttaactaaatgttatattgtgatggttagagatttacatatcagatggtcatttggtctgtttgcctttttaaagctggtagtgttttctcttttcttgcatgtatttaaatgccctaaatttttagttatacatttagggaaaaaggcctttgaccctaggtaataggtacataaattaaaatatgaaagaatttactaggtagccatatcaggatgctttctttacctttaatcttgggatgatttttacaaattttattttattttattttattttgagacagagccccattctgatgcccaggctggggtgcaatgatctcagctcactgcaacctctgcctcttgacagtccccctgcctcagcctcccaagtagctgggactacaggtgtgtgccaccacacccggctaatttttgtatttttagtagagatggggtttcaccatgttggccaggttggtttcgaacacctgacccaagtgatcccctcgcctcggcctcccaaagttctgggattacaggtgtgagctgctgtgcctggccgatttttacaaattttaggtagtacaaatttaaaaaaatggaaacttaaggcaacagatagtttatttgtctgtttttgtttgtttaaatatttttaaagtagtattttctttttttttttttttttttaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagatcagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagaatttttcttagtgcagaacaaaatgaaaagtctcccatgtctacttctttctacacagacacggcaaccatccgatttctcaatcttttccccacctttcccgcctttctattccataaagccgccattgtcatcctggcccgttctcaatgagctgttgggcacacctcccagacggggtggtggccgggcagaggggctcctcacttcccagtaggggcggccgggcagaggcgcccctcacctcccggacggggcggccggccgggcagggggctgacccccccacctccctcccggacggggcggctggccgggcagaggggctcctcacttcccagtaggggcggccgtagtattttcatttaaaaagaaaaagaaataaaagttctccttacttgttcctttttgctttctcctaaattcttaatctttttatttttatttttgagacagagtctcactttgtcacctaggctggagtgcagtggcatgatcctggctcactgcagcctcaactttccaggctcaggtcatcctcccacctcagcctcctgagtagctgggccacaggcgcacagcacgttgcctggccaaaatttttcttttttttttttttgagacagagtctcactctgtcgcccaggttggagtgcagtggcgcggtctcggctcactgcaagctcggcctcccgggttcacaccattctcctgccccagcctcccgagtagctgggattacaggcacctgccaccacacccagctaattttttgtatttttagtagaaacggggtttcaccgtgttagccaggatggtttcgatctcctgaccttgtgatccgcccacctcggcctcccaaagtgctgggattacaggcatgagccaccgcgcccggccttgcctggctaattttttgtatttttttagggacgtggtttcaccatgttgctcaggctggtctcgaaattctgggctcaagcagtctgtctaccttggcctcccaaagtgctgggagccaccgtgccaggctctaaattctaaatcttatcctagagataatcttggttaacaattcggagtaaatttttccaaactttattctctgcaattataaatatatacacatacagaacacagctttaagtttaagtgaagtctcaaggacttgctgtttcataactgcaaacttacactgaaggaggcctgaggggacctcaggaaactttaggagtaagcagtagggcttgtctaccttcttctaagacattggcactgataatcaaaccaggcttcacagccctgtctctacctcagttactgtagagttctctgtctccagttgtttgttatattttagactttcatgcagtcactattcagtacattgccaaattctgatctaggtcttcttctgtcattcctatgtgtttctgccataccctgtagaactcctctgtgagcaggaaactctcttgtatcatcaacttcttagaatattcgccgtcttgccttatctgaaactgggcagtttcctgagtttactaccttctccataaccttcttaagtgacatggcaacttttttcctttatatcctacatactttagcaccaggaaatgggtgggcgttgttcttgctctctgttgtctcatccagaccattaatactcccttctccagctgaatgctttgaggttcatgtctctaacctttcctattgatgtaatcaccgtctcattcattgacgattggagttcgtagattataaccttcctcttatgctctttgtctgttagcactcttagtgattttgatacctgtgtggatgagtcatccaaaaccttaacctcttacctccttaacctctttgtctcctgtgaacatttcttaactcttccctgattacaggctagaccctgatctttgtcattactagaactacagcacttttgaaatcttgatgttgagcattctcttctactctttacccacctccacccattttattcaagtttaatgctatagacttaccaagacttctcatccattgattccagaatatcctctctattcatactatcagtcctctcctagacttcagccatcattgtccatcattttattgtccatcattcagttgcttcttagcacatactcttgactctttagtcctctccttatctggagtgaaaaccgatttttttctctatgctgggaagtggaataggtatttgctcctcaaggcttcatccagaccattgcttacgtcctcttttctgggactgatcctttccttgaccttgtgcaggttcaaagactccatgtcacttcaagttataaaaagtctaattttcataattaatatgtcaagtcctattcagtactccaaacttcatttacatataaggttcagttgggcctgcctgaaactttggaagcctgcaatgggatagtaggttaaggtgggttgtttccagctttttcctgttgcaaacaatgctgcagtgaatattcttgtggatgcagaatagtgtagaagttgaacattgatactttaagtttgaatctcaactctgcttcattagctgtgtaactttgggcaaattactcaacttttctattcttcagtttcctcattttcaaaatgaagataatagtgtctgcttgatagtgtgctataggattaaatgaatgaacatacagagaactcttagaatagtgcccaataaatatctgatgtaaatagatctttgtgcatatatacaagtatctcttttgggtgattaggtttttaaagtagtgatttatatttgtatttaattatttgtgaataccagtaaataaattgccctttggtgtaatttaattcatttatctttgagtctgttttttgctttttttggtatgtttaagatcacataaatctttatgattgatgctactggaatgatctaatgctactgtttaccatattttacacatagggacccctcttttttatatatgtatatttatgtggaggtgattaagtatagtctatgaagacttaagattttggctactgacaatatgtaaataaaaatacatatttcaagatgttttatggctcaattaacaatgatgatgataacagtaataataatcatggccattcctagtgtttactagtttgaagcttaatattggtaagttgctctcagatccataacactaataacctgttttaatcctttatacttaacatagcaatttcacatattttatatcattaatttttcacagcaactctgaaataggtgggctagacagccttatttcagtataatcaatgagactgaggttaaatgatttgataaagattgcttagctagtaagcagtagagccagacttgagtctaacttcctattttaagtctgtataagaaaaccataatgggtgagttatatgttccaggacatcagtagttctcaacgaggggtgatttcacacccccccaggtgacatttgacaatgtttggagacatttttgtttgtcagtactggtgaaggggaatcctattggcatctagtggatagagaccaaaaaggctgttaaacatcctataatgcataggacagtcccttacaacaaagaattgccatcccaaaaagtcagaagtacaaggtttagaaactgtgctgtgcagtgatcactgacaacacaggacaaagatcataaaactttacttggtaagattttcccgataagccacagatttacttcaaacttcagtttcttcacatcttcaacttgtcttagattcaggatataaagcctaccagtatcttgcacgtaaaatttctactctaaatcaagagaagttgaagatgtgatgggattgtaaattggagtaaatctgatgcttaacagtaaaaccatttaaaggagtactcctgttgaaaggccttaagttcattattctttccctcactaggttgtttcccagggggagtgcattgggtttcagttgggaaacaagacaaatctgggcttctgatgaaactgcagaatctttgcacacggttggatcaggatgagagtttttcccagaggcttccacttaatattgaagaggctaaagaccgtctccgcattctgatgcttcgcaaacacccaaggtaccgatggtcaaatttagttggtgtgtcaggtcccatgtcccaataagatgtaactactgacctcttgagaacatcatgcctttttcctgctgttctatagggaggataagagagaaccattgcggccaggtgcagtggctcacgcctgtaatcccagcactttgggaggccgaggctgttggattacctgaggtcaggagttcaagaccagcctgactaacatggtgaaaccccatctctactaaacatacaaaattagccaggtgttggtggctcatgcctgtaatcccagctgctcaggaggctgaggcaggagaatcgcttgaacccgggaggcagaggttgcagtgagccgagatcgtgccattgcactctagcctgggcaataagagtgaaactccatcagaaaaaaaaaaaaaaaaaaaaagagagagaaagaaagaaagaaccattgctttcctgcttttctctcttgtatttaaaacgaaaaaaaaaagtggctgccactcggcctaaaattgctttttctctttgcatgctacctaccacatcatctcatatgtaccattgtaggctttcaggaaatgtcttaagtaggtgagttggtgagtggtctttgctagaaagtgcaaacttcttactttgaatccgttatttctaatgggttaacatagaacaacagagaataaatgcaggcaactgataaatgtcaggaaggggccagggacagtggctcatgcctgtagtcccagcactttgggaggccatggtggatagtttgcttgagtccaggagttcgagaccagcatgggcaacatgatgaaaccctgtctttctaaaaaatacaaaaattaatctggtgtggtggtacacacctgtggtcccagctactcaggaggctaaggtgggaggatcacttgagcctatgagattgaggctgcagtgaacccagattgtgccactgtattccagcttgggtggcagaggaagaccctgtttcaattaaaaaaaaaaagtcaggaaggatttttaatggggctcttctgtttgattgtcttagtttctagaaatatacgtgtaactcttctacttccatgtacttcaggagtgagtttgttttgtttgttcaacagttaattaattcagcaaatacttaccattataattatgtgccaggcactgttatcaagtgtttcacagttttcattagccaaaagggagacagcagtttagttgctgcttgtcttaagagtataaccttggattcagtcaacaatttgatttctgtcatcttaacagcctctctttcatttgttcatttaaccaacattgagtgttgtgccaggttctgggccaagtgctgcaagtacaaagataaataaagcattccttgggaatgttatagtatactgagtgagagttaggtagtggctctgcactttttaaaaatgccctaatgcacccaaggatgcagtatactttcatatgtagcagttgctgagtatggcagtgattctcaaattggtaagggtattaatatcagaatatagggtgagaagagtatttttgggaaaagcctactaggtgattctgatgcatattcgttatatttttatggtgcaatctctgctcactgaagctccgcttcctgggttcaagtgattctcctgcctcagcctcctagtagctgggactacaggctccccaccacacgccgggctaattttttgtatttttagtagagatgaggtttcaccgtgttaaccaggatggtcttgatctcctgacctcgtgatctgcccaccttggcctcccaaagtgctgggattacaggcgtgagccactgcgctcggcccctccttctcttgatattgatctgtgtagaggaaataggattgagatcactaacccttccctctttaattgctcagtaacttttccctagttctacttttccttttttgcaaaattaaaattgacttctgttgagtaaaataatgtagccactttcagatgtgtcagactagcttacaaagccaggcatatttttttaatctctcagtctcatttggtttgtgcttttgtaatttttcaacctatgtatgtgcctagagtatttctttatttttatttttatttttatttttttagatggagtttcgctcttgttgcccaggttggagtgcaatggtgcgatatcggttcactgcaacctctgcctcccgggttcaagcgattctctgcctcagcctcttgagtagctgggattacaggcttgtgccacctcgcctggctaatattatattagagacggggtttctccatgttggtcaggctggtctcaaactcccgacctcaggtgatccgcctgccctggcctcccaaagtgctgggattacaggcctagagtatttttttttttgtaatgcacagccatagtgtgtcattcagacaaaaatgttattgtataattatgctatcaggttttagttatattttttcccctcatctgttctagtgagtttagaaaagtttttggagagaacaactgggaactggcatagaggttcttggttactatgaataaacaaattgattaaaaaaaaccacttgtataccaaatgaaaggtaatattcttttagattacaacatatgaaattgctagtttttaggtaaaaaatggtcacatatcatcattattgtatgattcattctaatgctaacctgagctcagttctagtttggttttggtgcttaaagactgagttggaaaatcccattacttggatagtaatggtcgcttttttttttttttttttggcactcagtaagtgatggctgaaccttttatggtaggatctgtaattttaatatgttctgatttagggtttgaggagaaggcagtctctaattttttttttccttatttgaatcagcatattgagaagagtatagcaaagaggaagaatcattttcctagatctagccatctatttgttttaaaaaaaatttaatttggtagattttaaaagacactggtgggattatctttttaaaaggaagcttaagataagtgtcattagtgattaatattttttttttaaattaggtctctcttgatcttggatgatgtttgggactcttgggtgttgaaagcttttgacagtcagtgtcagattcttcttacaaccagagacaagagtgttacagattcagtaatgggtaaggattattcgtttactttttagtacctttatatttaatttaattacatttaaatatgtgacataccaaattacttactttgtcttgtgatttttgtttgcaggtcctaaatatgtagtccctgtggagagttccttaggaaaggaaaaaggacttgaaattttatccctttttgttaatatgaagaaggcagatttgccagaacaagctcatagtattataaaagaatgtaaaggtatggttatttatttgtttatgaggagattatagggagttatataatttcccttttgttaattgagctaatgaatatggtaatttagcacatgaacatccaaaaacttttctgggagatttagtattttaggttctctgatatcttaaatggatacatgatattatggtatttatttattcattaaaataatatttaccatctacccacagtgtgttagagaccacattagtgagagaagtgagacacagatgtgacctctgctgttagagttaaaaatagagtgagaatcagattttaaaacttgtttttgcttgggattttataaaaatagtgttctaatttggtaagtaaaaactggtgtcttaatttgcatttttttttagcgaagttaaactttttacttgtttattgaatacgttttaagaagttatccttgactttaagaaattatccttgactcacttttcttttttgatataagtatttttaatttatttctaaatactcaaaaaatagaaactattagctctttgtcatatttttacaagtattatttcccagtaaaacaattttttaacttaaaatttatatatagaatctcgctgtgttgcccaggctggtcttgaactacttgcctcaaatgatcctcctgccttagcctcctaaagcactgggactacaggcatgagtcaccatgtccagcctgttacccagttttttgtgtaccttttatttgttgtattcttttgacatatagaagcttaaaattttaaacagtcaaatctatcaactcttaaaattatttctttcattattgttatgcttggaaataccttatttttcttctttttctttttttttctcttttgagacaagtctcactctgtcgtccaggctggagtgcagtggcgtgatctcggctcactgcaacttctgcctcccaggttcaagcagttcttctgcctcagcctctcgagtatctgggactacaggcatgttccaccatgcctagctaatttttgtattttcagtagagacggggtttcgccatgttggtcaggctggtctcgaactcctgacctcaggtgattgcccgcctcagcctcccaaagtgctgggattataggcatgagctaccatacctggccaccttatttttcattctgccatcaaatagacacacagttttgtttgtttatttatttatttatttattttatttattttttgagacgagtctcactctgtcgcccaggctggagtgcagtggtgcgacctctgctcactgcaacctctgctgcccaggttcaagtgatcctcctgcctcagccccctagtagctgggattacaggtgcgtgctacctcacccagctaatttttgtagttttagtagagatggggtttcatcatcttggccagggtagtcttgaactcctgacctcgtgatccacctgcctcagccacccaaagtgctgggattacaggcgtgagccaccacacgtggccagttttgttaatttttaaagaaatcttacacttagaaaaaatgcttaatttgtagttattacaaagggtgatgcatgtccattttgaaaatgtgtgaaactaaaaaaaaaatagaaattatccataacctgataattattagcatcatgagagtattgcctccagtcttttagaacaaagatttaaaaagttgagattatgtatatgtggttttggattttgcccttttttttttaaagagccagggtcttgctctgtcacccaggctggagtgcagtaagatcacagctcactgcaggcttgaatgtcttggcttaagcaatcctcctgccccagcctcctgaatagctgggactgcagatacccaccaccacacctgggtaatttttaaatttttttgtagggacagggtctcactatgttgcccaggcaggtctcaaacttctgccctcaagcaatcctcccacctcagcctcctgaagtgctaggactacagacacatgtcgccacacccagctggatcttaccctttttctatatcttgagcattttcccatgttgttaaatatttttttgaaaaaaatttaccagtggcataatattgatatatcttaatttattcaaccacttctgtattattggacattgtttacgttgtttaagattttttcactattctaagtgtgctgtgatgaatatccttaaacttaatcattcttttctttttctttaagacagagtctcacactgttcctcaggctaggatgcagtggtgctgtcatggctcaccgtagcctcaacctcctgggctgaagcaatcctcccacctcagcctcctaagtagccggcactataggcacacaccaccacacctggctgatttttctaatttttatttttagtagagacaaggtctcattatattgcttagactggcgcatatatatatatatatatatatatttttttttttttttgtaatgacatcttagccagatttgatctatgttattttgacttaataaagataatcaggaacttactgaatgaaatctttcttatttctaattttttttgggataaatatctagaagtgaagtcaagagtgataaatacttaaggcttttgataacatgcagcagaaattgtttcttagtaatgtaagtaagtaagtcgattcttattagtgacaaaataggatggtattagcatagtgacttcattttttttttaaaggctctccccttgtagtatctttaattggtgcacttttacgtgattttcccaatcgctgggagtactacctcaaacagcttcagaataagcagtttaagagaataaggaaatcttcgtcttatgattatgaggctctagatgaagccatgtctataagtgttgaaatgctcagagaagacatcaaagattattacacagatctttccatccttcagaaggacgttaaggtgcctacaaaggtaatgggatcaatgatcctcatcattgggtatttattgcatgtaagctttgatatagtactgagcatgttgttacagagaaccttggaaggataagacccaggggactgaggtggtggggtgttgggtgtagaaatccctctgctgttagcttccattaagggctttgtgttgaactcaggagttaacctatttctgtggttctagtgcagctgaagaagcatctgacttctctttctcttttctatcttgaggagtagctgagtttcttcttaagaaatggagacattcttactcagggctttaagataccgtttttttgtgtgtgtgataatacctgtctacagtcctggtcattgtacttttgtggcatattaaatacttacaacaattcctaggtgttatgtattctctgggacatggaaactgaagaagttgaagacatactgcaggagtttgtaaataagtctcttttattctgtgatcggaatggaaagtcgtttcgttattatttacatgatcttcaagtagattttcttacagagaagaattgcagccagcttcaggtacttgcatcttggtttacttttttttttcctttttcctttgaaataattttagatttattgaaaatttacaaaatagtagatagtttctgtgcataagtccttcacctagcttcccctaatattaacattttatataaccatagtacagttgttaaagccagaaaattaacattgatacaatactgttcactaacctacgtgttctttttgtagtccaggccaatttaggatcccgtattgcatatgattgtcttgtttccctacttgtcatttttttccgtctcctcaaatctgtgaaaatttatcagtctttatctttcatggccttgtcacctttgaagagtactggctagtaattttgtacagtatacccaaatttggttttgtgtgatgtttttcctgactagattgaagttatagatatttggcaagaataccaatgatgttgtatctttctcagtggcgtcataggctgagagtacttggtggtttttaaaaaattttttgtagagatagtgttttgccatgttgcccaggctgttcttgaactcctgggctcaagtgatccacctgtcttggcctcccaaagtgctgagattgtaggtatgagccactattcccagactcctggtgttgatatgttttattatgggtgatgttaatgttgataatttgtttaaagtggtatctgccaggtttctgcactgtaaagtcattattttgtggggagattctctgtatatatatatgtatttttttttttttgagacagggtcttactgtgttgcccaggctggcatgcagtggctcactgcaatcttaaactcctgggctcggttggtcctgagtagctaattcccgagtagttgggtctgcaggcatatgccaccacacctgactgattttttttattttttattttttgtaaaaaaattaaatatacggatatctctctatgttgcccaggctagtctcgaagtcctggcctcaagtgatcctcctaccttggcctcccaaagtgctgggattacaggcgtgagccaccgagcccggcctctctgtacattcttaatagctttggaagctgaagttactgtgatgcttaggttataaaattgtttctggcttctgaaacgtttcattgggttgcaggatctacataagaagataatcactcagtttcagagatatcaccagccgcatactctttcaccagatcaggaagactgtatgtattggtacaactttctggcctatcacatggccagtgccaagatgcacaaggtaagatgacccatttaaaaattcttttatctgacttccctttttccatatgtattacaaataagtgctttttttctgttattttttgtcttgaattttgttcatattgctttccatttgattttttttttttttttttttttttgagacagggtctcactttgtttctcaggctggagtgcagtggcacaatctcagctcattacaccctcacctcctgggctcaagtgatcctcccacttcagccccccatgtagctgggactataggcacatgccaccatgcctggctaatatttttgtatttttggtggagatggggtttcactatgttgctcaggctggtctcaaactcctgagcttgacgtgagctcaagtgatccactcgcttcagcctcccaaagtgttaggagtacaggcatgagccaccgcggctggctgaagatttgaatttttatgtagttaaatttaccactgttgttgtcgtcgttgtttggtattttgctttgctgtcctgttcataaacatgtattgttttattagtataattttttattagtaaaaatgggattatagcttgcataattatttttgtttttacctgtagtgattagaaaaggtaccttagtaactagtaaatgaaccacctcagaattaatcctcttcttactagtagctttcctttttgggcagtatggatttgttttgtaagctttgagaggaaatggatagtggaaaagtatattcattgattcaataaatatttattgagtgcttgttatgtatattgctcttcattaagaggataaagcacaggcacaaagtcattgctctcacgagtttatgttctgggaggaggcagacattaaacaaatttattatatttcagtgggtagttaagtgctcagaagaaggacagagcatggaaggggaaagaaagtgatgatagaggggtagaatcatcatgatttgcttatgggtttggtatgcattatacgagaaagagaagaatcaaagatgactccaagaatcaaagatgactcaaaccccagtggaaagaacggagtccatgaactgaaacaggggtctttgggagaacaagctttttcctgcagagaatggggatggttaagaactcattttggatatattaagtctgatatacctattaaggcatctggctggaaatattgaataggcagttagatatatgagtctagaattctggggagaattatagatgaaagatgaaaatagggaattattagcacatagatggtatttgattgaagtcatgactaccaagtagctactaaaaatgtttacatttggaaaaccatatgtactttcagtaaattttctatgctcaggtatgttatttcttggttatgatacatagtaaattgttgtagtttgtttttttatctagcaaaatatatttacatttaatagtgtatattggaatgatggtattccaataaatacttgtgccctaatttacttaaccaaactctagttatcgaacatttaggttttcagtttttttggtccttatgatgtaatgagcattcttgtttatctttgtacctatgttgtttccttggcaaattccgagaagtagaattactgagccaatgcatctttttaaagcttttgacatgtatgatagtgtggcaggattcagtttctctttagccttttttctgactttaaaggtaatggttgattttcattggaaaaacagaaaaaaacgatgaaaaggaaaacagagatcacaaccattactaatgctcttgtgtatagttttctagatcattttgctgcttctataaacatacttgtctcttaaaaccaaatgggatcataatagaaatagtctcatatattgctttttaccatttaattacattgaatggtcatcttttcatgtcatttatatagagtgacatgatttttaaagctgcatattatttcattgtatagctacattatgaatggccagttggttgatggacaattagattgtttaagcatattcatctggttattttcttaggatacttttttataagtggaatttctgggtcaaatagtatgtgcagtttaaattttaatacagattgccagactgctctccagaagggtaccctgttttacatgcctaccaacagtggttgaaagtgttcatttcctctgattctagctaatcacctcctctcctctcctccctcccttcccctcccctcccctcttcctgccctcccctcttcctgccctcccctcttcctgcccttgccctttctttgacaggatctcaccaggatgtcactctgttgcccaggctggagtatagtggcatgatttcagctgaaatcactgcaaccgccacttcctgggctcaggtgatccttccacctcagcctcctgagtagctgggagcacgggtgtgcaccaccacacccggctaatttttgtatgttttgtagagttgaggtttcactgtgttgcccaggctgatcttgacccctgggctcgagtaatccaccctcttcagcctctcaaagtgctgggattacaggtgtgagccactgtgctcagccccagctaatattcttgttactcctttagtcttcagaaatctgatactttaaaaatggtaaatttttcttgttctcctttgattaccggtgagattttggccatctgtgctttttgttttgtgaattgtggctcccatcctttgtttgcttttacctcctttacctattttttctcttgacgtgtttttctttttcttactgttttattagaattttctataaaaaataattttctataaaaataaggattgaagccctgatctatcatatgtgttacaaataagtatttttttaaaacttctttggtcttgagtttaatttatattgctttctactgtattgaagatttgaatttttatgtagttaaatacacttttatatagttaagtgcagtttttctttttgtttgatattttgctttggggtcatgtttacaaagatttccttcactacaagcttacaaaaatatttatttttattttctagtatttttaaatgttttctattttctatttaaatttttaaccaactggagtttatttggagctgaagtatgaggcccattttatgtttctttggaactatggatgtgttctttctcactagcttttgcatcctttaaattctagatatttactgtttctcttagcagtgtgaggttaatgatgttatacctaaaattttttgatctctaacagtgctgctgatactactttttgttttttaaaggaactttgtgctttaatgttttccctggattggattaaagcaaaaacagaacttgtaggccctgctcatctgattcatgaatttgtggaatacagacatatactagatgaaaaggtatatatattaacatgaaaaattagtgctaaaaaggaatctcatttttttttacatttaattctagatttaatgatgggaatgagcagaatagaaggggtgaagataatttccctcctttgatttttggttattctaattaatttgcttcctaccctactgggaaagtaggtaggattgaagtttaaaagctaggaaaataagatgttcagtggtttttttaaaaaaagaatgtattaagaaatgtgtttgataatgagatttttaccctatgtttaaaagtcagaagaggattactatatatttgttacttaatggttggctgttcaattttagttcatataaagaatatttcatttaagcttttaaagtggcaagatcacagaaatggaaaaatgtcagatcgtggctctgattgtgtttctaagagatttcagtttatttgtaggattgtgcagtcagtgagaattttcaggagtttttatctttaaatggacaccttcttggacgacagccatttcctaatattgtacaactgggtctctgtgagccggaaacttcagaagtttatcagcaagctaagctgcaggccaagcaggaggtcgataatggaatgctttacctggaatggatgtaagtaggttaggagagaaaccaaagggagtggtgcgctaactatatcattatttttcaggtggtgaatacgatcactccaggaggatttaactactttcgaaagggctggaacttttaataagcattcttacttattgaaaagttctagagaagtaagcataggagaaaatgattgtattttcaaagaatccatataaatagatgcctgtaaggcatttggacaaattatcctaagtattcagtactaagtgcttgacttactgtaatttagtatagtggtgaggagcatggactttggagccacagaactgggtttgagcctcagttctaaaacctaataattctgtgactttgaacaagttacaggtttttctctcatatgtaaaatggagataacaatcctttgaaataagtgctgtttccatgaagattttatttatttatttatttatttatttttgagacagagtctcactatgttgccaaggctggagtgcagtggtgtgatcttggctcactgcaacctctgcctcccggattcaaacgattctcctgcctcagcctccaaagtagctgggattataggcgcccaccaccatgcctgtctagtttttatatttttaatggagatggggtttcgtcatgttggccaggctggtctcaaactcctgatttcaagtgagctgcatgcctcggcctcccaaagtgctgggactacaggcatgagccaccacgcctggccttctgtgaagatgtaaatgagataatggctgtaaagtaatttgcactttcctttgcacatatagtccttattaaatgaccactgaaccctgattattctgtctcttaaaggagtctcttttgctcttaccttaatcttgtaaggaaaggtataatcttacctttccttataaaaaggaaaggatagctattaataccatctttttaatgcctgttataatgctacataatcaagttattctatttaatcttcaaaacaagtttataaggtaaattttatttttattttattttattttattttttttgagacggcgtttcactcttgtcgcccaggctggagtgcaatggcacgatctccgctcacggcaacctcctcctcctgggttcaagccattctcctgcctcagcctcccgagtagctggaattacaggcatatgccaccacgcctggccgattttgtatttttttttagtagagacagggtttctccatgttggtcaggctggtctcgaactccagacctcaggtgatccacccgcctcagcctcccaaagtgttgggattacaggcgtgagccactgcacccggcctaaattttatttaccttataaaaatgtaagtacctaaaattgacctctgattatacaaatgagaaaattgaggcacagaaagatttggacttggctaagttcatgtgacttgctgaatgggatttaaaccttggatcttgtggctgggcatggtggctcatgcctggaatcccagcaatttgggaggccgaggcgggcggatcacctgaggtcaggagtttgagaccagcctggtcaacatggtgaaacccatctttactaaaaatacaaaaattagctggatgtggtgaattgtttgaacctgggaggcagagactgcagtgagccgagattgtgccactgcactccagcctgggcaacaaagtgaagctctgtctcaaaaaacaaaaaaaaaaaaaacaaaaaaaaaaccttgggtctgcctggctttattttgcatgctctttccatatgtcatgcttcccttacagcttgaaataataaatatgagtggctctcttttcatatgtataatttatatctaaatagaagtccaggttggtatctgtgatctttatggcattaggccctctttccaaataagtcagactactgtaggtgattttcttgattcagtttagttcaagaagcgtttgagtttctgtactgtgctaagcactagcatttgagtttctctactgtgctaagcactgttactagatgtgaggtctttcccctaaggagttcaaaatctcgtagtgaagaaaggagtttaggcaaataattacaatataatgcaatgagtataacaacagaactatgtataagtagagatagaactgataagtatttggcttggaaaaatgaggaattcaagggagggttccatgaaggagagaatggtatctgagagaattaaaattttttttttaagttaaaatgtttaatttttgttggttttatttatttatttattttgagacaggacctcactttgtcatttaggttgagtgcagtggtatgatcactgctcactgtagccttgacctcttgggctcaagcaaccctcctgcttcaacctcctgagtagctgagactacaggcacatattaccatgcctaattttttatttttttgtagagataaggtctcactatgttgcccaagctgatctcaaattcctggacacaattgatcctccttccttgacttcccaaagttcttggattacaggcatgagccaccacacccagcaggttttattttaaataatacattcctgattaagacaaaaaacaatagtaataggatgtaagatgaaaagtcaaagactagccatttccctcctaccttcccactttccagagttgaccattccttaatactttcttgtgaagtggaggtctctctctctctctctctctctgagaagcagccccctaacttactgaagctagattagatctgtctgtattcgagagaactgtttgccccatatcataggatttgtcacactttatagtgattatctgtttacttggttttctctcatactagtccatgtgttctgaagtatagaatagtttggaggttaaaataacataccctggctctagactgcctgggtttgaatcccagctctgctattgattagttgtgtatcataaggggaaagttatttaacttcctttgcctaatggtagtattttatagcattgttgtgaggattaaattagtgtatatatgtatataaacgtatagacatacatatagtacttagaacagcacccagttcatagaaagtgctcaataaatattagttgttattaagaatagcatttagcatttttctggtctgtattcagtataaatttatggaagattgaatgaactcatgtttcagttagtggctgaaatagaatcttaatacttggtctgatcaaagggcataggtttagttcttgttctcttatgaattgttgagtttcttcctgttttctcccattgcatcaactgcatttctccttgtgatgttctctcatagaatggttagctatttatagcttatttttaaattgtgtttgaccagtccatattcaaagaatgctttatttaagtactagaaacttttttggtgtttactatagaaaggtttaggttggtataagcttaaatttaattgagtttctgttttcaatgaaattatttattcactcattcatttgttatttgtctagtacttttgggccatctactatatatcctttattatgaaagtcactttctgagctttgaggaattgagtagatagatcaagcagacataaagaacattttaaaatctaatcctcttaactttgctagaacttatctgttcttctagttgtcatcactctagttcttatattatacagtcgaccctccatatccgtggttctatatccatagattcaaccaacctggattgaaaatattagaaaagaagtagatggttatgtttgtattgaacatgtacagactcttttcttgttattatttcctaaacacgatggtattacaactgtttacatagcatttacattgtactaggtattttgagtaatctatagatgatttagggtatacaggaggatgtggtgggttacatgcaaatcctataccattttatgtaagagacttgagcatccatggattttggtatctgtagtgggtcctagaaccaatccctcatcaatactgaggaacaactgtacttgtttgttttatcacttctactaaagtgtaatactttgtaggcaggatctaaatatgatttacctttgtgttcacttttatcacttgatctgtcttgtgtgtggttaagttttttgaagaatgatagtagtggcacctttatgtgtcgggtgctgtttagaatagataccattacttccatttgacatatgaagaaataaaaacttgttaggttaagtaatttgctcatttacacacctaataagtattagaaatgaggttaggtttgtctgactgccaacccttgatttctaaaataagcacaatactatttgacatatttacttgtactcaaagtgacagggatgtaacgtatatgaaattctgtcactgcactaatagttttttctggtttaagtatacattacattcctttacaccttattatttatttatttatttagaaacagaccctcagtcacccaggctggagtgcagtggtatgatcttggctcactgcaacctccacctccagggttcaagcgattctcatgcctcagcctcccgagtagctaggattacaggtgtgtgccaccatgcctgctaatttttgtatttttagtagagatggggtttcaccatgttggccaagctcatctcgaactcctgacctcaagtgatctgcccgcctcgtcctcccaaagtcctgggattacaggtgtgaaccaccatgcctggcccctttatactttagatactatgagcagtaatataatatctatactggtggaatagttgatattcattagattgagatacaaagaatatgatgttgctttatctttttggtatgtctgaataattgtagtttgagagaagcagtttttttttttttttgaaatggagtcttgctctgtcgcccaggctggagtgcagtggcgcgatcttggctcactgcaacctccatctcccaggttcaagcgattctcctgcctcagcctcccaagtagctgggattacaggcacgtgccaccacacccagctaatttttatctttagtagagacggtgtttcgccatgttggccaggctggtcttgaactcctgacctcaggtgatccacccaccttggcctcccaaagtgctaggattacaggcatgagccactgcgcctggctgagaagagcagctttaaagtacatcataataatggtgggtgtttccttcagttaggaaatgagcattttgctatgatttttattttaaaaaagagatggagaatttttgaaggtatccttatataatgatttatctgcacatgtatcattattaatgtatcaaaggaaaatggaaagtgacatgttgattaactagatttgattaatttgattaattagatttcttccaactcagtgacatttgtaacacgtgacaggttgcttgataaagggtaacatttctcttacaaatgctacttttgttattttttttcttttggtgatctgtgctgtcatttgcatgttagtaatctgattttaagaattttgtattttggggaacataaccatgttaaaagacagtttattttagtactgaaagaaaatagttacttttactctcatttatttaatttctgttcattttttccctgtatttagaaacaaaaaaaacatcacgaatctttcccgcttagttgtccgcccccacacagatgctgtttaccatgcctgcttttctgaggatggtcagagaatagcttcttgtggagctgataaaaccttacaggtaaaacacatctcttgagaaaaatgcaaagaggcatgtatccagttttgtgcagatcagaatatgtttaaatcctaaaattcaagaaaattgcaacttagaaataacagaggaatccagctctcttgaacattttattaaaggtttctctagagatttaaaagatacagttacatgttttcctaattctaaacttacaggtggtaaggaagtgccctttaccctgccagtcagttcccagccatccatttgtcagctaagggtagtgaggaaataattgttagaagacgtagggcttcatagcacagggaatagggctgtgattaaaaaacagtgattaggaaaatacctattttatcaaagtcttaggcataggtttttttcttgtaaataggaactggactagactatttcctaagttgttttaaagaatttcctttaagattccctttgttttcagaaaatattaatgagtacttttctttatgtttgtgttctgccttttgattttgcagagaacatgatgaaattagttaaaacttgtatttaggatacttttagtctttgcaagattatgactccatagcttatgtctatatgtgtactttattactaattttattaatcttggcttttgagttccagagagaatgcatattaaatgaaatgttttatttgattgttaagaatttgccaaaatagtctcaagagctgaagctgtgctctgacacttctttttgatggcagcggcgggctgcctggagtggctgctgccatcatgctggctgcagcagggaggcgcagctggggctgcatgctctgtggagctggcggtagctggggacaagcaggaaccctaccccttctgaattggggcaggagctcctggttcctgctgtagccgcccaagccacagctgtggacctgggaacccgctccatggagcaggccagagccctgccctcctgggtgtagctgtagccgcccaaaccacagctgcaggctcgggcctccggctccacagagcaggcaggaccccttccccctggtgcagctgtagctgcccaagcggtggctgcagactcaggcatccctgtactcttgggggacctggaaggaccccctgcccttgtaggcttggaagtgcctgctcccgctgcctgacttctccctactgttggcacccactctgatcttagagcaaagctggggctgagcctgggtgctgttgcagcccggccagatgtgcacatgcttggggcagtgctgacatgccagccccctgccgcctcggccccctccggactttgggtgctgatgagcataggagggaagccaagggggtgctgagggcagtttgatactggcctgcaggctccccttggcacctacagcctgggtgccattcatggcagcaggaggcagacaggttcctgggtggaagggggcgggtcaccaatgaggccccaccttcaggccacaaagggcctgaagactgggggctgggctgctggtgtggactgaatggactggagtgggaacttatagtgccttttccaggcttgcccatgtctgcccatggaccagttggcatgtacttcctcccttctgaagcccataaaagcctcgggcttagccagtgctgagcagacactgggacaaccagctgcagagaggagcaacccactctagtgccccctctttgctgagagctgtgcagatgacaggaggaccagctgcagagaggagctaccctctctgctgatagctgaacacttgtcaggaggacttgcctagcagagaggagctaccctctcctgagctgtggaaaggagctgccccccgcaggtttattgagctattttatcgctcaataaagctcctgtttgtcttgctcaccttccacctgtcagcgtaccacattcttcctggttgtaggacaagaacttgggatcccactgaatggtgaggctaaaagagctgtaacacaaacagggctgagacatgccccttgcttgccgcattgcaagtgaagataagtaaagaaaagctgcggcccttcggggagcccagacttgggagctccccaagctagggctgtgactccctctttggggccccgcggttcctggcatctccaagcttctgggcaccaccgtgttccccggtgccagcgtgtaagctgcttgtggtgtgcctggtccagccacagcctcacagagagccagagcccatgctggcacctggagctgcctgccccgctgcagcagtcagcacgtctgtgcgcagtggctggaccccacgctcactcacacacgcctcgctgttccacgcctgactcgcccttggcaggcttgggacccaggctggtagtgtgagctgaatgcagcctgtcaggccaagtgggtgaaacaagaccagtgggcccaagcaaaacttgggcaaaggcgccaccggccacagaagtttctggccagaaaatcaacaccccaaagatcctgtaacattttcattgatatttacaaacatgtaacagtgaatagttctctagttatgtgaaggcatacacattctgacagaaattctgattttgggagtagctttgccaaggttcctttctgttttgcaaaatgacaatgattaaactcacttaaagatttttattgaatgatgaccagtagttaagcagtttattataaaaaatattttattgttacttgtgcaggtgttcaaagctgaaacaggagagaaacttctagaaatcaaggctcatgaggatgaagtgctttgttgtgcattctctacagatgacagatttatagcaacctgctcagtggataaaaaagtgaaggtaggaaaatcttttcctcttgagttgtaatcacaacagaattcattttatttttccatgatcatgagaccagagtaagtagagttaaaggactctcacctgttgatctactaacctgattcattgtaaattaacactatctgaaaattctttacttttttttaaagagacaggattttgctctgtgacccaggctggagggcagtggcatgatcatagctcactgtaaactccaattcctgggctcaagtgatcctcctgccacagccttccaaagtgttaggattataggtatgagccactgtgcgtggcctgaaaattctttatttttaaacaccagcaaaaatgcctaggttgatcacctcaggattaaacaagcagtggggaaaagcaatgacaaattagtgagtttgtcttccattaatagacaagtccatgggttaaatatcagttgaaatctttgagtgcattgtgattaggagtgttgctgcacaaacttggggattcctgttgtaagatacaattttaaaatgcaaccccaatttttttaatttgcttatgaactggcttatatattcagtggaaaaccaggtggatgaacaaactaataattacgttactggtctaaaaacataaatagagaaaagtaaacagagtaatttttacttatttattttgaggcagagtcttgctctgacacccagactggagtgcagtggtacaatctcggctcactgcaatctctgcctccaggattcaattgattcttatgcctcagcctcttgagtagctgagatcacaggtgtgcaccaccatgcccagctaatttttgtagttttggtagagacagagttttgccatgttggtcaggctggtattgaacttctggcctcaagtgatccgcctgcctttgactcccaaagtgctgagattataggcatgagccactgtgccccgccagagagtaatttttatttttgttaagtattctcttgttcctaaatttggcttctaccaggagcatttatactaatatagaattcaagagaaactgaaggcttgtgggggttatcactgatatatggaagacagaccttactttaaccctttttcaaaggggttaaatctggagtactggatgtagctaggtggagtgggcaagaaatttgccttgggtgttttcctgaagttttcacctactggaagagggctatggaatgtccagactaaatttgagaccttggaaaaatctacctcttgatagattggactcgtggcttaaccaacagttaattcactctgtagtgtctactctgactctgagtcagacttggaggtggccactgagggcagttctaaagtcagagctacatggagtaaaaggaaataataatgagtttctgttttctaagccagaggtagaaatacctattaaagaactttaaaataagataaactctctggacctctggggattctaatcagtgctttgataacatacaaaggaaatgccaaaggacattagtacctctaaaaagtcaaaatcccagtgaaggttcattaggtaatttatttcttttgtttgttgttatatggcatagactgcttagttgtcttacatagtaactagaatgatgattaatttttttgtttttttttttttttttttgagacggagtctcgctctttcgcccaggttgaactgcagtggcgctatctcggctcactgcaagctccgactcccgggttcatgccattctcctgcctcagcctcccgagtagctgggactacaggcggccgccaccgcgcctggctaattttttgtatttttagtagagacggggtttcaccatgttagccaggatggtgttgatctcctgacctcgtgatctgcccgcctcggcctcccaaagtgctgggattacaggcgtgagccaccgcgcccggcctgatgattactttttactgaaaactgaacactataagaggctataaatactacacactttgtcatattacattatcaatttcctgctacagcttgcagggttaagtgtcgatcccgtttacagaagaggacgcagattcagagatgaagtctcttgctcaagcttacattaaactgggaacagtaatagggttgaaagctgggtttctctcagactataaaacctttattttttttaactaagcaatctgcctttacttatttatatggtaccttgaagtccatagaacacttgtcatgttcattatctcatttgatatcttaaattgtgtgggagaggtatagatatccccattttacagaagagggaactgagatgcaggtaagttagggatttgtgacacacaagtcataagtggtagagccagctcttgggctcaacccttctgaccagaaatctattatgctaacctctttaaagcacttctctgcctgctttcattcatataaacatgtgaaatcttgcccttaagaaatgtcatgtgttcatgacactctagttatgctataggtacatatatgtatatttgcaaataattttttttaaacattaaggcaaaatattgccatattttagaaaggggagaggtttcattagcatcttgtccaactaggaaaatctgctatgacaggataagatagcatttgcaaagcaatggacattgctttgcccctctgttctccctttgaaaataatggatatttgtaaattttttctcttttctctttagatttggaattctatgactggggaactagtacacacctatgatgagcactcagagcaagtcaattgctgccatttcaccaacagtagtcatcatcttctcttagccactgggtcaagtgactgcttcctcaaagtaagtgtggatattgagaattaggtagataaatttgattcgtacatcagagtatctcctttgattttcttatgtatactactattaggactttctggtcacaatgatagaaactacaataatatattagctgaagcaaaaaaaaaatagcttaaaaatattttattggctcatgtaactgaaaagtctagagggagcatggcttcaggcatagctgactccaaatgcttaaactgtgttctcaggctctacctccctttccatctccagagtcttgacttcctctgtgttggttcaggcatgctctttctgtggcagaaaatgtggctaccttacagctcacaatcacagagtaagagaaatgtgctctctcctagaacccatagatctaattttagagaagcctttatttgactcattttggcttacatgctcatagctagggtaaccccagtggacagtaggatggaatccttggattgtccaagggtcacaagtttagttatatggaagtgggacaaatgagtgaggtcaactctacttgaatcgtaagtagagcttaattcaaaagagagttctgttatcacagagaggagggagaaaaggtgctggtaggaaagataaccaaaaacagaaattcattccacatatgctttgtaatgtttgattgtatctttttttcctcttaagtggataaagatagctagattaccttttctggaatcccagaaagatctgctaactttttttgaattgttttttggtttgatttcaaacctttcttccttgataccataccatctttgcaattgaacatgatatttttgagaggggtagtaaaagacatttcagtttggaaaacttcatagactctatgttttgacatttaaataaattattagaaaaattatctttagaaagtactgaaacagttattgaaaattgccgtctccatccccctgttcaggaagctaaatttttatttatttatttattttttcagaagaaaaaattatacagaagctcagtgtgtataagagttaaagcttgctgctctggctgaatgggacctacatttcttcttgactctctcttcctccccctttccctctcctctctctctctccctctatccctttcccttcctgtcaccttcccttcctcttgaccttcctttctctcctcctccctctcttcttctgtctcctcctcctcctccctcctcctccccccaccccccctctcattctctctcattccctttcatctctaacctctccgcaccacatagtgctctttaggcatatttatgtttatagaatcccaaggaccctgcagagcacaatttgaaaacactggattggaccaaaattacagagtaatgtagtaacataaaattatatcacagttatggttcacttttactcaaaaaaacttggccctatttgaataaatgtaccactaaaaaaaaataagactgttatactatttacgactaatttttgatgttgcttttggcattttgtaggttgaggaaataaatacaggaaaaaacctctgccatgtgggagggggttattggttagtaagccattttaattaaggacaaggtttactttaagatgtgctatactacctatattaccataaggactattaggatgcatttcttgtgattcttgagcagagagaagccagtgaaaatatgtaattgtgaagctgccttcatgtaacttgctttatctgaagaattgagtttatctaggactgggataaaggagtcaaagatagaagtggacatgaggaacagtatatatctcacttactaatcatttctaaataatttttgccaaaactaacatttagcaataattgatttcttcttctgggtttaatcttattagcataaatcaccagagatgactataatcccttttatttgcattttttatactttccaaacctacccaaagagaggagatataatataaacccctgtggtatccatcatttagtttcaacaattatcagtattttgtcaatcttattttataaatacccctcccttttttttttttttgagatggcatcttgctctgtcgccaggctggagtgcagtggcacgatcttggctcactgcaacctctgcctcccgggttcaagcgatttccctgcctcagcctcctgagtagctgggactacaggtgccgtgccaccatgcctggctaattttttgtattttagtagagatgggttttcattatgttggccaggatggtctcaatctcctgatcttgtgatcgcctgcctcagcctcccaaagtgctaggattacaggtgtgagccaccacgcccagcttataaactcctccacttttttgaatagagtcttcctctatcacccaggctggagtgcagtggagcgatcttggctcattgcaacctctgcctcctgggttcaagcaattcttatgcctcagcctcccaagtagctgggattacaggcatgggccaccactcccagctaattttttgtgtttttagtagagatggggttttgctatggtggtcaggctggtcttgaactcctgacctcaggtgatacgcccacctcagcctcccaaagtgctgggattacaggggtgagccgccatgtccagcctgaatagaggattttacagcaagtcctaaatatgtcatttcacccaaaatatttaagcatgcatctcagagatcttaaatataaatactatgtttattatcataccatactattatcacacctaacataataaaatatagttttgtaatatacttggtccatgttcacttattccatattctcaaaacatgcatttctatcatgtttgttggaatcagaatccaaacaaactttatgtagcatttgttctgcctcttaagtctcttttattctattaaagttccctttttcctctgactgctttcttataccattgatttattagagcaatttagtcatttgtcccatggaatgtgccatattttggatttggttaattgcttcctagaggtggtacttgacttgctccaccatttttagggttggataacctgacatttaaaaaatatgggggtaatttatattacatattacttattgtggctttttgtaactgagtaaaataataatgattctaaaccactccgttgaaataagtagtaattgtttagttagttatttagtactcagcctaaaaacctcggtgagcctttgagtcccttagtcgatttacatgctgatctaaaggctgccccattgcttgttaatcacaagttcatttttgtgtttgatacgtttgtgttactgtgaattaaacatcattctgtaatcaaaaagcttaaatgagagaaaaggaagaacttcacatgatttctgatgtttccccactcaatactagttgtttatttatctttttttctttcacaaatagctttgggatttgaatcaaaaagaatgtcgaaataccatgtttggtcatacaaattcagtcaatcactgcagattttcaccagatgataagcttttggctagttgttcagctgatggaaccttaaaggtatgcttttgtacactattaaaataggttgtattttatggaaagtcttatgatttgattatagaaataggtttctgttttttcacatttctacagaaagagcctgcttctttcaatttccaggagcatatttaatgtaactgtaattgcttatcgtaatgattgtttatgaatggtgtacaacctaatgcttaaagttctataatgtaggctgggtgcggtggctcacgcctgtaatcccagcactttgggaggccgaggtgggtggatcacaaggtcaggagttcaagaccagtctggctaagatggtgaaaccccgtctctactaaaaatacaaaaattagctgggtgtggtggtgagtgcctgtaatcccagctacttgggaggctgaggcagagaattgcttgaacccgggaggtggaggttgcagtgagctgagatcacgccactccactccagcctgggcgacagagtgagactccgtctcaaaaaaaaaaaaaaaagttctgtaatgtagaatttttattcttttaatttgaattcttaaattttaagtgtacattttgtttcaagcatatgttcataaaatattttgagatctgttttagtttattttgtgcttctataatttatgttgtgcttctataaattgtgagtaatttataaagaatggagatttatttcttacagttctgggggagagggtaccagcagagaagggagagagtgaggaggcggctgaacttatccatttatcaggaacctaggtaatagcattaatccattcatgagggtagcgccctcatgacctaatcacttttgaaggtcccatctctcaatacttgcatcagggattaagtatttaatacatgaactttgggggacacgtttaaaccacagcaagatctatgggtcaggtttgtaaaggatctggcttttgtttttgtttttgtttttgagacagtctcactctgtcgcccaggctggagtacaatggtgtgatcttggctcactgcagcctctgcctcctgggttcaagcgattctcgtgccccagtctcccaagtagataggagtacaggcgcctgccaccaagcctggctaatttttgtatttttagtagagacggagtttcaccacgttggccagtctggggacctgtttttacttataatttattcattctgccttttatattattgctttcttgtttttgagaagccacaaggtaggaaaaatgcaagagttagggaaaaaagcttattcagccttctgaaatttataggcctaaaaaaatgaaataattcttcctcaaatccccaccttctccaataagattcccaattccactttattattcctgtctctattgtctctcctgtttattgactgtcctttctttctttggtcttaagatcaacccatctttgacattgttgtctcttggtctacatttttccctcttgttctgtagtagttgctctagttcaggctgttgtctgctcatgcctgatagcaaccatctaagatgcattctgcatctcttcttatctaagttcagagatactagaataaccttctaccactgttttctttctttttttttttttttttggagacagagtctcactctttcactcaggctggagtgcagtggtaccatcatggctcactgcagccttcacttctggtctcaagcagtcctcgtacttcagcctctcaagtaactggaatcacaagcatgtgccatcacacctggcgaaattttttttttttttttttttttagagataggatcttactatgttgcccatgcttgtctccagctcctgggctcaagcaatcccagtgctgggattataggcgtgagccaccaagcctagcctaccactcttttcttttttcttttcttttctttttctttactcttctcttttctttctttctttcttttttttgaaacagggtcttattctgttgtctaggctggagtgcagtggcctgatcctggcccaccacagtctatctcctgggcttagatgatcctcccacctcagcctcttgagtagctgggactgcaagtgcctgctaccatgcccagctaattttttgtacttttattagagatggggttttgcctatgtttcccaggctggtctgaaactcctgggctcgagtagtctgcctgccttggcctcctgaagtgctgagattataggagtgagccactgcatccggccctaccactattttcaacataaattatgccatagtataaactgtaggaaacgcagactcattgggatgacttctaaggttcttcaccttccgtcattctgccacatcctttcctgtcaagtttgtttcttctaacccctataccttaattgtctgttctgggcaaggtgttttatttcagctactgtccctgtatgtgtttcttgggatgtttcctatgtgtgcccctgtagcttttcttaggatgttttttgccttcgatttcacttgccatattttttaatgcccgtcaaaactttaggcaaagccttttgtgtgagggtgagagagagagagagagagagagagagagtgtgtgtgtctgtgtgtgtgtgtgtgtgtgtgagagagagacacagggtcttactttgtcacccaggccggagtgcagtggtctgggctaactaaagtgatcctcctgcctcaaccgcctgagtagctgggacttcaggcgtgtgtgacaatgcctagctaattttgtttaatttttgtagagatggggcctccctgtgttacccaggctggtcttgaactaagctcaagcgatcctcccactttggtctcccaaagtactgggatcacagacatgagccaccacacctggactgcaaagcattcttcagaaagtgttctcttacagcatccatctgtttggttctgagtacatatatctatctatatctataggtagaaactgcttggtttgtcttctgatttccacttataaatgtgttgtactgttcagtcattttaatgtgtcttctgtttctttgattaggttgaatataggtttatgatctgcagggaacttgacatctttttgttgtattatacctttctttgtaactcatagtacagaattgtactcaagtattcagtaaattttcttgactacaccttttctaggaaaatacttaaatactcctgggcactattttgtttgttagaatctctagggaaggagattcagcaatgctactaactcctgagaaaggtaaactgttttgattctgatactctggttgaatctttgatcttgctttgctgacggaagataactgtttttgtataaattactccagagtatctagaaactctttctgggtagaattctactttgtagagtttagctagctgttagtgggtgctgggagcattcttaggtagaatattcaggtaagtggattttggcctctatgctatatctatctgcttcttcctttagaatgatccatgtcatgggaggtttttcagaatacccgtggatggatttaggcagccctcctttcattttgtcagcctattatttcctggtttttactcagtgaaagacttcagaagaaggcattttatattttaagttttcctttcatcttatctcctttgctaattccaaattctgggaagactgcattatccttagcatgtttgccattattattaggttgccaaatgttcaagaaagctgtaaaactaggccatttatgtgttgtacaaatataagttgtacagctcagctgggccttatttgccgctgaattatggtctgttcatccctaatttatttgcttttccactagtgcctattctaatccttttctgctgttcttaagcccctaacccttttattttatggcaataatgttacctcatacccattcaaaggattaaaaccatccaccaagagtcccctatcataagccccctcagaaattgctgtaaaaagcctctgctccattttttctcataacagtgtccaaaaagtcctgtacttgggccagacatggtggctcatgcctgtaatcccagcactttgggaggccgaggtgggcggatcatgaggtcaggagttcgagaccagcctggccaacatggtgaaaccccgtctctactaaaaatacaaaaattagctgggcgtggtggcgcatgcctgtaatcccaactactcaggaggctgaggcaggagaattgcttgaacccgggaggcggaagttgcagtaagctgagattgcgccactgcactcaagcctgggggaagagcgagactccgtcttgaaaaaaaaagaaaaaatcctgtacttgtacctactgttcctccctttccttcttttcctggcaccttgtttcattagttgtttcctctctatgttgcttcttcagatttttcttcttttttgaattattttccacagcttacaaatgttcttgggccttcctgagccttataaagccaaaaagtgaaaaacctttgattcttccttgattgtattgttctttaaaattgtcattctgtttttctctttcccttcatgactgggcttcttaagtcatctatacttgcctctgtttcctgactacctactccctgcttaaccattttttagcctggtttcatcttccctgtattcccttgaagaatgtaaaaatccagttttattttcagtttcaattttttttgtagtctaaggccctctggattagtgtgaaatctgatatttttctttatctgattctcattatttttgttgtattactattggtcaaacccccaatgaccacctagtttttttgtttttttgtgttttttttgaaactctcctcattttacatcaatgttttattctttctcctcttagctctctgatcccttcattaactattttccctgaccattaaaatgtagctattcctgcagcatctaaccttggctaccacctctatcaccgctcttccatcccagttcattcagtctcatggcttcaactcatcttttttcaggtatgtcatctgcaaccttcattttatgagctgtgttcttcattcctaacttcctgctagttgttgtcacttaagtaacataccatgcctcaaagttattgcactccaaactgagttaattattctcttctcaaacatgacctactttttatgtttcattattattttttttagacagagtctcgctctgttgctgaggctggagtgcagtggcgcgatctcggctcactgcaagctccgcctcctgggttcatgccattctcctgcctcagcctccctagtagctgggagtacaggcgcccgctgccatgcccggctaattttttgtatttttgagtagagacggggtttcaccacattagccagaatggtcttgatctcctgacctcgtgatccgcctgcctcggcctcccaaagtgctgggattacaggcgtgagccactgcacccagcctatgtttcatgatttaaaaaaaaaaatttcaacttttatttagattcaggggtacatgtgcaggtttgttatgtgagtatattgcatgatgctgatgccgaggtttgggtacaactggtcctgtcatccagatagcatagtacccaataggtgcctcattcccccctccccaactctagtagtccccagcatttattgttcttatctttatgtctttgtgtacccaatgtttagctctggcttataagtgagaacttgtggtatttggttttctgttcctgcattaatttgcttaggataatggcctccagctgcattcatgttgctggaaaggacatgattttattcttttttatggctgtgttgtatcccatggtgtatatgtaccatatttcctttaaccttccgttgatgggcacctaggttggtttgtgtctttgctgttacgaatagtgctgcagtgaatatacaagtgcatgtgtctttttggtagaatgatttgttttcctttgggtgtatacccagtaatgggattgctgggttgaatggtagttctgttttaagttatttgagaaatctccaaactgctttacaaagtcaccgaacaaatttacattcccaccagcagtgtataagcgttcccttttctctgcagcctccctggcatcttttattttttgactaaaaaaaaaaaacaacacatatataaaaattatatagcagtgttttgtagttctccttgtagagatctttgacttctttggttagatgtattcctgggtattttatttttttgtgtgtggctactgtaaatgggattgtgttcttgatttggctctcagctttaatgttattgatgtacagaaatgctgctgatttttttttttcttaaatagaaaaaaggtcttactacgttggccaggctggtctcaaactcctggcctcaagtgatcctttggcctcagcctcccaaagtgctgggcttacaagcatgaaccactgtgcctggctaactgatttttgtacattgattttgattagaacagtgttcagggtttacatcattgtaactaatcacaattgagccgtatcgtgtgaatttttttcctctctcattagctttctgttttccctggggttgataagtttgttttttcatttgtttagtttttatatgtgcttatcttcaaactctctcttgttaatttgctccttaaatgattcaaacttaccaggcattttataagtcttttcttggaaacaacatttttggaaggttctatcttgctccattctggtcggtaatggtaatactattcccagagtccagctgccatcctgaggtcttccttaccatcatcctagggattccttttgcttttcttttaaattggaacacttgtttttcagttttttttttttttttcgtcttctttcttggcttactttttcagcttggtggagaatctcctctagcttcctaagaaagaatctatgggaagtaaatttttaaggtgtctttattataatgtctaaagatgtctctgtttttcacttgctgatttgcttgagttccttatgaattctggatattagacctttgttggatgcatagtttaacaaggccaacaaaagcaatgcgggagaggactctctattcaataaatggtgctgggataactggctagccatatgcagaagaatgaaactagacctttaccttttaccacatgtaaaaattaaagatggattaaaaatttaaatatatgacctcaagctattaaaatcctagaagaaaacctaggaaatacccttcttgacatcagtcttggcaaataatttttggccaagtcctcaaaagcaattgctacaaaaacaaactttgacaagtggaacctaattaaatgaaagcttctgcacagcaaaagaaactatcaacagagtaaactgcctacagaatggtggcttctttcaatctggaaacttatccttcagttctggcatttccttgaattatttgatttcttcctattttctctttctggaatgcttgtgtttctggattaaaattttttttcctctccttccttctttttgtccatttgccctactttttgaaagatttctttagctttacttttctttccttctattgagttttaaatttctgctaccatatttttaagtattcattcttgtgtgattagttccttttaaatattattctgttcttgtttcatggatgcagtatcttttatctttttatgggcattagtaatagggttttttttgaagttttcatattccagtgtaatagatatttttctatttgttggttttggtttctgtttggattttagacatagatatatcttagctatctgatcctttgctatctgctcatatttaagaatacatcaccaacaagttgaatgggaattgtgaacttttaaattgtggttttcctatgggttatctgtttttatcatgaacaattttttttttttttttttagacagtcttggtgtgttgcccaggctggagtgctgtggcaccatctcggctcactgcaagatggtgaacttttgatgtcaaagtctttatatcttttgtcttgaactggttgggtgtccagagtaaaaattttcttttctcttttttctttttcttgcattttttttccctcccgagatggagtcttgctctgttgcccaggctggagtgcagtggcgtgatctcagctcaccacaacctctgccttttgggttcaagcagttctcctgcctcagcctcccaagtagctgggattacaggcacgcaccaccacacctggctcatttttgtgtttttagtagagacgggatttcaccatgttggccaggctggtcttgaacttctgaccttgtgatccacccttcttggcctcccaaagttctgggattacaggtgtgagccactgcgcccaatgccgcccccccccttttttttttttgagacagggtctcactctgtcacacaggctggagtgctggagtgcagtggtgtgattgcagctcactgcagcctcaacctcctaggctcaagtgatcctcccaccttagcctcctgaggagctgggactacaggtgtgcaccaccatgcctggctagaagaaattttaatctcctatttgtaggatatgactctggccagttctgagatgatatctgggcagagatctcaacatttagaaaaaagactttctcttaattttcctgttttcaggtgacccttctctcaactgtgttgggtatagaatagccttgtattctgccagagtagggacacaggccccctgggttgcagagtgaagggaggagatttcaatggacttttaaagattcctcttgacttagcttcacctttatcagaaggtactgggtgccagcacttcctgagtctttttgaaggacttaacttcacctttatcagaaggtactgggtgccagcacttcctgagtctttttggagttctgtggggtgattgggctgcttggatttctccactgcaggctcagaatttaatttctaggagtctgcctattacttgcctttctgctttctagacttgatgattttgttgctgctgtctctttctccattttccttcgccttgtggattatgccgagagaaaaattcctattactattgtttacctgagttttgggagagtttggaaatggtctgtgtctgttctctgttttctgaaacataatacctgagactgggtaatttataaagaaaaggggtttacttggctcatgattctgatggccggaaattccaggattgggaagctacacctgatgagggccttcggctgcttccactcatggtggaaaggggaggggaagtgggcgtgtgcaaagagatcatatgaaaagagaggattgaagatagcgaaacccaggaagccagactgttttcaacaacccgcactcttgagaactaatccattcccagggaactcaccccagtgggaaggcattagaaggcattcatctgtttatgagggatccacccccatgacccagacacctcctatcaagccctacttcccaacactgccacagtggggatccaatttcaacacgagtttgggtcaggataaataaaccatctccaaaccatagcagagctgtatgtgttctctgcatctttaacacctgaaccctatttctttcagcaacactattgtctgtactcgcctgtgcttgaaacttgggagtgatctttttgtttgtttgtttgtttttagagacggggtttcaccatgttgcccaggctggtcttgaactcctgggctcaagtggtccgcttgcctaagcctcccaaggtgctaggattacagacatgagccactgcaccctgccgggagtaatcagtcttttcacttaaaatgtatttattgaatacttagtgtgtgccagatactgtactaggtatttggattttaaaccctgaaaaagaaaaaagtatacttcctggctgttctgaactgttcagaataaagttggagagaacataagtgaacagatgaaccatgaaaatcataaacgtatgaagacagtgctctgagagcagataaggactctgttggggaagggttcacatacctgatactacaaccagattgaacttgttcttctttttcattgtctttgttttctcattttgtactttagcttatgctgatcccttggaataggctctaggccctggagtgttcccctgtctttttgatgttgaaattctctgtcttaagctggtataagataggctaatctcagggagtagagtgaggtgactacctcctgtacaaagtgttccctcaagccctcagcttgaatatagcctccccactgtgctataccttttcctttcaaatgacacctgacatattttgtgtttaagttatttatgtgcttgtcttacttcccttactggcctgtcaactcattgagggtagtatctgtatctgattcatttatatagtctcaaagtgactagcatagtgtttaataaatgtgttaaagatgataaacccttgctgtgtcacttcaagtcaaactaagacttcttcaaactcggacactttttaaaaagtcatcatttgacagggacaggattttgatttccgtattcatgtatgagtatcaaaatgtgattgtggctcacagagcactcgcagcaggggacagacactactgcactcttggtgagaactgcccatgtttgtggtggctttcccaccgtgctgttaagtcagtatcattggttggttcacactgatataatgacaggtagtaagcagaggtcctgcaaaatgatgttagataacagcatttcaaggtcaaattctcctgtaagtttttaccttttgagaggatgaaaactgtaaaattatgtcctgccccaaatggctctataactttttaagcattttgtagggtatcatgttgataagcatgtgcttttcaggctctgagatgaactgttttaaaatgtgagttctatttaaaaatttgccatttaaagcacgcagaggcctggggtgcacagggaccctggatacagtgtagcgacttgctcagaatgaaatgctggtattagtttatgtggtccctcaatatgtgggatttcaccactgcttggacagaagctgaagtcaggtccagaaacagatgcaatttagacatgtataatcaagttggattgtgctacttttatttttctttgtaaaattcaggcaatagttgctttttctttttgttttttaaaatttttttaaattgaaaacaaaacaaaacaaaacagatgaggtctcactgtgttgcccaggctggtcttgaactcctgggctcaagtgatcctcccaccttggcttcccaaagtgctgggattacaggtgtgaaccactgtacccagcctgattttcatattaatagggaaactgatttctcatatattctggataatgtaactgaaggttcaggcttttatgtttatttatttatttttctctttagtatcagggaaggctgttttagcacctgctgtctcttttgcattacccagattacctgcagttgttgcaagtagaaaagttttggttttggccatgtttcttagtatatataatacttctttttactcgagagatttgaaaatgtacctggccagaaaaattaggttttacctgggagttgtgctttggaagctgacttaaagcctgagcagcagctttctcccccaacccccatccttctccgtggccaacctttggtttgggcatgggcagtcattatcactctgtgaggctgagacactgctcatggcccagaggagtgaaggtggatcttcttgaaggcctttgtcttttgtgctattcaagtggtcctactagtgagcaaagtttacagtattttgtatctcattcctcaggatccagttagttttgtagccctatctggccctgccaagcacacaaagagtcttgcttgtccctgttttcagagacttccttatgtctctggatgctctgctaggtcacgacctaacttggactgggtcctgtgtagtcttcctgctgtgcatgtggtaggttcgtgaaacacacttcattcctggcacagcagagggcagcagtggcaagtcgtgagtctcttcatcttaccacctttcttccacttgtgtccttactgtcaacatgtaatttttagcttccacaccatgcaagactcttaactttttatttaattttatgttctgcattttgggcagtgcttctaattttttctttttaagaacgtaataatgaaactggagatcttaatttaaaagccttacaaaaagtcatgcataggtaaaaataattcatcaagtgaagtgaataagtttatgtggcatttaatttaggaaaaattctagaagtgtgattatagagtaaaacaaactttttcttttttattactttaattcaaagctttgggatgcgacatcagcaaatgagaggaaaagcattaatgtgaaacagttcttcctaaatttggaggaccctcaagaggatatggaagtgatagtgaagtgttgttcgtggtctgctgatggtgcaaggataatggtggcagcaaaaaataaaatctttgtaagtactttaaaaagccaacttcagtctgatttaaagaaagttaaaacttctgttcatttttgcattttacaatgtttattcataaaaataaagtctagctgtgtgattttgggcagtcttcctaacctgtcatggttctttggaactgtgctccgtgagataaggatggccttgtaaggaaaggtctccatggttacaccgtttgggaaatatgttttgtattgctttcccctattaggcacactgtatgaactaacatattcagggccccaggaagtcctcttacacaatttatgccatcgaatccagtgttcctcaaatgtatttaaaacatagaatgctttcttcatcactccttttttttcttcaattttgattacattggtttaggtgatttttcaaagtgttttcttacacctacaattttatgatttgatgactctgacagaaatgctcatcaatgactgaacaagatagtgaaatttttataaagtaaatgaggaaaatatgaaaaaagtaaataagaaaattctttgcttttcttccccacatctaatagtagctggtatttgtggtattcagagtgccctcacatataatttcttttgatataagtattcaagaagcagcgggttacagtagccctatgataataatgaggcaactgaggttcagagcagccaaatgatttgtctaaagttacattgtgattaggagaaccagatcttctgatttatggctcacttacattctcatctaatagtgatttcaaaagacttgaatgagggatattactgttttaaagagcataattgaaatataaaatatggttatataagaactcactgagggatcatgtatatgattgttattgatttagtgctacaatccttggatgttggttgcttatgagtttgtacccctttagcaggaaactaagaggaaaaatacctccctttaagtttgttaaaatctataagaacagaaaagaaaccactgcataagcaagacttgaagattaaaacttttttattgtgataaaatgcatataatgtaaaagttgccattttaaccatctaaaaatgtgcatttcaatggcattacattcacaatgctgtgtagccattactactatatatttccaaaactttttcatcaccctaaacagaaactttgtaaccatgaagtaataactcctctttcccctctcttgctagacctttgtaatctctaatgtaatctgcgaatttgcctaggtatttcatataaatggaatcatataatatcggtccttttgtgtctgactcatttcattgagcatgttttcaaggttcattcatgttgtagcatgtatcagaactgtatttcttcttatggctgaataatattccattgtatgtatatatcacattttttctttgtttttttttttcttacaaaccagtgtttattttcacatacagccttgttgtaaccaatgtacagatcaaaactcaaaatattcctcttcagaaaactttgaaccttatcccctagccgacctataatggttgaatttctgtcaagtatatatttatgtatataatgggcttaattatttaagagaataactgagtgatttgtgtgatctgtgaaaaggaattggactatcatacttgggttgtatatcacatttttttcatccattcatctgttgatggacacttggtttgtttccaccttttggctactgtgaataatgctgcagcattggtgtacaagtatctatttgagccttgtgtgtttacctaggagtggaattactgggtcatatggtaattctttatttatttagttttctgaggaaccactagatttttccacagcagctgcaccgttttacattccactagcaatgtacaagggttccaatttctccacatccttgataaaacttgttattgttcatttttaaaattatagccatcctagtaggtgtgaagtggtttctccttgtggtttgatttgtgttttcccaattaccaatgatgttgaacaaaagataatttttgaaaagattttaagagacctgttctagtgagaggaagataattttatattgcatgaaatgccttgttttaaaaatctgtacagcagttccctgttttaccatgctaaaagaaagctacccaaaggtgttccttaactgcatgtagatcccgatttcttaccctttggtctctccttcctcctcctgttctttctttccaattcctatgtgagtctactcctattgttaggtcttttttcttttactattccataattgggacaactgcctattgtggaataggcaagtttgccaagtttcctcgatcactgtcagccactaattttttaaaaaatgacctatcttgggaagcattttaaatctgatttcctgccctgtgtttttggcctccggcgctacgctgcctaccatatgtgcatgcttgcagggactatgcattcactaaacatttttttttttttgagatggagtctcgctctttcgcccaggccggagtgcagtggcgctatctcggttcactgcaagctccgcctcctgggttcacgccattctcctgcctcagcctcccgagtagctgggactacaggcacctgccaccgcgcccggctaattttttgtatttttagtggagacggggtttcaccatgttagccaggatggtctcgatctcctgacctcgtgatccacctgccttggcctcgcaaagtgctgggattacaggcgtgagccaccgtgcctgggctactaaacattttaatagctcccactggaagcttttttgtttctttctaaggtctatgtcttgatcttaaatcagtatattgtatcaatacatgtagtaaataaaaatcatcttatttggcaaaaactttggaagagtatattcagcatttataaatcttaaaaattgaagaaactgcggctgggcgtggtggctcacaccggtaatcccagcactttgggaggccaaggtgggcggatcacctgaggtcaggagttcgagaccagcctgaccaacatggagaaaccccgtctctactaaaaataaaaaaattagctgggcgtggtggtgcatgcctataatcccagctacttgggaggctgaggcaggagaattgcttgaacccaggaggtggaggttgcagtgagctgagatcgccccaagctgagattacgctattgcactccagcctgggcaacaagagcagaagtctgtctcaaaaaaaaaaaaaaaaaattgaagaaacttggattacccaaagtagttttttggggttcaaaaacaggaaaatgattgactataatggagcaatttggtagttctagagagaaataaaaatgactgagctaattttattttagcaaacctctgctctatattattttgatcatcttcatttatgagtattcattttctcttttgaataaacaagcattagggagaactactctgtatgttaattgggccagtctattcatttattcacaaagcttttatttctctttaggctagcttgagagctcatctgtgatgaattttcctttatagaaaatatgttttaagatgagcagtatttttaaagtatatgtatattgatccatattttgtttatgactgtcaataattatgccagttatcagtaattgtcatatttttttcaggacttatatttgaaatgggaggatattagaatagcttatctcttaaagtattttaccttcataggtatctctatttatgttgacagctttttgacattcatactagtggcctattgggagaaatccacacgggccatcacagcaccatccagtactgtgacttctccccacaaaaccatttggcagtggttgctttgtcccagtactgtgtagaggtgagtagttgaatttattctgtgaagcctgggtttccagagatcaaaggatgacagagaatgggcagcttaaaccattaactgctgaggagccttgcttgagaaattatagagtattttctttatagcctaatgacctctaactttgggatattaaaccacatagccagctttattattttaacagtgattacagacttgatttgacagtatgacagggaattcagcaagcatttgctgaatgcctaacatgtgccaggaactgggaaaacaatggaatgactgctggtcatgaaacatgacatctcttatccagtatagatatgtggcatttcttaaacagtgtaggcacagactcttttcttcttaaaaaaggtggtgagaaatgagtccagttcagatttcttagatcattgagtaggataagataggatgttcattgccaggcactaatgaataaaataactcatataaattacttttttatgattttgtacttacctgttaaattttatgttcagaatgtatacctagctggccctggaagaattccacccagtgaagtgctatattagttttttcataaagtagtgaattatttttttccttcaaagatggattagtgctttttttttttgttttttaatagaaatgggggtctcactgtgttgcccaggctggtcttgaactcttggcctcaagcaatactcccccagccttggcctcccaaaatgctgggattacaggtgtatcaccttgcctggccaaagatagattagtttttccaggctttcttagtcttcattccttaggttggttttaccaccaggtagtttgaaaccccttcagatcacagttccaagaagatgggtatgggccttttggaaaatagagaaattcactgggttcacaggctcctcatcaagggagccatgactactgcaagcacttcttcagtgttctctgcttatttagcaaattttagtgagtttgccagccttgcccattactgtgaaggtgttgggggagagttgctaagctatagcccttcaacatagaggcacaggtgagagtgagggcatgagatccataggcttctcctaattctaggtgcagcagtgcatgtgacactgaagaacttccctactgagactcttcccattgcacacagaggcagggagtgtgaaaaagctctagtcctgtatgaaacagcgggaagaagtagggtgctgtgggcagtgttttgttgggcagagactttgaattggaagtgttttgttttgtgttactttgtttttgagacagagtctctctctgtcacccaggctgcagtgtagtgttgtaatctcagctcactgcaacctccacctcccgggttcaagctattctcttgccttagctttctgagtagctgggattacaggtgcccaccagcatgcccggctaatttttttttgtatttttcatggagatagggtttcaccatgttggccagggtggtctcgaattcctgacctcaagtgatccacctgcctcagcctcccaaagtgctggggtttattgggttttagatctcctaggagatcttgaaccttatgtgtagatcctcaaagtaaatgtggagcgtttgttaggatttttagaaacagtactaagtagcaacccctctttcagcctttcttgtcacttctaaagtccttaccctctgccatccttagcaatctccaggaaacaatgaaagagtatcttccttcttgaaatgtagggactcagctctggaggctctgagtgacaaagaaatgatgggagagagatggggagaagaaagtgggaagagaggggaggattctcaagggagattttcagtttcttaggagagattttcagttgtggaaccactttcatttttggcccttagctctgtatgtcccagcttggactcttagagataaggcggagaaaatttcatataattagttcataaccacagaactcactgaatgaaaaccagtcactgggcctatgatgaggtacttgttttgtccatgctagttctgaaatgataaagtagttctgtaatttaaagtgtaatgagaggaactcagtcacatatggtacttcattagacttgaatatattagagtaatttacagcagaacccaggataaaataccaggctgctggtagacatggtaataagcatgaataacaagagaaatgtgtacatgttacaattattgtgttaatttattgtaggttttacagtcagttgaaatgaaggttagatgacagtattagtggaaaataatctgaatatggaagctgcttttgttcatcctattattttttggattgacttttttaaagtgataaaatatttgcatgattccaaagtcaaagttttataatgcgttatattcagagaagtcttgctttcatccctatcccttcgcctcgctctccctccttccctgcatatgtaaactattttctgtttttggcttaactgtccaatatttcttgcatatataagcagatatctatatgcatatatatccatacctgtatccttctatatgttcttgtacatatttttccatctcatataaaagatagtagtgtatagtatatagactcttctacactttgctttttttctgttaacaatatatcctagagatttgtcgtcatcaaggtgtttttctcattgtttttaatggctgcatgatattccattatgtgattaatgtagtttattcagttggttccctattgatgagtatttagtttcctagtattttgctataaaaaataatgatgcactaaataatcttctgcataagacattttgtagttttgatagtgtgtttctgagcaatattcattgaagtggtattgctggctcattcttgctattttcaatatttttgctctcttcaaaatgcttatgtatgtgatttcctatatgctgtgtttattctgtagttgtggaatacagactcacgttcaaaggtggctgattgcagaggacatttaagttgggttcatggtgtgatgttttctcctgatggatcatcatttttgacatcttctgatgaccagacaatcagggtgagaaatattgagattttcattttgaacatttcctgatggtgagctaaacctcctacaaactaagaaattgatgggtagcactgaggtaagcagaataggaaactagtactatattcctattcaccctggaaaagtgctgttatatggactgtaacagtctcattcattcgttacatgttcattgaggattaccatgggccaagtgctgtgggaacttcagtgattaaactgtattttggttaatttaaaatactgcatttgattcctcagaaaaatttttgacccttttctttaccttgaattcctacatccaattacttgccaattctgagagagtctaccttttcattttctattattatctctacctttccatttctgctgcccaagttcaggactttgttaactgttacttctcttgttgtattagtctctgccacaagtcttctttcttgcttttctgcatgcagcttctaagatatttttttttcatgtacaatgcagtcatgtcatttttgctcaaaaataagatagtggctcccttgtctaccaaagtaaatatatacttctgtttctgccattaagcttctccacagcatggccttattctgctccactctgtctcccagtttattcctacagggaaccaacactggactgctcacattttcccaaacactccgtagttccctgcttctgtgcttttccttaagtggtttcttatatttggaatgctctacttacctgtatctctgtttgttgaaatcctaaccattctataagtcccctcaagtcttctctatttggggagaatgcctgtctctcttaatgccatctaattctatgtcattttctagtggtgcttatcaaattttgacttgaatttaaatacagatatgatttactccttatttccaacactccactgcttctctggctcattgacgtatcttacattataagctctttgaggccaggaaccctggctggtccccacagcatcctaatacagcattatgtatgaattatagctaaaattcattcagtgcttactatattcaagacattatgcaaagtactatatatatatatatatatacatataaatttactaattctcacaatagtcccttttgcagatgaggaaacaggcagagaaagactgagaaaggtcattggttcttaacatgccagtctcaatgagcttgagccagaatataaatcaacacattgctttcttcatcaagaaagtcttcttgaaatgaaataagctgcatcactagacacagttacagtgtgtttagtgatgtagttgatttacgttctggtacaaacttctttttgtttttttgagacggagtctcgctctgtcgcccaggctggagtgcaatggcactatcttggctcactgcaacctccacctcccaggttcaagcaattctcctgtctcagcctcctgagtagctgggaccacaggtgcacaccaccatgcccagccaagttttgtatttttagtagaaatagggtttcaccatgttggtcagacgtcttgaactcctgacctcaggtgatctacccgccttggcctcccaaagtgctgggattacaggtgtgagcccctgcgcctggcccaaacttcttaccttgtggattggtatcaaacagtttgataaccagcaggaggtctttatctttgagtaacactgggttaagcaacctgcctgaagttacaactttaggtagaactagaattcatactgaggaattttggctctggagcccataactcttaatactaactgcatcttactatagattgtgttagtaaatatttatttttggattataatctaatattgaaacctttctagcatcataggtattttatgtgaaacatagtttgtctctcgctttaagatgaagacatgttattttagagatggaatgataatttctttatctcttaatcagctctgggagacaaagaaagtatgtaagaactctgctgtaatgttaaagcaagaagtagatgttgtgtttcaagaaaatgaagtgatggtccttgcagttgaccatataagacgtctgcaagtgagtattttttagaaaacaattggaaaattgttttggttgaattttctattcacggtttttcttgtttttggacttgagattaagcataattattttgtatctaacaggtgtccagcagacattagttaaataaatatatataagtcttgagctgaggctcagatatgcttatatttagaattaaattagataattcctcatctcactgctcttctgttgctatctatgatcacattctttgatttgcatggagtctaagaataccatgaggacaaactcatgttgtctacaagagtgattcagacatgtctgatggagtgtgcaagggggatgagcatatggaagcatttttaaaagggaaggattccagggtctttgaaagaacagaagtcactttaggtgaggaaggagtctgattgattggaactgaggtgaaaggagctgggctttacatactgaagtacacctgttcatttacacacacctttgttcagtaaatatttattgaatgcttattttggtccttgaggaggaaagggttgtatagtacaattgaaagaactgtattgcttagggatccaaacagcactactctagtctgttctccttctgccacccaacaaagagtgggacacgtgagaggaaggcatttctcaactagctgaagagagaaggagtcccaaagatccattggcagaggaatggtattcaggagctcggagtggtggtaacagatgccctaagagcagatgccctaaggagcactggaattcaagagcaggttggcatcactgtgctggtggctaaataaggtgtcgttgcattgacagagatgtcctggaagtggtgatagcgttgtagatagtggcagcaagagaaagcagatgcctcatggaagattaaaacacaagaggctatctatatgttggtcagcccaagcagaacagcagagtatggaccattgaaggaagtgtcagcatgtggagctgacagcatgtcactgtgacttgtggctgagagaggtggtaagagcaagcagccagataagaagggcaggaggtggcatggcttttatgtgaactggtgggacattctcccttgccctgaggattccctgagacataggattgagaaggacagaaaccctttcatagtgagggctaattttctttcttttgtttttcttttgagacagtttctctctgttgcctaggctggagtgcagtggcacgatcttggctcgctgcaacctccacctcctgggttcaagagattctcatgcctgagcctcctgagtagctgggactacatgtgtgctaccacgcatggctaatttttgtaattttagtagagacaggcttgtgccatgttggcctggctggtcttgaacacctgacctcaagtgatccacccacctcggcctcccaaagagctgggattataggtgtgagccaccgtgcccggcctaagggtttttttttttttttttttgtatttttagtagagatgaaactattttctcatagtatatttagggcctttcattagctcttgaagagcacgaatacagcttgagttaactttttccatatgggttttagaagtgctttattaacttctagggaaaggttttggcagtgataacatagtcttatgccatcttttcgtttgatttttcttgatttgcttattgaaagatagggagcatgaatgtgtgtgagagagtgaaatgagatagtgatgtcaagctagagaggagagagaggagcagaatagagaagacgagagtaatagagcacatgtgtggaaggtctgagaggaagcagacaattgagacagatggacagagggtaggacagagtttaatgagttgtcattcaaaaaatttttttttgtagagatgggggcatctcactatgttgaccacgctggtcttgaactcctggcctcaagtgctcctcctgcctcagcctcccagaatgctgggattacaggcaagagctgccatgccccactcaaaccttaacaagttgtaaagctgtagagctcagcttggtgtagtggagagaatagtgacttttcactaaggagacctaggtgtaagttcagacttctttatcaactagttctatgatgttgaataaattgtatcacgtctttgagcctcagtttgtaaaggtccttttcatctttacagtctctgagctagttacagggtcaaagtagaatccaaattcaggagtagatactgggagtaaatcgcctggtatgtggtaacttcttgtttactgtgggtgtcaaaatcaagctgtaagtcacctctgaatatggcttgctttgattttacaagttttactattgtcctcaatatgctgattaggagctcctaatgcacagtacttctggggtgaattgggatatggaattcaatgtgaatttctcattaactgttttttagaaagctgattcttccacttgggatatttctacttcagttttcttgacaaatttagtgtcctcatgcttgtatttcctttattaaatttgtgcaacctttctttaatgactgttgtaactgtgagacttaaaaagtcatctgtctataaaggtatcattctatgtcagtggttgtgggagagtttagaggataaacttaatagtttcatttaagtgaataaaacattttttagttactacttaaagaattcttgaaattgatttttgagagaagatgttcagctcttcgtagttcaattttcattttgaatatctaatagatcaaaatgtgctatgtaaaataatgttaaggaaaaactacctgtgattggttgactctgtaatctttgtactagaaacaaagatgcctgcctatttcatgttgaaaaataattcaagaattttagtttatgacactaagagagaggtatctgacaactgatttaagcttgagaaatattttcccaggtcacatgttttagatgagtgataaggcatcataattcatgggatttaagcattggtacagattatgaaattaggtaatctttgttcaagcattgtaaatccagctacacaaattatgcttatgagttcttctccattgtcctcactgccccagctccaagaaaaagaatcttaatttacactgttttgtgagtgatttggaggatataagccccattttaatttgtctttttatgtctgtctcagtcttgtttgaccaacagctttgaaatgtagcagaaaagtatattttaacaaatgatagccctattaaaagtgggctttgtgaagaaatggtgtggagctagctgtgggattacaaatcagatagatgtgtctcaggtggcgggcgcagcagctgctttttaaaccttgtaatgcttgttttattttatgaaaatgtatttgaaccaccaaagtggattgaaatgaaagtgtgaagtgctaaatgcagctgctaagactaggatatggcttgttgttcccctgagagctcttgttggttattttctgtgttttattttatttttttcaattgaagcctctgttctgacgaacaaaaactgctcttacagcctaataactgattttgcctcatttttcattagctcattaatggaagaacaggtcagattgattatctgactgaagctcaagttagctgctgttgcttaagtccacatcttcagtacattgcatttggagatgaaaatggagccattgaggtattcagtgctagtcttcagaatctttctgtacagaattaaataaaactaattatatgtctggcattgtgcacttctatttttatttatttttatttttgaaatggggtcttgctgtgtcacccacgctgagtacagtgacacgatcacagccgactgcagccttgaccttctgagctcaagtgattttcccacttaagcctcctgagtagctgggactaaaggtgtacgtcaccatgcccgactaattttttttttttgtagagatggggtcccctgtgttgcccaggctggtctcaaactcctgggtttaagcgattgtccggcctcagcctcccaaagtgtggggattataggcatgggagcttttgtgcctggctattgtataccttttttttttgaatcaggatctcaccttgttgcacaggctggagtgcagtggtacaatcttggctcactgcagcctttgcctcccaggctcaagcaatcctcccaccacagcctgctgagtaactgggacttcaggtatgcaccaccacacctagctaatttttctgtttttgtagagatggaggtttcaccagtgttgcccaggctggccttaaactcttgggctcaagtgatctacccatcttggcctcccagagtgttgggattacaggcatgagccaccacatccagcctattgtacacttttatactaaataaatctttctgtgatctattagtcattgttcgttaaactaacaatcatcttatccagttggctgtatatttttcagatttcctttattactgtttctcatgctttttgtctttttatgtcccttattctctacttagttgtttggctgttctccacatatatcaaatactatctatcaagatttcgctaactatgcaaagagcatttttttctcctcttcttagaagcccagccatgtggggtataagttgtttccatttcggtactgataaggctcatggggaatatgggtgcagggctgcctgtgcttgcctgttccaccaatccttgctgttctacttttggtggcagaagaacctcagttcaccacctgaaatccttaatttatctaacaagaccaaataggtaaaaatagaaacactttgcaaggcaaaaatgtagtataataaaaggcattttgggtaaaaatattgttgtctttatcacaagtgaaattcatcccaaaagcacattttctctagctttatagtggtttttcaaaaaccttggttccttctctcactttttctcaccaggtgtctgggaattattttttaaccaattacttatggcactggccacagttattttactttggattcattttcataaggaattacacaaatattctctagtccatatggccccacagagaagagactatatgcttagacacaaagtgaagaaggaagcatttacacagtgatctcaatactcttatatatttgtcatggcccttatgtcatggattgagagttcaggctttgttttctctttattattgtgaaaaatttatttatcatttgttaagatgtgtactattctgggataaagtacatcatggatatgtatttcttaagcaagggataattgtatgtttacaggtgaaccttaggcttccatctcaggctcatctctcaaactgttgtgtattattatttattcttaaagagtccttggtttcccttttctctttaccttgatgccaagtcagtaccacattcttttcatttttaccatctatcttaaaataagtcttttagatagtttaaaaataaactcacaacacacatatgtgcttcatccacatcgttagttccctcaaagtcatcaaataatataaataatacataatgaaccatgtgaaattaccagcatttacctataaagtggcagtttcatatggtgtagcctcatatcatcaaataatagcaactaccatttattaactgtttactgtgccagatgctctcattgaattcttataacatcctggatgttcgatgttgttattcttgttttaaagatgtctaaactcttatttccacaattttcataaaatcagtaagtggcagagctaggattcaaacccagatctctgaggctgtgtgctcaactgttatgctatcctgcccttgcctcagggtttgtgagatcgttcatcccgctcatttaggaaggtttccattcacacaattcccctttgttttcaaggggcttttcttccagacgtgggttaggtttgagtttctggtgtctcctgctttagcatcatctgtattttccttaggctttcttgagtacattttaatttggtcaatgaaacatatttcctctctttttgtttttttggtatgagttcatttgaaagcctttttttttctttttttttttttgacatagtcattatcttttgaatttgttactacttttatttagagtattattagtctttggccctcttaagtattctcattgcactgcccaccagccttctgatatcctgtctccctcatcatcttttatctttccttgtttgtgttgttttatgaataatttgccttctcatccaggacttacttactttcttctctcttatccatcttaaatgtctttttttttttttttggagggcaagcccagacagccacttgtttgatgaagtgggtagttgagtactcagaaggaccactggttcctactgctgtctgatgattgcagtgagtgttttattttagggtccaatatgtttgcatgtaggcatacatggtgtgcatatatatatatatatatatatatatatatatatatatatatatatgacattcatttgtttttaattaggctggaagcaccagatggaaattctgtaccctccagtctaattttagtttaatatctttggggtgtaatgcctatgtattgcttagtttcttcttaattttctgtgtttttctgctttgaagattttagaacttgtaaacaatagaatcttccagtccaggtttcagcacaagaaaactgtatggcacatccagttcacagccgatgagaagactcttatttcaagttctgatgatgctgaaattcaggtgagagggaggatgaactcttaacatatttaatgctgattctagcaaaggaacactatgattatgcctaaaatctggtgtatattttaaacacattacgttgggcatacattcagattatgtacatgggcttagatgaaacctatgggtgtttcatatttttctgtgggtgaggcagacagtttatcttagaatcctctgttggaaggttgtttattttgaaaatgaagggtttgtttgcattttcttgcctgtcttggtatttggatttgtatcagtaagtatactttttgccacatttatgtaatttctctttatttttctttacagtagtaaaatccaatggaaatcatttcattctttccttttaagaacaaaatgtttattacaggaatgaaattctgtgaaaagagaatggtttgacataataaagaattgtggatatggaggcctaaacttactatatattcttttaaaatttacttgattattaaagtcccaatgcacattcttttaaaattcaaatagtattacaagacttattatgaaaaacagaccctttcccccatttctcgttctccagaggcaccacttttagcttttagatgattcttttgatattaccttcatgcctctatatggcatgcttatagtgctcttcttgattttcccatttgagaagttatctaccgaattccctacaggaagatgttgcttttttccgccttccacctgtcctgccttcagcttatgtgcatgcacacgttcacagacactcatttatcaatccatttatcccaattataacgaaattttgtttagatccttcctgttactatgatcactgtgtactaagggtactgtgaatgcattttttgccttaacgcaatttaggaaaatttgacctttgggtgtagttggaaattattttacactaaaactttgaagacattgctccattttcttccaagttccaaagttcacgttgaaaagtctgaagccattttgctgcctaatctttctctctggaagattttaggatcttcattttatccccagaatcttgaaatttcctgatgatacactgtgttgttagtttttattcattgttttggatattcagtcttccttttcaatttggaaacctatgatttttaattcatggaagttgaattatttctttgattctttcctttttgttccagtttgctttctctttttgtaacacccattattcagatgttagatctcccggactgataatctagttttctttttccacatttcatctttctatagtgtgctttatgtttttttctttatttttttttgagatggagtctcactctgtcacccaggctggagtgcagtggcgcgatcttggctcactgtaacctctgcctcctgggttcaggcaattctcctggctcagcctcctgagtagctgggattacagccgtatgccaccatgccaagctaattttttgtattttttttagtagagatgagattccaccatgctggccaggctggtcttgaactcctgaccttgtgatccgcccgcctcggcctcccaaagtgctgggattacaggcatgagcccccgcacctggcctactgtgctctatttttggggagttttcctcagttttgccttccagccattttattgagtttttcatttctactagtatatttctaatgtgttaaattcttattttgtagatagaatattttatctctctgaggagatatacacacagacaggtaaatatatataatatatatatagaaattatatacacacacacacacatataatttttttttgtttttttttgagacggagtttcactcttgttgcctaggctggagtgcaatggtgcgaccttggcttgctgcaacctccgcctcctgggttcaagcgattctcctgcctcagcctcctgagtatctgggattgcaggcatgcacaaccacaccctgctaatttttgtatatttagtagagatggggtttcttcatgttggtcaggctggtcttgaactctggacctcaggtgatccacccaccttggcctcccaatgtgctgggattacaggcatgagccactgtgcctggcttatatatataattttttccccataaatttttgttttgctgcatagttgctgttccctccaagttgcttttttctgtttggttgttttgacctcctattttgaaggcctccttagctctcagtggtcattggctatcagagatctgtactgaacaactggctgaaagctctgtgtgttgactgagatcttctctaaaaggtgaatctgaaaggggaaactttgttgtgagtatcttcaggtcttttgtcttggtctcctcagattcctagagaggaattttctggtcttttgcctggaggataaacctggctggcaggttctcagagctaagttggggaagataacaggaagtattaatagatgttggatctcaacatttagtatgtacaccttcccttgatccctcattctcagaattgtaattctaccctcagttgtgctggtgcccttaaattcagagattcttctttctagtttgctgtcactgtctgtctactttcttcctttttttcccatagtaactttgggattcaacagcaattcttttcttttctttttctttcttttttttctttttgagacagtcttgctctattgcctaggccggagtgcagtggtgcaatctcggctcactgaaacctccacctccgaggttcaagtgattcttctgcttcagcctcctgagtagctgggattacaggcacctgccatcacatgcagctaatttttttgtatttttagtagagacaaggtttcacgatgttggccaggctggtcttgaactcctgatctcaagtgatctcaccttggcctcccaaagtgctgggattacaggtgtgagccaccgtgcccggccttcttttttatgtaaaatcaagtttcctaaactccttggaggagtggggaagtccagcatttctagcttcacagctctgcagctcgttctcttattttcacgaggcattaaaaatatggccttactgggcgcagcggctcacacctttaatcccagcactttgggagtctgaggtgggaggattgcttgaggcaggagttagagaccagcctgggcaacatagcgagaccccatctctgcaaaacaaaataatttagccaggtgtggtagtgcatgcctataatcccagctactcaggaggctgaggttggaggatcgcttgagcctaggaggtccaggctggagtgagctatgatcatgctaccgcactccagcctgggcaacagagcaagtccccatctcaaatatataatggccttgttcttaggagatctctttgccccatctccttccctctcagttatttcgaccttctctttcctttgatgcccttatcctcgttctactccattggattctattccctgtggtttctcctcactgtagggttgttctggttaattttgagagctcacaaggctcacactgctccagtccttccagactgtacctcacactcagtgtctcctgctcttctctagttgttccattgcacttttcggtgaacactgtgtggctatcttaggattctctgcctcctaattcttaatacttatattcttagccccaccctcatttcctcctttgggtatacttagtgccttccatttttgagcattttgggagttcataatgccgattttgttgctttagactttttcttttcttttcttttttttgagacagtcttgctctgttgccaggctggagtgcagtggcatgatcttggctcactgcagcctccgcctcctgggttcaagcaattcccctgcctcagcctcctgagtagctgggactacaggcccgtgccaccatttccggctaatttttttttttttttttagtagagttggggtttcaccatgttggccaggatggtctcgatctcttgaccttgtgatcctcccgcctcagcctcccaaagtgctgggattacaagcgtaagccaccacgcctggccacttttgactttttataatgcctttaggattctgttttcttgactttgctgagtcagttaccattctcttgctttccagcctcccacattttgttgctgttatctcctttctcattcttttgatcttgccattttagtagggctttagaagtgaaggatagaatgcatatgttcagtggaaattattatattcttttatttagtatatatattaattgtggtggcaatatttaattgtattgttaaaaacccttttgggaaaaagatcttttaatgttatgtctgtgtgagtcctaggaagcagtatgattgcaatgaaatttggctttagtacagaaacttacttgttataggctcccatgacactggtgttctagctgtaaaactcagtgtaatagtcacctttcttcctctccagatgtctttggaatgggtaaaactaaaaactacatctgatgaagttcttttgagacattgtatactatgtattctatcaaaagttaaattcataaggtttttatgaccagcttgacgatttcaggtattctcagctagggggaagaataatttctagagatatttttagaaaaggagttagattatatttagaaatatgagttaagtagttgtgtttcttcctctttttctgttctactcagaatactttttacatttacagtgttttaaatgtaacaaaactctatagatattttcgagaaatgactggttgggttttgttttcattttttaaggtttttgtaaatgattaagtggaggtttgttttaattatctttgtatccccaaagcctggaatccagtaagggttctgtaaatctttgctgagctgaagttattgccaaaatttgaagaatcagctcacctgattatagcccttaggattgtgaacattgaggtctactttggtagtttttgatcctttaccttgaagtaaataaaggccaagtattacccatgcttacatgagccagtatataggactatgttagttcttgctggtatgaaaagtttccagccgggtgcggtggctcacgcctgtaatcccggcactttgggaggccgaggcgggcggatcacgaggtcaggagatcgagaccatcctggctaacacggtgaaaccccatctctactaaaaaatacaaaaaaattagccaggcgtggtgacaggcacctgtagtcccagctactcaggaggctgaggcaggagaatggcatgaatctgggaggcgaagcttgcagtgagctgagatcccgccactacactccagcctgggcgacagagcaagactctgtctcaaaaaaaaagaaaaaaaaaatttccttaacatttctacaatttaaattttattcatatagctgaaaaaaattctacaagtatatatacattgcaaaaatagtcaatgatagagacatccccaaactcaacttttgcatttgactaatggtggtggaagtttagtgatattaaggttattcaattagcacagtgtgtttccgtgcaacaacaacaacaacaacaaatcactcatcatcattgcctagtcagaaaccttctgtaacaaaagctgcaaaggctattcttaatctgccctcagtggttgtcaaattctttgttatatctgctccagaaggctgtctgagttcttgatgcagagggcagaagtaagatactaagttagaaatgaacattgaatcaggcaaagctagaataggcagtgtctgtaaactaggaggagctgttcagcatagccattgatcctccagtccagtgaagcccagaaagcgggaggagagagccaggagtttcctagtagaaatggaataaggtcttttatgcttagtcatatggggtgcccttcctctctggtatgatttgggaagccagaaatgcctccatttcttccccttcccccagcatatctcattgggttcttaaaatatgaaaattactaattcattctctttagaattactctcacttccagttcgtcttctaaagttctcttgcttgcatacaagaccccatgctcctgatatcctgcttctgtgaatgagcattctgaggcagaagatgagagatctgaaagccagggcttgttggggaggacgactgctaaatgtggtggaaaaagaagtaaaaaaaaggggaataagagatgtcatttattttaagattttgcctaggtctgattaaagatatttctgctgtttaacattggccaataaaaagctagactcagaatgttactcatgtgcatacctgtagttgtggctgctttttctttatctttttattcttttggagctggcctgttttcccatacctcagaattttagcttcatcaggcccacggggctgtttctttggataccttcccaaccttttttctcttctgtttcttctgcgtctcctatgctctagtcagatggactcatgagcaggtcccttttcacgtttccctgctcctatactttaactccaacatttattccctttgaagaacccttctcagtttgtgaatcacactttaaacccattcctcaagcctactttgaatgtgctatctccaaattttctctaaggaattactttttttgagtttcacagaacttttatctctatcattgtatcttctattgtaggactttttgggtttgttgttgtatttctcattttctttgctaaactcttaagtttctttatgctagatccttgtttgattcctatttgccttgcatataggtactaaatagacatttattaaataagttaatttgaagtcaagtattaataaagctctaaatacagttgcttttagtaattaagaaatgtcctttacatagacatagcataaaaataaacttctgtgtacctctgtgtctcagatacgtttgtatgcatattttgtgctagttactcatgttatttcattccccccacccctttccttatgtctgaggagctcctcctgaagctccacatgaaaaacaatgccttctcacttccgtcattttgaggattgcgatgggggatagctgagatatttgaagcttgggaactcttgtgttttggtttgaagctgctttgatcaactggccttcccaggccagcttcagtggggccaggatctgtagacttccccagcttgtaggttcagaaatctgtgactatgtaattaggataattttctcaggaaaatttaatcagatggtgagctcactggcatattgtgtgtttttttttttctatcttctggtataattaactgttctccaagcaactgaagaaaacaaattttatttaggaggaaaagtattttattttgcccctagtcaatttacataaccgcagcttctgtctgtaaaatgtggacaccacagtcttctctcttattcctctctgttttactgaaatgccatgtgagtaaaagactttagacaagagaatgtacactctctccacccctccaatgagataggatcgggggaggattataacagacttatttctttgatattcaggtatggaattggcaattggacaaatgtatctttctacgaggccatcaggaaacagtgaaagactttagactcttgaaaaattcaagactgctttcttggtcatttgatggaacagtgaaggtaatttaaagtataaatttgttttttgaaaaagtattctcatattgcaatgattatattgagacagtcaaaagccactgtgaggctaattacttacttaaaaatttttaatttttctcatgcttgttttctgttaattgcagtcacctacatctgctgtgtttaatgagcatttatactgttagtcacatttaaagtaaaggggtcagaacagccagtgtattaaaactcttgttttatagacctgtcttgtagctgattatgctttttaatataaaatgttcttaaaagtgtcaacctccaagtgttttttttttttttttaaggtatggaatattattactggaaataaagaaaaagactttgtctgtcaccagggtacagtactttcttgtgacatttctcacgatgctaccaagttttcatctacctctgctgacaagactgcaaaggtaggtcaatcaattgaaaccatgcataaaactttggtagtggttatgtataatgagttcaaataatatatgcaaaaggacataacagttgctctctacatgtctgtttcatattttgtgatcttttggaggatgcccattggcatttagttggtatcaaatgaatgaaatgaaatacattgaggacttctgatttctcccttatggattactttttgtctataactaatcaaatgcaacctctactgcatattgtaggcaataaaaatcattgaaaagcatttacatttaattatacactgacaatacaattttaatataattaatgtaatataattgacgtgtgtctaaaatcacattctggtgaatgatgctgcttggtgggggacctcaagtactctcttctctccttttttctccttctaccagtctttccaaactataaaccttggaattgtcagggctgtatcctgtcttttgtgctctgttgatgactctttagtgcatcttagagttatcttctcctctttgtcaccaccctgaagagcatgctttcctcctcctccactggtgaactgtcccagcatcctgcctctggtctgcacctcttccactttatcttccataccactgcctgtgtcccttgttgaaacacctattacctaacggtttataggccaaccacttagctcctcaccatctttttctgctatattgtttcctctgtgccagcctactttccaacttcatctttttgtgcatgctgctaactttggtttgataaaccttctactcttttaccttgaagcattatgactcatctttctagacctagatttgatggcagctcttctgaagcgtttcctgaccctcaagcaaggttagctgctctacctccagtgtttctattacattttattcatttgttagaacatttacttcatacaactgttcactaactgttcgtgagcctgtctttgtgattaaactataaacttttcaaggatagtgactgtagctagtttatcttcttgtaccactagttcttagctcacagcgcttggaacttggtagttttcagtatgtggttgctaaatgatgttgacaaaaccatgagacaatattgaaagaaaaaaaaaatagcatttggctgccaagaagtaggctagtatagtgactaacatttaaagattacttgtcacatgctagtaatttcactctctataatctcatttaatcttcacatcataggtacaattgtcctcattttacagatgccgtgtctgaagctatagaagcttatatgagttgtcctagtcacaagaatctagtgaacagtggagctagcactcacattcaggtctgcttcactccacagactgctcttagctgattcagtgttcttctgtctaggtctaaattaaggaaggagtgacattgatccttgagctgaatttaacttgagtaaataaagggaaactcagaaaaattaacaaggttgcatgctggaacttgggcatctcatgacagtttatgaattgccagatattagaatgtccatgtgattgaatttatggctgaatagcaatcaaggcagatgcttattttgagtgtttatagcattgctaaacaatcctaattgccttccagatctggagttttgatctccttttgccacttcatgaattgaggggccacaacggctgtgtgcgctgctctgccttctctgtggacagtaccctgctggcaacgggagatgacaatggagaaatcagggtaggctgtttgctgacatgagagcactgctcttcttgtagcttgggctagcactgttcacagtggggacctttgttcacgggccagggaagcatagtcctgaagttgtggttggatgaggcattctttttgtttcttgtgcacattgtattcacagctgcactccactgcagaaacggattcattttagagttagagtgaagcattccctgtatatgtgaggaagcaagtgctctagtcatttgtagttcattctctgccattagcttgagaatgattcatcttaattcttggacttgaaccaaaggtttttggtagcagaatttgaggaaaataattttgtaaattatggtctggattataaatgaattgcaaattctgctttttctgtgctgaaagaaaagatctctttagcactatacccatttgatagccatttccagtgtggtttgttgcagtcctctgtggactgcctgcctgttaaacagtgcagaggttcacatttccgtcattgtggggcagcgaagggctcctaattgagtcacagtctgcatgctaggccagtttttattaccctgcagtgcttaagatatacatacaaaccatgccaattttatttagaaaacaatctattttttttagatatataattttgacttttagaaaacaatctttttaggaggcttagaatgttgttctctgtgtctgtggaaatatagtaccatatggaaagaattgcatgctgaaagattagaaattatggaaaaggagtcagttgacctagttgtgtcagaagaattggggagccgattggaaaagtttgggtattgggatgactactttggtaaccagtgtagatgaggaagatggggttttccccctttcattacaaaggaggatctaaaactccaggaacaggtatatagtgcagaagactaggagagtatacagtttgcaggaacagaggtgttatcagatgggctttccagggaaattaagattcttcttcttgaggactaagtaaccaaccttctctctaccagtcacataaatgtgtgtcagctgaagtggcagggctgctttggaaatgttcattttgctctgagttcgcgtctttggatgaaagtgctcctttcccagttatgaggcggtgtttcatttttcaaccactgcaggaaaaagttgtctccattaaaattgtgttattttaaaaatttttgttggtacattaaaaaaatttttttctccctgattattcagaatataggaaagttactgatttttgtttgtatatgtactaccttactgaactgtttctaatgagtttttccattcggttctcttggattttctagggagagatttacaaatgattgtttaattttcttttaccatttatgcctctgtttctttttcttattctggtgtacctttatttgaaaaattagagcactgcttatatattaaatgccactggaaataaatggcaatattagtatctgtgttagggttgtttataataaagtctagtaaaataattttagaatacatatatatggacatatatatgttttaaaaccagagaagcttctggataactctgttaatgaattgtgtatcatgtttatgtagatatggaatgtctcaaacggtgagcttcttcatttgtgtgctccgctttcagaagaaggagctgctacccatggaggctgggtgactgacctttgcttttctccagatggcaaaatgcttatctctgctggaggatatattaaggtaagagttccccaagaactgtgaaagaaaataatagcctatatcatactttccaagctattttcacttcctgtttctcagttgggccttttacaacccagcagagtaaaaaggctgctactccggaggctaaggtgggaggatcgctggagtctgtgaggtcaaggctgctttgagccatgcttgcgccacttcactccaccctgggtgacagagcgacatcctgtctcaaaaaaaaaaaaaaaaatctggcagtaaaatgagtttagtaactaaagaaaagaacagaaaaaaatattgaaaacaaaaaagaaccagaaaaaactttaaaaaataattaaaagccaggcacggtggctcacgcctgtaatcctagcactttgggaggccaaggtgggcggatcacctgaggtcaggagtttgagaccagcctggccaacatggcgaaaccctatctctactaaaaatacaaaaaatagccgggcgtggtggcatatgcctgtaatcccagctacttgggaggctgaggcaggagaatcgcttgaacccgggaggtgaaggttgcagtgagccgagatcacaccattgcactgcagcctaggcaacaagagcaaaactctgtctcaaaaaagaaaataaataaataaataaataaattaattaattaattaaaaaaataaataaaaaggaaaagaaaaaaaaaggcagttactattatccccattttgtagtgatgaaactgagatccacaagactgctttcctcagatcttggggaagctttggtgacagtggcagggatgccctcaatccagagctgtcatactgcctcatactaaacttggggcattagaatgactagcaagttgggtgtttaacttagttctgttttccatgtcattcacaattaactatgttggttgaaaatctttaaaaaaacatatttttgaaatttcttcagtaataataatagcagcagtatatggctttatagtttacaaaacgcttcactcccctcatcttactagccagctttttgaggcttaaatttcattcttggtttacagatgaggaaaatgattttctatggaggttataactttcctaaagttacataattagtgccgggtgtggtgactcacacctgtaatcccagcactttgggaggccaaggcgggcagatcacttgaggtcagaagttgaagaccagcctggccaacatggcaaaaccccatctctgctaaaaaatacaaaaattagctgggttttgtggcgggcacctgtagtcccagctacttgggaggctgagaggtgagactcacttgaaccccgggggagcagaagttgcagtcagctaaggtcacaccactgtactccagcctgggcaacagagcgagactatctcaaaaacaaacaaacaaaaaaaccaaaaataaagttacataattagtaaatagaaaagccaggactcaaacccaggtctctgcctctgctttctctagctaattggctttttaaaacttactagtgattgaggccgcaatttgaatgtgttgtggtgcttcagggtcatatttttggtgtttttttgatgtatcttttatctatccactcaaaaagactgtgttgaatgtccagtgtgtgctaagctactgctctgtggcacaatgtttatggcttggttcctgcctttcagcagcttacagtctatgggggaagcaggtggtaaaccaataaagtccctaaagtttagaaggggtctgggacatgctttcatgagggaggtggaagcacaaaggagaggagtgaccagaccaacctcagagagttagcagaggcttcacctggaggggaatgcttgaagtgagtcttttgaatagcagtttacttgtaaaagtggtagaagatgatactctatatcagcggtccccagcctttttggcactagggactggtttccttggaagacaatttttccacagatggggtggtggtaggaagtggggagcggggaatggtttcaggattaaactgttccacctcagatcatcagcattagattctcgtaaggagtgcacaagctagatccctcgcatgtgcagttcacagcagggctcttgctcctgtgagaaactaatgccaccactgatctctcaggagacaaagctcaggtggtaatgttcactcaccagccgctcaccttctgctctgcggatgggttcctaaaaggccacagaccagtaccggtccatggcccagggactggggactcctctatattgggctgatcacttggacattctgaaagctttttcattcaaaattgattcctaataagatcttatgatactgttatttcttactgaaaacattcaagtgtaggagatgattctcattaattgtctaaggcaggataagtgtttggaaatatttgaatgactggtgttttggttacatgagacccacacagctgcaattttaccaccataagaatctagcttataaaaaagataaattagaggacagtttttagctttatgaaaggatgtactaaggggtacaaaaatacagataaacaaaaggagtaatttctagtatttgataatacagtagggaaattatagttaacaatttattgtatatttcaaaatagctagaagaattataatgttcccaacacaaagaaaagataaatatttgaggtggatatcccaattatcctaatttgatcattacacattgtatcacatgtacccccaaaatatgtacaacttaattatcaataaaaatttttttaaaaaagaaaggatgtatgttatccctttacaaggtttcattgaaaacacaattctgtttacaaaatgttgcattaacctacatctttattcagttattaggagatcctgagaaatgaccaccaattgttctcctttagtgtaaagataaactagaactcagtctgctctggggatgatgcttagaggagagtcattgctgtctgtgttggaagctggggagtcttcggctatattagctgctgacaaatttaactgctcagctttgacaccaagtttctagagaccacatcatttgattctctggcctccacagaattccatcacataattgagagtctggtttataagatgttacaaagatcagtgaccatatttgcagagttcttggggaaccttgaaataaagcagcagaataggtttacatagtatagatgttatgtctgaagggtgaaagaacttctagcctatgtatttagtttgtatatttaaatgacaatcaggctgcctttgccttctggtttgattactagcttattcaactgattatgatatagcccagcctgcatctacccagcatgttaatgagactatccaaaagcacagagcaaattaaaagtaaaaaggaacagctgctgtagtgtccaagaaaataggccttttgagcctgtttactttagaatccaagctgtataaattgagtgccagtaagataaagtaggtatccagaagcttaaaaagttcttaacttccaaattattcctatttataagtgaaaaaataatttagctgtttacctgcattatgccacagagtacatactgaatgacaagaaattcacattaattcatgtgcatgaagggaaagctgatctgaagtatggaatacatggtgataaatggtggtgtgccatgacttggtggcagcagagtgtaatggtcaggagagtgggcttttggccttgagataggctgcctgagttcaaagcctgcctctgccactcattagctttgtgaccttgcacaagattgtttaacttctgtgccttgattttcttatctgtaaattgatgtaatgataatacctaactcatttcacagatttcccatatacccctttcccccacaaacacatagcctcttccattatgaacatccccccaccagagatgtgcatttgttacaattgatggatccacattgacacatcattatcacccacagtccgtaattagggtttgttcttggtgctgtacatttttcgggtagttgaactaagtgatctctaagagccttagtgactgaaaacaaatgaatctcaggttggtggaatgtgcttgattacactgttattttacaaagcaaacttgtgagttctggaaaatcccaagttagtgcatgctggttcagtgaggtttaccaaagtccattgggtatacttttagcagttactattactaatagtgaacatgcttacttgacccactcacatgggaaagacaaaatgctaggtactgccataggcacaaaggtgggtgacactattactgtgttcataatactcaggatcatggtgagcttgaggccttttcagaataagtttacatgtattgtctcttgcccccattttagctgtgagattcatgggtaaactttatgattcccatttgttaaatgaatataaatattataagcaaattcagtgattgggaaggaaaggaaggacttggctacagcccttgctacgtttgagatgttcagtatttgtttagtaaataaataatatagattattttataaagaaacttggtcaagggctcttgcatcacacctggggaaagggaagattcagtagagagaacattgtttcctgtagcccatattatgaatagtttgggtctctgtcagaataccagtctgtgtctgcaaaggggcatttgagtgaagagagggggaatcttctgcccattctcccgagaaggacatgcagacaagagagttgagtctggccactgctgtaatggactctatagcttcctgtctgcagctctcaagcaggctgcatgtttctccagcacaactcaacggttggagttgggtgtaggcggagcagtgaggccatcaccagtgttcatcaggaagaggctgaccaggttgaatagtatattcagcattaaatccgagacattttcctcctgtttgcttgagttcggttggggggaggagatagggtaaaggatctgctggcactataaattgtcacacagtgtaattaccaatctaatgagaattttatttttctctgaacagtggtggaacgttgtcactggggaatcctcacagaccttctacacaaatggaaccaatcttaagaaaatacacgtgtcccctgacttcaaaacatatgtgactgtggataatcttggtattttatatattttacagactttagaataaaatagttaagcattaatgtagttgaactttttaaatttttgaattggaaaaaaattctaatgaaaccctgatatcaactttttataaagctcttaattgttgtgcagtattgcattcattacaaaagtgtttgtggttggatgaataatattaatgtagctttttcccaaatgaacatacctttaatcttgtttttcatgatcatcattaacagtttgtccttaggatgcaaatgaaaatgtgaatacataccttgttgtactgttggtaaaattctgtcttgatgcattcaaaatggttgacataattaatgagaagaatttggaagaaattggtattttaatactgtctgtatttattactgttatgcaggctgtgcctcagggtagcagtggcctgctttttgaaccacacttaccccaagggggttttgttctcctaaatacaatcttagaggttttttgcactctttaaatttgctttaaaaatattgtgtctgtgtgcatagtctgcagcatttcctttaattgactcaataagtgagtcttggatttagcaggcccccccaccttttttttttgtttttggagacagagtcttgctttgttgccaggctggagtgcagtggcgcgatctcggctcaccacaatcgctgcctcctgggttcaagcaattctcctgcctcagcctcccgagtagctgggactacaggtgtgcgcacatgccaggctaatttttgtatttttagtagagacggggtttcaccatgttggccgggatggtctcgatctcttgacctcatgatctacccgccttggcctcccaaagtgctgagattacaggcgtgagccaccgtgcctggccaggccccttctcttttaatggagacagggtcttgcactatcacccaggctggagtgcagtggcataatcatacctcattgcagcctcagactcctgggttcaagcaatcctcctgcctcagcctcccaagtagctgagactacaggcacgagccaccacacccagctaatttttaagttttcttgtagagacagggtctcactatgttgtctaggctggtcttgaactcttggcctcaagtaatcctcctgcctcagcctcccaaagtgttgggattgcagatatgagccactggcctggccttcagcagttctttttgtgaagtaaaacttgtatgttggaaagagtagattttattggtctacccttttctcactgtagctgctggcagccctgtgccatatctggactctagttgtcagtatctgagttggacactattcctgctccctcttgtttcttacatatcagacttcttacttgaatgaacctgatctttcctaatcctcacttttttcttttttaaaaagcagtttctccactgctaaatgttagtcattgaggtggggccaattttaatcataagccttaataagatttttctaagaaatgtgaaatagaacaattttcatctaattccatttacttttagatgaatggcattgtgaatgccattcttttaatgaatttcaagagaattctctggttttctgtgtaattccagatgagtcactgtaactctagaagattaaccttccagccaacctattttcctttcccttgtctctctcatcctcttttccttccttctttcctttctcttcttttatctccaaggttaatcaggaaaaatagcttttgacaggggaaaaaactcaataactagctatttttgacctcctgatcaggaactttagttgaagcgtaaatctaaagaaacattttctctgaaatatattattaagggcaatggagataaattaatagtagatgtggttcccagaaaatataatcaaaattcaaagattttttttgtttctgtaactggaactaaatcaaatgattactagtgttaatagtagataacttgtttttattgttggtgcatattagtataactgtggggtaggtcggggagagggtaagggaatagatcactcagatgtattttagataagctatttagcctttgatggaatcataaatacagtgaatacaatcctttgcattgttaaggaggttttttgtttttaaatggtgggtcaaggagctagtttacaggcttactgtgatttaagcaaatgtgaaaagtgaaaccttaattttatcaaaagaaatttctgtaaatggtatgtctccttagaatacccaaatcataattttatttgtacacactgttaggggctcatctcatgtaggcagagtataaagtattaccttttggaattaaaagccactgactgttataaagtataacaacacacatcaggttttaaaaagccttgaatggcccttgtcttaaaaagaaattaggagccaggtgcggtggcacgtgcctgtaatcccagctccttgggaggctaagacaggaggattccttgagccctggagtttgagtccagcctgggtgacatagcaagaccctgtcttaaaagaaaaatgggaagaaagacaaggtaacatgaagaaagaagagatacctagtatgatggagctgcaaatttcatggcagttcatgcagtcggtcaagaggaggattttgttttgtagtttgcagatgagcatttctaaagcattttcccttgctgtatttttttgtattataaattacattggacttcatatatataatttttttttacattatatgtctcttgtatgttttgaaactcttgtatttatgatatagcttatatgatttttttgccttggtatacattttaaaatatgaatttaaaaaatttttgtaaaaataaaattcacaaaattgttttgaaaaacatttttggattgtttcattctttgcttgtcatttatctgttgattagaccactaaagtgaaggattcaagctaaatacatcaacctttctatttaggctttatcagctatatgtaaattcaattctatcaaaattttctgagtgcctcctcagtgtgtctctctgatggttcctgcccggtatggctggcatgaagaagatcctgtaaaaaagagaattcatttatttattcacttagtttgttcatgcatttgtttaataaatattgagatgtaccatgtgcctggcattgtggtaggtattgggaacacaggagtgagcaaaacaaaattcttgctctactgcagttaagggccagggagaggcagaaaaagtaaataagtaaaatctatagtgaatttggtggtatgtacaagcggaggggaaggggttacggttttagatggactggctctttcagaagctgacacttgtacagacctgaaagatgtgaggaagtgagctatgcatctgtcgggaaaccattctgaaggatacagcaggtgcagactccagtgggatggttggtgtattctgggagcagccagacggcccatgtggctggagaagggtgagtgtgaggagtctaacaggagaggcagagaggaattggggtagcaccggaggctgcctcttaggccacagtaaggacttcacttttgactctgggagccagtgtaggagttttgagcagtggtctgatttaagctttaacgaatcacccaggcagtgggaatcaactgaaaggggaaccagtgagaagcttttgtaatcatccggacaaaatgaaggtgggccagactagggtggcagcagcagagcttgtgacaagttggattctggacatattttgaagataagagttaataggatttgctgatggattggataaaggttgtgagagagacaagaaaagaatgatgcaaggttttagcctgagcaactggaagaagagagttgccgtcagctgagatgaagacaatgaaagcagctttgcggacgcggtaagtttgagatgcccgttaacgagacatccaggtggggatgctgagtaggcgggatgcaaggctctggagttcatgggaaagctccaccaggaggtagaaatctgagagtcatcagtgaattgatggtatttaaaatcagaggagtagatgaaatcagcagtgaagtgggtgtagatagaaaagacagggggccccaagactgagtccagggcagtctggagatcagtgggatgagggataagcccaggagactaaaaaggaccagcagagactaagagttgcaaattagtgtggtaagtacagtgaatgcagcaggcatgggccccttaacgtcttcttgtctgtagtccttgatcagtctgctcattcacccacctatctatcctgtactccttgagcatctgcatgccaagcactgttttaagcagcagaggaagcaataagtaaatacatttgagttgttgagagatcatggggacaacagatgataagaaaacaggacagtatcagcagttgtcttatctgaaaaatgaggatccgttcctccctccagattgttgtaggatttaatgagataaagctcctgaagcacttatctcattgcctgcactaagagaccgctcaggggacattctgcaatgccatttgagctccctcctctttgcctggcaacagccccagctgccatctctgcctccagttgtgcccttctgcatgatctttccagagcactcatctgaatcacattaaacttctctgtttaaactttgtgtttacacttctgtttaaaccctggacctgctccaagttctcttctgtagctttgtgtacactgttttctctatgctgtcctctcaccgattttcttttccccgctaactccctatgtttcacaaattctttaagatgaccctcaagagctgaagggctgccctgccctctcctagcattctctt

SEQ ID NO: 15935 - DNA, 94135 bp, Human; identical to SEQ ID NO: 15934

SEQ ID NO: 15936 - DNA, 94135 bp, Human; identical to SEQ ID NO: 15934

SEQ ID NO: 15937 - DNA, 94135 bp, Human; identical to SEQ ID NO: 15934

SEQ ID NO: 15938 - DNA, 12013 bp, Human
agagagagagaaagtccagacccttcagtgactacctctgtctacataagatcagactcctcagtctggtatgtgaggccctggacaatcaggtgctagtgtacttttttaactttatctgtcactacttcccttcctgtgccctccactctggaattcttcctgggactgtaggactttagttgggccagaagggctgggtctgggatagggttgcttagagagtgccgtgatgccgcagcctcaatgctaacttttgtttttttgtttttttttttttttgagacggagtcttgctctgtcgcccaggctggagtgcagtggcatgatctcggctcactgcaagctctgcctcctgggttcacgccattctcctgcctcagtctcctcagtagctgggactacaggcgcccgccacctcgcccggctaattttttgtatttttagtagagacggggtttcaccgtgttaaacaggatggtctcgatctcctgaccccgtgatctgcccgcctcggcctcccaaagtgctgggattacaggcgtgagccacctcgcccggccaatgctaactttttttaggataacatcttctgtagacttttagacattatctcattgagttctcatagactctgcaaggtaagtattactcccatccagaaccagacacctgatttgcagggtccagtgcaaactaaaaaaagcgtggccccttgttcatacatgtattaagaatttcaagccgggcatggtggctcaggcctgtaatcccagcacattgggaggccgaggtgggcggatcacctgagctcaggagttcgagaccagactggccaacgtgacgaaactctgtctctactaaaaatagaaaacttagccgggcgtggttgtgcacgcctgtagtcccagctactccgggggctgagacaggagaatcgcttgaacccgggaggcggaggttgcggtgagctgagatcgccccactgcactccagcctgggcgacagagcaagactccatctcaaaagaaaaaaaaaaaaaatcaaaatgacagcagagcattaaatgaagtgtaaggccatgtgtgactgtaccagtgtgaacctatgaggccagtcccacccctatcttacatctagggaacaggtacacagagatgaagtaaattcccaaggttactttgtcaagagcttggaaaatataagagtcagaagtctaacaggttgaatccctattaaactctccccaactaaactacgcccctccctgttgagctgaatctaatgaaagcttcctaaatgtattaaccacacacacgcacaatctgctatcagtcactttcagtagttcatcgctgtaacatctcaggagttcaatgtttcaacgtgttctgtagattactgtgataacgcggcaagctgtcgtaagacttcttgctgcacatttctttttaaaatattctccaggagtctgatgaaaaatacagacatacctatgtttaatgtcaatggatggaacttattttaaaaagtactgtaatggcagaagttgtgacacaaagtactgcagtgatgttgtaactccaacacctaaatatattatcaagcattcgcgttttgttttgttttttaagtgactactagatactgtgattcacttaagtgaagcgaactgaagcccgtggtcaaggagagacacctgaaggtgaagggacaaagcgagcagggtaagagctcgagcccgacccctctcaaaaaatatagacccggaacgcgcgcctgcgcagaacgaatcctcccgcgcacaagccgggcggaagagctggggcgggcaggggcgggaataaggttgctaggagaacgcgatgacgctacgggctcggcgctcttctccaccaatgggcgacgcgtacttgcagtggcgcgctgtgtgcgtcacgccgacgacgcgcgaagggcacacatcttaggacccggaggacgtccggcctctgtgagccgcaacctttccaagggagtggttgtgtgatcgccatcttagggagtgagtgtggccgggccttctcctgtggcgggtgtggggagcggagcccagagctcctgtggggccgctgctttggcggtgggcccagccgggagcagcctctttcgaaggccgccgtgacctcttcaagggcgtggagacgggaaggaaaaggccccggttggggttccagggcgccggtaacgttaaccggcgccttgcctgtcctctaaccgtcgctccctcctcccctagaaagatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaaggtgagatcagaccctgcccaatacagtcgtgtggtctacttgtgggccgcccagcctttgaggcctggacccggcttggaggacagggaaggacgagtccagcccgctgcaccgtaggacggcgcccagttgcttgccctggggtatcggccttttccaccataggcgggtgtcagatccttggccttccctcaagggcgtggaagcgctgaggccctgtgtcccttcgtgacctccgtgtgcccgagggaagagaggccgtgactagctctttctccgccgtgagctcgcttggtcagcaaactaagtactgggtaaactctcctcccgaaactactgaccacccacagttctactaactatattacctgtcctttgatttgcccttagttttcttaaaaatagtcctttcctaagttttatatttgtcgacgccaggtcagtcatttttgcacttaattgtatatgagataactagatgtcctgttttcgtgcgactggaggaggcagcttgcagccctacataggcaatagaaaggagataattggtgggcgtccctttggtgtgattatctcttgggattcttggtggttgggcccagctttaacttagttgtgtgtgttttaaatcctagtgaagtatgtacatacagagaaacctgaaaaccgaattgtaggagtcctaagaatgttatctaccttgtgcctgtaaaatcgaaagatttttttctttaaatcattcatgtgcttctgttgtctttagtatggatagagtccttatttacactatctgtcgttcagtttaaaagttaaagctaacattatttgtgtattaaatgtatttgactgcaggaatttgtgcgtatccgtttttatgttacaggagttcttaagtggggatagtattggttagtggctgggataaactttgaagttgtttgcaagccttttacatgtcgagtgatctttctgagtttcgtttgtactctgaagtgtgctcttaccagtggttaataatttgaagtttgactttaattgtaaaagccgttaatgtagaaaacttttaaaaaaattaatatggcagaatacgagctattaatagtatcagatacagaaccctcataatttttaaatgatctgaatttggcagtgaatttttttttaagccacttaattgtggccaaagctattcagctgtgataatagtatctcacagggaaacattttctttcattccagtggccttagtcatctctgaagaaatacttacttgatttttttttttccaatcaaacagagcagtatagctgtgactatggatctggcagattctttatcctttgtggacttggaggaattattagctgtggcacaacacatacagcattggttcctctagatctggttaaatgcagaatgcaggtttgttttgcatgctggactagagcatattgaagcatgactgactgttaagttataagatatagtcatctaacaagctgtgtggaaacctaactgtccaggaggtaagtttatgaccagtaacatgagttttatattaaaatgcatggtgtgtcttctcttactacagagtacagttgtgaatttggctccgcgaagtattatgcactgtgtggctttggtggggtcttaagttgtggtctgacacacactgctgtggttcccctggatttagtgaaatgccgtatgcaggtttgtattgagatgacaacattgaaagtatctctcatgtgacttaactctaaataaaatcttaaatgagaatttgaagacatcacaactgctagaaacttcagtaggaaaccacatagaatttctttaaattgtgggctttattttgactagtgttttaaatccaataaatgcctctattgtttgagtaaattgttcacttttagagtctggctgtaaatggctctttgctgctgctcttcacttctggccggagttcttcaagcttactagtgccccaaatagtcatttaacaagcacctatgtgttggagtgggtaaacaagtctgtgtattatgtgaagtaacaatgtcctttatctactaataagaccaaggcaaagagtacatgtagatttatttaaagtgctcttaatatcttagtatgaaaattttgtcagattagcctcttgtttatttacacaacattttaaaataatttgaatatattttaattaagatcattgaaacaaaaacaagacatcgaaaatttatttgttccaaactggattagaagtctacttacctaaaagagaaatgaatttgaaatattaggagggagaggaaggtgatgtataccatcccttctagtactggcagaaatagataagcttttcctccccccccattagttaatgtaatggatatgaaatgtacctttgctaaaacgtgttatgcatgtctcttgaagtgaatttagtttatgtgctttttttttttaacttgtgtttagtttgtttagtgttcacaaaactttatgctataagctacttaaagaactagcatatgttaggaatacagttatatctattatctagacagtagcttttaaaaagtaggaggtgggccaagcatggtcgcccacacctggaatgccagcattttgggtagccgaagcaggtgggtcacttgaggtcaggagttcgagatcagaactcaatctagccaacatggtgaaacctcatctctgctaaaaatacaaaaattagctgggcatggtggcgtgcctgtagtcgcagctactcgggaggctgaggcaggagaatcgcttgaacctgggaggtggaggttgcagtgagctgagatcacaccatggcactccatcctgggctacagagcaagactcaaaaaacaaacaaacaaaaaacacaaaaaaagtagtaggagttgggtggtaagaaatctgttaagaatcagttttgttacgtatttttgttgaaattttaccctcttaactatcactccaagacttaagtttgacacagaaagcttttgttgaaattttaccctcttaactatcactccaagacttaggtttgacacagaaagctagaccttaatgtacaacagtttctatttataaaagtaatcaaatgaacaataataaacagtgataagcataaactaataaaagttatatgaatgtagttcctcactcaaaatatcttaatattttcagatgtcagttgaccttggataactgaagccacagaaaatgaactcttggataagggagagctactgtatttctttttttttttttgagatggagtcttgctctgctgcccaggctggagtgtagtggtgccatcgtggctcactgcaacctccacctccctccctcaggctcaagcgattgttctgtctcaccctcaccctcccgagtagctgggattacaggtgcacgccaccatgcccgtccaattttttgtattttagtagagatggggtttcactgtgttgcccaggctggtcttgaactcctgagctcaggtaatccacctgcctcagcctcccaaagtgctgggattacagatgtgagccaccgtgcctggcaggaattactgtagttaccttttgtgtagttgctgaaatttattatggaacccaaacaaaaataatcatgagattaaatttttatgttagctgtttggtgcatttaattttttttttcttgttttaaataaaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggtatgtaattaactttaaaattgaatgttccgagtgtttaagactttccgagtgttcttagatttttgtctgtcttgccttattttagcactgaagaaaatggtcctacaaagtgagcaacttgttttaaatcgtatgcctgtgtcagcagagacaggttgataaatgtatttcattaaattacaattctccttttaatatactatcttgttttctaagtaagttggattttgagttttttagagaagggctctgggactcctttgcgtagttccggggcatggcatctagatattttttgaatattcatgttgttcacatagttacgtgttttgttaatgaggttatgagaccacatatatattccatatcatcgtgtgttactttataaaatgtctgaagcttagttgttttctagaactgtcacttcaattgaaaaccaacacaacagcaattcacatcccttccttgtgttttggattttaggagaatacttatctctggcgcacatcactatatttggctgcctctgccagtgctgaattctttgctgacattgccctggctcctatggaagctgctaaggttcgaattcaaacccagccaggttatgccaacactttgagggatgcagctcccaaaatgtataaggaagaaggcctaaaagcgtaagtaaacacttaaaaatttatactatgaaagtacttattttaagtgaacttcatttttttttgtttttttttttgttttgtttttttgagacaaagtctcgctctgtcacccaggctggagtgcagtggcgtgatctcggctcactgcaagctccgcctcccgggttcacgccattctcctgcctcagcctcccaagtagctgggactacaggcgcctgccactgcgcccagctaattttttgtatttttcagtatagacggagtttcaccgtctccatctcctgacctcatgatccgcccaccttggcctcccaaaatgctgggattacaggtgtgagccaccgcacccggcttcttttttttttttctttgagacggagttttgctcttgttgtccaggctggagtgcaatggcactatctcagctcactgcaacctccgcctcccaggttcaagtgattgtcctgcctcagcctgctgaatagctgggattacaggcatgcaccaccacgcctggctaattttgtatttttagtagagactccatgttggtcaggctggtctcgaactcctgacctcaggtgatccacccgcctcggcctcccaaagtgctgggattacaggcgtgagacaccgcgtctggctgtgaacttcattttttagtattaagcctaccagactttttaaaaagactattataacatttaatgtctatttacctgtatgtagaacataaacttgagaggtaaagataagttaatacatggtttgagccctggactgagttttttttttttccctagagtaaggaccatttgtcggtctacaaatgacttgatgtttggcctaaacatttactattaacttttagggagggcttgttagtatccttgtgatctattcacagttaagaatttccatgaccacaacatgcttccttagatccacctttgtggatgaatcttgaactgagttccacttgtaaacttcttgtttcttgtggttccagtagtcaaagaaacatccagcaacttttttggttgtatagtcaaaggtgcttgagtcattggcatgtaagagaaatatacctgcatgttagtctaacgttctgatagaaatgacatgcatttatgctgccatttgttactatcaggactcgactcgtgtgcggacatttctgttaataatgacagtctctgatagatgagtgtatgcaactgtgtaaaacaagtctcttgatttcctagattctacaagggggttgctcctctctggatgagacagataccatacaccatgatgaagttcgcctgctttgaacgtactgttgaagcactgtacaagtttgtggttcctaagccccgcagtgaatgttcaaagccagagcagctggttgtaacatttgtagcaggttacataggtacgaattacttagaacacacttgtctgaaattatgaacaaataatcatttccattattggcgttttttgagagggaaaaatactccaaaggttataaagcagtgtttttgtttttttggtttccctgaggcatagtctcgctctgttgcccaggctggagtgcagtggcatgataatagctcactgcaacctcctcctcctgggttcaagtgattcttctgccgcagcctcccaagtagctgggacaggcatgcaccgccatgcccggctgatttttgtttttgttttttgtttttttttgagatggagttttacccttgttgcccaggctggagtgcagtggtgcaatcttggctcactgcagcctccgcctcctgggttcaagcgattctcctgtctcagcctcctgagtagctgggattgcaggcgtctgccactacgcccggctaatttttagtatttttagtagagacggtttcactatgttggccaggctggtctcaaactcctggccccaggtgatctgcctgcctcggcctcccaaagtgctgggattacaggcgtgagccaccgcgcctggcctgatttttgtaaagatggggtttcaccatgttgatgagtctggtctcaaactcctgacctcaggtgatgtgcctggcctataaagcagttttatcttcccataacattttatatgctttttaggattcataaatacttgctaactagttcctaaaagggctgtttcatgggatgtcattattaggcttgggaatgtattgatcttactgttgcaccatttttttgttgttgtttattaagaattttatacagaaagtgttgaataaaatctgaaaaactttaaaagattgttccgttttacataggatagacagcttgataactgtacccgtgtcaccctgagtctgatttttattttagaactagaaaaatattattttaaaatcataaaaatgattattggctctgtgaagttttgtttttaactggcactgtatgggatcctttatcttttttcagctggagtcttttgtgcaattgtttctcaccctgctgattctgtggtatctgtgttgaataaagaaaaaggtagcagtgcttctctggtcctcaagagacttggatttaaaggtaggatgatgtttttttcttgaaagaaagaacaacagttttggatatgttgcatttttttcatttgcttttcctgtttgaaccaggtgtatggaagggactgtttgcccgtatcatcatgattggtaccctgactgcactacagtggtttatctatgactccgtgaaggtctacttcagacttcctcgccctcctccacccgagatgccagagtctctgaagaagaagcttgggttaactcagtagttagatcaaagcaaatgtggactgaatctgcttgttgatcagtgttgaagaaagtgcaaaaggaacttttatatatttgacagtgtaggaaattgtctattcctgatataattactgtagtactcttgcttaaggcaagagtttcagatttactgttgaaataaacccaactcttcatgatttgcctgtgacttatttttaaaacttttttaaaaaagatttagctttaaaatagttggaaagaatgaagtatataagttaaggaaaaaatacaaaactgaccatgaccattgttggttgaatattccagttgctattcagaaattgtcatatgtctcaagttttatcacacaaagttcctgtatttctagggaagcagactttaaatttctaaaaacttgatttaattatagttaaatatgtgtagtcatttgtggttattttggcaagtaaatgtcagtgtatacttacatttttgcagcatgtactacaccttttttatgttggtgagtttgctaatccttatttgtaagacaaggtaaaccaaattaggctgattcttagaatgacagtaaaggaccaaagtgattgacagctgaaaacaattttcaggtacactaattctctttacacagatctgactttttttttttttgagacggagtttcactcttgttgcccagacgagtgtagtgtcgcgatctcgcctcacggcaacctctgcctcccaggttcaagcgattgttctgcctcagcctcccaagtagctgggatttcaggcatgtgccaccacgcccagctaattttgtatttttagtagagacggggtttccctgtgttggtcaggctggtctcgaacttccaacctcaggtgatccgcccgcctcagcctcccaaactgctgggattataggcatgagccaccgtgcccggctctgactttttacagaaaattgaactattttcagtctggtattttaagaaaggtactgcttgacagctgaactatatgaatgccactggggaaaaagcattccatcatacttagatacgagattggattgtaggtttaagcccatttttaaagagctcctagaaagtgaattagtttttgtgtttagattccccttaagtttgattaggaagtgtataaaagttcaatcttttgtaatgacagcccaccactggaaaaaaaacgaaaaacctagtgtaatatataacatgctgtttttcaaacactagattttacctagagtccttatgtgtaatacgtgggttggttaacagtccctacgtaaagcgtacagatggcctggagagaaaaactttttcagagattggagagaaatgttactacaaactcatggtaaggtcagtgaactcaatttagaagccagtgcagctagttgcatgttaacttctttatatcatcattgcctgaacttgttaaaggttccaacattttacctgtgctgcaggaaaaaaggaaaagttgtaggtacaaatttggaccaaactttaaaaaggtaaagtaggatgtcttctgaacccaaccaagtggtggctgtggtgcttagcagtatcaactgtatattatttcttgctatgttagcaaagcatccaaagatcaatggtgtatgataagcttttctgtgggtgaagaactcgggagtatcagactcttctggttctgagtctcatgaagcttttcacttctgagctgaaaggatgctctttgtgcttttcactattagtggtatagtctttcccgaaaatctctagcatggtggcttcagggcagctggacttaggtggtattttggggctccaggagagcttggcagagttggctttttaggacttatccttcaatgtcacataacatcacttttaccatgctcttggttacaacagtgatgtctcagaaaccaagtcccagattgaggaaaaaaggaacatagtctctacctcttcctgagaggaaagtcagtcaacgtgtaagaggagcagtagaaacgcattagtccagccaacgtgaaagtggaccgtagatctaaaacattttgggtatgcagttcagccagcccttactgaggcagttctgccaatcaggattcaagttttatttcctaagagttataataggttttatttgtgggcattgatacaaaatacgctgtg

SEQ ID NO: 15939 - DNA, 12013 bp, Human; identical to SEQ ID NO: 15938

SEQ ID NO: 15940 - DNA, 191569 bp, Human
  misc_feature (1)...(191569): n = A,T,C or G
gtgccacccgagccgcaccgccccgcccccgcgcggccgtcgcccgagctcccctcccctctccagcacgcgagtgtcggtaggtactacggcggagggcacctcctgggcccgcctccctaaccagggccccgcttgcgcgctgcctgctgtcttcacgtgatgcgcacccgagcttcgccgccaggcggcgctgatcatcggggagggggttaggggtcctagacacgcgagtcttcgctgtttctcattcattcattcattcacttaaatgttatttttcccttccttccttccctccctccttccgggatggggtcttgctgtgctgctcaggttggtctcaaactcccgggctcaagtgagcctcctgcctcagtttcccaaagtgctggggttacaggcatgagtcacggtacccggattctctctttctctctctgaatatatataatatatataaaatatatatataaaaatatataatatatataaaatatataaaaaatatatataaaatatatataatatataaaatatatataatatataatatatataaaatatatattatatagtatatataaatatatatactatataatatatataaatatatataatatataatatataaaatatatataatatataatatataaaatatatataatatataatatacataaaatatatataaatatataatatatataaaaatataaaatatataatatatataaaaaatataaaatatataatatatataaaatataaaatatatattatatataatatataaaatatataaaatatataaaatatataatatataaaatatatataatatataaaatatataaaatatatataaaatatataaaatatataaaatatataatatatataaaatatataatatatataatatataatatataaaatatataatatataaaaaatatatggatatataatatatatgatatataaaatatataatatatataaaatataaaatataaaatatataatatataaaatatataatatataatatataatgtataaaatatataatatataatatataatatataatatataaaatatataatatataatatatataatatataatatattatatatataaatatatataatacatatatattatatatattatatataatatataaatatatatataaatataatatatatatatttatatataatatataaaatatatattttatatattatatataaaaatatataatatataaatatataaataaataaaatatatataaaataaaatatataaaatatatatataaaaaatatatatatattttagtttctaagacagggtcttgctgtgtcgcccaggctggagtgcagtggcaaaatcataggttactgcagcctcgacctcctgggctcaaacaatcctcccgcctcagcctccgagatagctgggtccacaggcgaataccctgcccacctactttttttttttttttttttttttaattgtagagaccgggtcaggctggtctcaaactccttgcctcaggggatcacaggcgcgttatagagacgggggctttccctgtgtttcccaggctggtctagaactcctggtcttaggcagccctcccgcctgggcccctcaaagtactggaatttgcaggcgtaagccaccgcatctggctttgcacatttatcttccagcaaagaaaaacctgggcaactacatccaggaacttaattgctttaatttgggaggaagcaggagattgaggggtaaaggtgcaagaagagagaaaagaaaaattaggctgtttggaaagggtagcacagatatgatgtaagaaattgggtttcaccatatttgtgtgtgtgtgtgtgtgtgcgtcctcctctctcctgccctcactaggcgtgcctgtttgaaggccccgcgcgtttccggctcctgctcagaagctgtccaccttgattctgcccgtagcaggtgaacctggtgtggtgcgcgcactgcgggtcctgattggctgtgcacgccacggtgaaaaacttgagcgtctactccgagtcctgcaagctcctagtgtctcctctgggtggacgcctaggcgcacggccgttacttctctttcacctgtggattcgtcagtttctcgttcgtttcaggaggcgatcccgcgccctgggtgcggtgaggccgctgggacagcggaggtgcctcccgacgcgaagcagcgagctgaggcggcggccagcggggaagatgagcggcagcagcgccaggtccagccacctgtctcagcccgtcgtgaagagcgtgcttgtgtaccgcaacggggaccccttctacgcggggcgccgcgtcgtcatccatgagaagaaggtgtccagcttcgaagtcttcctgaaggaggtgaccggcggcgttcaggcaccctttggggccgtcaggaacatctacaccccgcggactggccaccgaatccggaagctagaccagatccagagcgggggcaattacgtggctggaggccaggaagccttcaagaaactcaagtgagtcggtctcccccaccgcccacccatttaggtgccctatagtgtggggttgatatgaagaaatgcagatccctacccccccacacctcagtggttgaggggctgtgacttctcggtgtgattgatgcccctcaaaactctcgttgcagttggggggtagaggttgacactgtgactggagaaggaatttcacttgggtcagcagtaggagtaaacttaaaatctgtgtataaacaacaggaatcttaaagaaaataaaaaggtatccttgcaaaggttagtgaccaaactgatacttttgcgttttctgttcagttttttctttccttttccttattttttttccttggaaatccatccttttaatttaaataaacattcttaaaaatcacttccaagtgttggacactatattgtcaccagaggagaaaattgctctgcatttcccgtactgtttaaattatttcaacctttcattccaagtagaattgacaacactcacttttgtgaccctgctcccaccccctgcatgtttatgctgttagcataatgcaggaagagtttactggctgactgtatttgtcgactgtctgtctccagcaacgtgattagaccttcaagggcaggggtccttattcccagctcttgagctcactcatagtgagtgttcagtgaattaagaaaccgtcagttcagggaacaaagatgagcaaggcatgattccttgtctttaggagctttcagtctaactggactacctgcacactaacaattttaatgcaagctacaaagggatatgtgcaattagaaaaataaagttatgtgggaattgtgagttgagagttggttggggtggtcattataggacaggtagaattttacattccattttttttttacagctttattgagatagatttctcatggcatgaagtccaaccatttcattggctttcagtgtattcagagttgtgcaaccatcaccaccaactaattgtagttcatttccacccctcccgccaaaacatttgtacctcccagtttcctctgtcccctgtcatctggaaaccactaatctattttctgaatctatggatttgtctattctggacatatcatataaatggaatcatacggtatatggtctttatgtctggcttatttcacttactgtaacattttcaaggttcatccatgttgtatcatacatcaatacttcattctttttattgttgaataacattccatgatttgggtatattaccttttatatccatgcttatccatttatcagtttgatgtatatttgggttgtttcacattttaactattatgaataatgcatctatgaatatttgtgtacaagttttcatttctctttggtgtatacctaagagtgaaattgctggatcacatggtaactctgtattccatagtttaatagaacattttaattgaaattcatcttgggccccaggatagaaaaaagccttgaccataaatctaagcttatgaattcataagcattattggattcttaataattaaaattcaaataaagtcttataactacatagaaatatttttcaaaatatcactaaaattcttgaatgtaatccttcttctcctatatttgtttaaattgagttctaggtattctattatactttttgttacgtcagacattcttttcatggaaagtgagggatatatttggatttatttttccctcccctgaagcttcttaagcatgctttgttaaacttcgtaaaaaagggctaaatgaaattgcatgcttaaaggaaacttaaaaccaggagactgaagactgagttgctcatcagctctgtgtccttgggcaagtcgcttgactcagctaatcagtttcttaatacagaaaaggtgcataatcatttgtaccacacagggctgtgataaaaagtaaatgctatagatgtgtgttttgtaaacaccaaagtgttacataaatataagacacctctatgaccagttccttttgttacatactttattttttattaaatatttccgtctaaagcaatttcgtggaaatgaaagtctggttcagaatctctgaacggctgaaaattgtagactcacttttatagttcatgttcttttgtttatttgatcctaccaactcacaagattaaaaaaaaaaggtacagttccacaccaaataaaaaagtgtactcaagtctctctaagagatttgcatgttatttttgctttcagttcatacacaaaaaactgaatttgttataacagtgtccatggttaggtttccatgctgacagatgactattttatttgtgttaaagaagtagtatctacggttataatgatagaagccaagaatacttgaatgttgaatatatttgaaacttagcacttataagtttatgtaaagaatggagaaactgtcagaacaaaagaaagcccaaacgatattgaggacaattcgtgggctttcatttagaccctaaatgttgggaaagacagcaacatcttttccaaatggaactgatcaaatcgctgcttgaattgctttcacttagatttttctaatatttttgaaacgataactaaacatcaggtagctattaaacccttatttatttcaaatgtgagaccatacattcacaacctttattttacagctgaggattctagagagtatttcccccaaaactttccctgtgcattgttggaagttgactctgcagcattaatcttgtggatctgaaaccactttcctgcacatgacagaatatttcggtattatttcaaaactcagcccctgcaggtccacaaaagacccattttattgctaagacggagtgtttgcactgttttaaaaatatgactacttttatataggggcattgtatgacaatttccagagatatgaattaactaaagtattttatccaaaaaggcaaacagcaacaataaaaacatttcaatagccaaaattaattctaacataagctttttttgggacaagttggcaattgtagtagttggggtaaaggattgatctatcattataaattatatgttagatttatactttttaatattaaaatgtttatttagcacattttatgtatgaagcacagtttagggaccatttaaaactggaaccacatcacagtgatattacacgtgaagttgacaaaggtatacagttttcaggttgtgcttatgtaacagctaaagaatgatcactgttagtatctagagcaaatagtaatggaataataggggtctccagaggttaactagtccacccatctgtttcttagctgaaccaattaccaaagtcatcccacatgagtgagtgtttttgtatcattaaggtgctctcatagagacaataatttctcagcctttcccagttgttaccctaatgcacgctatcagtacttcctttgacctaaagcctgtatttaatggaacagttaagcagctttgcacataagccactcttttaaaaaatcaaatctgtaagaatatagtgtatatagtaagcagctaactattaagagggaaaaatgttctctaatagatgtatgtatttctaagactttccttctcttgaagtttagggtagacatatgtcagctctggttggtgacactgcaaacagtttttactattgtaattgcttttcattagtagctatttgtttttgctttaaggttgagaatttcctatgagttgctttatttttttatgatttttaaaaataaattactgacttaaagtctataaaagcaactcttattgtttgtttgttttttcctcagttacttggacataggagaaatcaagaaaagaccaatggaagttgttaatacagaggtaatgcaaatattattttgaaaattcaaataaataacggtgccatttgtttctcatggtgtgtcttagagatttggacggcattctactttgatgagttctctaatgtaaagaaatggaacattatatgttttaaggcaaagataattctttctttgaatcattgtcagaaatgaaaagactgagtagatgttctaagatgtgcaggatatgtcaagattagacaaaacatatttttctcttttctagctacatgttctctgattgaaatccatgggaaggttccctgtcaagtgagaagattctgagcgttgttaaataaatctttaccaaagctacatcctcatcctaatgtgcctctgataactcagtgtttgatgtagccagggtcaccctaactgcccctgaggctttcaaaggagatgagtagatgtcacgttggacactttgtgatgtcaggaaaacacctgtgttttagcttctatcgaagtacgagttaagcatagttcgtgaaagtttatgtgaaggttggaaaaggagcttgtgaaatattcacaataccgcattccacgtagcttctgaaaccctggtggagttttaggtattctgtaggatgtattctttagtttgtgaatgaaaaaatagattaaaaacaaagttggggccacagcctgagacagggaaaattgtagttagatccagaataggcctctattcaccagcccagacagccactcttcccattcagaccccaaataaacaagtgcttccaatgggtaagtgctgccaatgaagaaatggccaacaggaaaagtagtttttctcacttgtagtccagagccccagagggactctcctcaacactcaccatttcctctcacatcatgtttgtgcctaataggaccaaataggcccctctagaaaaaatattgcgtaagaaaaaaattctaattgtacagtatttgaagaatatgaggttaaattcattattcaaataatctgtagaaagaggtacccttcctagacatcatttaacataattaatattttggcttgtattttcagtgcatcaaattgattagtcatgaaagtgataggctttgtagcttaaagtagacaaaggtatacaattttcaggttgtgcttatgatatagctaaagaatgaccaccagttgatatctgtctcaagtagagtagtaataaagggcagtgttgtgaatttgttctggatgtgattctgatgaaaggatacacacctgtttaaagtatactaccttgcatgaaattggtgaagaaacctggacttccgcaatagaatttgagatgtgtgaattcccaaaaaatgtgagcacagtatatttactctggattccagtgtctttgctgaagacattatccctagtaaaagacaacaggtgtgcaatagatttattgaatatacttttttcttaaaaatttttttttgagacagagtctccttctgtcacccaggctggagtgcggtggctcgatctctgctcactgcaacctccacctcctgggttcaagcgattctcctgcctcagcctcctgagtagctgggattacaggcacgtgccaccacacctggctaatttttttgtttttcgtagagacggggtttcagcatgttggtcaggctggtcttgaactcctgacctcatgatccgcccgccttggcctcccaaagtgctgggattactggcatgagccaccaagcccggccttaaaatagtatttttaataacagaagcattcacagaaactccagttcatttaatttgcttattgttcttccactctggggacagtaaccattgtttctctttattttgcacttacacatgagccaacgtacaagatccttatttatggatgcacaccttacgtgtgaaaaacctaccccttgtctccaaatgaaagactgcatctctttcatcctgcttcctactggtgactccctcccacttactcctttcctcttgctgccctgctgtggccttttatttcttctcagtccttacccataaacccttctaaaggagatggaaagagagaagtagaagaaattgtgaaatgcaaaggagatgggaaaaggtgttcagaaactgcttgtccatgctctttcccgcatcttccactcactcatgcccagctttcccacttgttcgctagagtcctctctcccactctgccctcctgtcctaaagtttcctccaggtctggacaagcagtgtgttcacttccctcacttcacatgtccagtccggagataccttcctccccaaagttcgcaccatgaccttcaccctccgaagtctgctttaagcaaaggcagcccctactttcattgccagaaagaaaggtttttgggttcttggcatctcaaaagggaactatgaaagcatttttcttctggaaatatcactttgactctgaattctatggtatttttacggctgttttaggtagagcacgagtggaaaagggttttgcaggctgccctgagaacctaattatactgtgtgatttttagtatgggaaactacctttctctttcccacaactgatttatagtcaaacttttggagttcaacaagttgataagttggaggatgatctatgctcaaaatttgagaacagacttggtagaacactggcatttcacaaaaattatagatctttaaaaatcttaggtgggtatttcctttcaacattaatgtgttgagaaaagattgcacatcttgttaagtgctattaaggatgagcattctttggagtatgatgatatataaagggagatcaatagagaattatttttgaagtggatttagaacatgaatacttcatgaaattggagggttaagagttgtttcaagggggagtttcagtgccgtagtagcacaaaaaaattcaaaaatgtgtcattatgagggatgagtaaaataacttactcaccaaaatggggggcatttccttcaaatctaaggtaattttgagttttcagtgatgggcctgcataataaaagccaccaccccagtatacacaattcagtttttctggttgcctaaaacatactaattctaattattccgagtacattttatacggaaagacctttgcatttcagtggagtcatgcagagtgtgtggcactgggtcctacccactgtggctgggacaccctttcagtgagtgctgggagttattccttctccttttccagagcagctcacccaagaccatgggtacgatttgttgcttttacgtagttaataatttagacaagatggcacctgcttattgacttcaggtcatgctaactagaatgtgcgtgtcaccttgacattggaaattcttttgtggtttgtgtcactgcttgcttgttccatgaggctcatctttgaagagatacttaaggacagccaatgctattcctcttcctctttatggcctcatgatgggtttggggaaaggcagaactgtaatggacctaacccaaaagaagcatagggtcctatttggtgaacactttgcacagcaggaagtaatggggtggagggggggaataaagaaacagaagaataaaagaaagaggaataaggtgactctgtggttgtttgcacccacctcagagtcagggcaccatatgggctcagagcagcctatccctgactctctacacccaggtcctgcttttactaatatctaaataaacagatctcctggattgcccttgtactctttttgtgctcctgagtcattttgcatagctatattttcatttttcctcccactttccctgtgtcagtggtggtttaatgaagacagttttcttagcttctgaccgtggtaactcatctccttgtatttatgacttcccaatcctctctttgcttcctcgtgtcccacctctcagtccagtttcacatctcattatatcttctaagtcctaagttgatttaccagctcctttctttcctctttaccttaagcagcctgtgggagtcctctgtcctcatgcagttggagacctctgattctgcatgtgtgatgcctttaccagcacttactcttgcccctacccttctgctttactgaatgtgatttctgcttcctctcttcttgttttcctaccttgtcctctctgcttccatgttattgaatgcctatacaatgcagtgggcagagtaagcaaaatgattaagacatgcatgacctctcacatccaggaatttatagtcttgctgaaaagacagatgagcatctctagtactacatcataagtgattcgatttagtaaatatagtttgcattgagccatttagttcaagtgcttctggctttatcatgttgcagcaaagccatttgtggacccttcaaatggaagcgtccttctgctttgacctggcattgtagatctcactcttcattcctgcacctcatgtctcatccatgtagtacatccttcaaataatgacattcttttttttccataaccattcaaggtggaattaatgacattcttaaatagatatttagagtacaaatctgttttactgtgtaaggggctttggtacatgttatatagagaggggaagagcaggcagcttgactttggagcacttagatgggctgggaactgtgctaggcactaggcataaaatggatacttcactgctcttgctctttgggagttcagcgtgtaggagaagagacagagaagtaaactagctatgattatctagtggcaggtggctgtgctagaggtgtgctcagaggactgaggaagtgcagattggattagggttgtgggtcagccagtttgaaatggtttaaaatataatagacccttttgttttttagcctgcttctcttagatcaaagttttgagaaagtctttttctacaacttgattaagagggtattatttaataattatatctgtaagagtcaaaatcagtctctagcagaaagagtgaaaatcagcttgcatggaaaagaggaaaaggtcgctttgctattaaccaggcttagaggatagacacatttaaagccaactataaaattaacaggaaacattgtttctcccatggtggcacagggctgtaaaatgccacaaggatcccttctttgagtgatgactgctttcttactgctgatgctctcagacttgctttgctattcccatcttttacggagatctttattggataaacttctcttatctcatacaacccctggttaatccctgattcttttaatttcaccttaaaaacagaaaccaatctagaactgatctctgtttcccttagctcttcagaatccttcaatgagattccaaaccctacaaacctacaaaccctcctgcctctttgtcactgtcattttatggattctttaagtgctggcacttgctacaccaagtccacacatctgattttgtcagactgcaggcttgttcctgttagacttctgattaggctttaacatatacatcagagttgtctgttagattgtggtctctaggaggtctgctaatcctgtatcgtacccaccacgctgaagactgggaattgtttaaatttgccatggttttgatcttccttttgggccaatttaagtagatgtccatttgccttgcacatgcctggttattccgatttttgcatgatggataggacgtctcaagtaatttaaaagcctttttttccaccacctatttagattttgtttcaggggtaaaattagttatagttaaatctttgtttgatacatttattgcccctgtaggataatttgcagctatattgaatgaatgctattcatgcaacaagtagagttatccttcagtatactcagtcctagggattgtttccagtaccccctgaggataccaaaatccaaggacgctcaagtctttatataaaatgtcatcatatttgcatataacctatgcacatccccccgtatactttaaatcatctctagattactagtaatacccagtgcaatgtaaatgctatgtaaatagttgttgtactgtattttttatgtcatttttaaatgttgagtttttttctttttctttctttctttgtctgtggttggttgaatctgtgggtgcagaacttatccatatgagggctgactgtatttattgtgtgcctgttatgtgctaggcgttgtggttgttagctgggaaccaagctcctggtttctgtccatggagcttactaatcttaagccttcctggtgtggtatctcttgatttttaactctaccaatgttggtctttgttgcagaatctggtgtaaggcagatttctttgattcaagagctgtatttagggggctaaatagcttttaaactttattattgataatgagtcagaggataatgggattaatttttgaagagtaataaacacctaattcctggaaagtatttttctattttcctaaagttataaacacttagtctactcattgtaacctgaataatagctggggttgtccctctcttatgatcaggataagtaggcttgaatctccattgcttagcctttttcttcccaagatacatgtgaattccacaggtattattatctcatgcccacctcttcttctgagtttctgcttctaaagtattggttgagttatggattctcttgttctcttacagtttgtgtctgtttaagacctcatcaacccagagatgaaattctttcattgatgtccacaagaatacctcacccatacaagtttatgtgtggtgaatctttttttttttttttgagatggagtctcgctctgtcacccaagctggagtgcaatggtatgatctcggctcactgcaacatctacctcccgcgttcaagcgattctccatgccttagcctccagtagctgggactacagacacctgccactacacccggctaaatttatatatttagtagagatgggggtttgtcatgttggctaggctggtctcgaactcctgacctcaggtgatccacccaccttggcctcccaaagtgctgggagtacaggcgtgaaccaccacgcccggactgtgtatggtgaaatttatcaatggtttgtagaactagagtggatattctaagtcacgtagaagtgttgacagctctacatgatgttgtacttccccactcttaaaaataccttggccttatatgccaattcaggctccagcctgtggccatgcttcttggtgacttctttcttttttccctcttcctgtctcttttctgtactacccctactccacatttccattaatttctaatacagaacaagttggaagttcatttttgtttctgtaaatccatgttctcagggtcagcagtaaatacattttttttttttttttttagacagagtctcttttgagcaatctctgttcactgcaacctcccctcccaagttcaagcagttcttatgcctcagcctcctgagtagctgggactacaagtgtgtgccaccacgcctggctaatttttgtattattagttgagatggggtttcaccatgttggccaggctggtctcaaactcctgacctcaagagatccacctgctcggcctcccaaagtgctgggattacaggtgtgagccaccatgcccagtcttgcagtaaagataatttttactctcttttccacatttatatttaaaaaatttagtagtctgttttgggcttcctcttcttttatcagttcttcctcatctgctattgatatccatcaataactctcaataaccagtcacaagagaaatataagcaagaagagagagcagaaggtcaagctcacctaattcaaagggatctatcagtgaataagtgtgctatctgtacttcagagaaatgctgcctcaaaagtaagaccacagtgaaaatcttcccagagagtagcagccttcttcttggataagccatccttctgaatcctcttgaatacattgagataggtatattctctcagggagaacgtggatcaaccttgtttcttcttagtggggtggagaattttagaagtaccaggagaggaagagagaaaggaagagagtgaaactgcaaaactttgccttgctgaaaagtttgtgggaacccgggttgtacttcaggtcagttactcaggtgaatgtccttaagattttgaatatcattattaaaatttcacatttcagtttaatcattaggcataatctctaatgaaacatactataggatttcctacttaaaggctttggttgggaacgggattctagacattaaatggattctagatattaattgggattccaggcattaattattaaccttattgcaggaaggcatggtgattatgtggtttaactcactaacctttagcttgggaattttgagacccaagaggcttcaaagagcgaactactgaagaggtaatctaaatatttctttctttaacttgaggaaaactttccagattatgttaacttgaggaaaactttccggattatgttagtcaggtttattaatttatgaaagaatcaaagaaaataaaacacacttttgcaaattcttccaaaaatattgaagcccctccccaaacttttattttataccttttcccccaccactctgatataactgctacttaagaagcattcttttaaggaaagccagttcacgtcagtgaccaaggtgactcccaagtattcatgaccttaccaaggttttctgctaaagaacaactgctatatttcatttttctttcacactttcttgttttacccttttgtcagcattgaactgtgtgtatggatgtgtatggatgcgtgtatgtgtgtttgaacaagactaagaaagacagaagtgtatctgtcaaccagtgaaatatcagtctaatgaaaaatattcatcaataactctcaatcagctctgatcaaaagctaaaagattggtgattttactttagctttgaacatgtatcatggcatttgttccaaatatctggcatcctctctttggcatttaggcatgatgttaggaagcttaataactgtgaaattagcagatatgcatattagagcatgtatagttttttatttatagtgataagctgttctaagcaaagagaaagttaataaatgtttagaaaagaattattaaccttttcagaaaaaaataggaaaagtaataaaatattaaattactaaatatgtgtaaaataccacttgttttttctctgcctgacttatttcacttagcataatgttctccaggctcatctgtgtttttgcaaatgacagaatttcttttgtttttatggctgagtagcaatgaagctcacatgtggaatctaaaaagtcaaactcatagaagaaaaaaaaatggtggttactggcgcttgggatgaggacagggtggggaatggggagatgtttatgaaagggtacaaagattcagtttgacaggagggatatgttctggagatctattgcatagcatgttgattataattaataataacgtatatttgaaaattgctaaatgagtttttaaatgttcctactacaaaaagtgataaatatgtgaggtgatagatatgttaactagcttgatttaatcatcccacagcgtgcccatatatcaaaaaattatgttgtactccataaatacatacaattttgtcaattaaaaataaataaaataccacttagttgaaatatcaaactattctcaatacagattttcttttaaattctgaccaaaataagatccttttggcaattgaacagcaacacctattgaactgagaggagcttgttcttatattgcatgagattcagaaatacagaaggtgaaatttaggactgtgtagtacagtgcatgatctgaaattctgccaaggtatatcaagcttttggttgatggcagtttagatacttgtgcacttgtgagaaaatcaatgtttagatttatatttcaggataattattagaatgagcttattgagttttctggtgaaatcagaggaactcgtcttgatgaaagtatatttccatatggtataaataatagaaaaatgtgtctaaatcaatagtaatgtctagccagggaagacaaataaattgtattcaactttttattgaatgctgctcatgcatgattttacatttcctcaagaatatttaggcggggcacggtggctgacgcctgtaatcccagcactttgggaggccgaggtgggtggatcacgaagtcaggagatcaagaccatcctggctaacacggtgaaacccgtctctactaaaaaaaacacaaaaaattagctgggcatggtggcagacgcctgtaatctctgccacgccggaggctgaggcaggagaatggtgtgaacccgggagacggagcttgcagtgagctgagatcacaccactgcagtatgggcgacagaaagagactctgtctcaaaaaaaaaaaaaaaaaaagaatatttaccaagagccaggcagtggactacattctaggcctgcagatataaaaagactcacgtgccaatcagaaatgacaacaaggtaattgtaggaggactctctaaagagttttaaaaggtaagatacatgaaaagagtaaaaatgttggaaagtaatatcagagattattaatccaggggaagaaaagtattatttagacccaattaataattggcttcaatacttacaaagaatgtggtaatcagccctctacatcatagctgggtaacaaaatgggggtaaaaaacattaagatattgtgtgaagattggtgaatttgagttggtttgaaagaaaacccttttttttttttaattggagactactaaaaacttactgaaggagaaagagtgatacctgctttctatctattttaaatagaaatacattcttctgacttgcacatttcggttgtatgccaagatggcagaggtgaattgaggcttatttaaatttcaaaatgcgctctaatctaaggttttcggggtcagagccttcctgtggaagcccagaaggagcgctgcccagctgccacactccacggagaagtggctggtgcaagaagactgccggagtgactggcagcagtccgtattgacacctcctgtcttgatttcctgtttcagagagttcttccatgcaaataaacatgcgatgctgtgattttctgacttacagtcaatattgtttaagcaaaaaagtaacacaatttgaagcaacactgtgaaagtaaagggtttgaggaatattcctgttttgccgtatggttttcatatttagaactgaaggtagcatagcaccctggacggacatagcaaccacctaaagagatgtttcagttttcccccactaactgtatgtccagcaaagatgcattaaaggaataagggaagtaaagcccaaaggagtcagtaataagaaaccagtatatgaagtcatctgtgaggatgctttcacatttgattaggatatagaaacttattgggttaaacactttaaattttatttctctttaatgtagaacaaattctctgtgtgtttgtgtgtgtgtgtgtgtgtacgcgtgcacacatgcgtgcgccctcttacatgtctgattgttggggaagtatttttggattttgggaaactttgtttcaaagatctagagcagcaataaatctttggacttttcttggaagggtagtttggtgagaacactgtgctaatgaggccaaggacttgggcttgaatcccactcttagatctactaggtccctggccccagactgttccctaaataaccagctgtcctctcaaatgtggtactggttaaggtttgtgggaaagtatacatgtaattcagcctacatctatcaccgaactcagaaaacaactaaaaaggtccatgtctcgaaagtaggaggctaatagtcctatctttatgtgtaaaataaaataagtttcagtatagttcaaaacagatggatggaggcattttttttttttaaaaaaaaggtaggtctctatttgcacttggctgatttcagcaggaaatatgcaggcagtatgccctagtgtctagcttggtcaacaatgaaaattcccatgtatcattgtgaaagcctcctttataagcagccagccagatcaaactcagatgtcatcccatgattacatagtttggatgtttggtttgttgaaataaagttgatttcagcccacctcttagctgggggtagaacttttaagtggtgaaggatcgtgggagagagacaaataaattgactttttatatttgcagtgtctaatgtttaacctggaactgttctctctaggaaatctcaaatggcaatctctgctgctttgtattttttccctctttctagcagtgagtatgtttgtgtttcaaagatctgtgaacctctatggccatctttgctatttcaaattacatagccatatgtaactgggctgccaacttttagaaatttttagataatggccaggttccatggctcacgcctgtcatcccagcactttgggaggccaaggcaggtggatcgtttgaggtcaggagtttgagaccagcctggccaacatgatgaaaccctatctctaccaaaaatgcaaaaattagccaggcatagtggtacgtgcctgtagtcccagctactcgggaggctgaggtaggagaattgcttgagccggggaggtggaggttgcggtgagccaagatcctgccactgcactccagtctgggcgacagagtgagacattgtctcaaaaaaacaaaattttttttttagaaaataagtcatctaatatcattcaagttgcattttgttaattatattctaagtgataaaactccatattcatggcttgttttcttagaaacgagtggataactagatttccagtattacaaattttgcattagctagttttagatcttccatgctagtttttaaaagctggattaaaaaaagaagtgtcaattaaaaatatttttactacagcaaatacattctgttagtatggcttttgcaaatgcatagcttgttttgcatgaaggctcaactgactaatatttaatttagtcaaatagtatatgaaaattgaattaaattgcccttccgctagccggtacttcttctaatcagattgctattcccttgtgttatttctattttaattaattttatcaataatattgattaactttgactttcctcacctattaggctaccataagccaggggaatcctcagaagcttcctggaaggaatgatgtatacattgtgacctaaagggaatgagtatgttcaccaggcaaacagaaggaggaagagcattgcaggcaaaggagatggcatgtgtgaacgtctgcagatgagagagcacagggcacattcatctacatgttcatctctgcatgaacatgtatataatgcaatccaagcaatgtgattgtctactgggaattttcagcatttttacttagtgactcttatttattccgaaactctattcctctccaccgcttcaccaattcatttccttatgtataatcatattcaaatgataattttccatctctttaggaattccctttgctctctctatcttatagcatcaagttagtggatcaattttgatgtgtgcatcaaatttggtgtcaaaagacccatccaacacttattataaatatatccattcatagacaatcttggttagatgtccacattttaacctgtaacaatgttagtttagcttgtgtgtcccaggcaccatgtaattactctgagtacacagacagaattataaaatcataatggcactctcctagtactccatcaaagtgatcctaaaggattacaaagatggttttgttggcagcaattggagaagaggagtctgcagatgaattgatctatggtctctgctattattttaagccttctttcatgtgggagggtttggaccccaagggaatgacactagtcacaaatttatggctctcacgttttggtggtaaaaaattaacatcacaaattctttcatcaaaaaaatgatatgagcaccagtttatgtgccaggcattatgttagttggatttgcaatggtgaatatatcagacaaggcaagctttcctgaagctggctgtgtagtggagaagatggggccgtacgcaagctatccgaagtgtgctgtgtgggaggatacaggcggcacaggctgctggaaggatggctaccataagccaggggaatcctcagaagcttcctggaagaaatgatatatacgttgtgacctaaagggaatgagtatgttcaccaggcaagcagaaggaggaagagcattgcaggcaaaggagatgacatgtgtgaatgtctgcagatgagagagcacagggtacatttgagaaacatacatgtgctgtttggctgaatcacgggaagaggttgggatagaaggttgggaatggaactatgtgagagacaaggcatgggaggtagagaggtaccaacatcaggggttttaaaaagtaatttatctttttcctaaaaccaaccaaaagctgctgggcatggtggctcacacttgtaatcccagcactttgggaggctgaggtgggcggatcacctgaggtcaggagtttgagaccagcctggccaacatggtgaaaccccctctactaaaaatacaaaaattagctgggcgtggtggtgtgtgcctgtaatcccagctacttgggaggctgagtcaggagaatcacttgaacctgggaagcagaggtttgcagtgagctgggatcacaccattgcactctagccttggcaacaggagtgaaattctgtctcaaattaaataaataaaaccaaccaaaagctattgaagggatttcatcagggaattgacacaatgactcttattgctacagcaaggttggaggccaggcgaccatgtgttggaggtaaatgtgccactcatgatgggagaggctgttgagatggtggaaggattagatttgagaaacagagcttagtgattgagtggatgtggggtaatgaagaaagattagctggatgatttttgagtttctggcctgggctactggatagatggcattccctttcgtgaagacagggaatacagttgttgtttttttttaatggcggtgacaggcagagatatttgaagcattaacttttgaatattgagccagcctaaatgttagaagatgcacaaaactggaactcactgtgagtgtttgtgcatgtgcacatgtgtgtgtatgtatttctttgatatgtgtttagtcagtgttgttctaagtactttacaaagatgatataatcctcacaacaaccttatgaagtagggattgttattattctgattttacatgggaggaaattgataatgaaaacatgtttctcaagagctcacagatgagggactgtgtgttcatgtattgtgtgttaatgcagaaggaagcgtttcctaagaattaatgcaatttaattaaaagatgatcattcagtgtctttttgcacttgaaaggatgtttgtgggagtgaagggttttaaaattttttaataccttgatttaatgatgataagaaggataaaatatataagaaagactaaagaattaggaagtgaatccagaaaagggataaaatattctttcaatttccttaatagtctttttttttttttttgagacggagtcttgctctatggcccaggctggagtacggtggcaccatctcagctcactgcaacctccgtctcccaggttcaagtgattctcctgcctcagcctcccaagtagttgggatcacaggcacgcatcaccacacccagctaatttttttatatttttttggtagagatggggtttcaccatgttggccacctcggtcttgaatgcctgacctcaagcgatccgcccacctcggcctcccaaagtgctgggattacaggtgtgagccaccgtgcctggctcttaatactcttctttaacaagtcatcattagtcacaaaatattgccgggaattattttagttgtattctcaattgacatttttttttttggctttgcaaatattccctataggacaggatatttatgttgaatgtttccaatacagtgcttgaaaaggctttggcatatctgcttataaaaaggctcccataggaaaccagaaatatttttacatggaaatttacaacagagtgtgaagagattacagagagatatatagagctgagaatcactgaatgcattttttatttatttatttttattgtactttaagttctgaatgcatttttaaaaagtttttactgtgctactgtcaaagggccatttggtttctttagctgttttttccagatgtttcgagtaacatttaccaagttactaagcaaaaaacgcaacttgaaggatgggaggaagataataggggagagcatcatgtgttggagacaagctacttttctccccaagatctcaaggtgtcagttctttgatctttatgagcctcatgttccttatctaaaatgtgaaaataatactactatcttttaaaaattattgtgaggattagaaacatataggtatgtgtttagctcctagcactgtacctaatacatatttagaattcagtaaatggaaattatgccatgttgttgctgatgttacaaagggccacattaattgaatagctcataagtgaaataagacagggtttacttcttgaagactgggtatttggaaaaaaaaataaaaaaaaaaggcagggatcactgacattatattggctgctttatcaggctgtgactaaaaggagaaaatgcaaatgcacattaaatgtaaatgtaaatgtaaatgcttggtcagctacaaatccctctacaaatgttatgtgatacttatcattacttctaaaagaagtaatcatagagtgaatgtttgataaatagttgagatcattattatataaatatatgaaaaggaaaatatttcagcaaataaaatagcacataatatacttctatgtgtgactggatcttggaattgttcttcacatgtttagcgtttgcataatttcacaaagactgagagatacagagagagtaaaatacactgtgaattagccaagagttttccttgcaataagtggaaaaaaaaagaagtctctgcttcattttagcagaaaaagaatttttgaaaatatgttaaatatccttcaaaatctctggtggggctggagaactacgttgagagaataagcagccaggaaatcaagacagccagaacccagattacactatgtcaccaggaccaagccattaaagacagtcctgccaccaccattgaacagtggagacattcagatttttaggctactgcccccaacttttgacagtggatattgtaaatacttcctctagaacctggatttggttgctgttgatggcatgattataccttctttgctttgttggtccatcagtactggcgtaaaagcctgggtgggactactgggccaagctaggtgatatggtttggctctgtgtccccacccaaatctcgttgtaatccccataatcctcacatgtggagggtgggaccaggtaggaggtgattggatcatgggggcagtttcccccatgctgttctactcatagtgaatatgttctcacgagatctaatggttttgtaaggcagttttccttgctcttgctaactctcctgccaccacgtgaagaaggtcgttgcctgcttccccttctgccatgattgtaagtttcctgagtcctcccagccatgcagaactgtgagttaattaaacctcctttgtttacaaattacctagttttgggtagtatctttatagcagtatgaaaacagacaaatacagtgggcttggctgcaataggctgacaaagtgaacatctggcctttttaccttctgtgggtggtggtgggatctgcttccctgccagacacatatggttggaattctattcaaatagaaaacgcattcagatgctggaaagctgaaatatgacaaatacttactatacatcctttgatggtcgaataaccacatatcttttgtttctgccaaaattaatgccgctaattctaatgcttttgaaaatacactcctcctcttcaggaggaggcaacctcaagtctctttagttatcgcatcctatctcacttctcacagggcacatttgcctggtgaatggctttgtgtgctttgaaaagactttgaggaagactcaaagcagttacttgtgatattattgtaggatccttcagcaaagtaccaggtcttcccttcaattttgggggctgtcaggtctggtaattgactgtggggttgagatgactgatagtttacatcaggccacagtttacatgatctagctattttttgttacacaaatcaagtagagggttgtacaagtcttttaatcttgggaatctcgtgatcatttagtcaccatcataaaatccattgattgtggttaccatgtttgctgtgccgccctcttgtgactgctctgcctgctttgtctctggagaataagtgctgtttttctccttttgccaccccaggatcctgatacatcactgaaaccagaaagcccgtttcaaatgcagcatcttccaccagcatgtctggtctagggagaacaacaagtagagtacttttagagttgctggagcaacattcttcaccagtgtgtttctcaaggcctcgttgaagggagtgtgtttgggatcctcacttgaattacatagatagaagattagtgggtggggtgctcatgccaaagctactccacaatttctgtttcctttagcctttgaatccctttctctaagttacatgtttactgtaaacagatagtaaataacttaggctttgcaggccatatagtcactgtggtaactactcaactctgctgtggtagcatgaaagcagctattgatgatttgtgagtgaatgggtgtgtctgtgttctaataaaactttattggaaatcagaagatagacagaatttggcccataggtcatagtttgccaacctctgctctgagttaccttgaagaaaatttggcatcttaaccttatttaatgagggccaccgcaagtcctggttttcgtcaactagctaagcaaaaactcagagctatccaagataacatattgtgtccagcatttccagtaagtatacccatgataaaagaacaatacctttgtttttttcatttgactctctatgtacaaccttcagaagagaatgatactttgtccaatgttagttccagctagtttccagtgaagacattatcagggactatggaattatttaaaaacaaattccactaatcatgcttcagaattactgtactccaattagcaataactacaaactagaagccggttttgtttgcaagggctatcttccctgctctatacctgactttcctcctatgttccttctcctctcttcacttcccactatccattccagttttgagagtcataaaccttccttattctcactgcttaatcatgcccatcagttataactcctgtttctgaaattcaccctcttctctccacttctgccacctctaccatcataacccaagctactgtacaccttgcctgatttgcctcagtagtctcctactgtgtctccttgcacccattcagcttttgcattctgttttatattttatttcatccagaatatggaaacactaatctgatcctgttaccattgagtttaaaactcatcagtgacttcctgttactcttagcataaagataaatgccttaaacttagcctgcaagactttacatcaatgttttttggacttcagttcatgaatcttcagtacgttgaaaatcaatttaggtagttgtgacaaatgtatacaaacataaaatagaacatatcaggctgccctagagatagcaaagataagtactgttttgtgaaattgtgattttggttgcgtgtgtgtgtgtgaattggattggattgcaacataagacgtatttcttactttgagttctggtcaatagaagtctgaaagatactatgtgtgttctggggtcgtcatacctttcaggatccacagtctaacacttccttttgctctcttttctctgaccttgccaccgtctttcaagaagtggagtatgttttttctctctgggaacctggatggaacttgggactacttggaagaataaaatgcaatggaagggacatggcatgacttctggcctttcttctgtccacagcatacctgtgctacctcttatctcagggcctttgcacatggctgttctcttgagtttggaacattctccctcattcttctttttgccttttttgctcatatttaccctagcaccagtgtcatttcctcagggaagtcttgtctgattttcctaactaggtcagttccccattattgatatacatcaggcctttctcctttgcagcacttgctacagctgaattttacctttgtggggttgcatagctgaagtctaactctcctcctagattgtaaactccaagaggttagataccatgcctgtttatactcatttttataccagcccagcatcaaacacagtgtcttgtgcacagaaatatgtgtgtgtgtgtttgtgtatttaatgaatagtaatcatgctgttttcctaatatatgaaaatggctgtaatgagtttttgctttaaatactactgttcttttatgttttaaattgcttagtttaaaaaaaacaaacaaactgttccaattattaagacaacatagtgagtcaccccaaaacttagtaccgtaaaactatgacttattctgcacctggattcctgtgtgtcaggaattcagggagggtgcagcagagatgccttttctttgcttcacgatgtctggagccttagctggagatctaaaagctgtaggctggaaccatctgagggctgttacacatgcatgagtggtgactaatgttggctgtcattgggccctggttcctcctcttcacctgacttttccatgtggtctcttcttgtgggctagattttccttccttacagaatggtggtggagttctaagctgggagcaggaaaaaagagggagactgcgaggaaaagatgcttggacatcacgcagcatcactcctattgcatttattcttccaggcagtccgaagtcatatcccggttttcggggaggggaaatagattccatctcttgatgggaagtggcaaaattataaaaaagaatgtgagccagaaatattgctgtggccatttttggaaaatacagtctcccacactgggaatgtatttcaattacaattcatttagatatgtagctaccgcatgcctttagatgtcagtatatttgatggttactttgtgaatttcacacagggtctcttcctttccaaatctcttattttttagcctcctgaaatgaagaactgatttttcacctaattgctttcagaattaaatacacttaaaaaatagttgtgcaacatgtttattccaatctatacataatttctccttcttggttttctggttgctgaggaagcaacactttcttttggaaattttttcctgtggaggattaccaatattggaaaaagaatatgaagaagctactgagtttgatctcctgaaatataatctgtcatcagaatcaagtagaaatatgttattacatgtacaatttagtctgagaaatctgtatactcacatgcagataatctaaaagaagttactttatataattataaaaaatacttaaaagcatttagatattgctgagtatatccaaatatttctgacgagattcaaatatctatttagatataataaaggttaattctaaatataattattcaataacttttgtactttagtatcgcatatcaaataaaggattagatttaaaatattaccattttgtatataatatacgacccattctagtccatatcatctattcctgtcctagctactcaggaggcaaaggcaggaagatcgcttaaggccaagagatcaaggttgcagtgagctgtgattgtgctactgaactctagcctgggtgacagagcaagactctgtctctgaattaaaaaaaaaaaaaggtatatatagacaacttaaaaaacttcaaactaagaattaacttttatttattaacactgtataagcaatggctcaatgcactttaaagggttgagtagagagagctatgggaattatacattgttaccagagggaattctcttcccgtcttccagttagataggaaagattttatagaaggggcgatatttcattagctgtttgagtgaaagaaggaagatgccaggaagagctggaaacaaaagaaagcaaatatatatctttatcatcctggaaggaacagggaagaagccttcatttttttgccttctttttatttcaatattctttttctcctcaaatattgtagttttaaagtaaatatcccagttgttataattcatctataaacgataaaaatgcctagtttctaaaactgcaatttaagcctttttggcactactctgctgcgtaagggttcatcgcagtattgaaaaatatgattaaaccacagcctacctagacttctcttattcagatagaataatttcagtttcaaacatcattccctgtggatcctgtttctccatccctcagttgctatggctgcccactctttcctttctaagttctctctgtcccccttgagctgtgggatcctgtgtgaacatactaatcttgaaagagatgaaagagtattgaatggcaaagatagcctgccttgcacactagcaaagcaaatttacaagagagaaattctttcaagtgttctttgtggtggtccattttaaaaggttttctgatagttttagaggccaaattccttctccttttgaagctagacaaaatgactttttagagcaaagttgcccaaacaatatgtttgtacaatgtgacctgaccctttactttggtttattattgtactccccacggtgtgaagattgaaatttatcttttgatacatagggcaggttttagagtctttggaacagtacgtgtagaagttacattcagcccggggttgtttggtagttggtaacctggaaacgtaattgccacaacaagccatccaaacagttattcttctgagtgctcataatgaaagtaataccaggagggatcagccaggaattgactagacagcccttgcaaacaaaactgactgctacattttggttattgctaattggggtacagtaattctgacacacatttagtggaatttaaaaaataataataattctacagtagtccctgataatgggttcactgaagactttagttgggactaacactggatggagtatcattcttttttcatttgaggggtaaagtagctaattttttctttgtattcaagaaagtgtaagagacttgctttcttaaataaatgtgtttttcctccagtatttcataccatgcaagtattacaattcaatggaaaggaacacagtgtgggcatttgaacacaagcctctccctgcctgcccccttttttattcattcatgtcttcattttggtattataaaaataaatgctgatagaagatagcgcaggaaagaatgtttcatgtgggatggattttgtgtcatctcatggattccttgaattatttgtattgaatgtaactaaggcacaaagcaagctaggcctcttgttgcaaaacttagatgaatcatggcaatgggtagcttggttctaactccaattccccattctgtttggaatattggatggctaatgttaagttgttgcccaagttgcctgtctgcattgtatcttaagttccaagttattaccattctttcttaccgtaccattataattttgggattgcagggtgaaaatgaggagttgaaatgaaataggatagcaatggtatatttttcaactactctttcaataaacctaagttgaaaagagagatttaattcagcttgtttttcttcttaatattgatacttacatactcaggaaaacaaacaaatgataaagtctgtccaggaagtctagcttctgtgcaaagggaatgagggttaatattctccttcggttgtgctatttttttgtgtgcatacctctttgattacatttactgcctacattttgggtgattaagcttctttagcctgaatcatctctccaaactttcatttatgtgtttccgtcagtagggagggctcatcattttttacctaaatgcttctgttttgcgttgtttatcattgagagatggcatggcatggcatggtggaaaagacgtgaattttggaaacaaatagccttaagtttaaatcctgattctaggacctataatataatttcctctgtggagactggaaaaaactaatgtttatcttagagctgtggttatcaagaaatattaagtaaatatctatcatgtatcggatacatgatgttgatgaaaaatgagaactatgtggctcctgctttccaaggaagagcttgttgtccagcaagcgtagatatgcgtacaaataactgtagtaacctgtagtaattgcttcacagtgtctaagcccaatgttgataagcatttcaaggggcatgcaattaatattgcatgataagggaatcaaggaaaggacacttcagagaggaggtggttttcgaaaaatcagtagttcagtggaccattgagggtgggttaaaaggccaggagtagggacatagaaccataaaatttagcagctgtgttggctactagtttgatcaatatacctctggggcatgattggccatgggcgtgggtttggccctcaaacttggcagaagggggctctggctataacaagtcccaaaagcagggattctcaactcttgggacattcaaactatacaaactccccctgtgccctaagatattcagatacaagttatggcctcaattagttgaacttataagccttgcatattcagatgtccaaagtacagccagtttgatattccttatagagtactttacagaaatctaaactccttattactcagagatctaataatcgtaaatgtaaatctacacaagggaatccactttaaaatcctcagttgtcaacaactcagtgccagtaggcaggggatttagaattactctgtgacctgagcaatagggcttaccaagtttcctgtatatacagaggagatgtatgcccttgaagaaagtatttctctttggttcttgagcaaataacatttattagatatctcggacacagaaactcttcttgttaattgtcagagaatttctacttcacttagaaagtgtctgtattttcatccatgcaaatggaatagcgtgaatctcatttctttgtgcttgccatctctgccatctgtcaaagagtaacacatgttgggcatcaaagaatgcatcaagctaaacatatattaagcagagactagcaaatgcaaggagaaagacaagcacatttgagaggcttttagaaattttttttatttaaagaatattcattttgtttactagtaacactccataaattcattataagtttataatgttgccaggcgcggtggctcacacttgtaatcccagcactttgggaggctgaggcgagttggatcacctgaggtgaggagtttgagaccagcctggctgccatggtgaaaccccgtctctactgaaaatacaaaaattagccgggtgtggtggcgggcacctataatcccagctactcaggaggctgaggcaggagaattgcttgaacccgggaggcggaggttgcagtgagccaagattgggcccttgtactccagcctgggcaacaagagcaaaactccgtatcagccaataaataaataaataaataaataaataaataagtttataatgttgattgactaaaagtggactgttgccatgaaaactaattatatatatgaaatgcagacacattacatgctgacagttgctaaagaccctgaagctattagcagaaattagttttaagtaagcaagattaacaaagtgtcaacagcaatgaaaacaaaatgcttatgtaagggagagagatctcagggtttatagtcaaaagtcctaagctgggtggcccgtggcctcagtttccttaactgtgaattggtgacgaaagcaacacttggcctaacctaggtttccctgtaattcagttcccctcatcaaatacatactatccagttaattgtaagttttgacagtgcagttaccctgactgacttgttcatggttacagagggatccatagacatttgttgcctccaatttgccaggtgctgagctgtgctgaaggaatgagattatggtagaacacaatccttggcctcaaagtgagcccatctatctggggagtagttagcaaatactgcaagtagaatacagtatggtatgggttaaatgaggatgtaaatgaacatttttatgcattttttttttttttttgagacagggtctcgctctgtcacccaggctggagtgcagtagcatgatcaaggctcacttcagcctcgatctcccaggctcagggaatccttctgcttcagccacctgactagctgggactacaggcatgtaccaccacacctggccaattttttgcacttttagtagagacggatttttgccattgttgcccaggctggtcttgaactcttggacttaagcgacccacatgcctcggcctcccaaagtgctgggttataggcataagcctccatgcccgctcatcatacatgctttttattgatacaaatgatggtgtttttttcttctgctagataaatgttggcttcctttctatatctgctctctttatagttaatatatatgtcacccagctcttaacatgctttgtatgatttttaattttatggatcatctatagtaaattttaaatttttgactaattttctactatccagggagctctagggcatgggggggtccttctattggttggtgtattctaaaaatggagactctttttaacatttaacattagcttgagtcaaaaagagaggtggtaggtatcccgatgaaatgaaaaggtctgatttcctccctcccttccttccttccttccttcattctttccttccttcctttcttccttccttccttccttccttcctttccttcctctctttccttcctctctttccttctttttatttttctccctgtctttctctcttttttcctctcttcctttctttctttctttggttttggaactttgcatgaaacttgatcaataattttaattctgcattcctacatatgttgataataaagaaaaattacagtagtttgtggtctgggattcaacatgggtgtggggaaggaagaactgaaataatatcaagtaaatattatggtagtaagaacagagaggttgtgacactgaaaaacagtttcccaaccttttaattttatttaaaaaccagagacatggtaaaataaatgtgactcatttctcattcacatgtataatatatatatttttaaaacaggccttgatattatactaaggaataaactctgctctataggctgagatgtgaatgtgatgaagaagagagagggagaagaatgttctggattttctctagtatgttatattaaaacataacaaaaatccactgcacctgctatatgtaccctgaacttgcagaaaattttgtggaatatgtttgctgaaaaattctggactaagagaacatgatgatgctaatgtgactgaaatctttgattcttctttgaggaacaacctcacagaaatggggccatcaggtctcccttgcgacatcttcaagcatgtgagggacgtttagtttcttagagaagacaataacccccactcatctttgccagtgggagccaagatctaggttattcttaaaggaagacagttgattgaggcttccagcctctcacattttctctagatggcacaataacttacattccatgctgattttcctttcgcccagaggacctcataatttgcttatttgctgtaacataaaaacggatcacagaataaagatggcaaatgtaagtgagcgcttttatttgagaaccgaggagaagtgtgaggaagtagatatcgtgctctctcactcctagatggaacgttttagttttgaccacggggctctggagattctggttttggattattctaagaggagagggtctcttcagggaacctctgattccaaggcattctctgtggtaggcaggctgagagtaagacgaacatggccttactcttcattgcatttaatgtgaaatcctttcttctacttcttgtgctgtctttgatgtagttgaactatttgagatgccaaagtgtcatagctctctctctctcttttctttctttcttttctgtctttctttgttttttttttttagacaagctcttgctctgtcagccatgtgggaatacagtggcacaatcatagcttactgtggccttgaacacctgggttcaagttttcctcccacctcaccctcccaagtagctggaactataggcatgagccaccatgcctgcttaaatttttaactttttgtagagatagggtctactatattattcgggctgtttttgaattcctatcctcaagccagccttcagctttggcctcccaaagtgttgggattacaggtgtgagccactgtgcctggccccaaagtgtcatagctctttgatgagctaccctcacccaaacaatccagggagacgaggcaaaatatgaaaaagatgggacaaatagggaacagactttgattttcttgctaacaaatattaacaagtgagacacactcagtatcataaacaacttttgcttttgcttctgcaaatctggatggaccaaatacagattttatttctttatgtgtttttcttaaaccagtttcactgtcattcattttcctttcttaggtgaatgtgtttcattctagtaggatagagattagcttacagtgggctgattaggtaagggggtggtcactggggccattgacagttttaaactgttactttttgcgagcttcttacactttttgaggaaaaaactcactgaaccttgagcgttcttctgtatcaggtgctttgacctcctggatggtgcagttttgatgtgaaagtgaggttcttttgacccagctctacccttagggaatgcaaatatttttccaattaagcttggttcactggttaactacaagccattgtttctcactgttctgagctaataagcttggtatgtgaaaaaagacctccctctgaatattagtgacaaaacccatgagtgatttcaggggctaactgtactttctcctctgttttagtggtatgataaataattactttagtgttaaatatagtttgagtactttttgttgttcttttcaacttgcttcacaaagtaatagaggatcaaatttctttgaaactaaaacaaaacccaatgtaagcaaatgacagaagtttatgcttaagtgcttaaatgtagtctagttacagatggagattgttgctggttgcctcaggtggtagtttttatcacactgtaagtacatacttgtgcttgattattgggagaagacagggagagagatgaagacagggagaggtctcttatgtattcgatcttttatttgcattaaggtctattaagcattatattcattgaacttttcattttgaaatgattttagaaaaaagttgccgaacttacagagaattctttgtataccttacttcacccagttcctttgttaatgtcctacatagccatagcatagttatcaacactagaacattaaaattgatacaattacctaatctacagatcttactagaattttgtcagttttcccactgatatttttttcctggtccaggatcccatctaaaatcccacgtcttgtttggtgttcctatctccttaggttctgccaaaactaggttgttttgatagaaaactaccaaactaccaactaccctgtgactgttcctcagtctttcatgaccttgacaattttgaaagtcagttatttttatttttaaattgaggtggagtcttgctctggaggctggagtgcagtggcataatcttggctcactacagcctcagtgtcctgggctccagtgatcctcctgcctcggcctcccgaagtgttaggattataggtgtgagctaccatatctggcaagtcagttattttgtagatggtcctttaatttaggacatatctggtgttttcttgtgatcgggttgaaatgattcatttttggagatgtcaacaaaaagagtcaaactctgtaaaatattttaagaggttaattctgatccaaatatgagtgaccatggcctgtgacacagccctcaggagatcttgagaacttgtgcccaaggtggtcggggtacagcttggttttatatatcttaggaaggcatgagacatcaatcaaatacatttaaagaaatacatttgtttggttcagaaaggcgggacaactcaaagtgggggcttccaggctataggtaaatttaaacattttcttgttgacaattggttgagtttgtccaaagacctgggatcaatagaaaagaatgttccggttaaagacaaaggattgtggggaccaagttttattgtgcagaggaagctctcagatagcagacttcagagagagcaggttgtaaattatttcttactggacttaaaagggtacctggctcttagttgattatctcctggatctggaaaaaaaaaaaaaaaaatggaaggaaaacaaaggggaaaggagattcgtatagaatgtggatttttcccacaagagactttgcagggcaatttcaaggtatggcaaggaaatatattttagggtaaaacatttttattttcttccttgttatgccagaatcagattggaaagtaagtcacgatatgcaaggtcaaataaaacccatctgatgagaatttatgatttgtaggttatgactccccagaccccttagataggaatttgggcaagataaaaaatcagagcttaatcttcagggagcaaaaataccaggaaattatgttccctgttcagtgcattgtattagaagacactgctgaggaaacatgattgaaaaaaaagtcttttcccaatccagaaattctctccacaaaaggtagtagagaaagaagagtgttattattacacaagcgttaaatcagaatatgacacccatcacaggcaatccatgaaacgattgcaaagacaaaaagaaatcttacccttttagatagccaagtagaggctacccattacatacatgttttcaagataaacaaaactagtcttcaagaaagagggcttgacagcatcatttgtcacacgtaattaattcatcctaattttaccaggtatttggggtgaccatttgtattagctaatttgtttttatccaaaggagaaacaaacgtctcatgtctttatgacaggaagtttggctcctacccagcaaagttaggatcctatcctcccacagagactgggaaataccagtgatatcgcttttgctttttgcatttcaaagagatgactgctaggtccttgagtgggacatttctgggtcataaagttgacaaaaggcctaagtagtgtttaaaataattatgcagatttcacagagaggacaaagtacttatactctagtattctaaagcaaatgctctgataaaaaggaagggagggagatctcttatttttagaattaaacctcttatttttaatttgtatttgtccttgcagtacatgatgctgacatgtcatattactggtgagactgactttgatcagttggttacggtgatgtctgccaggtttccccactgtaaagttaccattattttttcctttgtaattaattaccgtcttgtggaggagatagtttgagactatgcaaatatactgtttcttaatattcatagtttcacccacaaattttagcatccattgatggttcttttctgtagtaactgttactattgtgtttaccaaaaggtgattttctattttcattatttcttctacatattaattggaattcttctatatggaagaattgccctcatttattttttaatgtatttattcaatcatttatttgcatcagtatggattcttagatatttattttaggtgttaaaatctaataatatcattcgttttgttgcttaaattattcttgatttggccactgagaactctttcaagttggcttttgtgtctttccagtacggccctgctgtttttttttttatttttatttttttatttaattactttccagcaccacaagatgttccaggcttgtcttatatttttctttctctggccctggaataaattgtttctccaaggatctctagtcccttttattggagaatggtatttagaaaccagcatctgggcattaggggtgattcttgctattgaggtttcaatgcttttaggccctctcagtagacagaactagaaaataaatgtacatatataactatacatacatacaaatctagttatttctgtatctattctgtatctattatgcatgtctatatgcaaatagatattttaaacactgagtttgtagccgagtgtggtggctcatgcctgtaatcccagcactttgggatgccaaggtggacggatcacttgaagtcaggattttgaggccagcctggccaacatggtgaaaccctgtctctactaaaaatacaaaaattagccagttgtggtggcaggtgcctgtaatcccagctacttgggaagctgaggcagtagaattgctcgaacctgggaggcagaggttgcagtgagccaagattgtaccactgcattccagcctgggcgacagtgagactctgtctcaaaccccatcccccacaaaacaaacaaacaaacaaaaaccaaaaaattgagtttgtactgatacctccagttctactccagcaccacggggtttattctagtctgcctcagttccttatttgtaacttctttctgtaatagtaggaaatcctactctcatcatccacattacatttatgtattggtttacttttaatgtagattcaaaatagatttagaattgctaacctatactcttatgagaagcatttgattgactaaagtacagtatttgtgtacagctttttgtcgttagacttcagtatatagtaagaataccgttttcccaagctctttgggttagtttcttccttcaccgtccatttattgatttgtaacacagttaggttcatttgttactgtatctttctattttgtgttcctcctatattttggttggttttaattatttgccatggtcctaaaagtcataagctatacaaaatatatactgagagaagggttgctcctctccctccatctctgctactcagttcctacccacacactacccattacttctacttatttcctgtccattctctgtaggaaaccactctccttagattctggtttatccttcctgtccttatcctgtccttttgcacaaatgagcagatacatgtatacattttcaaaatacccttcttacctatatgtagggtagcatactgtagatagtctttggcactttactgtatttcacttaacaaaatgtcttgggaaaatctctcctggacattggtctaggcaaagaattcgtgactaagacctcaaaagcacaagcaagaaaaacaaaaatattctgaatcaaggaccagagaaaaagacaaacaaaacaaaacaaaagtagacaaatgggacttaattaaattaaaaaacttctacacagcaaaagaaataatcaacaaagtaaacagacaccctgcagaatgggagaaaatatttgcaaactatgcatcccacaggggactgatatccaaatttacaaggactcaaacaactcaaaaaaggaaaaaaaaaaccccacaaataatttcattaaaaagtggaaaaattcatgcatagtcatttttcaaaagaaggcatacaaatggccaaaaagcatatgaaaaactgctcaacatcactgatcatcagagaaatgcaaattaaaaatgcaatgagatatcatcttataccagtcagagtggctattattaaaaagtcaaaaaacaacaaatgttggcaaggatgcagagaaaaagaaatacttatacactgttggtgggaatgtaaattagtacaactgctgtggaaaataatggagatttctcaaagaactaaaaatagaactaccattcagtctggcagtcccactactgggtatctacccagaggaaagaaatcattacatcaaaaaagatacctgcactcatatgtttatctcagcactattcacaatagcagagatatggactcaacctaagtgtccatcaacagataactggatacagaaaatgtgatataatacacacacacacacacacacgtacgtatataaaacggaatattattcagctgttaaaaagaatgaaattatgtcttttgccgcaacatggatggaactggaagccattatcttaagcgtaactactcagacacaggaagacataggaagtgcatattcccacttataagtgggacctaaataatgtgtacaaatggacatagaatgtggaatgatagacattagagactcagaaggatgctggagcagaaggggatgaatgatgagaaattacttagtggatacattgtacattattccagtgatggatacactaaaagtccaaacttcaccactatgcaatatattcgtgtaataaaaatgcacttgtaccacttaaatttatacaaaaaacaactaaaaaaactaacaacaacaacaaaaaacccagtatgtcttggaaacctctccctattggtatgtaaagatctttctcacaccttactgcaacttcagagccctccatcgtatggatgtgctatatttaagcactctcctatgtatggacatttaggttgtttctaatattttggaattataaataatactacaatgaataaaactgtgaatatgtatttttgtctcatttgttggaggtatatatttagagtagatttatagaagtggcattgctgggccaaaagatgggggaatatgtagttttgttagacattgctaaattcccctctggaagctttgtgccaattcgtgttcctatcatcaatgtatgggagtgtctgtttctactgtcttaaaaaacaaatatgttgccttactttttcattgtttgccatctagtaggtgagaaatggtatcttggtgttgttctaatttgcatttctctagttacaagttcgaacattttttatatgtgtaaagatcaatttttagattttttttaaaaacatgaattgcctgttcttgtcctttcattttttctatcagagtataaagagttttttttttatttgtataaagagttctttttacattaaggatatttatgctttatctctgatataggttgtgaatattttcttctagtttgtcaattgtcttatgactttgcttatggtgctttttttgtcatggaaaaatgattttttgtttttatgttagtcaaatttatccagcttattgcctctggatatggagtcataattagaaagtctttgtctttaccaaggctaaagaggaattcacccatgttttcttttagtacttgtatgatttcattttgtacttttatattactattccatttggagttcattcttgtctatagtataagatatggatcgaattttctctttttccagagatgcctaggctaccccactgtcccaaagccatttattgaaagtttatctttgctccagtgatttgaaatgccaacttcatcatatactaaatttccatatgtacttcctttggtctgtttctgggctttctagtctcttcctctggtctatttgtctatgcacaagtaccaccctgctaaaattaatttttaaaattatggtttaaaaattatcaaaattgtagtttagaataagtatagtttttaaaaaatgaaaaatatattgtccctgagtctaacattcaaacaattggatttcatattttaaaattatctttcagtttttctccatacatacatctgtaaatacagatgtatgcatgtatgtgtgcatatatgtagtgtttttgccatggaaaaatagctttttgtttttacgaagtcaaatttgtctctctctctctctctctacatatatatgtatatacacatatgtatatacagagttgtaatcatggaatattttatacaaagcttttttcattatttttctcttatattgttttccttgtatttttcatacttgcatcgtctttgtcatcatttttgatagcaatatatactgttttattgagctgatgtcataagttacttaatacaattgtatttagaaaatttctattgtttgagtcatcatctttaagtatatagcttttttccacatcttaattattttatcaggataaatcaggcagacatttactgtcaaaggatataacacattttatgcctctgaatacctaattctacagagttttgaaaaaacatattaattaaaaatgttatcagtaaggtagttttgcctcaaatttctcagcattggataaatgatttttgaataacctgtagaatatgtaaaacttcaggttttcttaaagcactctgaatttggcagtatttaggcatttgtttcttactcgtttatcttaatatttccattagtggcatccatacagctgatccttctctcttagcttctgaaatggttcgctctcttggtttaccccttaccattgcactctcctacctccctgtccacttttctcctgagtcctctggaatttttttctcctccattacccaaccccaaagcttggtcctgaaccattttctttgctttctactctcttcgttgctgagcactttcattttcatggctttaaatatgatcagtatgctgattactcccacatctgtgtctctagccctgacttcatggagccccagcctgcctgcatgaatggcacctctatctggaggtctcataggcatctcagatgtaatgtccaagactgaactctggatccacagcaagtgcaaatgttctctgtcccagtagacagcatcactgtccacctgactgttccaggtctccttcgcttactagccacaaacttctttcagcaagttccagcttctactgcaaacatgtatctaggcttcacccacttttctttttttcctcagtcatcccccaggaaaagctaccaccatctctgacttggataactcaccagcctcctttttggtctccttgcttccattcttgctttctgcagtctcttctccatgtggcagctggggtgatgtttataaaaatctgcagtggagtctaattatgcttaggctgaaacttagccttctttctttggtgtaggaggccctgcattgtgcccgccagcctgtcctttcctccttctccctactgcactccagctactccagcctcctttctgctcccaaagtatttttttggtttgatttcttatttttttgtgtatcactaaccctctctgttattttgtgggcttcatgaaggcaggggtcttgactattttatttaccaacaaatactcaacacttagtccagtgcctgtcacacagtaggtgactgatagatgtcattgaatgaatgagccctctctgtggatagtaaataaactaggaggtacatagacgatttactgtagacagcttctgatttcagaatgtggggtgcctcttagggcctgtctcttcctttggaaggggagtatcatgtatggaaggctttcttctctgcattggggttcttcagatgtcctcaaccactgcagtaaaggctggtggctggtgtggacgacttggttctaggaggttccttaaggtgtaagtgcttcgctaaggagctacagaaacatgcattatctgggactatttatggggctggttatttaaaaaaaaaaaaaaaagcaaagatcaatatcattttccatcctggaacattgcccttaaagtgtgtttttggaaatcaaagtgtattccactagtatatctatcagagaggtatagctattatatagcaatggggaaaacggacatgaactgctgaggcaggattaatttgagtgggaaacatgctcagattcttaaatttaggttttagtcctattacaagaaaaatatatttcttttgaaagatctcaagcacttagcactagtatatcagttttggttaaggacaggacacgtttctctaccttgaaaccacctagaacaatgcaagttagcagcatcattggtctgttgctgaacagttgtgaccctgttaggaagggtttctgatcttccggacttttttccaacactgacacttattcaaatttaattactatcacgtttgccttgtgaaatgtggcatctagtaagcaattgaaactgaagtttataggttattatattaaaaacctagctgatctagtcaatgttcatttttttaaacagttatgagaagattcctatatcggattccattgatgttcataatgatgatttgttccattttggaggttcctattgccttagcaattgtttgacatttagggttagtaaggccatatttttagttttaattttagtgcttttttgtttttgtttttgttttttttgagacaacgtcttgctctgttgcccagactggaatatatagagtagcatgatcatagctcatttcaacctggaacgcctaggctcaggcaatcctcccacctcagcctcctgagtagctgggattataggaatgagccactgcacctagctaattttaaacctttttgtagaaacaaggtctcactatgttgcccagactggtctcgaactctgagcttcaagtgattctcttgccttggcctcccaaggtgctgggattacaggcatgagccaccatgcctggctcatatttttaatagtttaattttaaaagctctatttttgtttgaaataacttgtattttaataacactttagtatttttggagaatgtgagaacttggagagattgctgaaatgcagtgccctcatcctgtagctgagtatgcaagtcacccatattggtgaagtgactgcctccggaaactcagtgaggagctgcgcttctagggctaggagctgactcccagtccagtgctcctgaataagctgcaccaccttattcttccctttacccctttactgtctgccatccctgtaagctcagtgagagtggggaccccgtctgtcctcctctgctgaatcctctgaagagatcataaagccagcacattgtgggtgaaaaactaatatttgccaaaaatgttagcttcccttttcttgccatctgttggtgggttcacagctttcatagtatttctgaaggactgaatgtagatcatgtacagttggcacattctccagtgggaatcctgggggctaaatgacttatttccttgcaggtggaagctgcacccgcccacacgggctgcccgctgcatactcagcattgctcacttttatcttgcattgttatgtacacactgtcagctgctctgcattcctagtggaaaatttacattccactgcctagatatgtttgataaccaaaatcccatttgggaaaataaaacaaaaacaaaaaatggcaatggtgaaatctaagtatggtgtagtaagttaagaaagaatacaaaagaaaagacaaacaatccccaaatacttttattttttttttccccagtgcttgcttagtggcagttcctgtagacttctgagaattctcttgagttaattggttattttttaactttatgggggccatattattctcttaagcatagcattagggaaacccatgggcatttacttgtgaataccttaacaagtattcaagtaacatttattttcttgtaagtgcccattgcaaataattatttttagaataagttagtacacttgaggcttaacattatatattcagaatgcttaggatcatctgtggaaatatttctgtggtgatatattccacagaaaacaataaagagaaaaatcaaaccagaatttcaatagcttaaaaatttgtggtatgaaaactgatttgaagcatcaaaatttcctgagaagacttaggaatataaacatttacttaatatatacttacattgaagagttttccaaagaaggtattacttatgatgggtatcttatcttctgggtcatttttaggttaaaaaagaaatattttactttgctttgttttgaatagcatatcatctgtttgtttgttaatttggtttgagttgttttcctgtctcagtgaatggaggtattcatttagatcacagtacaaaaggcaaaatatgcaaaccgatgctatggtatccattattgggaggaaaatagccatctgaataaggaatgataatccacacttgacagataagccctaacctttcctttggaaatcagcctgtgtactgggtacagcaacatgggggccaataggacccaggtagagatgagtggtttcatcagctcatagaaactaactggacccttctgggaatgttccagacagcttgttcgttataattaaagacatattctctaactagtttctcactggttagtgcaattggaatttaaaaaaaaatattattatataacaatgccggtaaagagattctttccaaaatatttccgtggctggcctgattttgccaccatccctggattatggaatttctagaagttactgggattaacagattttaattttcattccactgaggtgttacgtgtccatgtgaagagaccaccaaacaggctttgtgtgagcaataaagctttttaatcacctgggtgcagtcagactgagtccgaaaaaggagtcagcaaagggagatggggtgaggcagttttacaggatttgggtaggtagtggaaaattgcagttaaggggagttgttctcttgcaggcgggggtgggggtcacaaggtgctcggtggggagctcctgagactcactgtccaggagaaggaatgtcacaaggtcaattggtcagttagggtggggcaggaacaaatcacaatggtggaatgtcatcagttaaggcaggaactggctattttcacttcttttgtggttcttcagttgcatcaggccatctgaatgcatatgtgcaggtcacaggggatatgatggcttagcttgggctcagaggcctgacatcaggttgtacataaattgtactgttagcctcatgtgaagaatatttgatagtagtcaaggggagacagacttgggtgaacgtgagaacgtatgtgctgcaaggcacagtaggaagaactctggtttggaagtcagaagtggattcatgtgactgcttctttgcttactgcatgaccttgagagatggggaggctcatcttttcccatctatacaattagagtaatggtagcctcataaggttattttgaggaacaaatgtgaatataaatgaaaaccttttgtaaattctgatgtgttttacaactgtaaatttattagaaaataactaccttagaatgatattgtgaaaagtcaaagtaacatatggaaagtatttgatgcagttctgggcataatatatgctcaaaaattggtgtcctaattgttgtttaattaaagtatgtactgagcaaattctgtattcaaagcaccaataataggttttttggttatagataaggctgtttactaagaaaacaaataaatatgcagtctacataaatattgatgccattggggaatatgttaactttataaaaagtattgtataaaaagtattgcatgaaaagttcagacaaaatgatttgcattttggaagagagaaattatccagccaagtgaatggtaaatgtggcaataggagaaataaggttacagtgtggtaggatggggtcagctcaaatatgatccaaataatcaagtccagtccaagacacgaggacatcatctgaagccagtggcagcttttataggtgtttgcagagagacatcacatgtttgggtctgtgcttcaggaagatgaattcacacagagttggatgagagaggaaagatgctagaggcaggaatcctggttagaccatgctaggtgcagctcctagaggatttgtgaggacctggccttgggctgtgggggcaggtaagaaggggacagataaaataattttgagtggggagagctctgggatttcatcagtggtaacgatgtgtcctgtggtaacattttcttgcaactgctttgaaaaaaaatgcaggtgatttatgaaaactgaataatgcaaaacaaatttcttatgttttagtgactctgctgacttgatgactgtttaggtatagacagacttttacaaatcttagttttaatgaaaagcattagacatatccagctgggtatacagatttggtgtcaggagaaaaatttggactagagatagggatttggttgtcattggcaaaatgatgttggtcataaacaacatggcatgtgataaatttgaccaagagagtgtttgggttaaaagccgggaaggcagagatggaattcttggggggaaataccaacatttaatgtgagccaaggaggaggagttgttggtataggaaactgagaatggtcacagaaggatggggttcagagacaacatatagctgaactgtgatggagtatccagttatgcagttagtattttcctttgataccatagaagattatatacccaaaatacccgggagctgtactatttcagattaacaatacttatttaattttctggagcttaattttttggagctcgattttcttacatccaaaagagcacaatactagaaaaagatattttagcacatcagatattatatgggatataatgttctctaagacatagccaagtataaaaagtatatttgtttaaaaaacactttaatacaaatctactatgaaaattaatcaagaaaatggatattatgtttctcttgtagttttgcattgaccaaaaacatctgaatttacttgattaatatttatctggtatatctttttccatagttttaacctacccatatcttgtttttgtcttttttttaattattatttttttaatagacagggtctcactatgttgcccaagctggtcctgaactcctgggctcaagcagtcctcccatttcagcctgccaaactgctgggattatgggcatgggccaccatacctggcctactcacgtctttatatttaaagtgtgtctcttataaacagtatatagtgagatcttgttcctttttccagtctgcctgtctctgtcctttagttggaatttttagttcatttgaatttactgaattactggcatgattagaatcgagtttatcatgttatttgtttttttgttccatctaatatttgtttttgttctttcttgtcttttttatgaacagattcatcaaacatttaaacaattatttcattttatctctctattggctttttagctatgcctctttgggattttgttttcagtaggtactctagggctcacaatatacatccttaacttattttagtttgccttcaaataatattatgccagttctgtacaacagtgtaattccatttatctttaatggtacctttgtgttcctattaaatattttagttttatatatgttaccaatctcatgaatcatcattattatttttgttttaaactagtctttaggactaattttttttttttttgagatggagtcttgcactgtcgcccgggctggattgcaatggcgtgatctcgtctcactgcaacctctgcctcctgagttcaagtgattctcctgcctcagcctcccaagtagctgggattacaagtgcccgccaccaagcctagctaattttttgtatttttagtagagatggggtttcaccatgttgccaggctggtcttgaactcctgaccttgtgatccacccaccttgacctccccaagtgctgggattacaggtgtggattaatttttttgagttttaaaaattactcacatatttccattcaatgtccttttatacttctgtgcagatccaggtttgtatcttgtattattttccgtgtttgaagaacttcctttgtgattttttggtagcatgggtctggcaacagtcaattctctcggcttttatctgtctaaaaaaggtctttgtttcaacttcctttttggaggatattttctcagggcactctctgttgtgtctaatttgctaaagcgcatggaatgaattcttcattacagatattctgttttttagttctagaattttcttttgtttctttagagtttcaatttctgggctaaaattcctcttaatttagcatttttccaccttttctactgaattttttaacgtatttataacatttatattaaaatccttatttgctaatttcaatatcatgatcatctctgggtttgaccttatttctcttgataacaggtcgtcatgttttctactttatttacatgttttatagtttgtgttgtgtactagtcattttgtatgaaattttgtataaaacttatagaaatttaaagtaggtgataattatccccaggaaaaagcatgtccccttcttctattgggctgctagggaaaggagctgatcttatagtataatccatagttgagctgggaacaggctgggctgcagttttagttagatttagtttactagtggtttcaaacactttgagggtgaaatcagggcttgctttctgtgcaacaggacttgggagttaatattggtgagatttagaaatctgtctctacaattagtccagctattagctatttccaccactggagattctgtctgttacacagctttccacactatgggattcctttctctgctcttttgccctgctcttggcttttgttacacttccgtgcacttgaagaaggccccatggggaagaattcatgggtggtgtggacttgctctgcatctgggtttccttggtcatgctgactaacacaggctgactgtctatggaggtttattcctctgccttttgtgcccctggggatgaaagcagctgaagatttcttctcccttagaaagggttcatcactctctggaatttagttcatctagacatctttgcatcctaacaaagtgacattggcactttccaatatcagttatggcacatcccctcaaaaatagggcccgttcagtctagtagatctcatcagacatcttagccagtctttctcccatttaaaaaatagtgatactgaaaaaaaaaaagaatgattctttaaaaaatctttttcagaacaatctataatttggatgtatctggtgtattgactccttgataaattgttttctagtctggtgtcttttactagcctttggcccttctcatttatcaaaaagtggtgaaaactgattcattattttgtaaaggattttgttctctttgatgctgtgtgctgtttgctaagtagtaacagtttcctctaaaattaccattttgagaacctacttttccttaaatccatacgataaagaaaatagagttgaagcttttttgtgtaggttggcttatattttgcaagtaagaaatttcactacatatttttctttaaaaatgcctatctcatggacagtcacaaaaatctgatatgtattttttaaagttattgaaaattgagcttttaaattctataatcagttcttccaagaggtttgtggtcattacaattttgtgatagtatcatttaacagcatcctttcctcacctctttagacagagtttgtttttttttggaccaggttttcaagacgtggtgagtgctgagatttgaggcagagggattctcagaagcattcagtttacagccccagggagtgatatttccactttattaattagttcatggagcatccctttgggctagtttagcaggattattcctacttttataggtctagaaattgaagtgtgaagtgttgaattggctcatgtaaaaaggtttaggcaatcagtgtcaaaattcagaattccagagctttagtcagttactcagtttatcaaccttcatcttgttattccaaatatatgtttttaaaggaacaattttgattttattgattttatttttcatagcaaacagattcatccagcttttaacttgaatgttgacccagctgtgatattgacctactgttatggaatttgtgaacttgacttaaattacttatgtaaacttactggattcacatgaagcattttatttttgtatggtcatctgtgacataaaatctaatctaaataagatgtcagagacagggtgatatattggagacagcatgtgatttgtatccaaattctgcactagactcctagctcatcccattccagcagggtaagaatggttaagttacttttgccacctttgactttggaaatatttccaagaaatattttgtctgtctgtctgtctgtctgtctgtctgtctgtctgtctatctatctatctatctatctatctatctatctatctatctatctatctaatctccactcaggggtttgaaatggggttttgccagcctcttcagcctgctccagaatgactcctctctctaattcactcggctaacctacttctcaatattgaaataaatttggtttttcaagacaatgttgagcccagtgcagaatcaaggcaagaggtcagtcatcagtgtgtcctgcttttgcttggtgttgattccttcaccaaatgacaaagtcaaagtacaaagtgaaagtttgaattttgcaatgataacttaccatttgattggtttcgtagtcacagattacacgctggtcagcctgctcaccagtgaactccatccctggctacacggggctctgagtgagaatacctcatactccatctctaggtgtccatctccttgtaactaggagtgttgatacttaatattaccctcatatttcaagtagcatttcttttctttcctttcttttttttttgagacagagttttgctcttgttgcccaggctgaagtgcagtggtgcaatcttggctcactgcaaccactgccttctgggttcaagtgattctcatccctctgcttccaagtagttggaattacaggtgcacaccaccacgcccagataatttttgtatttttagtagagatggggtttcaccatgttggccatggctggtctcaaactcctgacctcaggtgatccacccccccttggcctcccaaagtgctgggattataggtgtaagccactgcacctggcctgaagtggcatttatgtttacagtgcaaggggaagtgtatgggctaataagaaaattgatttaaaaattctaatttatcattatgttccccatcatctaaagccatcatgtccctagagtaccatcaactgaccaaccctttatccccgattagggctctggagaagttcctcttatacccagttgatttggtttaatttttttgtgtgttgtttattacttaaaatgcctgctaaaaatgcattttgtataaaaactggtattgtttttaaaaagtatgaatcattttttataattatctttttgtttcttttacaattcaggtatactactttgagtagtttttcagatttttagtgtatctgaaaacagtaatttagttattttaattatgtaactcaaggaaatataactttaagattagttttcaattcaactggttaatcatgaacatttggggaacacttttgccatgccgaatgaggaaaacaattattatttaaaacagatggtttgattgaattcaagtaataatttacatactcagaatcaaattacataattatttcaacaatcatgtatttttatgaatttcaatatattgtttatagctatctgtgctctaaagcaaaacagcatgttttagacaatgcaacaagatttttaaagttacttattgatataacatattaacttttgcctttaattcaataacccaacaagattttaaaccatcaagaatgggtatggttagagagtcacatattgaagagataacagcagagcatcctctgtatgtgcttagtgcattgctagctaaggcactaaggaggaatgcttaagcccaggaatttgaggttacagtgagctgtgatcgcaccactgtactctagcctgggtgacagagcaacaccctgtctctaaaagggaaaaaaaatgatataaccctcacttgtaagtacccatttgaaacaatctccatgataaattattaaattaaaaaagcaaggtgctgaagaattggtaaagcaggccatcagcgcatttaaaaattgtatgtatgtgctatgtacataagataatatgcatgtgtatgtacagactatctttgaaggaatatttctaactctggttgcagcttggtgattagggcataggagtgggaaggacacttcttttttactgtacaccccctttaaccacttgaattttgttcaggtgcgtgcattacctgctaaacattttattttattttttcttttgagacagagtctcgctttgttgcccaggctggagtgcaatggtgccatctcagatcattgcaacctctgcctcccggtttcaagcaattctcatgcttcagcctcctgagtagctggaactacaggtgcacaccaccacactcagctaagttttgtattttcagtagagatagggtttcaccatgttggccaggctggtctccaactcctgaccttaggagatccacctgcctcagcctcccaaagtgttgggattacaggcgtgagccaacacacccagccctgttaaacattttttaaaaagtcagcgtcacttaatgtgatgctaggtgttagtgtagggctaagaacctgtgtgcttaaaatgaaaaaaagttactatgattaaattttaaaaattgtactctagagtatgacattttaacaaacatttattgtgcaactcgtaggcattgccaagcactgttttaggcacttgagagtcacagaaaaaatattcattcttgtttctctcagagatggcataattctaccaagaatggagtcccataaatgatctagggctactatttgatttttaagataactagcaaagtgcgtagcaaatagtaggggctcatagacataggttcactaaaactctaccacttattatgtgtgattttaggccaattaattaatcaagctccagtttctttagtaaattgggactatagtaatgccacttcaggacactgttttgatgattagaaaatatataatgcatataaattacttagtacggtgcttgccatgaaatatagcacaactgttacctatttttataaattagtgttgtttgtaagttttcctttcaaatcatggggtaaaatcacctaaaactcaaagtgcaagaatcaatactatagtagctgtagcagtttgagacagaaagcgcaagaagaatgagcagggaatgattggtgataactgagctgggccttgaagagcagatggaattccagtaggtggagaaatgaggagggcgttttagccagaggggcaaaggcaaggtgtggatgcaggggatgttttgggaatggaggggagcaggctggttcaactacagtgcgtgacgaggagtctgtgtggaaggagtgttggtaggagatgagggcaccaagtaagcggcacttggccctgggagttcttgcaggccatgcttgaaagtcgggatttatcttccagtattaaaggtggacaccagacggcagaagcctgaagagaggatagggaggaagtcggaataggaataatgaagagagagatggcagctgtacttgagagcggccataaggtcaaggggaaaattaaaggcaccaggtagagatggaggtcttaaatgaatgaacaagcagagacagccggggacaaaatcaagatgtggggttagcttcgtaaaggcatatagttccttctgagacaggcagaaaaggagaaaaatggtgaggatctagatgaggtgagttgtggagggaaggaaagttgaggggcttcgtgtctactggcttctatttcttgacatttggaatgaaatgacctgctgagagtgtgtgtgcctggagtgggattttaagggttaggtgaggggtgaggtgagatgagaggtgaggatttggactatccactgtgggaaatggaaaaaagaactgtgggaggagtggagggctggctgagcaagctatactgaggtccaggtgatggcttgatgctgaaagctggtctcaggtgagggctgctcgtggggccccgtggttctctctaatagcagctgggaccctggaagcaaaaagagaggcaaaggtgatcacatctacccagtggcaagggctgcgggaattgagggtgctggcgtgagtgtacctgattcaatgggggataggggagaaagtgaaacctgggaaaaattgcttgtgtcagtcttaagagaaaagggtggggtcaggcacttggtgggggccaaggatcagaaagcaggtgcatgggaatgggaaaggaaagatgatggaacacagtatgttgggctgcaggcacagcacttcagagctcaagattttataggattattttgttgtttttcagaatgcattgtttaaaaattatcttaatattttcgtaacagaaaatgatttctgtttttttttttttttccacagatcatgagcagtgtgcctagggcttaagggaaattttcctttcttttcttgagagctttgttaagggcttataatattgctaaagggtgagctcagagtttacagaaatgctgagaaaagcaaggttttaacaaaggcacaggaagtctcaggcagttccctagaaactgtagattttcctcataggaaaaaaaaagctaatataagcttagtggtttatattttttttcctttgcttttaaaggtaaaaccagtaatccatagcaggatcaacgtgtcagctcgctttagaaaaccgcttcaggagccgtgcactatcttgtaagttgaaaccctttatacttcaagttaaaattggcttggtggtttccttttggtttggaatttgtgttgtagttttcaaggcataactgtttcagaaggtttgcctcctgttttccagcttgattgcaaatggagacctcataaacccagcttctcgcctccttatccccagaaaaaccttgaatcagtgggatcatgtactacaaatggtcacagaaaaaatcactctgaggagcggggctgttcacaggtatgtcaaaacaatcttgtaagtggaggagtttttgaattgttgaagatattctcaggaggctccggagtcactggtctgtggatttgaattttggctccccagttaggccccgtatgcctcagtttctttatctgtagaatggagatatacctcatagcgttgtttaaaatgaggtaatccacatacagagcttaaaacagtcattggcacatagtagcacatctacaaatattaacgatttttattctttgatttagagtgactaggcaaacataactttagttgagaaggattttttgaaagagccagccccttaacttttttttttttttttttttttttgagatggagccttgctctgtcgcccaggctggtgtgcagtggcacgatctcagctcactgcaagctccgcctcccgggttcacgccattctcctgcctcagcctcccgagtagctgggaccacaggcgcccaccaccacgcccggctaattttttgtatttttagtagagacggggtttctccatgttagccaggatgggctcgatctcctgacctcgtgatccgcccgccttggcctcccaaagtcctgggattacaggcttgagccaccaagcccggcccagcctcttaactcttaattgtccgtttttttttttttaaaggggtcatttatgattatttgatagtttaaactatttgcctagggtaaaaatcagatatcaggaagtattagtgcatttaaagaggaggcatagaaagaataatttagtggggttgtctaaatgtaagaagtcaaaagcatttttttcaggttccaacatttaagtgaagattaacatcatagatttaaattgtgaagcctatgaaattatcccttgatggaggctgacatttattttccgtcagatgggagggttacaaataacatatacatgtgcacaacatattaaaagtatgtatatgtatatactgctttagcagagtacactgtttcaagtgtttgtgttttcatacacacgtgataaaatagttctcaaatgattgcatattacgtctttcaggtaaatgtgtatgcagattaatgtttgtatatttacacatattaatatccacagtctcatagtcattgagattttaaatataattaggtgttttaattgaaaggaatactttacatgtggcaaaaaattcaaatacgatataagtaaagagcatttctcctatcttaggcatgtccagtccttctccctagtacttttcagcatcatcccggaaatattctatgcatgtgcaagcatatacatttttaatttttaatttcatttttttgagacagggtctcgctgtgtcacccaggctggagtgcaatggtgtgatctcagctcactgcagcctcgattgtgcagactcaattgatactcttacctcaacctcccaagtagcatgcaccacaacgtctagcttttgttttttttttcttttttgtagagattagattttgtcatgttgcccaagctggtcttgaactcctggggtcaagcaatccgcccgccttggcctcccaaagtgctgggattacaggtgtgagccactgtacctggaccactttttaaaaacattaaatggaaatgcatacatatgtataaataaataaatacatgtatacaaacacccccttgattttttcctataataaatcttagagattattcttatcagcacagatacctctattttattatttttaatgactacaaagtattttatttatttttatttttatttttttttgagatggagtttcactcttgttgcccagactggagtgcaatggtgggatcttggctcactgcaacctccacctcctgggttcaagtgattctcctgcctcagcctctcaaacagctgggattacaggcgcctgccaccatgcccatctaattaaaaaaaattttttttcgtagaaactgggtttcaccatgttggccaggctagtttcaaactcctgacctcaagcaatccacccgccttggcctcccaaagtgctaggattacaggtgtgagccactgcgactggcccaaagtattctattttaacacaaagtattccaaatcctaattttttcattaagaaatttttagttgggcaacatctcattttataaaatagaatgagtgttcccaacttaattttttagaccagttacctcttttttataatttcatttgtttattttaggttcagggaatacatttgcaggtttgttacatgggtatattgcatgatgctgagatttcgggtacagatgttgtcacccaggaagtgagcatagtacccaataagtagtttttcactctatttccctcccctctctagcagtcaacagtatctactgttcctatttttatgtccatctgtacccaatatttaagctcccacttactagtgagaataagtagtatttggttttctgttcctgcattaatttgcttaggattatggcctccagctgcatccatattgctgcaaaggacaggatttcagtattttcctggctgcgtagtattccatggtgtatatacaccatattttctttatccagcccaccattgatggagcacctagactgattccacatctttgctattgtgaatagcacggcagtgaacgtaccagtgcatgcttctttttggtagaatgatttattttcctttgggtttgatggatatttaggtcatttctaatcttttgctattacatgtacatgtctttttgtataagcaaagtttatcaggatataaaagtctagaagttgaattgttgtattaagtttcaaatgcctttaacattttgatagatactgccaattgccttccaaagagtttattctaatttatattttcaccggaagtctatgaacgggcctgtttgtcatactgttacctgtctagtaaaactaacatttagtcttttcactcatgttgcgtgaaaatagtatttcattgttttgggatttttatttaatatacaacatcatctattgactatttcttatgtgtcaggcattattctcagtgctttatatttttgacttaattaactgagcgaccctatgaggtaggtagtgtttctattctcttttaatagacatgagatgtgagacatagagcaggaaaattatttgcccagggttatggagatactgagtagcagggctgggattcaagcctagtaggcattccggctccagagcctgtgttctaaatgaccaaggtactctgtaagtaaatgccacatatttatatccattgtatctgaactgtctgtcatggcctttgcacgtttatcttattgatttataggcactctccagggttccccaacccccaggccatggactggtaccattccgtggcctgttaggaacccgactgcacagcaggaggtgagtggcaggcgagcatcaccgcctgcactccaccccctgtcagatcagcagcagcattagattctcataggagcatgaagcctattgtgaactgtgcatgcgaggtatctaggttgtgtgttccttatgagaatctaattcctgatgatttgaggtggaacaatgtcatctcataaccatcccgtcccccactccgtctgtggagaaattatcttccgcaaaaccagttcctggtgctaaaaaagttggggaccactgctctagacatattggggaaattggccttttctgatatgttttaagtacacttccagtttgcattttctttacatttcttttttcatacaaatatcttaaattttaatgcagtctaattttcaatctttataatcactacgttttatgacttgtttagatcttccttactccaagattataagaatattctcctatgttttctccttgtattttaaaattttatttaaacctttgattttgttggattttattttggtgtcagaagtaaaggcagatctcaataattacaattttttttacatatataattttgacatttgacatatacatagatgtaaatccaccctataagtaataaaaaggacacaaaggtatatacaggtaatttcacagccagatatacctattcatacatatattaatatgaaaaaatttacacacagaaataaaatatattcaagtaaaaatatagaaatgaaagtatagttatgttgctcaaacacttgaatacttagagaaacttctttttttttaaacttgtattttaggttcacgggtacatgtgcaggttagttgcataggtaaacttgtgtcacggtagtttgttgtacagattattttgtcacccaggtactaagcctagtacccaatagttacttttactgttcctctctctcctcccaccctctaccctcaagtaggccccagtgcctgttgttcttctctttgtgcgcatgtgtcctcatttatctcccccttgtaagtgaggacatgtggtgtgaggttttctgttcctgtgttagtttgtaaaggatgatggcctccagctctttccatgttcctgcaaaggacatgatctgacccttttttatggctgcatagtattccatggtgtatatgtaccactttttctttatccagtctaccattgatggacatttagtttaattccttttctttgctactgtgaatagtgctgcaatgaacatatgtgtgcatgggtctttatggtagaatgatttatattcttttgggtgtatacccagtaatgggattgctgggtcaaacggtagttctgtttttagctctctgaggaattgccacactgctttccacaatgattgaactagtttacactctgccagtagtgtataagcattctcttttctctgcagcttttccagcatctattattttttgactttttaataataaccattttgactggcatgagatggtgtatcattgtgctttttgtttgcatttctctagtgataagtgatattgagctctttttcatatgcttgttggctgcaagtatgtcttcttttgaaaagtgtctgttcatgtcctttgcccactttttaatggggttgttttttttcttgtaagtttaagttccttatagatgctggatattagacctttgtcagatgcatagtttgcaaaaatttctcccattctgtagtttatctgtttactctgttgatagtttcttttgatgtgcagaagctcttaagtttcccaattggtaaatttttgcttttgttttgattgcttttggtgtctttgtcatgaaatctttaccagttcctttgcccaggatggtattgcctaggttgtcttccagggcttttatagttttgcgttttatgtttaagtctttaatccattttgagttgatttttgtgtatggtataaggaaggagttcaatttcagtcatctgtatctggctagccagttatcccagcaccatttattgaatagggactcctttccccattgcttgtttttgttagttttgtcgaagaacagatggaagtaggtgtactgtgttatttctggggtctctatttggttccgttggtctacattgtctgtttttgtcccaataccatgctgttttggttactgaatccatgtaacatagtttgaagttgggtaacaggatggctccagctttgttctttttgcttaggattgtgttggctatttaggttcttttttggttccatttaaattttaaaatagttttttctagttctgtgaagaatgttaatggtagtttgatagcagtaatattgaatctgtaaattgctttgggcagtatatggccattttcatgatactaattcttcctatccatgaccatgggctgttttttcctgtttgtttgtgtcatctctgatttctttaggcagtgttttgtagttctcattgtagagatcttttacccgcctggttagctgtagtcctagatattttattttattttttgtgccaattatgaaaatgtgctcctgatatggtgctcagcttgggtgttgttggagtataggaatgctactgatttttgtacattgattttgtatcctgaaacttttctgaagttatttctcagctgaaggagcttttgggccgagactgtgagattttctagatatagaatcatgtcatctgcaaacagggatagtttggacttcatcttttcctatttggatgccctttaattctttgtcttgcctgatgactgccctaggaagggcttccaatactatgttgaataggagtggcgagagaaggcatctctttcttctgctggttttcaaggggaatgcttccagtttttgcccattccgtgtgatgttagctgtgggtttctcatagatggctcttattattttatgttccttcaatacctagtttattgagagtttttaacttgaagggatgttgaattttatcgaaagccttttctgcatctattgagataatcatatggtttttgttttaagttctgtttatgtggtgaatcacgtttattgatttgcatatgttgaatgaaccttgcatcccagggataaagcctatttgatcatggtggattagctttttgaggtactgctggattcagtttgcaagtattttgttgaggacttttgtattgatgttcatcaaggacaacaaacttggcgtgaagctttcttttttgttgtgtctctgccaggtttgggtatcaggatgatgctggcctcatagaacaagttgaggaggagttcctcctcctcaattttttggaatagtttcactagaaatggtaccacattttgtacatctggtagaattcgactgtgaatctgtctggtccgaggctttttttgatcggtaggctattcattacggattcaattttaagagtttgttattggtttattcagggaataaatttcttcctggttcagtcttgggagggtgtatgtgtccaggaatttatccatccctttcaggttttctagtgtgtgcatagaggtgttcatagtagtttctgatggttatttttatttctgtagggtcagtggtaacatcccatttgtcgttcctaattgtgttcatttggatcttctctcttttctcctttattaattcagccggtggcctatgtatcttattaatttttttttaaaaaccaactcctggatccattgatcttttgaatagtttttcatgtctcgatctccttcagttcacctctgattttggttatttcttgtcttctgctagctctggagttggtttgttcttgctgctttagttcttttagttgtgttattaggttgttcatttgagatctttctaactttttttttggagacagggtctcactctgttgcccaggctaaagtgcagtggcatgatctctgttcattgcagcctcaacctcctgggctcaagcgatcctcccacctcagccaagcagctggaactacaggagtgtgccaccatacccagctaatttttttgtattttttgtagagacggggtttcactatgttgcccaggctggcctcaaactcctgagctcagacaatctgcccggctcagcctcccaagtgctgggattataggcataagacaccatgcccaggcaactttttgatgtgggcatttagtgctataaattttcctcttaacacagccttagctatgtctcagagattctggtatgttgtatttttgttctcagtttcaaagaacttcttgatttctgccttaattttattatttaccccaaagtcactcaggagcaagttttttaatttccatgtaattgcatggttttgagcaatttttaaagtcttggtttctatttttattgtgctgcgatctgagggtgtgtttggtatgattttgattcttttacattttctgaggattgttttatgtttggttttgtggttaattttagggtatgtgccatgtggcaataagaaaaatgtatattctgttttgggatagagagttccatagaggtttatcacatccattttgtccaaggttgagttcaggtcctgaatatctttgctaattttctgcttttatgatctatctaatactgtcagtggagtgttgaagtttcccactattatgtgggagtctaagtctctttgtggatttctaagaacttgctttatgaatctgggtgctcctgtgttgggtgcgtatatatttaggataggtgaaattcttaatgtaatggcagatatgagagatttggttgctgctctcttgggatatgaccgttttcctttaacgttaataaatcttatggttggcccctccctatgcatcagtatattcatatataaaaagcatcccataaaaatttactgaacttgctttttatgtttcttgtgtttgtagcaaaagaagaaagtagagcaacaacagttatataaaagaaggctaaaatcatgaattagaatttattcagtgctgggccaggtgtggtggctcacgtctgttatcccagcaccttgggaggatcacttgagcccaggagttcgagaccaacctgggcaacatagcaaaaccttgtctctattaacaaaaagaatttattcactgcgttttacttacctgcagaggaaacaagtcaaatcttggctgtttccagagtccacagctatgctggtttttaatttctagctatgaaattactactgattgagatataactattttgaagaaaagtagaaaaatagtgcttggatataggccattggctctcaagcaggtatgattttgccccttggggacatttggcagtgcctgaaaccatttttggtagtcccaactggggatggggtggctactgctactgtttagtgggtggaggccaaaggtgctgctaataaacatcttacaatgtacagggcagcctactcacctttccagcaaagaattatctggtccaaaatgtcaataatgccagtattcagaaaccctggtcaagtgttttttgagatagcgtcttactatgttgcccaggctggtcttgaactcctgggctcaagcgatcctcttgccttagccttccaagtagctggaactataggcataggccaccatgtccagcttaagttaaggcaaaaaacatagaattctgggttaagtgttgatatttagacttgttaggagtagaggtacaatgttataaagaaagagactttaccatctgtatactaactaaaaacacaaatacatttcaggaatgttggtggctattggtggctattttcattgtatttcatggttctgtatgatatggccatttatgtcatcaggaaacaagctgacaggtcaatgggtttttttttttgcgtctgtaaatgacatttaatcttattatgtaatataggaagacagaaagctttttgatgatactgaaatccttccatttattaatagctcttgcttataaccttaaaaaatatgcactgtctttctggtttagttttctaatacttattttcctgttctttaaaaaaatttttgtggacatttaaaatcatctggtaaaattatgactgttcttttaataagtaacatattaattgtagctcgtagcagcagttttacagtaaaggaaggttactgtgaaactgctcgattctgggaagatataatgttcactcttgttttgcttagtagggacggcaaaaaaaaagaaagaagcacaaatgctatgcagttctgcatcattaacactggcaatgggttcttttacctcctgccctctcaccccattgttcctgacccggttctctgtgtgtttgtatgtaatattttggttgagggctgttcttacacagaatgtggtcagaagcttgccagcctgatgaatatgctaagaaaataaaatttaaaagtattaacaaggccgggcgcggtggctcatgcctgtaatcccagcactttgggaggccgaggcgggcggatcacgaggtcaggagatcgagaccatcccggctaaaacggtgaaacccggtctctactaaaaatacaaaaaattagccgggcgtagtggcgggcgcctgtagtcccagctacttgggaggctgaggcaggagaatggcatgaacccgggaggcggagcttgcagtgagccgagatcctgccactgcactccagcctgggcgacagagcgagactccgtctcaaaaaaaaaaaaaaaaaaaaaaaagtattaacaaaatataaatagaagaatcaatgttcaatggaaacagagctttatttaaagcactgtgatctgtacaagttaatttttctcctctaaaattttaatatggcagcaatagggatccttatgccagatcatcagactcactggggtgaaaccctgtacagcaagatagtcattgtatctgcattataacattagtatttagtggaatctgataactttgaggcatctataatgcaataatgaggatagtaacaaatgagctaaattaagtacagaatgtttttatttactatgtaattttaatttttttgacatccagaatactttgtaatcttaagcaattctttaaatgttggttaaaattctaattgttggtgttcatattttcgacaggctttatactttagaaggaaaacttgttgagagtggagcagagttggagaatgggcagttttatgtggctgttggcagagataagtttaagaaactgccttacggtgagttactttttgacaagtcaacgatgagaaggccttttgggtaagtcttactccttaccactcctcatgctttagttaccacttgaaatagcattgggtcttttgctgaccaccattatattttatgtaattgataatcttatttattacttagaatggaaagcatatatggtatacattgatctttgtttttattgccatgatgggagactgaaagctattgaacaaaaatataatttctgggaagttatgaaagactacatggtttttttttagcatgcatgaaatttataagtaaatgcaaaaatttattattgtgaagaagatacagggcaatgagcttctctacagcaaacattattagaagtttttgtgtcttaatagttgctagaccaaataacttttcagttggtttggatagaaacatccaagagtgttaaaaaactcataatattttatacttgttttaataataactgtaaaatataaaaacaacataatcccacttatgcaaatagagaggatgggtgtacagttaattcatgtaaaattttaaggattatatttttaattacaatataccgtaaacagtttttctccatgaaatgtcatatatttgtgaaagatgctttatttcagcctaggagatacactgcggagtcactcaagaagagctctgggccgggcgcggtggctcacgcctgtaatcccagcactctgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagctgagatcccgccactgcactccagcctgggcgacagagcgagactccgtctcaaaaaaaaaaaaaaaaaaaaaaaaaaaaaaaaaaaaaaaagaagagctctggcccatgctgcaggatctctcggcttgctcatggtgcccagggatccatctctgttgcttttcccagagattctgtggccaccttgccattgcaaaaaaaaattttttttggttgtcgtccgcagaagtagagcagaatatcaccagtgtgtttgcaattaattcacaatttgtgtaacttgatggagaggctggccaagagcttctaaataagtaatagatgaagtggaatttcaggggtggtgtttgaactatgcaagagcacatggttttctagcacctttgaattatttaccagctgacttatcgctaaccaaccttacccatccatgaaatcaaatctttagccatctttgctaagcagccctaggttaacctgctgtgatcaacagtgtgtacctgatggtaataagaaaactgtaactcacgttggcctttctcatacaattaataagaattttttttatatatgtgtccttctatttttggagagattcagttgggtttcaagatgggtcttttcctaataatacagatatcaacaaaacaacttattcttacagcctaaaagaatttttaactttttggtgaggacgacttgtttaaaaactacctgaatgcaaatgccagtgttttacctctgctctcctatcagaggtagacatagaagacatcatagaaacgaaggaaatttgtttttaactcagtctggaaaaatcattattcacatttggaagtgattttttgaaatgcaaataggacactttgggatctggataaaaatgctatacaaatttcaggtgatactaaaagtttacttgtaagcattgattaaaatattatacaggaaaacattacaaatcttttgggatggaatttggaaatgttatgatctttgtgaaattgggaaagtatgtgttaaagtgtatgttatctaccttttgtgaaacacagcagtaaacagttgacttccaggtggggatgataattatcttgcattgtacattatttgtaaacaacattcagatttctaaattgcaatttgtttccacagtcagaaagcttcttcactacctcctattgtaggatccagaaagtctaaagggagtgtaagtatcagatgctttcctcgttgatgttctatatttttatatgatacaaagagactgtcctttgggcttcaattaagttccaagagataaaacttagccgcttcgtggtgtataaccaattatgtgaaacagcactagaactttaatgttacacttatggtcctaaacagagctaacattttttagaatatgtattttaaaattttttccttgtatatacacctgacataatttatattgcacttaaaatcttggcaataatactttaaactgtaagaaccattgtagtaggtcacatcaatgatcatccagtcttggtttctatctttaacgaagactaaaagggaagtttcgctgagaaaaggggtataatcctcattaatattccttgaaaagattgagaattgttctaggtatttagtttgccatctgaatcttttccatttatcatttattcatggtttgttaattcagcaaacatttattaaatacctactctgtgggagtaacgacagcatttagtaggtaatttcctaaccttcttgtgttttcagtctgcgctccctgatggggtgagctccatgtcatgccagagcgttgccttggcagttcttcctggctgaggcttctctttcttcccttttggttgaattgcccgacaagttgtgatcagaactgatttgacatcttccacccacaccctgaattaattaagcaacattcttattttggtattttgtaaagtaaatgatttctaggcaatgatattgtctcctaatgatttagatccctccttttttttggttatatcatgtgaaattcttgaaagaaagacaaataattttgtgtacataagtagtgccgaactcagcataacagatattaagaactcattagctgagactcttatactattatgacaaaaataaaataaaaatcaatagagctcttgccctcaagcaacttacaatctacttgaaataaagaagatagcttaaaaaggcaacaaacaagctaatgctaaacatcaaatatctagagattggtgaccatgagagggagggaaggactgaatgtacaatggcagcagtccacagaggaagttgaatttgagctctgcctttgaaactgtttaaaattcagaaaaaggtagatgaggggagaggaccttcagatccaagggagggtgagatggttggggcagacgtgggcatgcgaagaagcagtcacgctggctgacatttaccgggcccttgtgggctcaacactatgccaagctctttacagtagtgatttatttaacctcaccccacaaggcaggcatctttgtcatctacatttaaaaaggaatgaaaaaaggaagtacacagagtagaagtgacaggttcaaaggctcccattgaaggcagaggttgcagtgagcagagattgccccactgcacttcagcctgggcaacagagtgagaccctgtctcaaaaaaaatgaaacaaaataacataaaatacaatacaatacaaacaaaggcccctactgagcaaatggcaggggaggaggggaggaattgcatccacacagccagctcagagctcctgctcccgagccccgggacaatgagtcccttaggctgactggaacagatggtcctttttggtgtgggggctgatgtgcctgacatggtaggtggtgacagttattacatgaccttgaatagcagaatgaagagtctagtgtttgtccttgaatagagggcagcccacaagggcttctgagaggtgagaatattaatctgagtccattttgggagcatcagatcttttacatggaggaagacttcacgtggtgagaagccatagataagtcgatggttgtaaggcagttgcaactatcttggtatgaggggaaaggagcctagactggggaggtggtagaggcagcaggaagtgatgattattctggaagaaaccaaggaacaaaggatttgtgtgatgattggatacaaggggttaatggagaaattggggccaaagataactgaggtttttaagcttggaatttgagaaaatggtagttctatggccaagaagaaggcagccagggcaaagaatgacctacgtaatttcaaacgtgttgagttggaagtatcatcaggaaacttagttgaaagtgtgctgcaagcagttgtaaatggcagagctgaggcctgccaaggacatcaggactgaagctgcagttgcaggtggttttttttttttttttgagacagggtctcactctgtcacccagggtggtgtacagtggcatgatcatggtttactgtagccttgacctcccaggctcaagcgatcctctcacctcagtctcctgagtagctgggactccaggcatgtgccaccatgcctggctaatttttgtgttttttgtggagacagagtttcaccttgttgcccaggctgttctcaaagtcctgggctccagcgatcggcctgccttggcctcgcaaagtgttaggattacatgtgtgagccaccgcacctggcctgagttgtagatttgaacaaccatgtaatggtcctagttgaacagcagacgtagcatcactgtggtacttcatcacccagcacagcttgaacagagcaggtctcactggtgctgccaagtgagagaatggatgaggggctcctagaggaagatggtgcggtgagaattacagagggcccaggcttgaggcaacctaacttcacaggtgcggggtcaaagaggagtgagaagaatatttcaggaggtgaaaacaatatcagagcaactataaagctaaataaaactcatgaatttagggattggaaattgtattttgctttttttgtttttctttaggactttgtagcagaatcccttctgtgtactgtatagatattagcttattaattctcacagtgcagctagaggaatgattacagagaccgattgtaattgaataaattgatcaataaattgatcccaagtcacagggaaagtcgatgtcaggaccaaagtcatgacccaactctttgtattcacagtgactgaactttggaatgatatgtttagtattctgaaatttgaaaaactaaaattttaattaaaaatgtgtagagcatttcctgctttaaaatgcatgtgtaggtacacacatgcaatttttatttcttgctcatttgtaagttttttagactgtgctgtgaatactgtgatacatcaatgtcatcacatcaattcatctgatgattgaattttccaggtgtatggcacagtagtaagccccagggatacagcaatgagcgcaaagatctgatgctctctctgatactcgtggtctacttgagtagacaaaagtgaaacaagcgattccattaatcaatggatacttatgaagtataaaaatgaaagaaaagtgcacagtaatatgaaagacaataaaagaaaaacacatttagataggtgtgtcaggggaggcctcatggaggaaatgacgttaagcaaagactcagttataaggtatatttgcatcccatagaaagcaaagttgtcaaacgtagttccatgctatgacttagaaaaataaaatgatagcagagtttgtccctctttccacagtgttcccgtagcaccctgtattcatccactccatccgtcatccattccaaacatactcactgagctcctactaagtgccaggaactgtaggcactgagcgtatagtggtagatagatgaggacttagatttatggtgctttcattctagtgtgtgtgtgtgcatgtatgtgtgtgtgggggggagggtatggatgggatgaatgggagtagacagacgatcaactagtaaacaaatgtacaaatagtttcaaatggtgataaatgctatggggaaaataaaatgtagcagggcattgatttatataaaattgtctgaaactgagaccttaatgatatctaacacagccaattgtgccagggatgaggccggggaagaagagcatccaaggcagaggaaacaaagtcacacaggcccttgctaaagagcctggcatgtgaggagggcagaaagaaggccgtgaatgaaatcggagaggcaggcagggctcaatcatataggcatgcaaagagtttggattttatttcttgatggggtgccatttgagggttatagggagggagtgatataatttgcttcaaaaaaaatttttttttttttttttttgagacagagtctcactctgttgcccaggctggagtgcagtggcatgatctcggctcactgcaacctctgccccacgggttcaagcaattccctgcctcagcctcccgagtagctgggattacaggcgcccgccaccatgcctggctaatttttgtatttttttttttagtagagacggggtttcaccatcttggcaaggctggtcttgaactcctgacctcatgatccacctgcctcggcctctcaaagtgttgggatgagaggcgtgagccaccacgcctggcctgctttacatttttaagtgctcattctggctgtggtatctctagagaaatggtttggggcaagaatagaagcaggaggcagtgggacacgtacaggtatgtgatataggtgagtccgctaggtggccgcagtgggggcggacatctattataactcttctttgagtatattgtcattgactgattcgctgatccaacaactatttattgagttcatatgatgtcctgggactgttctggtgcttcagggcccagagattctgaagtactaaatgcacggaggttacattccagaaacaaatgcacaatacgtgtgatatacaccagggataaacatgaataaaaatacatgaagacatgggaagaggaagtgagagagggtgctatttcagctgggtggttggaaaggcctctttcaggaggtcacgtttgagtagaggagaataacccctggcacagtgcccagtgcctggtaggttctcacaaactcggcttaggcagtgtgtgaatgtttggcattgagccacacagaacttcctatgccagtaaatccaaagtcacaagctcgatttttaacaggattaatttactcctttcctttaatgaattggttcccaggagaatgcatgcattttatagatcattagctgcctggcactgcgaggaggggtgtgagtgaaggggactgtgtggggagagcttagcttctggctgtaggaaccactgcaaaatccatggggaaagcaccctaaattcatgatgcaaatcaaaggggacacagaactagagttttagaaatttatttttccctacatggctttctaggaattgctcttttgcatatagaagggagtgtggatgagggactggtagagcttgagagagaaagagagaaagcagctgccatagtgtacacagggacccctgctggtgcgtaactgagttggtcagggagcctggggaatgccttgtgcaaagcaagacagaccagaagtcattccttttatagcctcagtgctgcgggagtcacagaaattagcatgttgagaaaaattttaagttgtgattctagccttaaaaacaaaaggaagatgtaaataaattatcttaaattcgctgagcttgaagaataaacccatctgcagaaggctgttttctagtgacaaggtgacaccatgtagaatcatagcaccctctatcggaaaagacgaaaaaattaggaaagtatttgaaagtgaaagccaacgactaaatgatcttttgttgtccttattaccatttggcttatacatcttatggtcagtagtttacaggatcaaatattatgatttctacggttttgacaaaaaaatttcgttattattcaagtatcacaatgtcactgtgaagcaagttatacacatattaagatgaattccttatactccaaaactccattttgccatgggggaaactgaggctggtataggtaaaagggcttcttactcttgtcatcaccagatatgcagatgagagaaatgtcaggtgcagtccccgtctagtccctaccccccacccccagcttataatgtctctgggtgcacccatgaaatacatcgtgaaggctgctcactgaggcaaacctctcacgaaattattttaaatttgatgttttttggtctatatgtttttggcacattttcatggggactggaaatgagtttttatgctaatgaaaaaaacctgagttggttggatctagttggaaagagcctagggaactgtttaagaagtatcccaatcttggccaggtgtggtggctcacgcctgtaatcccagcactttgggatgccaagtggggaggatcatttgaggtcaggagtttgagagcagcctggccaacatggtgaaaccccttctctactaaaaatacaaaaattagccaggtgtggtggcgggtgcctgtaatcccagctaatcaggaggctgaggcaagagaatcacttgaacctgggaggcggaggttgcagtgagccaagatagcaccactgcactctagcctgggcagtagggtgagagtctcaaaaaaaaacaaaacaaaaaatatcccaatcttggtagagtgagggatgattggaggctgttttaggctttttgtttgtttgagccagaggtttggtattccttttggatatactgatatgcatgtgagacaaagggcaggacagtggttggagtatctcaaggggtctagtttttgcataggacaccctgtcaaattaggctgcttcttgatttcttccactttgagataaagccataatttgttacttctgggatggctgttttagggaaccatactatgtaataggagtttttagtgctttggacattagaaagtttcagtgtagtagaaaaatcagacccttagaaagttaatttatttatctataaaatggtgataataatacttatctataaatttgttaagtatttgtgttaatgtatatgtagcatgtaagggacacccagtgatatcgttttatttctgggatagctgtatgagatagcaaaactcccctatctcttatgctctgccaatagcaatgactatctatgtatttgagttacaagtcacatgtggaagccttacagaaagaaaaagctccctctctccctttgtcctttcccctctctaactatgtataatttatgtaattgtgtaaaacaaatatatgaattatatgtgtatataatttatatatatagtgtattatgtattttcacatgaacactttagatgaatcaacttttttctcttctcccccttcaccctcctttttttttttttttttttttcttaaaagcatttagctgggtgcagtgacacatgcttgtaatcccagctattgaggaggctgaggtaggaggattgcttgagtccaggaatttgaggccagcctggggaacatagcaagagcctatctttaaaaaaaaaaaaaagcatttcaattattttaaattttctaattacaaaacaattctttcctgtcttagtttagtttactttttactcacaaagttcctggaaagtagttattactcaataattgaatgcatgagtgtcaactgcaaaatctatgcattatgtagtgatttgaatcaattagtctttcttgatactccaaaattaccctttttcgagtgtctttatcagaaatttgataaatcggaactttcctgtctattcataaacaagagtggtgacttagaaagacacgcactccagagtggggcttctgcgtctcccttgtcgtgcccctttgtgagtaatgctttccccagagaactgcagaaaatgatcctgctgagctacagggtttcccattcattgggttccattccagtccttgcaagttcaacagcatctcagaacattctagtaagcttgctaacggcgtgtgaaaggttgatcttctcatctaaagcttttaaatttttaaaatcgaccatgtgcagtggctcacacatgtaaatcccagcactttgggaggctgaggtgggtggatcacctgaggtcaggagttcaagatcagcctggtcaacatggtgaaaccctgtctctactaaaaattcaaaaaaatttacctgggtgtggtggtgtgcacctataatcccagctacttgggaggctgaggtaggagaatctcttgaacctaggtggcggaggttgcagtgagccgagattgcaccactttactccagcctggatgacagagtgagattccatctaaaaaaaaataaataaaattttaaaatcttgggatgaaagactccattgagaataaaagggactatgagacttggctgatgcttttggaacttctgctataatcgtatatttcttctgccagacagtttatggcagagcttaagtttctcaagaaagaatcctcaaagaaaagaaaaaaaaaaaaaacccctggttgcagtgaccataataattaaatggaaactgtatgtttaaattgcagttggaataggaaattaaattacacaaaaagtgttatagatttggacaagttttcatactgttaataaacctatgcataattcatttacttgtaggctatgacaaaatagcataaataacttcatttgtaaggctgtgaatttttccattcctaattggatgatggctaaatccatttaaatgcttctggatgactgaatatataaatgcttaaaatgaacagttataatagttttctaggcagatttgtttatttaatattactacatttactttcagacacaagcatagtacagatgttgcataaagattacactcaatacggtgtgagtttgatatgatttttaagaaaaatattaactctctgctcttgaagacagcattctgatacttattaaacaaacaccatacatcacgcactgtactagtcactccataagccttatcattgcatcctcatgctagacctaaaggcaagtacattaactccactcaaatgatgaggaaactgaggcttagagaaattaagagttagttaaggcatggtccctgtgttcagtggcagagcagtagctctcagccatgtatctggggtttctaaaacttggattctttccactacctgcagcctctcaccacatactctcaggtaagtttagcacctgagcatctgagagccaaggctgccttagtaagggagtttcttgttctttttctcttttttctttttgttagagatggggtctcactttgttgcccaggctggagtacagtggtgtgatcacagcacactgcaatctcaaactcatgggttcaagtgatcctcctgtgtcagcctcttgagtagctggggctacaggcatgtaccagcacgccaggctgatttttttaattgttaattttagagatggagggtcctgctatgttgcttagtctggcctcaaactcctgacctccagtgatcctcccacctttgccccctaggtagctgggactatgcttaggctggcctcaaactcctgacctcaaatgatcctcccacctctgcctcctaggtagctgggactacaggctggagctaccatgcctggcaagagggagtttcttgctgtagcagtggctcagtatcagcacagctgttccttgcagtagcccccaatgtagtggctgctatgtggctccccaggagctgtactgggccagtgataaaagccaccgaaactcaacctcccttttgtgtggaggagcccacttttggcagccacagggtcttcattgtgagagacacatggggaccagagataaccatggaaggtgtgatcacccaggctgccttgtgggagtaggggcaagcatctgcgcagctccctcaggaacaagtggggacatgtggtcgtgagcctcttgagtctgtgtgtggctctggatttgcgattcttagagaccatggtggtcaccaacagactcgttaatattggagaatttctacaagcagagtgtatggctgcttgtaggatgacatctatacacccatagcgacaacttgttacgaaggtatttgtagattaattgatcactgtaggggaagtcaccatttctcatccaatagacactggctggttctgcagaaaggtgcaggagtgagaggattgttaaggcagtggatttacagtagttttggaggcagctgctctgcccctgactggctacaggatcttacacaagatttatcctctaaaccccacttgctgatctctacagtgacgtggtaacagtagtgtctatctcactagcatgaggctagtgagctagtaactagggctagcatgaggattgagtgaatacaattttatagaatacctggtacatattaagaacccaatgattgttagctattatttttatcctccttcctctcctagacccttttgcctccaggaagatacatttggagttaatgtataaagatagacagttgcagaaccaggacaatacacctccctgcccctgccctgcttaccagtagttaatgacatgtatttactgggaatgtttttgagagttcattagctaataataagggtctaatactttgccatttagggaaatgatcgccactctaagtcaacagttggatccagtgacaactcatctcctcagcccctgaagaggaaagggaaaaaagaagacgtgaattcagaaaaactgacgaaattgaaacaaaatgtaaaattaaagaattcacaagaaaccattccaaatagtggtaagtgtgttattattatcttaaggctgtgatacaattttaattcttaaatagatccattgtttctctgggcccacagaagatattccttattttcatatatgagagttttcaaagaaaattgtatttgtatatgagagatgctgctgtttttatgcttggtttttatttgtaattagatgttgtgccatgaggacacttattttgagatcaaatatattttgtggtagtcttattttaaaagtatgtttttttcatcctctgctcccactgatactgcttgattaatatttttacctacaactactatgatattggtctcttatttgtgtgtctgtaacccttgcccacattcattatgatttattagtcaaagatcatctttactgaaaagtcattttgttaattatactgataaccaagagaacactaaatagacataacattttatcagtaaacaataacctattcagcaaaattagatgtagtttcatcttgcactagcaggtgagagatggtataaaataaaaataaaaaattgcattagtccaagatttcactggtatgagataaaagtgtggtagactaaggaagtatgtaatgaaaattgttaactttgatgttagggttttgtaagaggggcgacttttggttttattcccagtgtgttctcagagtggagtgacgctggggtgggaatggctggctgggaagcagaccagtggaatgactcctgctcctcttgccctgagatcccctcacacaccccaccccaccccacccatgggactgtgaggggttccaggaagaggactgatgggatcaggtttcagattaatgggcaaagccttaccttccacctgggagctccagcttatttcaaagtcgatatgaagagttacattagaattagagctaatatgagcttcacagctgaggagacagtttgaactcctgtgagagtttagaggaagctgcacaaatgattaaagagtcagaacaaagacacgtgaggctaggttaaaagaacaggcgaaatgggtgaaccagttgcacagagaagtggaggggtctaaatcatcaaagacctaaatgatcgagactagctggaagtcaggagtcctagattctcgtcccagctctgccattgaccttgggcagctcatttaactttttttttttctttagctctattatctatctgaaaaatgtgggttcttatgaagatttctttttaaagttttgattatcttgaaatttgtacagtcctttcccgtgagtagcaaacaaggaggctagggtgaaatacagtcaacaaatatttaccgagtgcctattgtgtgacaagaatcaaagaaaagaaattagccctaagaacataccctaccttgaacactaaaaataagagaggctttaaaaaattaatagatactagattgtgaggcccccaaagccttgggctatgtcctactagttttttcttatttccaacaactggcacaggtctgaggcacttaataattatgttgagtgaatgaatgatggaagtttaaaaatagttaattctgtaatactttaatacccatcatgaaacaggatccaccttaaacttttcatttttttttttttttgttaaaagccttttataagatgttatttgcttcttttctgtgaggttcttgttagcctatgaaaatcccaatccttacttccagtatattttaaaaaagtctttaaattaagtagttgtcacctggaagaaagagaatgatcatcttttcaggttatctcatttgtaaaaacttgagaacacaagaggctgtattaacatatcccttgttcataggaaagtaaccttcattaaaaagttgaattattggctggtacagtggctcacgcttgtgatcccagcactttgagaggccaaggtgggtagtcggattgcttgagtttgagaccagcctgggcaacatagccaaaacccgtttctacaaaacaaataaaaaaaattagtggggcatagtggcatgcacctgtagtcctagctacttgagaggctaaggtgggaggaacacttgagcccaggcggctgaggctgcagtgagccatgatcgtgtcactgcactccagcctgggtgacagaattagaccctgcctaaaaaaaaaaaaaaaaaaaaaaaaaattgaattattggcatttttgcttttgtagaaattcacagtagtttttaacaacatttgtgttggtgggcatgaagataaaaaaaagtgtttattattgaagcaaatagtattttgaaaagaaaaggtataagccttcctgttcttttatttttttctttagagaattttgcagttgttttagacagtagcccattttaagtctatattttccaatgtggttttataatgtgcagattataggttttaaattgctggatctcattgttacaggaaacgctgctggtgtcttttaaaggaaggttttagggaatgaatttttttttccttcactaactggcttgtaccactgatctagaagcattttgtatcttttcatttggatagaaagaacatataacctggaaaatgaatcttggcttccaaagacaatttttttccaggaaaaatgaaaaaggattttgtgcagttcactagattaaaccatcacttgataactttaagcatattagcttaagtccatactactgaaaattgagcaatttggttcttaatgggatctccctgcagatgtctttgactacagaaattttccagattataatatcaaaagtccctctccatttctctctttaattcagccttcatattcatttattattgaagttgctttttactttaatgtcatatattttagtaattagaaccaagtatgtgcttttgaatactcatgtttcaagagggctcttattcctcataaaggtaaaagcaataagaatttgaagcaaaatgaaagtgaagggtgtaagaactcataataatgtaaaaaaatgcaaaaatttggttttagagataaaatttacatggctttttctacttacaatgtattttaaatttgatattaaataagctatttagttttatttcaaagtgataaattttagggttagggtgaatagctatgattattttctagcatatgttaacttgtgcaaatgtttgatctagtgttctttacctatatagtattttcatttgaattagaaaaaaagagacttcataggttatcttgattttttaataattaaaattgtagtcacatattttttcgttattttttaaaaatatctgatatttactgattcagttaccaaatgctgtatgaatgtgcaatgcttctatcagtctgtagatggcaacctgggtctaattttgttccttttttcttttcttttcttctttttttttttttttttttttgactctgtttctccctgtaatagtaaagcttaataattcaagcagagcagtgacatatttcttcagggaaacaaatctcattttcttttggtagccaagatgcaaagtaggattggttggtgattgatgaagttgggtgtgaaatgcatttttagtgttgcatttaaataccagcttaactggccagcacatgtttttgttacactttccacttgagttgcagtgccttgagatatgctttagaggctggcaactagctatattctccactatgaccaaaacagtaacgatgattgttttgaaatagcattttggatgattgatcatatcaattggtattgttaatatttggtacatgaaaaaatgtagtgcttttagaacccttgtgaacgcaagaagtatagtgaatttaggtctctgtaggaatactgaaagggctgcagagaaaatggcctggtctctttgacttacattgtattgataattgtaagtacgttttcaaggcaaagcattaaaaaggcaaaaataagagttgtattcttttgatggatgtggctctctttcactttgggtgagtgggcacgcctgtgtgcccacacatgggccagtattcttcttgatgcaaatcctggtttattcccagtgtggttctgtgatagtttccatgaaacttgtgatttttagactcctgatgactgattgggagcaggtgtggttccggcagaaggatgtctgaatattatgaccttgttgggtgactgcccttgagcagtcatgctcttgaatttcttaatagctacaacctgcacatggtttgcctgcatcgccccaagcatgaagcgttactgcaattcatcctcagagttatgaggcattgaaacttgagcttctttggttcagccatgaatcaacccaggcacttgcatggttcccagtaacaagagactctgaagacaaaaccggaagcacatgaggaaaatgtgctctctcacgtgttacctcctaagggatatcaaatctgggaagcaaatatgtaagaaggtaccaaggtgacatcaccaagtggcacactagtgttgtttaataagctaaggtaagatttatgattcattggtgtctcttgccaccacattcaccctataccagaaatacaggttttctttttttcttaatttgtgtaaatttaagggatacaagtgcaattttgttacatggatgtattgtgtcatggtgaagtccaggcttttagtgtaaccataacttgaataatgtaaattgtccccatgatgtaatttctcatacctcttcctgctcccacccttccgcctttccgagtctccagtgtctgtcattctaccctctctcatgtgtacgcattatttagctctcactaatatgtaagaacttgtgccatttgactttacatttctgagttatttgttaggataatggcctccagtcccatccacattgctgcaaaagacatgatttcatttttatgactgaatagtattttactgtgtgtgtttatatctatatgtatgtgtatatctacatctatgtacacatacccacaaagtgtgtgtgtgtgtgtgtgtgtgtatgtctttatacacacattttctttttccagttatccattgatggacacttaggttgattccatatctttgctgttgtgaatagtgctgtgataaaaatacaagtgcaggtgtctttttggtataatgatttgttttcttttgatatccagtaatgaaattgttggatagaatgaaaattctattttcagtctttgaggaatctgcatgctgttttccatggagactgtactaatgtacattcccacccacagtgtattggtattgccctttctctgcatccttgctaacatctgttgttttttgactttttcagaacagccattctgactggtgtaagctgatatctcactgtggttttaatttgcatttctgtgatgattagtgacattgagcattttttcaaatgcttgttggccatttttatgtcttcttttgaaaaatgtctattgatgtcctttgcccactttttaatggggctgtcattattttttgttgttgaattctttgagttccttgtaaattctggaatcaatgacagggaaatacaggttttctatcccttggtggatcacaacttcccatctcaatggcaatgtgtactgtgggatatatgggtcagattttatacatcaagtactagtatgataaaaattcttaagatcagcattttttcacaccttcatgatccacttattggaatgatatattgtgccacaaatttctagtacagcgagaggtcttagtaattttcttgaggtttattgtgaatttaaactctattaataaaagttagtttcaaaatgtgtactttgctatctactttagtactgagagactgaaaaattaaaagttggctgaatactagtaagacgtatggctcaatttgagtggagtaaaatactagccctttttcgaaaaggattctttttatatcctgccctcttaaacactttgttcactatatagagagaagccatgagggaagcattctttcacagctgatatagggttgagacttctgcagtaaattcttttgggggttattttttcatgtagcccagggttgagtttgaagacgctttttgttttcaaaaggaaaaatttgtgaggtgttgaattacagaggtattttcaaaactttggaagatttcattccggaaattcattttaaataggtattttgatactcagatcacattttccatacaagcgccccataaaattctatgtaagccataattcatcttaattattgcattgtgctgccgatgctgtgtaggttgcccactgtgtacaatggtgtttccagtgggaaaacaaatgaggagctccactttagaatgccaagaactcatgttaccctgctgtcgtaggatgcagaactgccctctgttgaattactggtgtaggccagagcctccaggtcagggatccatctgggtttgggtctgagaggaatgcagagctggaggagccagacctggagttactcgggtggggacactgaggtgtgggcggaggttcttctattagcgtgatcctctgcaggaggattagtttgggattgtcacatctttatttcttccccagctccagagtttggcttgcctgcctcccttttcatagatgctacccattacttctaagcagggcctctttgcttcttgccttaccaggggctctgacaagtttcacagccttttcttaattctgctgcctgcaaggtcaggttgaacctttctctttttttcttttttttctttctttctctctctctctctcttttttttttttttttttgagggagtgtctcactctgtcacccaggctggagtacagtggcaccatcttggctcactgcagccttgacctcctgggctcaagtgatcctcccacgtagctgggactacaggcaggtgccaccacacaaggctaatttttgtatttttatagagacggggtttcaccatgttgcccaggctggtctcaaactcctaagctcaagtgatctgcctgccttggcctcccaatgtgctgggattacaggtgtaagccactgtgccctgccaggtctgaacctttctgtagcttactacagataaaatatgcatccgccccagtggtgagtttctggcataccaaagactgaagcatgatttatctgcttttctgaaagaagctgaaattgggtcactctgagcatttcatcctggaatctgaggaagggccacatgggggcttggttagggaggtgtctgatgtcatgaatgttggtgagatgcctatcatagagggtgacagggtggagggaggaggaagatgtagccatagggtttattaccctttctccctcttcaactccctgttttccttgtcaggcctggggtgatataaaacctggaaagggcccggtcatttagaatatcagcagatcctggaccataggtcacatgtaaaggacacagataaatgttcagagcattccgcacagagtagtcagcacagggtcagtatttgttgatatatatgtgtgtgtgtgcatgtaggtcaattatacctatattatggtgacaattgaaattaaaggctgcaaactgtaagcattgagtaatggcacactcctgatacccatgctttagaacatcttgatggtgcattctaatctgatattttgtaagcttcatttacaaatacttagaatggataaacagcattttcctagcttagtgaatgagggggaaaagaggagaaaccagtttgcccagagtcaaagatctatcaatggttagtgatttctggaaattgccagactgacacatagctgctggttaagaggtggatgtgcctgtgtgactgtttgaaaggggaggtggagggacaagtgagggaagctctcgtgtgtgtgttttgacctgtcttccttcagtgataaaaatgttgatgtatcacagcagaccctgaagcttagctgggagattttggggagttcctgtttgtttcttcttctactctccactatttcatattaactttttaaatggggatgattgattttcatcccttctattttctaggtggtcggagttagtcattactaacaagccgtttttctctttagcagtctgatgtaataatgggtcttctctattttgacacatcttagctggggactgccttcagcatttagaccctcttttctagggtttagggaccttgaagaaggtagatattttgggggctgacctctagtttctgtatcaaatgatcaaatccccttttttaaaacagttacttaaacattctaggacttaagctctgcaacccaagcctttctctgtgtctgaatttccttccccatgtttcatgactttctagacttaggaaccccatcccctttcctaggtcactactttcatttttcagtgaacatttattgagtccctaccatgtactccaccccttgctaatcaccagagtatttcattttctcttctttgttctaattgctcagtacttacacattttcttccaatagtcataattatatctttatcaataaattttccttggttaagtagatgcaatttaccttttccctttcaatgaccagactttattcactatccctaaatgccaaattatgttgcaagcattgacattttttccttctgggtattgagtcatttcttagacctctgtattaattttgtccttatagaaagtaccagcacactactaaagaacataggccatttctacttaaatgtatttagtccaatgtctgggacaattactaaatactgcttggcactatgagacagggaaggagtatttcctcacttatgtgataccctgggactcctttgtagtctgtggcctattttgtatatgaactctatttttattcttctctattgccctagttattttcaaaataagatataacctttattgcaaatcaccatgcagtgtgctatcacagtggagataaagataaaatatctgtaaaatacctttgagctttgtaggtttaaagctacccatttattcttattttatacaattggatgataataccaaattgtttctttgaaactgggcaagattttatttcctttaaaattacataataaagtggcctggcacagtggctcatgcctgtaatcccagcactttgggaggccgagatgggtggatcacctgaggtcgggggttcaagaccagcctggccagcatggtgaaaccctgtctctactaaaaatacaaaaattagccgggcatagtgtcgcatgcctgtagtctcagctacttgggaggctaaggcatgagaattgcttgaacccaggaggcaggggttgcagtgagctgagattgcaccactgtattccaacctgggcgacaagagcttttggatggtgttaagctgaaggctcttacccagggcgtttactgtcatttcctaagttgggttccattgagcagtagtttcacgcactttttgtatgtttgtttgtttcttttgagacagagtctgactctgtcacccaggctgtagtgcaatggcctgatctcagcttactgcaacctctgcctcccaggttcaagcaattatcgtgccttagcttcctgagtagctgggattacaggcatgcgccaccacatccagctaatttttgtatttttagtagagatgggacttcgccatgttggctaggctggtctcgaacttctgatctcagctgatccatctgcctcagcctcccaaagtgccggaattacaggcgtgagtcaccgcgcctggccaatttcatgtacttttaatatatgcttctggtaatgagtttcatgttcaactacaaatttgggaaatgttggatgatacaaagttaagtcattgtctctgctacaggatttctcagagcctttagtatggacgtattccacgcttttacttgctttggatccctattactgaggagcatctggtgggattattgttctttagagcacaacttgagaagcgttggggtactcaaataggcatactgcttccacacattacctgatcattgtagggcttggggaatttctgatgaaaattaagtcagacatctttttgtgtgattctgatcagatcagtagctagcatggacagtggacattttctgggtgcttactctgtgccagggactagactgagcactttaagtgtacagtgcaagggttcccttgtggagtcctcagacctttggttccagcctgcaaaggttgttctcttggcttgtggcacagatgttatcttgcattttcccttactgtcattatgaaaattgcttttgtgtcttttctgtggagatcccatttccaggggcttttgtatacttatttcttggttgactccattttggcaggacatatcctccagtaatttctggagaatggctagagaaatggtcattattttttgagacccagcaagtctgaaaatattttcatacttttacatttaactttcagtttggatggacatagaatttttgttttgttttatttttaattttcatgggcacatagtaggtatatatatttatgggatacatgagatatttcgatacaggcatataattcataataatcacgttagagtaaatggggtatctatgacctcaagcatttatcatttctttttgttacaaacactccaattatacccttttagttatttaataatgtacaataaattattgtttactataatcacccctgttgacaaacaaaagctcttattcattgtatctaactatatttttgtacccattaaccatctccactcctcaccctcactacccttcccagcctctggtcaccaccattctactctgtatcttcgtgagtttaattgttttactttttagcttccacaaatgaatgagaacatgcaaagtttgtctttgtgcctggattatttcacttaacataatgacctccagttccatccatgttgatggaaatgacagtatctcattctttttttatgggttgataatactctgggtgtgtctataccacgttttctttattcattcatctgttgatgagcacgtagctttctcccaaatcatgtctactgtgaatagtgctgcaataaacatggagtgcagatatctctttgatatactgatttcctttcttttgggtatatccctagcagtgggattactggatcatatggtagttctatttttagttttttgaggaacctccatactgttctgctatgctaatttacattcccatcaacagtatacaagtattcccttttctctgcatctttgccagcatcccttattgtctgtcttccgaataaaataactgggttgagatgatgtctcaattgtagtgttcatttgcttttctctaatgatcaataatgttgagcatctttttatatacttttttgctatttctgtgtcatcttttgagagatgtctattcagatgttttgcccatttttaaattagagtattagattttttccctattgagttgttttagctccttatatattctgattattaattccttgtcagatgggtagtttgcaaatattttcttctattctgtgggttgtctcttcactttgtttcctttgctgtgtagaagctttttaactttatgtgatcccataatcttgtgcttatggggtattactcaagaaatctttgcccagaccaatgtcctgggagtttccccaatgttttcttgtagtggcttcatagtttgaggttttaaatttaaatctttaatccattttgattttatttttgtatatggtgagatatcggggtccaatttcattcttttgcatatggatatccagttttcccagcaccatttattgaagagactgtcctttccccagtgtatgttcttgtcacctttgtcaaaaatgaatttattgtaggtgtatggatttatttctgggttctctgttctgttgcattggtctttttttattagtctggctaaaaatttgtcaattttatttttttttccactatttatttcattgatcttttgtattttttgtttcaatttcatttatttctgctctgttgttatttcttttaattttggattgggtttgctcttgcttttctagttaagatacatcattatggtatatgaatttttttttttttacttttttgatgtaggcacttacatctatcaactttcctcttagtactgccttcgctatatcccatacattttatgtcatgtttccattttcatttgtttgcagaaattccttaattttcttcttgatttacccattgacccattggtcatttaggagcatattatttagtttccatgtacttgtacagtttccagagttcttgttactgatttctagttttatttcattgtgacagagaagatacttgatatgttttcaattttttttgagtttttttaaaacttgttttgtgatctaacatatgatctatccttgagaatgatccatgtggtgagaagaacgtgtgttctgcagctgttggataaagctgtatatgtctattaggtccatttagtctgttgtgcataataagtccagtgtttctttgttaattttctgtctggatgatatgtccaataatgaaagtgggggtgttgaagtcttcagctattactgtattggggtctattgctctctttaataatatttgctttttatatctgggtgcttcagtattggatgagtatgtattttcaattcttacatcctcttgctgaattaacccctttatcattatataatgaccttctctgtctccctttatagttttctttttttcttttttgttgtagagatgaggtttcactatgttgcccaggctggtcttgaactcctgggctcaagtgatctgcccaccttggtctcccacagtgctgggattacaggtgtgagccatcacacttggcctctctttagagtttttgtcttgaattccattttgtctgatataagtatagctatttttgctcttttatggtttccatctgcatggaatatctttttgtatccctttattttcagtttgtgtgtgtctttataggtgaagtgtgtttcttgtaggtaacagattgtcaggtctctttttttttttaatccattcggccactctttgtctattgatagtagagtttaatctgtttacatttaatcttattattgatacgtaagggcttactcttgccattttgttgttttctggttgttttggatcttctcttctcttctgtcttccttttagtgaagacaattttctctggtggtatgttttaatttattgctttttgtttttttgtatatctgttgtagtttttttttgacttgaggttaccatgaggcttgcaaatactatcttataaaaccgattattttaaacaaatgacaagttagcactaattgcaaaaacaaacaaggaaagagaaaattaataaaaactctacagtttaacctcatccaacttttaaacatattatttctatttataatttgttatactgtctgtcttgaaaagtttttgtagttatttttaataggttcacattttaatatttcaactgaagatattaccagtttacacatcacaattacagtggtataatattctgtgtttgcctacttactattaccagtgaattttgtaccttcaggtgattgcttaatgcttattaatgtccttttctttctgattgaagaactacgtttagcatttcttgtaagataggtctggtattgataaaatccctcagcttttgtttgtctgggaaagcatttctccttcatgtttgaaagatacttttgctggatatacttttctaggataaaagtttttttttcttcactttaaatatgtcatgccactctctcttggtctgtcaggttggcaatgagaaatctgctaccagatgtatttgagcttctttgtatgtatttgctgtttcttttctcttgctgcttttaggacattttctttatccttgacctttgggagttggattattaaatgtcttgaggttgtcttatttgggttaaatctgcttggtgttctataaccctcttgtacgtgaatattgatatctttctttaagtttgggaatttctctgttattagtctttgagtaaactttctactcctgtttctctctctccctcttctttaaggccaataactcttagatttgccctttagcggctattgtctagttcttgtaaatttgtttcattctttttaaattcttttttgtttgtctcctctgagggtgtattttcgaataacttgtcttcaagctaattattttttttctgcttgatcatttctgctattgagcgactttgatgccttcttcagtatgtcaaatgaagttttcagctctagaatttatgcttgatttaaaaatttcagtcttgttaaatttatctcataggattctgacttcctcctctgttatcttgaatttcattgggcttgctcaaaacaggtattttgaattctctgaaaggtcaagtatctgtatcactctgggattgtcactggtgccttatttagtttatttggtgaggtcatgtttctcgggatggtctcgatgctttggatgtttgttgatgtccgagcattgaacggttagatatttgttgtggtcttcacagtcttggcttgtttgtacccatctttcttgagaaggctttctaggtattccaagtgtgttgtgtgttgtaatctaagtctttggttactgcagctgcatctgcattagggggcacctcaagccgagtaatgctgtgactcttggcagatgcgtggaagcactgtcttggtgatctggggtaagatccaagagaattccctgcattaccaggcagagactcttttccccttctcttgccttcctgcaaacaaatggagtctctctccatactgagctccctggatcctggggcaggggtgacacaagagcccatatggccaccaccactgggactgcactggatcagacctaaagccagggcaacactgggtcttgcctaaggcccacagtgaccactgcctggctattgctgatgttcacccaaggcccaggggctgttcagtcagcagttggtgaacccagccagacccatgtccttcccttcaaggcaataagcttttctccctgctggcccaaggtgggttcccttctggccctgggtgtgtctggaaatgtcatctgggagctagggcctggatgagtgcatcagggctctgcctggcaccctatcctactgtggctgagctggtgtacaagttgcaagacagtcttctttactcctcctcctcctctcctgtagcagaaagaaggaatctctcccaaagctgcgagctgtactgcttggggttgggggaggggtggcacaagcactcccttagccaccctggctggtgtctcactaatttgtgtgcaccccaagtccactggctccaagggcagcgcagcaccagggctttcccaggagttgcactctttgtggcctagactgtctttcaagtttatttaagtttatcaagtttatttaagtgctctggcactttagccctcagtgatggggctagtttgaactcaggttctgactgctaggatgggacagtttccctctggctggggctggtctaaatgttccctccatgggcactggctgaattctgccccatgttgctttctgctgtgacaaggcagcagtgagttacaatgcaaagtctcacaattactgtgctctccctcccctaagcacacagattctctctcggtgtcacgaggctgctgctgggggacgggggtggggtggtgtaggcaattcaagactgtctttcctaccatcttcagtgcctttctccttgatacgctgttaaaaccaggcactgtgattgcttacctgatatttgttttttatgaaggggctttctcgtgtggatagctgttcaatttggcattcctgttggggggtggacagtgattgctggagggttttatttggtcgtcttgctccacctcatttcctgacatagaatttttggttggagatacttttcaactggaattttgaatgggctacttcattgattgtttatgttcattgcagctgttaagatatctgatgcctgtttatcttaatttgggtttcaccaaaagctatgcttagtagatgacgagctgagaaaaggacttgggtgcaagtaattcatttgggaattgacctcggaaattaggggcaggtaagacataaggatgagaaaagtcaataaggaaggatattattgaaaaagttactcctgtgggcaactgcactcagtcctgctgggaccctctcagagcccatgaaacacaccttagaattgtcccatgcaggatcaaggaaactgggatgtctgtctcccaattactgccctttgttgcttgagggttttacttggagaattacctccctggcactccagcccatcccatactcaggctgaacatgcttctctggccagagaagagattcaggcagagaaactcaggaacttgaggtagaaagacctcaaaccatatgagaactgtccaccaaagctgccatagaactttggcttgggctaagaagttacaaaccttatgtgcataacattagtagcaacaaaaaaaagcactgacatctcagatcagaaacaaaggtagagacattctgcagagtagttgaacaccaaaaaaaaaaaaaaaaagcaagaaaatggatttaaaatgtacttaatgaaggatatggagaagatgttagctgagaattctaaaattgctctttttgtatgaggtgaaaattttgcaatcttaaaatgaattactattcttctgtaactgcagaattgtttaaaagattcaattaaaagcatagacagttcccatgtcagactagacaaagaatgtattaggagcaaaagggaacaatgactgtttctcttaaataaaagaattctgtcatttaccccacattggtaccagagttctcaataattcaatccaatattggaataagcagtgtgggctgtcattgttctgggagtcaagaagagtagcctcccaggacaaaaacttgaaccgttgagcaccatcattgacaaatggtctccatattttctctggcactttttatcccagcatggttgagatttattatattttcaatttggtaaggtttgctagctaaaacagagttccagacctaattagtacagcactctataacttttagatggatgagttcacatcttagaaatttttattttctgagcaagcctcagacagaagggacagagaaataaagcttctttagtagctagatggatataaggcagctgttcaactgtgaggcaagctgcctgtttaatttttagaaattagttgggagaataatcaaattctctttagactttattcctgcattcaccctgaggttataatttagaagcatgatgatggttatttagcatttttataataatgaaacattatgactgagaaaacacttttgtaaagtagaaagtgccaaaagaggcagtatctatgtaaggagatacgaattagtttggactggtctccaagtcagagatgaggaactttagtaccagaaatgagagagcctagagatgagaggtgggaaccggcaacccattaataattcatgctttcctagttagctgtcccttatagctttgtgtcctccccctcccaagactcagttgccactctggtctgaagccaaaagctgaagtttcttggaagatgatgaaaaagtttaaggaagatcagtaggattagaaaggagtagaaggagagagggaagaaaaaagttagttgggcagacagaatcatttcttattctaataaaaatttaaaaaactaaaaataaccttaagcatcaattctctttaacaccagttagcctctaggttactctctttactcctaagctccactgaattttattgtcaacatggtgagtactgagaggagaggcataaaaatgggaaaacactgtggtttgttttcttctcatgaaacttactgagttggagactcagaagtgtttctaagtcaaggtaggatattacaagtagcagaatagagtaaccaagcaaggctttgagagcacaggggagagaggttaaatctgactgctgagactgggaattgatatttatttgagagagaaagttctaggcatagaattttgaaaaaaagaagaaaataaaaccaggaccagtttcagcatttaaatctctaatgcattttaaaccaagagtagttaaatgttaattaatccttcaaattggaaaaacaatttaatttaatatgaacagggaaggggagagattgttcagaaatttgcttcttggacaatagagaattgctgtttttgttttctttttgatgtttccgtgctagtttaaccttataatgttattttcatatactttttcacattagcttaaaagtggccatgcactcttctaaaaatcataatggtgactgcgaatatcactatttactctaaagaccatcacttagtaaacaacaaaactttcatttttcgtaattatgtatccctcactaaaaggcccttgacacattctcaacggcctctttatagatctgagcctggaaacaaatttcttcttacattaaggcccatatttctgactacttgaaatttttaccttgatttgtcacgtacatcctacatgcacaaattaaaaaattctccgagctttggattccccctacatgctgttttttttttcacatgtcttgtatctttggatatcacccagctagaaatctgagtgtgacccacgctagtggaaagggggaagaggagaggagttcatagtatgaacaaaagttctctgaaaaggaatttcgaggaaagactattcctgtgaacagtttgcaaaccaaggagattgcagcctttagtgcacaatgaagatgtgttctagagaacaaagggagggttcaggttttatagcacaagttcctgcccaggttcatttatgcaaatgaaggattcaaacttgcttagctcctattgattggtacagctgagccctgattggttgaggcaggtgagctctgattggttggttcaagtgactctgagagtcccaaagttgaacagaaatgtggattttctgagggctcagagttatgtgtgtgacctctagtcagcaaagggctacttggctctattttaaatttagacccagtgagtgactcaggattcaacttgaaggattggctctctgaggttcacatttgttgacagtagtttccatattgtggtgctacggagaggtgaagccagctggacttctgggtcgggtggggacttggagaacttttctgtcttacaagaggattgcaaaatgcaccaatcagcagcactctgtagctaggattgtaaaatgcaccaatcagtgctctgtggctagccagaggtttgtaaaatgcgccaattagcactctgtaaaagtgcaccaatcagctctctgtggctagctagatgtttgtaaagtggaccaatcagtgctctgtaaaatggatcaatcagcaggatgtgggcggggacaaataagggaataaaagctggccaccccccgcccccagccagcagcagcaacccacttgggtccacttgcacgctgtggaagggtttttcttttgctcttcacaataaatcttgctgctgctccctctttgggtccgcaccacctttaggagctgtaatactcactgtgaaggtcagtggcgtcatttttgaagtcagcgagaccacgaacccacccgaaggaacccactctgaacacactacttcaggaggttagcagtccatgcctgattcctttctaatcccctccgtgtctcctcttacaccactttaatccagttaactttagagtcatcctagatttttccatgcctcattcttcacactcaatcagagctaattttcattgattctactttctcagagtctcttgaatctggtccttcctgaccatccttgatttaagctccttatttttaatgcagactactgcagccttttttccagatggtctccaagctccctccctatctgtacatcacagctctgccagagtgctctaaaaacacaaaacttttctgatgaaatttctttagaagcttgtcactttcatggccttttttttttttccccaacttcaggcgtcttccacaagcctccctacatataaaacattttagagtttctcgatcgcgtgtcttttgtatgtctctttgcagctgtctagaatacccataactttattctctttaagactaacagtggcatcatctcttctataagatctgttctgagactcccagagttgagctttttctttgctctgcctcctagtgggacacaactttacagcaggtgtattacaacagcaggtgttgtaattgaacaggttgttttcatgccctttctctccactggtgcgtgaactctttgagagccaggactcctgcttattattgtctttttcatctttgtgagcccatcatctggcttggtttataacacaaagctctctgaagagcttgatgagagaatgactgaattttttcacacattgtgtactttttgccatgtttttatttgaaggttaggcattccagttatttatgatgatatttcttaaggttaacttgattaaatcagatttgctaatcaagtattttccagtggcacagagattaacaaggcctctgccacaatgttgaggcaaagtagatatatatctatgtaagcagaggcattttatttaaatgcaaggagaagtaataggttagagaaaagaccatttatttgacttaagaaatcaatattagagcttaggtgcaatatatggctctgtgtagagaaaactgaaaaattaatcttgttataattttattaaaaagtcaacgtggttgagtggccccagaactggtgcactgtgctgccaagataacagccttaggaagatgccagtaaaaaatggaagctattaaaagcaaactgagttgatgaattttcctcaatttataatgtaaaattattcttggtgtagtgctgtctacatgatatcggattttccattattagaggatttaaaagccactttggactaaaggttatttacatttctaatttctcacattatatgatggggcataactttaaatagtggcctcccaaacacgtttttataaagggacaattgttagctttctgatgaatgtttcttttacatgtttatttttttcatgtgctgtattctgtttggctccaactagcagaaatacccagcatttggagagtcttctcatctgagcatccagctgtttacacggacacacacacatgcaacaggggcacatttaaaaaataagctttttaacttgactacctctgtaaagaataaaattagaaaaattaaaaattttaagaaaataacataaaaatgagctttttgttgatatataatgtacatacaaaagagtgcttaaatcataagtatttttatgaatgtccacagatgaaatagacctaatgtaatcaacagtcagataaaaaaaaaaaaaaaaacatgtccagcatctgagaagcccctccctctgcatctttagtctagatatcaccccaggaagaaaaccttgattctgacttctatcttcataaactagtttttcttgttttaaacttttaaaaataaaaccacatactatgttgtaaccttttatgcttggtttcttttactggaagttattcttctattttgttgaccataacaatagtttgttattcttatatagcagcatgggattccatgtatgactgtatcctactttgtgcagtccccagttgatggagttttgtcttgtttccagtttggggcttgattgagtagtgctattataaatgttctttcgattttcctctagtcagcatgtgtatttctgttgaattgctgggccacatgatttgcatatttcatcttcagtagatactgacaaacactgttccaaagaggtcatactagttcacactcctgaaagccatgtatgaaaattcaagttgctgtacagcctcaccaatactcattctagcagatgagtagtggcatctcactgtggttttaatttccatttcctgatgaataatgagaatttgaatactttttcatgtatcttttggccattccgaggtgctttttagtaaagctcctattcaagtctcatgtccatttttctgttgtattgtttgcctttttcatattgatttgtaagagttctttatttgtgattcctttattgaatatatgtatcaaaaatatctttttccattctgtggcttgtcatcactttctgaatgacttttttgtgtaggacagaagtctttaatcttaacaaagtataatttattaacttttcctttaggattaatgtttttcctatgttttcttctggaagcttgttttccttttttttttttcagtgctatgacttggatataaacttattttaccttctactgttaaagttacaatctgtctggaattggtttttatgcatggtgtgaagtcaagattagtttttctccatgtgaatatctagttgatgctgtacaatttgttgaaaatgccacaatactccctctgcattgtggtgtcaccttcgtcttaacttagatatttatgtatatgtgaatcagtttctgttctctctatacctttcccttggtctgttgtctatctttgtgctgcactgccttaattattttagctttatcatccttatgtcttgataccaggtggtataaatccttcagcatattcagttcttctttaagatttctttctttattctggtcctttttatttcatatacattttagaatcaacttcctaatttcccaatttcctccaaaacacttgctgggattatgattgggactgaattaaatctatagatcaatctttaaaatattgagtattaatgccctttctgtatctgtcaaaatgattttttttatagtatgaattacactgatttttgggatatcaaactaaccttgcatttctggaataaattggctgtgatattttatttttttgatatctgactgatgtagccatttagacctggagtttttgttacgtgatggttttaatttcaggtctgacttagcctatcaagttgaggagtgcactgaatgcctgtcactttcacttcattgtaaaaaaattataaataaaatcattgttaagtttgggatgtactatgcagccatgtgctacataacaatcttttggttaatgatcacatatatgacagtggcccaataagattacaatggagatgaaaaatttctatggcctagtgatgttgtagccatcataatgtcatagcacaatgcattagtcattagtcatgtgtttgtggtgattgtataaacaataaacaaatttattgtgctgccagtcatataaaagcacaaataattaagaatagtacctaatacttgaaaattataatagataactctattacttgtttatttactatgctatatttttattgttattttagactgtattcctacttataaaagttataggtagaacagtctcaggtaggtgtttcaggaggtatccaaaagagggcattattatcataggagatgatagctccagttgcattattgcctctgaagaccttccactgggacagtgatgttgatgatccagcccttgtgtaggcctcggctaatgtgtgtgtttgtgtcttagtttttaacgaaaaggtttaaaaattaaacaaaacttaaatagaaaaagcttatagaataggaatataaagaaaagatttttgtacagctgtacaatgtgtttgtgctttgttatgaaagagtcaagttaaaaaattaaaaagttttaatataaagttacagtaagctgaggttaatttatgattgaagaaacaagtgattttaataaatttagtgtagcctaagtatacagcatttataaagtctacagtaatgtcctaggacttcaccttcactcaccactgactcactgactcacccagagcaacttctagtcctgcaagctccattcatggtaaatgctctatatagataaccattttaaatcttttataccatttttttttactgtactttttctatgtttagaagcacaagtagttaccattgtgttatagttgcctacagtactcagtatagtagcatgctgtataggtttgtagtgtaggagcaataggctatagcacacaccctaggtgtgtaataggctattccttctaagtttgtgtaagtgcactcagtgatattgacacaacaatgaagttgcctaacaatgcatttctcagatcagatccctgttaagtgatccatgactgtatttacattttttccagcatcagttttgatacattatgttggtaaagttcatttcacttaaattttaaaatttatttgtgtaaaggtattccttatatcttcttttaaaagaaaatgcctgtaggatctataataatgtactatttttattctcacattagtattttatgctttctttttttataattagtttagcttttgacttagatttttctctattgtacattcgttttatttttcatttaatctctacccttatatttatttcctttcttcagctttctttgagtttaacttactctttttctatcttctggaaatggatagagcatcaatttttagcccttgtttttttcctaatattatatttaagcccacgaatttccctcttatcacagctttagctgcatccaacatgttttgatttgtcttattttcattatttatgtaaaatgttttgaaatttcccatgtcatttttttctttgaccccgggttatttagaatggccttacttaatttcaaaacagtttgacattttctggtgttccttttgttgttgatttctagcttaattccactgtggtgagtgaacataaataattttagtctctttgtattgttgagacttgcattatggctcagcatagggtgaaatttggtaacaattccagaggtacttgaagaatgtttttgtgttatcactgctgagtgctgtgtcagtgtatttgtcaattaggtcagatttctttgattttgtactttggctttgagatggctctaggctcatcctcccctcaccattctctttctactttcttgctcattaaatctctttgccctcttgcttgcttttaccagagcttcctcttttgatctagcatctttttgatccatacatgttttcacatgatttcatttggctgtcttccccttaaaattctggtttcaatcatcgccctttttcccttttgttctgtggctttgctcagcaggtcagcatggtctttgtgtcctttagaccttatttgttaaaggagccaatcagctccatcagcaggcattcattagcacatgttgtgggactttagaaattcctgacattgttcactcaaggggcttgtgatctggctggaaattatagtatagttaaatatacagatttaacagtagtacaaggaagtatataatatgaactatatgtgtgttgtagggtagaagaagggacagtcactatgggctggaatggctttgtagggaacttggtatttggtctgaaatcaaaagatgggaaatagggaatttgccagaataaaaatccagaggcaggaaagcttaactactttgtgtttgtatttcataaattactttggctggagaggacgatgttagtgtgcaaagctgtagtggcctggtccatagaggtaggctgggactaggtcataaggagccttaaatgccaagctattacatttagacagcattctgcagctacagaggcaaggcattggagatgatgaatatgtgcacagggatttgatgtggtgaatgtaacatttttgggaaaattatctgatggttgtatacagaatataattgggaaagagtcccagtaaaatcctggaaaaattatgtgatttgagattataatgtgcatagaaagataacagatgcatacagaatcaggagaagggagttgatttacttataatgcttaagaaatccatcctaggtttttaagagaccaaccagtgctgtggatagaaatagagacacagggaggcagagcagaattcagacacaggtgtcagaatgtgctcaagaccagagagctgaagccatggtgcagaggtgagatttagcttaggcagactttgccaactgaaaaagagcacaggtgtcaggaggtgtcaagatggtgtatggaagggctcccgcagagttctctctgagatagcagaatttcaggaggtttgtgaggaattagggctagccataccagctgtggaagccaaggtaacctaacattgctgtccaaacttataatctctaaagtaacagaccaaaatcgattaacaataataatggcactaataaggaaaagcacagcaagctctcaaaccgcaagtgaaattcatttgcgccatttggggttcacttttaaaggagtaagctattcttcatgtatcctcctgttttgaaggtttccctgaaactgtccagttttgcctcaaccaaggcgatttgctaggaaacaggagagaattctaaactccaattagccagtgctattggagattaataacactttagacctgctggaagcgacttcacatctaagcttcttcctactgtgtcatagcaacaatttacaaattttaataatagatgtcctgtttgagaaattgcctttccttatgctatgggaggttttatgattagactatacctctttccttgcagttgttttcaaggcgtttatgttaccatttttgcttatcagtaatggttcaaaaattttctaacacagagcaattaatatctgtcagtagaaataaattacatttttcatcgcttgtgacacactctcaaatgctgtttgaaagtgccataattttgcatcatcatgctatgtaattttggtgcctggtgtaggagtgctttaggggtatgatttatattttctgttttttttttcttgaattaatagggtaggtgtaaggattaggatataagttggaaaatgacactttgcagaataatttgtattatttctgttcttctaaagcagtctgtcttttagaattgttcacatattttataaatatatttgtgcatgcagattgtgtatattataatgttaccatcagtaacttttgccttatagcactagaagggacaacatgcttttagaaattgaatgcttagaatatatgtatgttcagaacatatttttcattgccataaggaagaagtgtataacatttgcaacatttttacctctgtaggatccttgtcgtttaagcacagcaggcccaccctagtgctctgttttagccagccgtgattactggccacagatgagagcctatgacaggcggagcacccaggccaccttctgcttatttttggccccattctcttctcctttggccctgcaagcctggtgttgacatgtgattttagcctggtgcttttaggttaccgatttgtactcacctctggtttgatagattccaacttgcctggaggctcttgccaattgtcttctaccactcactgcctacctctgactcagtccagtgagagatgatgagaaggatcagaggatgggggagggaggctgccgggacccgggtaaaaaatcaaaaaggacttgagcctactaattaaacctctcaaattgcaattgtgctgaaagctcatactgctctcgtcagtgcctaattgatgagtccattactatgttcagtcattgctacctggcagccattcttaaagtgagcaatatatttcattctattagactacaatcagtgattcccttctgaaacagtgaagaaaagctttaactttaaatttacaactcaaataatattgcttcttcaatatggctattataaagaggaatggagtcagggagggaccacactcactcgacaaggctttgtagaggatctactatccccaaacacagtgctgagggtatgatattcctgagaaatgctgttaggagatgtggttttcaaaataattcacaatgattacaactaaatctgtctttactccccatctcttaatgtttttattttttaatttaacactgtcggttggattaggcttagataaaatacacataagagtataaggagatagaaacctaaatataggcgttttgtgcaaccaaatgcatcgctgccttatcttgaaacttctgaaattatcaaaagctacattactgtatatcatagcagcacagctgtgagcaaagctggggctttgctattttaaaatgttagaagagaaagtgtattgaatttttcaattgaattttaaaaaggtatcagtgaatagagacttgtcttcttacatgggactcaaactatcagattcccaaatagaattttagcaattaatactagttaaatgggtttcagcaagtcaaacccatctccacagagctatgattgtagtatatttttaattatggaagtattaaaaacaatcagctcacattaacttttaaaatagaattataaagcagagcctttcactctgctaattcctttgtttagggagtcatcaggtattaagtgagtcactttagaatgagcggcttatttttaagagttttaatatattaaataagaataacagaaatcaaagtagaaggaaccttggaaattatggtcacctgacacttggtatttcatttagaaaacaaatacctaaaattattaaatgcaaaaaagaaactaaagctgctcactggatggatggatggggcattggtaattggtagttatggttttaaaggaaataagggcattaggttaattggcataatgtgaaaacagatgctttatattttcaaacatcttattagtgattccctattgagctccatttttaatttaatatttatgcaggagttaatattttgaaaatgtttatagtcatttttatttgttgtatgttttatatgaggtaggtcagtgcattttttcatctgggtaagtcatcaattaacaggtggagtacgtggcatgtagtaaacagatgtttctgccctcgagggaattacaaattaaattcgcctcttagtatcttactattccaaaggtcttacctttgcttaaccacgtatatcctgccagcaaaactggtcttcaggaaattgtgccacaaaatgatactaatgatactaatactaatactaccaatactaatactaccactgattaaggacatcctgtgtgccaggcagtatattgagttctttgtgcatgttgtataatttaattttcttaacagtgccatgaagcagctactatctcggttttacagacaaggaatcggggcttgaagaggttcagaccatgtaacttgtatgtgaaggtctagatctggtaagtgaagaagttagtgtttgaaacaactgctcccccgcactgcaccgtatggtgtcctgtggtaataatggtggctacatttgttggtggctgtctactaagaacttcacagcatattttcatttaatgcccacaacaattttaggtattttattccaatctacagatgcagaaactgagctgaagagcagttaaagaacgttagaacattctttttttatttttgttttttaatatttttgagatggagttttgttcttgttgcccaggctggagtgcaatggtgcaatcttggctcactgcaacttctgcctcccgtgttcaagtgattctcctgcctcagcctcctgagaagctgggattacaggcatccgccaccatacccagctaattttttgtatttttagtagagacagggtttcaccatgttggccaggctgatcttgaactcctggacctcaggtgatccacccgcctcagcctcccaaagtgctggaattaaaggcgtgagccaccacacatggccaaggaacatttttaagagtacacagctatgaagaaacatagtttcaaaatatagtgctctgcctccatactctgttgctatacccatattccaaactgctcccctttcaacgtttcttcatgtgcgtgataaagatatataaccaatccttatttgaattgaaaggagctcggcatatatctgtgagtgactgaatggtgttttattcagaaagtttgtttggagtatttcttattctcaatatgttcttcccttcttagcctaccctatcttcagtgtactccatctctagatgactagggccctcaaaccatttcttgttccttaccctcccaatacaattacatgttgaaaagcctacagtaagttcagttgcactaagttccaaataataatgtcttttaattaattcttcccccaagttatgggtatttgctgtgattttatatatatatataaaaatagttaaatatgtatatatatatccaagaaaacaaggtcttgctctatcactgaggctgaagtgcagtagcatgatcatagctcagtccccagatgcttaaatcaaactaccttaaccgctacactgcagcctcaaactcctgggctcaagcagtcctttgattggataactttactggaattccaagtggtgggtactggctggagatattttcatgtggtctttggggattcctcaaaacatagcagtagttgtctccctttatatatgttaagaccagcctgagtcttagcaaactgctttacaggatgttttcatctcttttggggttacctttttctgtgggtatatacttctgattttacaatgaaaagtagtgagaaaatgggactcatttcacaacagttcttctttacttagttatatatgcttcatgaagcaaaacaagaggaagctcgtatgtggatattagaaacacaagagttaattaaaacaacaaccctctgtctttcccatttaccaagttaagacatgtcattatcagggccaggcacggtggctcatgcctgtaatcccagcactttgggaggttgaggcgggcagatcacctgaggtccaggagttcaagaccaacctggccaacatggtgaaaccctgtctctactaaaaatacaaaaagtagctgggcgttgtggctgacgcctgtaatcccagctactccggaggctgaggcaggagaaatcgcttgaacctgggaggcagtggttgtagtgagctgagatcacgccactgaactccagcctaggtgacagagcgagactccatcctcaaaaaaaaaaaaaaaaaaaaaaaaaaagaaaaagaaaaagacttgtctttatctaaaacagatcttacaatgaggttcattaagtgaataccatctaagatggcgtacaatttaaatggattggggaatttattttattttctctaaaattttaccactaaagatctagtcacttggaataatagacattttttaaaaataaaaataacccttgaagagtaaacatagtatatcatttcatgatttatacctatcttatggaaaaatattcagcttgcagaattcggcttgatgggatttgatctctcatgtttatttgtttgtttgtttttatctcttttgtctgttgccttttggtgattttcttaaatgtatcctccaggccgggcgcggtggcttatacctgtaatcccttgaacccaggaggtggaggttgcagtgtgccagtgcactccagcctgggcaacagagtgaggctctgtctcaaaaaaataaataaataaaaataaaaataaataaaaaatctatcctctcagatcactaataatattctctacagctgggattagctatttaatctgtccatttggtatttagtccttccattgaatttttaatttcaatgacaatatttttcatttctagtagttctagttgaccctttttcaaatttgccagtttttgtttatactgttgttttctttcagtattgtttctgttgtctttgatctctctaatcattttgatgcactttttagtaatctcttttaaaattgttctttctactgttctctaaatgctaattctctttgttgtgtctgcacatcatatgtaaatctaatcttcaactgaaagtcttgtttgttttgctaagacagtcttgtgtgtctagggtaaggtaacatcccttcagagtatttttcatttgcttcaggtgaggccatgggaactttctggcttgggaccagttttatggttaatgtcttggctggagttttcttgaccacttgactagtataaacagatcttacagcctttctcacagtacatggttgaagttttgatttctcaaagactccagagagatgccaagctttctttctactttctggtctagtggacagctggcatttttcaggcatttggaacccctggaatggtcccggttttatgctgggatctgggttccaacactccacttgtggaccttaaaatcctagctcccagccgctcgaacctaagtttctgtccatttcctcttgaagcactgagattgccctttcttttgagctcagctatgaataaaactttttgagatggagtttccctctgtcgccaaggctggagtgcagtggcatgatctcagctcactgcaacctctatctcccgggctcaagtgattctcatgcctcaaccacctgagtagctgggattacaggagcaaccaccacacccagctaatttttgtatttttaggagagtcagggtttcaccatgttggtcaggctggtcttgaactcctggctttgagtgatgtgcccacctcggcctcccaatgtgctgggattacagatgtgagccaccacgtccagccacataaaaatcttgagttcacattttgtttgcatttctgggtatttgtagcaggagagggtctgtgtcacctcaatccattatgctactttacatttcagctacataagatttgcattgagaaattttgtcagagttttcacgtggaggaaagaatgttgtggaacacagaccactgccagggaaagtcaggcttgggcaccccgggggagctgacaagctctaggggagggagacaaagggcagtggcctttaaggtggggaatggagaggaaaagtaggagaaagcacagagagcaggtctgggaggtggtggagaccaactgcatgttcttgcccaagggcagttcttcccttgccttccagatgcagaatttgtttttctcactgaacaccgtgacatttacccagccagatcaaatgaaggagagtcttaggccccagaggcagctgtgtgagcttcccttgtggttgaaaggtcagggtgatttctacccatctcaggtaattttgcagtgggtacgttttctgtccttttcccaccatccctgatgtattttgaaatgaatcacatacttttttgaagaaaaatcttttgattaggcttcttggttccatatcgttttatagtcctattttcatttgaactgttagaagcaaacccggaaggtcactatttcttaactttcctttagaagtagatttttaagtatgagtcgctgcatagtctatttattttgaagtcttctggattttaccttctagattgagaattttctgttcatggcaactgtttgcttctaacacagaaactgcttgtctgtttagagatcttttgggtggtagtgtgtatgttggttaggaggtgagtagtctttagctggatgctacttaataaaccttattaatgtgcattgaagatttaaattctgaaatgaaaaacaggcattgggactagcaggaaatattaaccaaaatcgtgaagcagatcagatggtaaagagacataatgtgttttatctgtagaccctcatgtttgttcatctctctccctatctctcttccctagttcactcaacccccattcccattcctgtggtttggggttgcctctgtttgcttgtctgatcctgaaggccagaaccacacttagattctcgtagggacaatttatgattctgattaggttaacatgaagctagacttagctcagagtatggggatcctgccctataggatttccaaaggttggcacaatcagccatgtagccagggacaatttaattcaacttgtgagcacaggtcatgtctgggccttccttccaaactagcctctcagctccatataagctgccatcctgaagcaataggtaagaggggttttgttattctattaaaaatgagagccataataataataacaatagctaacactcataagatggcaggtgttattccgagcattttaaacacattaaatcattgagtcctaatgaccccatgaggtaagactcttttagcctcatcttccacatgaggcacagacagatgtggtactttacccagaatcacatggctagcaggtggcagagcctggattaaatgtgctctgtctgactgtccagaggtgtgcaacctcatgtccagcctgactttggcatccatcccatgtgagagtaagactctgttatctgcaggtcaggggtttcctgcatctttgccttttccagacaacatgtttgtaagcccagggtttcagctctgatcaccattttgtttctctgttctgctttagattactgacaggtttagcttgtttgagtctggcagtgtcctttaaatttttctcttctgttttgtgtctcactggtgtgtttggacagatgaaatacctcagagggtggactcccaagctgtcttgactggcagtctccagtgccttctcagggggatatattccttccttttttcctttgttcgtgtcttctttccttttcttttttttttgagatgagatcttgctctgtttcccaggctggagcatatcggcatgatctcggctcactgcaacttgtgcctcttggtttcaagcaattctcctgcctcagcctcctgtgtagctgggattacaggtgcatgccaccacgcctggctaatttttgtatttctagtagagatggggttttgttatgttggccaggctgttctcgaactcctggcctgaagtgatccgcccgtcttggcctcccaaggtgctggaattacaggcgtgagccaccatgcccaaccatctttcttcctgtcttcattcagcatttattgactacctgcctatacctgtgctctgtgacagtctgtcctcggcaagctcagtctcctgtgaagaattagatatgggcatctgtgctgtggtaaatactctcacagaggctggcggtgggtggagtgggaggacacggagaggtggggggaagacttcacagcgaaggtgccagtggagtgaatgctgaaataaaccttctccaggtagacagagggaagatgtttcaggcagggaacctacatgcacctaggctggaggcatgagcaggcgtggtgagtggagggctggccagtcagtgcaggcgatgggctgaaataacacgaggctatcaaagggggccaaacacagagctcaaagggccctgatgacctgtctagggagattggattttacttcttagataatgcaggtgccactaaataatagtaaattaattgtttattatttagatgatttattatgactactttttgagagagggtcttactctgtcacctaggctggagtgcagtggtgcaatcatagctcatgacagcctcaacttcctggctcaagtgattctcctgcctctgcctcctaggtagctgggactacaggcatgcaccaccacagcaggctaatgttttaaaaaaaattggtagagatggggtcttgctatgttgcccaggctggtctcaaattcctgggctcaagtgatccttccacctcagcctcccaaagtgctggaattataggcatgagccacgacacctggcctgatttctttttgagaatattgtattttccatttgaaaagccagtaaaatatgaagtacactcatatattctattcatatattctactgtctttagggataaacaattaaaatatggaaagacatacagtaaaccatcacaggtttgaaggactttggggaaggtggcttatctaaataagatcttttgagattactctctaaatgctttgtgagtcttttaaaacactgccaaaagccattagaatattctctctagtaaacttttcatgaatatggaaaaatagtggtttttttcaacctagagttttgtgtagttggagaatactttagaaatgatcttaaaattctagaggatatatgtatttaaaaaatgagtcactgcttattttctcttcaaatattttaatttttaattctttgttaaaaccttcctgtaacaatactaggaaaacgagtgattggaccttttactgtggcatgcaaaagagacctaatattgaaacatagtcatgttttaggagtgcgtgattatgtgaaatatatttgtgtaaaatgtcctgtgctcctggaggctccatgtagaaaatgcagcaatgtaaaagtgtaaaactcaccattctttctagcttttttggtcacagttttgaaaatgcctgtagagaactacagagtaaaacacaaaggccattgtttttcctttacatgtttacctaggttaatagtacactgtgcatagctgtaatgaagctctatatctaaccccaggtggctgaaggtcatgggctttataagccaaaggtaaaacttccgcctgtattctactgcagggaatgacaaattcttgaatcctacaaccaacaaaaaatgactttacccgaggaagcctgcacaaattacttccattgttcctgattgccttgatatcagtatcagacactttgtgaacagacattctgactttacacaaatagttgtgcacaagccaggagcccattatcttgttataatactcaattttcttcccattcttttaattgaaacgcagttgccccactgcttttgggcagcagaagtgttacgatagcctaaactctcagccatctaagggattgatttgctgtcttacccagctttatctgttacttctctgtgtgtgctacctcttgtttctgaccacagcgtgatgctattaaatgtgtactattgatccagtctgtgatgacagagcactgattagcccttttgtattactttgattttgaaattgactagtcccctagtctgtaaatcatgtattctaaaatgcctagtaatcaaaataataacattaatgattttctaccacctaggcccataaagtaaattaactggtggaaacagctttgaaaagcaatatggctgaatagacctattcttaccttgttgaccaaatgttttgtaatagtctaccaatttcaattttaggttaaaaacaccatggaaaaactctgcagttcagttagcaggagataaattgcatgatgcttgtaatcagaaaaactggaataaactcagtgttcaattaatactccagcctcttcttcctttctgatgcacctctttaaagccaccgaggattcaaggatgataattaatttttagggtaaattaaactaatctaacaaataatcagggctgattttcagctggtacctattgtagagtcagtagctacactagttgtttatgattttctaattggttaatctcagtgttcaaaatatatttacttttaaccttacagataatgctagatgtgagtttaatatatattttaactatattacattgcctgcctccttgttggctcttagttgagcaaatggaaacatataatttcttttatctttgtacatctcacaccagcttggattggtgtgatattttccaagttttgttttacagaatgatattattatatgtatgttttcttccaagtgattttcaatattgaaaaagataatttacagaattgaagaaagagtgtcaaaaaccagatcaaagccagagacctcaaaaactcgaatgagggacacagacacccacaaaattctttttgcattatccagctctaattcttctagacccttggcttcattcttctttatttatataaacttccctcatttgagaggaacatagctgtaggcagctcctggattatttccttttagcctgggaacatgagagtaaagagaactttcccttttagctttagattgaaaaaaatcacaggaaaggattctgactgatccagcttaatatcatgtgcccactcctggacctaatgtggcagggaaatcattcctaattagctgggtcacatgcctgcctcggtgttacaggggcagtgcttgttaccagaagaaagtgaattggctttgagccggtcaactatcccagtttgtgcctatcacagagtgaatcagatatataaagtaaaatgagaagaggctctgatctaggtggtccacctttgatggaaaataagatgatggtgccagaaggaagtgtgtttctatgaggaccttgggtccagcaggagaaggacggtatcctgtccttcttccttttggtccaaagggaatgccactcctggtgttcttcctctgggttgataccgaagtttgtctttgcctccattgtacttattacacatactctgataatgtgttacaaatctgcctccctgactggactgtgaggtgcttgagggctaggactatgccttattcatgtttgaaaatactcttgttatgatatgaatgcttgacacttgttgaatgaataaattttgggaagtatggcaacctaccacagataaggcactgaatgacaatatcgttagattacgcatgtcatatactctagaattgtacaacaaagcttttaaagctaatactctctcctatagtaggcagagttgcttgcacacttgaggcagnnnnnnnnnnnnnnnnnnnncctttctcccttcctcctttcctcccttccctttccccttccccttcccttctttctttaaaaaaaaaaaaccttttattttagattcaggtgcacatgtgcaggtttattacaggggtatattgtgttgatgctatggtttggggtacatctgaaccatcacttgggtagtaagtatagtacccaataggtagtttttcaacccttgctctcctccctccttctcttctcttacagtgctcagtgtctgttgttcccatctttatgtctatgcatactcaatgttcagctcccacttatatgtgagaataagtggtttatggttttctgttttggtattagtttgcttaggataatggcttccagctccatccatgttgctgcagaggacatgatttcattcttttttatggctgcattgttttccaggggttatatgtactacattttctttacccaatccaccattgatagacacctaggttgattccatgtctttgctattgtgaatagtcctgcaatgaacatacaagtacatatgtcatttcgatagaaggatttattttccttttgttatctacccagtaatgggattactggtttcaattatagttctatttttagtcctttgagaaatctcccaactgctttccaaagttgctgaactaatttacattcccaccaacagcgtataaacattcccttttttccacaacctcacaacgtgtgttattttttgacttttgtttttgcaatttattttgcatttttaaagttataacttttaggtttaagggtacatgtgcaggtttgttatgtaggtaaaccaagtgtcacgggggtttggtgtacagattatttcatcacctagctaataagcatagtacgcaacaggtattttttttctgattctgtccctccttccaccctctgctctcaattagggcctgattttttttttttaccttttcatgatagccattctgactagagtgagacagttatctcattgtggttttgatggcatttctctaatgattagtgatgatgggcatttttcatatgcatattggctgcttatatagtttcttttggtgagtgtctattcatgtcctttggccacttcttctttttttttttttgagtcagagctttgctcttgtagcccaggctggagtgcaattgtgcaatcttggctcactacaacctccgcctcccagattcaagcgattctcatgcctcagcccccaaagtggccagattacaggtgcctgccaccatgcccagctaatttttatatttttagtagagatggggttttaccatattgggcaggctggtcttgaactcctgacctcaggtgatccacccgcctcaacctcccaaagtgctggggttacaggtgtgagccactgcacttggccttttgtccacttcttaatggggttgtttgtttttttttcttgttgatttaagttccttataattcaagatgttaggctttcatttggatgcatagtttgcagatattctattctgtagcttgtctgtttactctgttgatagtttctttggtgtgcagaagctctttagtttaattaggtcccacttgtcaagttttgtttatgtttcaattgcttttgaggatttagccataaattctttgccaaggccaatgtccagaatactgtttcctaggtcgtcttctaggattcttgcagtttgagattttacatttaaatctttaatcattttgggttaattcttgtatatggtaaaagccagctttcccagcaccatgtgtcaaatagggagttctttccccattgcttatttttgctgattttgtcaaagatcagatggctataggtgtgcagctttatttttgggttctctatctgttccattggtctgtttttgtaccagtgccatgctgtttgggttactttagccttttagtatagtttgaagtcaggtagtatgacaccttcagatttgttctttttcttaggattgctttggctatttgggttccattttggttcatatgaattttagaattttttttttcctaattctatgaaaaatgatgtcagacagaaatggcattgagtctaaattgctttgggcattgtgaccattttaatgacattggctcttctaattcatgagcatggaatgtttttccatttgtgtcatctatgatttctttcagcagtgtagttctccttgtagaaatctttcaccttcttggttatatgtattcttaggtgttttatttttgcgtatggctattgtaaatgggattatgttcttgatttggctctcagcttgtacattattggtgtgtagaaatgctactgatttttgtacagtgcttttgtagaggtgagagtgggcaggcttgtcttgttccatttctcaaggggaatgcttccagcttttgtctgttcagcatgatgttggcttgtgggtttgtcataaatggcgctagttattttgaggtatgtttctttgatgcctagttttttgagactttttattatgaagggatgttggattttgatcaaaagcttttattttatctattgagatgatcatatggttttttgttcttaattctgtttatgtggtacatcatatttattgatttgtgtatgttgaatcaaacttgcatcccaggaataaagcctacttgattgtggtgaattaaccttttgatgtgctgctggatttggtttgttagtattttgctgagaacttttacatctatggaaccctttccttgaaggaaattttatgcaaagtccactttgtataataagtaaaagaggatctttcctgcttgcagggagtttgcaggacaaggaataaggcccatctgtccatgtcttatctcccccattcactgtgatgactgctgaaacattttgagagaactcagtgttctgtggcccccctcaatctgaaagatatgttgttaaaaatgtattacacattcttatgagtaaaattcaagtttttagatgtaatatagctaaattaagtgctactaaaattctcatttatttctgcatgaccagctgtcaaatcatatctttttatcccataatgcagaatttttcatgttatcctattaaattgaattttgttcatccatatttcagtttgtcaggatcattttgggccttgattttgttattaagtatttatttgttatcatttctatcctcccataatctgggtgtttggcaagtgtgctatctatgtggtatctaattatttttataagcttattgaaataaataggggtccatgagagaggcccttcttaaaattgacacttggacagtggtgtacattttttggggtccaaagacttgtacccaacatccctaaaactaaactgtcttctactctaaaactgtctatatcgcttgatatcactatctacttatgcctgaaatctagacacaatcttaatgttccccttccttttagtacatactcacaatttttcatcaagtcctgtgattttacttactaaatatttggaaacttctctgatttccacctctctaccgccacccttgtttaggttctcctttttttctccacaggcagcaataacctcctaacaggtgccctttcttctgggctttgccttctgagttttgttctgcactcgttcccaacgttatctgtccaaacaaaatctgactgtgtggttcacatgctgcaaacccgccattggcttcctgttgcccacgggacaaagcccattatcttcaactttgcactcaagtttatgttctgactcttttgtatcatcttccagcacttcctaagctgggcttgatcgctcactacattcaatggcttgtaatttcctctgtgccccgtgcgatttttttttttttatggtctcctttaaaattctccttcctcatacggccaaccaacttctttttgtcaaagcttacttgtttttaagagtcagcttaggtgtgacctttccctaggatattccttgaaccttcttctatagttggcctcctgcttccttacaagtctggcttattagtgtttatctttatgtcattgtgcataatctatctgcattttatgtgcatctctcacaagatcatgagctagttaaaggcagggtccacagttcactcattttggtataatttgcatttaagctggcatttagtagatactcagtaaatgtttgttgagtaaaataatcattgaatgaacttacttaaatgcacataatcatcacatttccctaactaaatttcaccatcctatatacaaagatatgtagattagtgagtctgctagccattatgttgaaatgcaaatattatatatgtttgatgttttcttcatctatcaaactagcaattatataaattatttcatcattaagagcttctaactgaacttctttttggctcctttccattactgtgttctttcctaaatgcatacagacaattttaaaaagagtgaatttctaattaaactgcctcactggagaacacttttacatggctattttttcccagtagcgtcaaacaattaaacctgggttaaaataacatggatttattgactactctgtgatattttaagaaattgcttctgacactaagcaatttataatctcattgggggatgacgataatgtatacaaaataggtaacattaaaatacatcaaggggtaaagtatcaacaagaatagtacagatgataagtgttgggcattttgatgaaacagtagtgatttaagcaaataaaaagtaaccacgccacataatatgaatagatagaggccacaggtaagaagtatagattatttattttgtaatcagacaaaagtccaagaaacagagcctcctttgattttgtgttgagctatttgtgaagccagtaggactattctggaaatgaacctaacagtatacctaaacttaaaaattatatattgttgggaagaggacagactattttattagaactttgtgatgaagtctgatcgccattgtcatcagataggacacctcacagagtttgtgtctccttgaaaacatattaaacatagaaaacaaataactcagctttgggaaaaccattgagtgctgccctaaatggccattgcctatcatgcttcagaaaaggaaagatgtttttacccaggttgttttttttgccaggttgttcctaggaagatatggaaaggaaagttggctagcttttcctatggccagaaggaagtacagcatgaaacaagtattttttttttttcaagaaccccattcattcattaattcattcactcacctttatccattatttattgagcactgaccttctggaaggcactgtgtcaagctatagagagctccatgttcactaaagcaatgttataaatttgatttcccttgttcaacccatcaaaataatattttgtctatcaaccagatatagcctattgtaaattaaagagcatggctggtgtaagtgaaaaatatgggtctagtcatgccttgggcaaattgttcaacaattctgttctcaattgtaaaatgaaagggttgaaccatttactttctcaagtcctctgaggctctaaaatataatgatctaattaattttgatggcctcctggtttacactttagtattggtgagtttgtttagtgcctgaacatgctgattgagttgactttgcgaacttgcaagtaagacagagttctgaaacacagtgacagcagtgtgctcatttaaacgagagaatgtccttctgtttgtaggggatgtataaactttcattccttaggtgtttgaaaacttagtgaactagtatttattatgctatagttaaaatatttctgtgcctggttaattgagatgtacgtcaattttatggcactttatgtgaataaatctttaaaaacattgcttgagtgcatggatattcctgatatttcagacatggcataaccatatatctttttatatctgttatattcgattaaattgctgtataaagtttaaactactccatcaacaaaattgagcattttagttatatgtatgtatgtgtgtgtgtgtgtgtgtgtgtgtgtatatatatatgaaattactaaagtcatgcaacaaatattatcttgaagtcatttttgaaagggagtattttaatgtgctcagtgaataatttctctctgcctgagagctactgttgtatcctgggaaatattcagaggagaagataaaattatttagatttgcagcttcttgtcatgggaggtgaaggcctttttattattattattaatgtgatgggaatagttccatcacatcgtgtctctgcacagcatcctgagaacaaccttttcatcacataaataattacagttctgttttttttaatgtctcctgctattccttccctccccctcttcaccattttccctttgagtgaggagaggatagcactcccttcagataaaggtttcctaagtattgacaaaaggcaggcacgtggtgatagtggtggaggatcggggaggggaggattgttctttgtcccaacacaacccaggtctgagctggctggaaaggactgtgtccagaaacaggtgtatatccttttaaaagcaaacttgttatatgtagaaagtgcagtaatttttccagagaaagagtcagcttctggcctgataccttttccttcttcatgggtctcctgcaaccagagctcctggcctgggtctcagaaagcacatcctgcatataatggtacccagggcctagatggggccagagtcctcttggtgatgggggtgagcaggtcaggcaagatctttgctctcagggcgtgaacattctcctgagggagacacacagcaaacctggacatagatgcagaaataaggaaaggtctgacaacagcgatgctgagaagggaatgtgggaggaaagggacctggcacccagcaacatctcttctcatcgctcccatttctgcatttggaattctgcctggatggaaggcaggccatggggcagacaacgtgggccttccataagcctccttttctgtgcatttttgcccttcagtagtgactctttccagtttctcttaggactctgctttgtcccttattgttattgagtggagcatggcctatgcagactctttggtgatttaaatgggctaggtagagccttaagacagaaaatgaagatagtggtagaagataatttttaaaaggataaggagctagtacttttgcatttaaatgaattccaggactagttcttttagtgaaaaagctataaatccctaatacttagtaatttttctgtgtttgcttctacctcagggcctttgcactggcattccctctgtctggaacagtctcccctctgatatccaatcctcaagcttttcgagtttttgttatgttttgttttgttttgttttgagacagagtattgctttattgcccaggctggagtacagtggcacaatcctagctcactgcagcctcgaactcccgggctcaagcaatccttgcacctcagcctatcaagtagctgggaccagaggtgtgcgccaccacactcagctaattatatttatttttttgtagtggcggggtctcactgtgttgcccaggctggtcttgaactcctgcgctcaagtgattcacccacctcagcctcccaaaatgctgggattataggcttgagccaccacacctggctctcgagtctttatttaagggttgttgttttcaattactactgtattgagaattagaccctctttctagcacttcatggcacttacatgataataatcctgttccttgtcactctccattggccgcctccttcccaaatgtaagtcatatgagaccagtgattttggcttgttttgttcacttctgcattcccagtgcttagaaaagtgtctttaacatgatgctcagtaaacattgttgaattaaaataagatttttaaaaactttatgttttaagttttcctaatggtaaaatcccttagaaaactctggcaagagctgtttacttttgggacttagaggttggaagaggatttctggacattttgtggtcctgggaaggactgtgtggccaagagcaggctgggtgggtcagaaggaagccagtggccaaaccatgggtctctcaaaggggaagtggtggggccagtggtgggagtttgggataggcaccctctgacttctacactcctgagatcagtcagatctaagtgtggacatggaactcatccttcctgttgtttggtgctgaaggaagtgagtataaaataaagtaagcataaacatttacagtgtatctccatttatgggctcagtgaagacaggatcataagtgttgaggatttttaaaaagtcattagaatttgagcattctgaaggggcagctccctcagatgaaatcagcttttctatttgactggctagtttactttgataatgtctaccatgaaaattttttgcattttttttcctgaaagatttcatgggaatgtggcaagcaaaataacggcccccaaagattctcactcaaaccaggatctgtggataaatgttacacggcaagggggaattaaggttgctaatcagctgaccttggaatagggagatgatcctgaattactgtggtgggtccaatgtaatcataaggtcctttaaatgtgagacagggaggtagaagagttagaagcagagagataatgtaaaaaagactcgaccacgagccatggccggctctaaggatggatgggggccatgagccaaggagtgaagatggcttctacaacaggaaaagacaaggtcacagattctgccctagagcctccagaaggaacatagtcctgccaacaccttgattttagcccagtgagatgtgcctcagactctggcctccagaactgtaagacaataaatgtgtgttgttttcagccaccaagtctgtggtaacttataacagtagctgtaggaaaccaatacagaaagagcaaggggagacctgtctatatgttttcacaacgcatctacttagcagtgctatgatttctggtattctttgggggaaaattaaaagccaaaaacagaaccagaaagcacttcagaagtgtatgattgtgaaatctagcagtggccacaacagaactagaactactaggcaaccagccccctcaagagattatgacctatgactcccacctctcctctccactctgagtcacatcctctttgtggacagtgaccacgagctcacaaaaccagactcaggatggcaagacccaagatgtgattattccatcagagcctgggttaaggaaagaaacagaggtaggaaatattcgaagttagtacacagtgctgctttcaggattcttcattagcagatgtttaaaagtcactgctctaaaatgacttggaaatgcttataaatatgaatttcctgtaattcacattttatcagaactcctatcagctgtatcacagcttgaaaaataccaaaaatgcattagaaaaatctttctgtttaaaactagattgatcccacatttacatggcaaaagaaggccattacttggcaggcagtaaaagcttcctttcagagagcttgagaaaaaactcaaaataattcacttcgacccaggccatttgacaaccgttagacttaactttacaaaataaaatgaaatcctaccacctgctgcttaaaatctccaattaatgctgtaaacagtgccttcatttaaaaaaccaatgagtaaatttctgcaagctgggtgcagacatttctacaaatttgctgtaaccttttgctcttgtctgcagtaagaagagccttccagattccaaaaagaagccagagctgatttatacctaattgtttaagagctaaactctttttgttcattagcttcagttatttaagatactgataattcacacctcatctgctgctatgtgtgtttggtagaaattgtgaaagaaaattattgaagcttgccaactttccacctatgaattaaaacaagagtaattttgcacaaactgcagaagagaaggaaggaggtggcaggcttttaagatagaaccagcaagtaggagaatcaccatcttccagcaacttgaaagcagtgagaaagttaggtctttaatctcttccttcctgtcctgataggttaattggaatgttctgagaggtaagcccctggacatctttgacctgcccccttctgtttaccagattaatcgggagacagtcattgtgaatattggtcaggcagggtcagctgataaacgggcagacggttgttgtttgcatcatgtgctgctagcaaaaccagcaggtggattctgtcattcccagccagttagcagttcaggggctagtgtggaaagagttgccaggaataatttggggctgctgtggtcggttatttctaggagcagggaacacctggcagataggacctgtgggcatggctatggcctgtctcagatctgtccagggtctctgattaaccctcagggtgctccacagtgtaactcttttgacgggtctggcttcgtctctcattcctcaacattcatctcagaagatgggtctctttagttagatttcttgataatccctgcttcttcagtggtttgttcttatttctaattcctacctggaatgtcctgttctcccatctctcttttctacagaccacatagaagggcccagtgggagtacaaattccctgggaagactttgtaattttcaccctctctgatcttaacctttcacatttacttactgagtcacaaaactggcatctcatccagaagttctcaaaaaggcacctctgttatttaatgcctaattaactcagtacatgatgctgatattttgtgggtacactgccatcttctcaaatgcccttcctttagtttttgtcatactcccgtctgctgcttttccatctttttgttctttctcagtcggagaagaaagatcaatccccttctctgtgtatctttgtgtcatgttctaagatttatatcacaagcagtttctcttcggtatctctacactccaaatctcccagaacactactctgacatcctggctgcctcccgagtatgtgaactgatgtcacaggattttcaaacttaagagattttaaatcaaattcattctttgtggatcattgttaattatatcttccctgtatattctactcagatgcctaagtgagaaacctcggagtcaccttttggcttgtgtttcttccttgctacctcccacaggatactgttcggtctatttccaacatagctgtggaatcagtttccacctcttgactctgctgccattaccctagatcatattctctctgcccatgagcattcctgcttaaggggttgtctgcctccacttttgttctcctttaatttattcttgacactgtcacaaattattgttctgaaacacagataggatcacagtcctatcattcttagaaattttggtggcttcttgttgacaagagtggagcctgtctcttttggatgcaagtcttgccatagtctgctccagttttcatccctcatgctcacataggggatggtccagccatagtagtgaccacacagcttgtgaaagccttgtgggagcctggtcagatttcagtttctctgggaaaacttcattgagcccttagaaagaatcattcttttcttatggtactattagcactttgtacacacctttattgtggcatctattatgtaaattattatgtattaggaagatgatctatttgaggccagggactgtgtcttttgttaatctttgcatccaaaatgttaccacaatacctgaatcttggagatttgaggcataggtttctgtggaagtttatgaatcaatggatgtttatttccgattaaaatataaatccactgtgggcaagtattatgttttagacatcttttatccttacataatgctgatcacacatatagtaaggaataaatatttgctgactgatttttgataaggacgcaagcaagagaaagtggtaggagacagacttgtaggctaaaatattagatgtaaatggttcacaatggtgtgtagtagtgaataattgctgtattagattttgttataatatgctgactgtttttactgttctgatattaatggaagcacatgatttttaaaataaatcaattgctatgattttttgggaataattcatttaggctgaattaggtagtcaaattaaaaaacaaaaaataatttcagacctatcaaagagctatagtctcaggacattatatttgtgtgtgtctgtgtgtgtgtgaaaactttctaagagttgttttaatgtaatatataaaatgtaagtaaatcataggcttgctgacattagaaatttcataccatttaagtgaagagttaaaacaatctgactgcctggtgttgaggactgcttaggaaggggagatggttagtacattgagcatggttgactgatttatagtcacaggctaatattcagtttttagtgttcttttgtgagctttctatccatcttcatatctacattcagtatgtatatgcagatatgcacacatatttgtgtgtgtgtgtgtgtatcaagtttaactgcatgtttttctggtcaggagaagatgtgtttatttgtgtctactgcttctcctagatggattgcacctaacaaattgttgaacatgttgcaggtgctcaggagttacttctgacagcttcattatcatcgtatatctaactgaaatggtacctttagttccattcttgaaatttaaaaaaagcacccagagtcccacagcagttatgcaatttcacattttttttctgggacttagacctagcaaccacttataaaaatctgggtatgggagggacccccaaattggaggaggggacttgggagtagacttaaacctcttcattctcattgctctttatgctggctcttacatggctctgagaggagtatttctaaagcaccaatctgatggaaacacgcacccacacatttattatgtttttaattggttgcataactctgttagatgctaaggatataaagatgaataagacgtggtcccttcccttaaaacttcctctttaaggctcttttaaagtaatatttagaatttaagtgagtcagggcattcgtagaggagttaatcagtctgtatagtctgggtggtaagtgctacctatgatagaggcagatccagcatgctgtgggatcacagaagagggagctggtagctgagagcagactgggaggccagggtgggcttcctggagaaaggaatgcttgaaggtcattgtgagctcatcttccatagtggttccctctcatccttgggcaacattcctgagagggggcttacaaagccttttaccttccggcttctgccaccccagttttgagttttgagcaccagtgcacaccacatatgtgtgtgtacatatacatgcatgtacacaccacatgcacacacacgctcaccaagtgcttcagttaaagagcactgagcagatcatattagtaagctcttcaccttaggtgtttaacagctctgtcctctgtgcaccattgtacccctggcagatgtctattagaccatgagaacacatagtgtgcccagttgcatacatagccatttccttttgaagcgcagggctctggttctttgtatctttagagtctaagaagcagtggcagtggttggtacagagttggtgctcggagaatgaacagctgaatgaatgaatggatgaatgaatgaattaatgaatgaacgaatgaactgatgaaagtgtttataaactgcaaagctggatagagagcccattcccggtgaactctggtgatgccagttttacaccacctctgactgtcagggagaaaactttcctgaatcttccttttttttttctgtcttgagagggttggcgggaatctgtgcgcctggtgggcatctgcagttgatccagattgtcacaatcctcagtgttaagagaaagaccaaggatgaggtcaaggtcattagaaatagaaactttcacttttatttcccattgatgggaaagctcggcacactgaagtttaagaacagtttgaactgttaagccctttcagatatgtaatggtcatagacatctgctctctgcatcaattgtacttttctttgtaagtaccattttggtggttacactggccaaagtggcaactgttgttagctgcagatcctcagacacatggtaatttataaagactggttggcatgatccttatccaatgccatttatggcttattctgataagctaagaaattcaaagaggtaagtcggatatgcaaaaaaatttacatggattgtttacttaatgtagaattttcttttggggattatctatcatttatgcatttattcagttattcatttgctagagtgtaccacctccagcaattcaaaggcctttccaaagttaaagtaaaattgttgcaacctgcatgagtctcacaaaatagataaactgggaaagtgagagagagtgctcgatacacaaaatatgactttctggatgccatttgaagcaggaaccacaaagcgctcttcatgtttgcgtagagttagcctcactcactcgtgtacagaaatgtcagcctctcctaggtgtcctttgtgaccacaccataaaattgcacgtggtttcatcatctagttctaaaatgtgcagcttaaaatgtacttaagaacaatgtgtcatacatttaaatgtaaaattggactgtgtgaatattcttagaattgtattcataatgaagtcaattcaggcaggcacagtttcaatgatattatgagcttcatcttaatagctttttccaaaagttttctgatataggtttgccatgttccatttaaacccagctgtggaattcattattgtgtgctaaattcatttggccactgactttttgaaaaggagaaaatcaggttttttatacacacatacccatataagagtatacactttaatcagtctttttttcttaaaagttcagctatttgctgaaaaaggaaatatactgcttaaaaaaggaaaatatattcaaataagcaaatatgattggaaataataatggctttaataatagaactttgtaacttcgctgtttaaacagttattcaattcttgtttttattttgtattgtagcgtattctattgccttatggatatgctattgttatatctgtagctcaactttttagtatgttcttatttttaacgagaaataatatacataagctttaggaacatctaaggaaaacagatggtttttcactttctttaccctgaaattaaaccccttgcttttaacttttgagctaagaataaaaacaaagttacagatgttctcatactgtgtattagtgcatgttatacccatatcccacattaacatttttatttccactgagatttctgatataatcaggtattaaacctgtggttattttggcaattatgccttttacagaaggattccaacagctaaaccctaagttaggaaaaaagaatataatttgacttcatctggaaaaaaattatcctaaaagatggttagaacattcagtaatagtttgcagtttttaaagaaaagctcacaggtaaagttcttgactgttctttcattaagcaaaaaacatgaagcttttttctttctccaaagtctcttcaaggcgcccgctagactcaaactcatcacaccttatattccatgcctgagtttccctttgtaaattaatggctctcttctctcttgttcctccaaagtttaatttgtacactgccctacagttgtgatttattgtaaagaatattctgtctttttctcaccttttccccagatgagctcaaagttactcaccctcatttgcccctgccatctctccacccagacctactatttccatttttaactttcgaatttgcttcttctcatccatgacttcagaagcagcctaaaagttcaaagtaacatagctttcccctatgactcttaaaacatgtgttcagatttggtctagttggtgtacttagcagttgagtgccttaacagtggtgatgcttcctccaaggttctgtagataatgatgggcgtaatgaaaggcatcatggagggagaaacttgggccttacccctggctcaaacacttcctgcctatgccgccttaggcatgttatttaaacttcaagttccttatccataaagtaggctaaaaatatccacttcacaggtaattgtgaggcaaggacttagcacgtagtagacatcctgaaaacaaaaacaaaactaggttgctttccctgtcctagctccatatggagtgctgtatgtaacctgaccatgttgtgtgtgatgagctttgggggaagtggatatgaaacagtgtcgtctcctctctgtagcaacatctaaattgtctgtcatgtggtactgttagggtacagagaataagtgtaaaaacttcagagatgtggaagacttctggggaggtggccatcacgttgtgtcttgaagggaaaaacatggctgtgaggagattgtatgagtgcagaggtgagaaggagctctggggacagagaagaggaggacaggcaagtgagcagacatcacgagtccctttggggttgaggggtctagttgcagagctgtgggacgtgttgttaaggctgaagtgaggccaaattctgacggtcttagaagttgggcagaggagtttagttatgacacagaacataacaaggagctaaaactcaggtaatcaaggtgccctcttaagtgaattatcctttaggatgatgaagagagaaggtctgtaccccttttgttttctccagtgtggatgatatggcttggctctgtgtccccacccaaatctcttctaaaattgtcatccccacgaggtgagtggatcataggggcagttcctgcatgctgttctcatgatagtgagggagttctaatgagatcttatcatttaaaagtgaccatttcccctgcatgtgctctcgctcgctcgctcactctctcgctcgctcgctcactctctcgctcgctcgctcgctctctcgctcactctctcgctcgctcgctcactctctcgctctcgctctctgtctctctcgctctctgtctctctcctgccgccatgtaagatgtgacttgcttccccttcgctttctgccgtgattgtaagttttctgaggcctccccagctgtgcagacctctgagtaaattaaacctcttttcttctttataaattacctagtctcaggcagttctttatagcagtatgaaaacagactaatgtagtagtgaagtggtttttcagctttctgactgtgacccatacataatatgataaaaatttacatcctgatccagaatactcacatatactgtatttgtttcatgaaataaaaattttgtgaaatgacagttacccttccagggctgactgcataatttgtggggtccagagcaaaatgaagatgtaggacctcatgttcaaaaagtagggaagaatgctgctaaaagtagttacatatgtctttttccatttcttctctgcttcttgacctgtcatggatttgtttttttgttgttgttaatttgtttgctacttactgtcattctgagtaaataaaaattaaaaatgtccattattaatactaattttactatttttattgtgcaatgccaattttaagtgcaaaacataagagcatgaaattaatgaaattacacaattggtatttcttattttgtacctgcatatgcatcttgttcttattagaagaatggaaatactgtacaaagctaactcagctgtttttattttacttcttgataggtatacattctaccaaccctctttaccttaggcttactgttgagtaaggactgaagaaaaggagcgatgggtagccttatatttcactttccttctcttttgtcattttcagtgtaagaggttggctgatataattaagaaagaacaggacagaattatccttggtcatctttatttcttagaatgccattgtctcctttcctcctcggaagcaagttctggttttgatagaaagtgtggcctctaggggctgtgagcaccctctgtactccttcaccccttgttcagatgctgacctaacacgcttgcttggtaaccacaaacacacacatattgcacccatgtcttctcatgagcctgctccagtttttcattgaacttcacttacaaagcacacaagttcaaggataaaatgattaagaattttaacgtggttggtgatagtggagcattaaatcaatgggtagggcccttcagagcagggccctgtgtgactgcacaggtcgtatacccacacagccaacccgggtactgcatttgattttctgttgtcttctattttattaaaaataaccccactagttgcaccccgttaaactgatgttaccatctactaatgggtcatggttggcagattagaaaacactggtaaattcatgaaacgcatggactgtgtgtcaggctgctgtattagagtcctgcttctaccacttgctgcctgtgaacttgaaaatatctccgtttctcgtgtaaaatgcaggttctagtagttcataaagttgttatgggaactaaattattaaatacatgtaatatgcttaaagtggtgttcattatgtaataaatatcctctaagtattaatcatcatcatcattattgacttatatcttgctgtaggtaaatgttgaataaaaaaatgtttcttgactatatcagcattcccacttatcctaaaacagatattttcttaagtttaccaacatctgtgttttcttgtgtctggaagtatataaaatataacaacaaaataaaagttaattcaactgcacttaatacaatggaaatattttaaaaattatagttcaataagaaatccaataaaagactacttttatttctgttcctcctcccagattaaaacaagtagatcattagtatttcatacttatcagttaagaaagaagcaaggatatctggaagataccatctgttgaacttaagaagccagaattattccttttcaaatgaaattatttgatgaaccccaatcataggttaaaatgcttgagaggaatattttctatcttttctttttttccccaaaggtttatttttatttatttttaaaataggccggatgcagtagctcaggccttaatcccggcactttgggaggttgaggtaagcagattactcgagcccaggagttcaggaccagcctgggcaatgtagggagacctcatctctacaaaaagcaaaagaaattagtcaggtgtgatgatgcatgcccgtagtcccagctattcaggaggctgaggtgggaggatggaggcaggaggtcaagactgcagtgagctatgactgtgccactgcactcaagccctggtgacagagtgagaccctgtatcagaaaaaaagcaaaacaaaactgacagataaaatggtatgtattttatcttttctaaaatacagcatacatacatttttattatagatagagaacaaatctacaagtcatgacatgaaaagaacacagaatctggtggatgctcagtcaatatctgttgttggagcaaccttaatccaagtgaaaaaaatgctggctggtttgttttgatctattttgaatcttcttccttgataattttgtaataaatagtactattttatggctcatttgaatatttcctatcattaattgaggctactgagatctcttttcccattgatttgatatttcatgtttgattctctcaaattgggcactaaattaacatatagtcattttgtatctgagtacaaaagttgtgtttgtgtcaattgctgatatatgggcatatttgtgttaggtcatcatcttaaaatggagtccaatagaattgcttaaaagggcttatgttaggctgtttaaataaaatttggaacatgatagatattgcagggaaatgtatcttacggaaaatttgtttttatctgccttttattggcagcagttccttgaattgcagactttatgcatagtcagaacagatatgctaaactgagtacattataacttctattttatgttaagatggaagattaaccaccagttaaagttattatatcttgagcaaggtatcgactctgataaaaatttatcatcctcttcaaacattactatggagcaaatataaacaccttaaatgctaagattcaagagatctcactttgtttaaagcaagtcaaagcacattaatctgtaaaattctagaacagttaaattgaaaacaccctcactcagatttaatgagcaattcaggcctattacctgtgccaatttagattaggtgaaaaaaatccaatccctttattcaggatgactgatttgcactgatttgcacatttacaccgtaaaccactttaccttgagtgagaaccacagtttacagaatcactagcacttgtctgagagttagattggctttgaaagtggttgatacttgctttatacttatagtagaaacatattattggtagtagttgaaagtgaatgttggagccttggattattagagatgttactcggtaataattgggatcaataacttttgaaaacacatatccagtccattttgattttcatatttgagctaggtatttaatcctttaagtatatatttatatataatttggaagtaaatatttagagaatgatttcagtcttctatcttaggtttatcaactgaagatagatttagaaaattcacaatcctgatttctctttggctattttttttttaagattctttgtatgaatttttaggaagccttctgaagctaaggagttttttatgtctctgtctgaaatgattgttagtgattatagtaaattgaatgctttcattcaggcgtgcaagtagaaggtatcttgttgcctggatgtgtgctgccctgcaggtttctcactttcttctacttcctcgcagcccctgacctcctgcaatggatttctatgttgtaacttgttttggtattttagctaaggttcaaactctaataaatatctgcatagcaagaatggtatattcatgaagtacaattctggttacattgatattgtcaaatgaagatgatctctatcggtttaacttggccatgagtgaatgggaattgtttaaatttctgtacaaatgtttgcatttcatgagacatgcttgtgcattagagacagaggtttagcaaaagctttatggtgctgacatctgtgataaaggcaggagtcagaagagatgggatttaatcccctttcatccctgactgtcttgatggcctcaggcctctgaattaggttgacaagactatggtctctctttacttcacagccaatcatcttgaaagagtcgtctgtactgcttgtcttcactaattcacctcttttcttataccacaaccccgtgtaatctgattttcatactgtactataattactgttacttaggtgaccagatcaaggggatccccaaatggcgggacactttaatactgattattcctttggtgttgacttccactttcccgcatcttccttgacagcctactcttttttttttcctgttaccttttactatttcttttcgatctttgtgagtttctcttctgcccatcccttaaatgttgtttcctagaactctgtccctaaccattttctattttcaccccaagttctgaaacccatgactttatcaatggtattctgactgttcccaagtctacatctttatcttggaactttattctaattaacagacttacatttctagccacttgctggacatttctatcagtatgcttaacaggaggcccaaaccaatatatcaaaatcagaccccatcacctcctttctaaccacccccatccccttccttctgtcgtctggccagtcttgatgaataacactgttaaccatgtagacaaccaagccataaacctgagagtccttcttcagctcttctgtttccctcaactctcacatcctggcagtcacggagtcctgccaatacaagtattcaatgtctcttgttgcattctgttaatcctggcattgccttcatccaggacctgcggtgtgcagagcagtgctgagattccaccaagcagtgccgccccctcagccgggagtggtgctgatgcagactcctatgcttcggagcgtcctgacccatcatggcatgctttgtttcccatttcattgctttgaaatctcctggctaccagcctcactgatctccaattttaatatgtattgcctttggtggcttcagtctgacccagtttcaggcattcttttctacagtcttgcctggtctcactctgccatgatatctccacctcagcaatatcagtcctaggtggctgtgggtgataacactttccatgatctccccctccacacagcctgtcatgaatcttcacctgcttctgtccaggcaactctgtttccaggacgctccctcagccccatgcaccccactccatgcttaaagtcccttagttgctcttcattatcttcatgatcaagttcaaattcttggtcacatcagacagccttatacccagccactccttatccctacagccttgctgcagccacacggatctgcctgcagttcttggaatacaacctgcaatgcctccaagcctttgcatatgctgattcttctgtccagagtgccttcctttgctccttaatgactaatttgtcttgtcttttgatttgtagcttccgtctctcacagccttctttgttctcctctccccattttttttctttcctactttatgcactgtcttaacagcttacatagacttgcatgctatgcgtattctgtgcagttgatttttccatgtgaccccccggtagataatacgtatcctgaggtcagtgccttgttcatctttctgtggctggtgtctagcacatgtgggagcatgaggaagctcagtaaacgttgcataataaggaagtagtgaacacagaattttaaaggaatttaaaacagtactatgtgtttttgttacaggcagatacttcatttgttatgatgataaatctagagtatagaagtatggctaactcttctgatacaaggtcatttggaggaagttggactaaccagaattaagaagagaaattgtcaattttaggccaaataagtaactgcaagtcactggggtggaaaaaggaacaattcaattattctgatgaactaaaactaatttgcagtgtaatttttataaggatgcaaaattagaaatgaagaattaaagctatatatacacttgttggtttaggtaaacctactcagaggtacttaattattttcagtcccacttatcagatatagactttagaaattgtatcataatttatataggttaggaaataagcattaattatacatattgtaaataatgtgctttattctttgtactctgaatatttctgattttcatgagaatctgaaatatctgtatctaaaaataacagaagtgtaggaataagaacaaaattacctgtgatctgggaaatcaatgataataatcctacttttgttttctgtctacacttagaatattttgctacacctatttaaagttaaggttaaataactgtggtgattaaaatcaattctatgcaaacagttaatagtcaaatgtatacatcaattgcataacagatgagatttaataccctgaaatgggagttggagaatagaaagaagccaaatatttcaaactacagttaagaatacttagcccatataaatgtgcggataaaattatttttatgtgttattaaaaattgccagagaaaaatatgacttgtgatattcttgtttctgtaaagagcttccatttgagctgatgggacataataagacatgtggagaagattagtgattaaaaaaatttggacatttgggttgtatcattgtattcaattagaggcactcagaacattagctctcatttgattagtttttcagtcttccttatgatgatttttttatatttaatccagaaaggtgatgcaaagaggggtattatataagttgtgacagggatcccaggagagttggctaataccctttcataaggaagtgttattacatgtgaacctgcccttcctctctacctcattacttgctaagcttcataaagaccctatcctactgggtcacctttctggaaatgctttctttaattttcaacaagatgctgtgatgacaacaatctatatctgtaaaaagttgtataaaaattcaatatatttcacatgtgaatgtagttcacatcagactaagctaatgaaaattatttttatatcaccttcttaccaattttaattttaattttgcctctggtgactgaggtgacacataaagagtattgccttataaatggattgacttttttttcttcttaggatattattttatatattgaatgtcataaactccttgttccccacattttttgccagtaccatgctggttttaaagagctacttttaaaaattaacactttgttttaaagttcattcaacatttttattatgataggcagtcttagtgataaatcgtagtaaaagagcttctagttaatagataactaagatttttataaagtatttagaactggacattatgatattagttttcttcttattcatcctcataaatctcaatcagtttcaaacactaaatatattaaaatatggattatgataccatttaagaatagtttttagtaattttggtgagaaagcaagaatggtaggcttaaattctgattatctttacttgaaagtatcattaattattgggtaacttttaaaatttgagaatgttaaataattgtaatattgttaaactgaagtactgataaattgaaacaaggaaatgctttcatttcagctgtcctagttgcagaaaagctaaaaacacacaaagcatttatttcatgtttcagtaggggaagcagattcctatttattatgaacagtacagtggtgatatgacttccctacctcagcagctctgctttcattttgtaagcaataaaattcataagggataagtgaaaaataattgaggagcacttttatttttactagagtgtttgttatggctttaccgtgtaatatacactaaaatgtctgttcacgttcaaagaaaaaaagatgagagctgaatttgggtgtagtgtgcattcaagcattgaatttgatccttcacgtagtaattgaatgagagcagtattgtgtatcaaatttatccttgctttttagtttgttagcaaatggcttttactacaaaggtttttagggcagggtaagacttaaaaaaatagaatcactttcctctggaagatgtgtgggtgtctggggttggtggtagtgttttgcacctggtaggagaatgagaaagagaagtatttacagttagggaaagaaaacaaaaggcaggaggctcaaaggagggttttctgaccactgtctttttggcaggaggagcagagggtatctgaaaggcctgtttttgcccagcaggtatctgcaggactcagaaagtggatctgtggtggccactgcagatgttctttccagaagaacgcttcccaacatttattgcaccagggaccagttttgtggaaggcagtttattcaggggcgtcgggggatggttccaggatgaaactgttccacctcagatcatgagacattagttagactctcgtaaggagcgtgcaccctagatcccttgcatgtgcagttcacaatacggtttgtgctcctatgagaatctaatgctgctgctgatctgatgggagggtggagctcaggtggcaattctcactcacctgccgctcacctcctgctgtacagcccagttcctaacaggccacagaccacttccagtccgtggccctgggagttggggacccctcctcatgcacataatttctagacacatgttgtatcattttcctatggctgttgtgacaaatcaccgcaaacatggtgccttaaaacaacacagatttattatcttacagttctggaggtcagaattccaaaatgggccttactgggttacaaccaagctgtcatcaggtctgtgttccttctggaggctctaggcaaggattcatgtccatggtttttccagtttctacaggctgcctgcattccttgacttgtggcctttccatcttcaaagccagcaagggtggctcaagtcttgtttgcactgtatcagtcccactctgggcctccttcctctttttcactcacaaggacccttgtgattatattgagttcacatgaataagccacaattctcttcccatctcaaggtcagctgcttagcaaccttaattccatctgcaaccgtaattcctctttgccatgtcatgtaacatgctcacagtttcttacgatcaggatgtggacatcttgggggtggggggcattattctacctaccaccaataacgtaatttgttgatccctttgtaggttgtacctcaatctgtcttctttctcgtcagttccctttgttctcctctctaccctccatccaaatgctatactgccaagtgtagccagattggggcaacaccctgtaagaacatgaagaattaatgcactgggctagtggctaagttgttggctccttacattctacttcaatacagcaaatatgttttagtgctggggatggaacagtgaaaaatacggacaaactgcctgatctcttggagcttacactttggtggaaactgacaaacacagtaagtgcaaggcagagaattaaaccagggcactatgaatgaatgagtggctactggaattggaacaaggagggtttcctgagatctggctgacggtgtgaaaatggggaaagaactttttaggcagagactctgtgaagaacaaagccatgaggcaggagagagttttctagtgagaaacagaatgaaggtcagtggagcttgagtttaatgtgcaaggaaaaagatacgaaatgcagtttgaggaggagttaagtgccagatcacatctctgtaagccatagtaaggaacttggattgtatatgtgatggaacaatgttggagagtttctaagctgtggaattaaacactttttaaatgatctattaagagcacttggctattgtatggaggatgattatgagctagcaagagtggaagaagagggacactagtttgtaagctgttttaacagcccatccaacagataatggtgatgagaccaagttgggagtggagatagaaataaatgaatatatttgagatacattttaaaaggagattgaattgagaagattgacaatggaatggatatagaaactgaggccaggaggaaataaagataattcccagattttgggattgagaagtggtgccatttcctgggttggggaatctgggggatgagcagtttagggtggggaaccagagttgtgttttgaccatgttaaggttgaggtgcctattggacatccaaggtgaagtgtcaagttagacagttagatagatatatatgttttgggatctataaagaggtcgaggctgaatatacgtattagagaatcactggcacattgatggtactcaaatgagattaatctagaaagtgtgtagatagagaacctgatccacaatgcagctctgaggtgggccaatatttagaagttgaacagaggaggatggattggccaaggagacttaggagaaacttctggtaaaaccaggagggtgaagacagacaggcaggcaggcagacagacagacagacagacacacacacacacacacacacacacacaccctgatactgctgcattaaaagctgctaaaagatcaagtaaatgagataataaatattgtaatgatggtcattgataattttgacaagaataatctctctggggtgctgttatagaagatagattagaaagagctggggaaagtgtgggggtgaggatgagaccgtgactctagacagctaagcaccaggtgctctgcattctgagatgatgcgccatcccattattacttttcccaagagctcacttttactacctagagaagagttacttttatatgatacacaggcattctgttattatacttgctgtgcccaattagttttagaggaagcaaaattgctaaaactcaagacgtttcatgagcagttgaaaattatactaatgctcagtaaaaggggactcagaactcctgaatgtgtgcagaactattattggcacactaaaaagttcacaggtgggcagtgtgtggcaaaaaggatcacttacctgttgacattagtatgtagtaacactaagttcctgtttttatgaaaatcccaagtgacactaaaactgcttctgtgtctcattggggacaaaacacctcagccctagttgtcactcacccttcatgagtcgtggtagaatagctgatgttgctgtagcaataactagacaaccatggcacataataacgctgtcatggtctaaatccacaaatttactgtgcaagtttaaattagtagtaataaagggaatatggtaaggttttgaagtgctcaaataatgttgcccttgataaaaagggtaatacttttggaaatttctcatggaatctatacttgcaagcaggtgttttaaattttcaatgttttatctttgactttgtccatgaaatgtgtcttcagttgctttttacgatggcatcgacagaggggaaacatattcttattatatcattcggattcttttccattgtattttggccttgttggcaattctttggcatcaaatgattttaattttctaatttaaggcctaatttacttttgaacactcacattggcccacggatcttggccctggatgaagtgtatatgaatacagattgtattacaaataatacttgcagacaatgccaaaaatttggtgtttatataatgctttgtattgttagttcagtttaaagaacatgtcaaaacctgttaggaggctgacattgtgctaggcacaggacaaaaattgtggtctatgcctaaaggagcttgtggtctagcagggaagggggcagaattggtaaaagaaattgattaaagtaagtgtgatcatgaataaacgcagtatgtgggaggaaaaagtagtgcagaggggctgagcacagtggctcatgcctgtaatcccagcactttgggaggctgaggagggtggatcacctgaggttggagttcgagaccagcctaaccaccatggagaaacgcttgtctctactaaaaatacaaaattagccaggtgtggtggcacatgcctgtaatcccagctacttgggaggctgaggcaggagaatggtgtgaacctgggaggcggagcttgcggtgagcggagattgcgccactgcactccagcctgggcaacagagtgagactccatctcaaaaaaaaaaaaaaaaaaaaaaaaagtagcacagaggagggagctgttggttctgttttgttgtggggttacaggataagatcagaggagattttcatgaaacattgacagctgagtaagatttgagccatgagtaagtctgctgttgggccaccacccagggacagggtagaagtggcaaactagacatggaaggcatagggtgagacatgaaaaagcatagcgggtccgtgacctgcaggttctttggtcctaactgcacatgggctgtgactgaaatcgctccatttgatgaaaatgatcgaaatcaaggtgaaattgaggggatgtcaatggagttgaagagtcagggtatttaagggtgtagagtggctcatcacatggtgttgaagttactcagatggtgacatacagggttggttagatttcctttaaaatgaagtagaagaagcattcaaagaagaggccaaggattcttttgaattaattgtatcaaaatcaggatgcccatgagataattttggaagagagaatttaatactgagcagggtgggtgaggacacgtgggtgtagggggtgtatacagcaggaggggaatcaacgtgtgagaaagagattaaaccggggcttgtcttttgtcttacatctaataaatattaactgaggacttactctttgcagtgcaccatgcttattcttggaaaacaaactcctaagataggaaaggagctacagggtatgaatgtggaagagtaaacatcgcatgtctctgtgatggtctccatgggatacaaaaccctcaccagcagcgctttcatattttccagagtgactattatgcagtagatcttagtgcatatttacccatcaatcagatgaatagtatctattcattaaaaattcctattttgcactattcattattgtccattaattaaagcatggtactgcaacatgcagctatttattatgttttcaagtaacatttagtgacatgagaaatgctcatgatatggttttaaagaaatgattttaaaaattatatgtacaataagatcccagttttacgagtgcatgtgtctgtgtgtgtgtgtgtgtgagagagagagagagagagagagagagagagagaaagatagatggagtgagggagggaaggaaagaattgtcaaaatattagtgatggctgtctctgggtcatgagattaaacatatttattttttcaccttccaagttttctaaaatgcatataaacaatttataatcaaaaatactatttaaaatagttttctcgaaaaattaatattctgcctttaattttatataatgtttatggtaaaaatgaaaattctagtaggcctatcacaaaggcctttctagctgttctgcctttttttgatcactgtttattcttacgaattcctttctgatcttcatttcttgctctgtgctgttaatggcaatggcttaaacattttggttcactgataaacacatcctccctccacacctgaggcaaccatttaaaaaaagtatttatattctctttgtgtcactgtgcacagcgttgagctttgctgatttgtctctttgctgtttatatccttatggttgtcattttccattccagtgccctttcaattttattttatttgttgttatcgattgtattcttcttttctggtaaaatgcttattctaaaacacatctgcaaaccattcgtagctccgcttggatacagttaaacatttcattgaatgtgagtattaagactgtattccttttgtatctataggcctgcctttgtagtctcttagtaagcaagtgcaacatttggacacaaaatgtcatccaaaaagtcatgtgcataggtcataactgtagtctactgagtttagcatctgactatgatggttgtttttcaaggtaatttcagaaggtagaaatgaatgtcaaacatacctatttttcttcactcttttcctcccttcctgtttccatccttccttctttccttcattccttcctcactgggctgtatattttcagcttccataatactctgctattgcccttcctcatcattcaccttattggaagtatgtttatctctgtctcctcattggactggaagcaacttgagagaacagtccacatttcattcatatcttaggctgtctcctgggttcacatcctgccttgcatataattggtcctcaacaagtgtaaaaatatattttacatttaattaagagtgacttcatagctttagcaatacgaaagattattagataaaataggttaaataattatgctctgggaaataagcttccattagagaaataaagggggttttaaggcaaaagataaaaatatattttctagactgtaggggtaatcaaatattgtaatagattaccagagaaggaggtaaaatcgccatccctggagagccttaaaaattggacagagaaaacatctgtgagaatggccaaagcactaaacctgtcttgaggcaagtagatagacagaatgacaaatggttctgcaattctttgattacttggcctgaagaagagaaggctgaggggagacattaaaactacttcaaatatgaaaaacagctattattgctttccagaggaaagcaagttgaaggagcttaacctaaagtcagagattgagtttacatttgatagttaaggatttaaagtcataggttgtgaaaatcttgtggagatctgcagaataaatgatactgattttttggtgagatatggaaagtcaactctatgatttggctgcagtaaaaacattttttataatactctgaatagagagaattattccaatacattatattgaatgcatagcattctcttgggaaaggtaaatttctaaaagtagtattttaaagcagcaagcattttcactgttttgtgaataggaggggagaactgggatgatacttgtgaatttcttctcatctcaatgcctgtacaaagggctatgttagtaaatcagtagccaaagggtgaacaggagcttcgacagaactttaccctgctgggtcagccttgttttgaccactgaatgttttctcaatgaaaatgtggaacaactgggggtggtgtggtggtcggaggagggggtgcacaaaaatactatcaactaaaaagggaatccaaatgtctattaaaaataagcatttgattgtaattccagcattcagccacacgatgtcacaattggattttgattttcactgtgtgtttgtctcaatagatgaaggcattttcaaagctggagcagagaggtctgaaacacggggggcagcagaagtccaagaagatgaagatactcaggttgaggttccagtcgatcaggtaatctccatgccttaaaaaatatgtgtaagacaattatagtgttttttttccaagttttgtgttatctcctacaaattgttcctatacctgtatgaattaaaccctctaaggtactatgtggctgatcaaccttaaaaacataacaaaacaccattctttctcctagtattcctgtgaagaatagccatttagaccaagtctttttaaataacagcaaatggtatttccttaataaagagcattgaagagcaagatgggatgggattaggtatgagataaagtgataaagtttgatataaaaaagagtattggtttgggattttcatctggaataaaagtacttacccacttagaaaagcatttttaaaaaattatactttaagttctggcatacatgtgcagaacgtgcaggtttgttacagaggtgccatggtggtttgctgcactcatcaacccatcatttacattaggcatttctcctaatgctgtccctcccctagctccccaaaccctgacaggccccagtgtatgatgttcacctctctgtgtccatgtgttttcattgttcagctcccacttatgagtgagaatgtgtagtgtttggttttctgttcctgtgttagtttgctgagaatgatggtttccagcttcattcatgtccctgcaaaagacacgaacacatccttttttatggctgcatagtattccgtggtgtatatgttccatattttctttatccagtctatcattgatgggcatttgggttggttccaagtctttgctattgtgaatagcgctgcagtacacataagtgtgcatgtgtctttatagtagattggtttactatccttcaggtatatacccagtaatgagattgctgggtcaaagggtatttctggctctagatccttgaggtatcgccacattgtcttccacaatgttgaactaatttacactcccaccaacagtgtaaaagtgttgctatttctccacatcctctccagcatctgttgcctcctgacttattaatgattgccattctaagtggcatgagatggtatcgcattgtagttttgatttacatttttctaatgaccagtgatgatgagcgttttttcttatgtttgttggctgcataagtgtcttcttttgagaagtgtctgctcatatcctttgcccactttttgatgggtttgtttgttttttttcttgtaaatttttttaagttccttgtagattctgaatattagccctgtcagatgaatagattgcaaaaatcttctcccattctgtaggttgcctgttcactctgatgatagtttcttttgctgtgcagaagctcttcagtttaattagatcccatttgtcaatttcggcttttgttgccattgcttttggtgttttattcatatgaagtcttttcccatgcctatgtcctgaatggtattgcctaggttttcttctagggtttttatggttttaggtcttacatttaagtctttcatccatcttaagttaatttttctataagatgtaagaaaggggtccagttccagttttctgcatgtggctagccagttttcccaacgccatttattacatagggaatcctttccccattgcttgtttttgtcaggtttgtcaaagatcagatggttgtagatgtgcgatgttatttctgagaactctgtgctgttcagttggtctatatatctgttttggtaccagcatcatgctgttttggttactgtagccttgtagtatagtttgaagtcaggtagcatgatgcctccagctttgttccttttgcttagaattgtcttggctatatgggctcttttttggtcccatatgaactttaaagtagttttttccaattttgtgaagaaagtcaatggtagcttgatggggatagcattgaatctataccttactttgggcagtatggccattttcacaatatcaattcttcctatccacaagaatggaatgtttttccatttgtttgtgtcctctcttatttgcttgggcagtggtttgtccttccccttgaagagggccttcacatctcttgtaagttgtattcctaggtattttattctctttgtagcaattgtgaatgggagttcactcatgatttggctctctgtttgtctattactggtgtataggaatgcttgtgatttttgcacactgattttgtatcctgagactttgctgaagttacttatcagcttaaggagattttgggctgagatcttggagttttctagatatacaatcatgtcatccacaaagacagacaatttgacttcctctcttcctatttctatttgaataccctttctttctcttgcctgattgccctggccagaacttctaatactatgttaaataggagtgattagagatggcatccttgatctgtgccagttttcaaagggaatgcttccagcttttgcccattcagtatgatattggctgtgggtttgtcataaatagctcttactattttgagatatattccatcaataccttatttattgagaatttttagcatgaaagagtgttgaattttatcaaaggccttttctgcatctattgagataatcatgtggtttttgtcattggttctgtttatgtgatggattacgtttattgatttgtgtatgttgaaccaggcttccatcccagggatgaagccgacttgatcgtggctgataagctttttgatgtgcttctggattcggtttgccagtattttattgaggattttggtgtcaatattcatcaggtatattggcctgaaatgttcttctgttgtgtctctgccaggttttggtatcaggatgatgctggcctcataaaatgaattagggaggagtccttctttttctattgtttggaatagcttcagaaggaatggtaccagctcctttttatatgtctggtagaattcagctgtgaatctgcctggttctgggctttttttttggctggcaggctattactgcctcaatttcagaatttatcatcggtctattcagggatttggcttcctggtttagtcttgggagggtgtatgtgtccatgaatttatccatttcttctagattttctagtttatttgcatagaggtgttcatagtattctctgatggtaatttgtatttctgtgggatcagtggtgatctcccctttatctatttttattgcatctatttgattcttctctcttattagtctggctagtggtctattttgttaatcttttcaaaaaaccagctcctggatgcattgattttttgaagggtttttcgtgtctctatctacttcagttctgcttggatcttagttatttcttgtcttctgctagcttttgaatctgtttgctcttgcttctctagttcttttaattgtgatgttaggatatagattttagatcttttctgctttctcctgtgggcatttagtgctacaaatttccctctaaacactgctttagctgtgtctcagagattctggtacattgtgtgtttgttctcattggtttcaaattgcttatttatttctgccttcatttcgttatgtaccagtagtcattcaggagcaggttgttcagtttccatgtacttgtgtggtttttcatgagtttcttaattctgagttctaatttgattgtactatggtgtgagagactgttgattatgatttccattattttgcatttgctgaggagtgttttacttccaattaagtggtcaattttagaataagtgtgatgtggtgctgagaagaatgtatattctgttgatttggggtggtggattctgttgatgtctattaggtctgcttggttgagctgagttcaagtcctgaatatccttgttaatgttctgtctcgttgatctgtcttatattgatagcggggtgttaaagtctcccactaattttgtgtgggagtctaagtctttttgtgggtccctaaaaacttgctttatgaatcttggtgctcctgtattgggttcatatatatttaggatagctgttcttgttgaattgatccctttacaattatgtaatggccttctttgtcttttttgttctttgttggcttaaagtctattttatcagagactaggattgcaacccctggtttttttttttctttttttctttccatttgcttggtaaatattcctccatccctttattttgagcctatgtgtgtctttgcacatgagatgagtctcctgaatacagcacaccgatgggtcttgactctttatccaattggcagtctgtgtcttttaattggggcgtttagcccgtttacatttaaggttaatattgttatgtgtgaatttgatcctgtcattatgatgctagctggttattttgcccgttagtttcttcttagtgtcgatggtctttacaatttggtatgtttttcagtggctggtactggtttttctttcccatatttagtgcttccttcaggacctcttgtaaggcaggcttggtggtgacaaaagtctctcaggatttactcgcctgtaaaggattttatttctccttcgcttatgaagcttagtttgcctggatatgaaaatctgggttgaaaattcttttctttaagaatgttgaatattggcccccactcttctggcttgtagggtttctgcagagagattcactgctggtctgatggacttcccgttgtggatcaccccacctttctctctggctgcccttaacattttttccttcatttcaaccttggtgaatctgacaattatgtgtcttggggttactcttcttgaggatcatctttgtggtgttctctgtatttcctgaatttgaatgttggcttgccttgctagtttggggaggttctgctggataacatcctgaagagtgttttctaacttggtttcattctccctatcacttttagggactccaatcagttgtaggtttggtcttttcacatagtcccatattttctggaggctttgttccttttcattattttttctctaatcttgtcttcacgctttatttcagtaagttgaccttcaatctctgatatcctttcttccacttgatcatttcagctattgatacttgcgtatgtttcacgaagttcttttgctgtgtttttcagctccatcaggtcatttatgttcttatccaaactggctattctagttagcaattcctctaaccttttttcaagcttattagcttccttgcattgggttagaacatgctcctttagcttggaggagtttgttattacccaccttctgaagcctgcttctgtcaattcatcaaactcattctccatccagttttgttcccttgctggtgaggagttgtgatcctttggaggagaaaaggctttctggtttttggaattttcagccttttttactggtttattgtcatctttgtggatttatctacctttggtctttgatgttgctgaccttctgatggggtttttgtgtggatgtcctttttgttggtgttgatgttattcctttctgtttgttagtttttcttgtaacagtcaggcccctctgctgcaggtctgctggagtttgctggaggtccaccccagactctgtttgcctgggtatcaccagcagaggctgcagaacagcaaagattgctgcctgttccttcctctggaagctttgtcccaaaggggcacccaccagatgccaaccagagctctcctgttatgaggtgtctgttgacccatcctgtgaattttctcccagtcaggaggcacaggggtcagggacccacttcaggaggcagtccatcccttagcagagctcgagcgctgttctgggagatccactgctctcttcagagccagcaggcaggaatgtttaagtctgctgaagttgtgcccacagccgctgcttcccgcaggtgctctgtcccagggagatgggagttttatctatgagcccctgactggagctgctgcctctctttctgagatgccctacccagagaggaggaatctagagaggcagtctggctccagtggctttgaggagctacagtgggctccacccagttcgaagctccccgtggcttcgtttacactgtgaggggaaaaccacctactcaagccttagtaatggcagacatccctccccccaccaagcttgagtgtcccaggtcgacttcagactgctgtgcttgcagtgagaatttcaagccagtagatcttagcttgctggggctccatgggggtgggatccactgagctagaccacttggctccctggcttcagccccctttccaggggagtgaacggttcattctcactggcattccaggcaccactggggtatgaaaaaaaaaaaactgtagctagcttggtgtctgcccaaaatggctgcccagttttgtgcttgaaacccagggccttggtggtgtaggcacctgagggaatctcctggtctgcgggtcacaaagactgtggggaaaatgtagcatccgggctggaatgcaccattcctcgtgacacagtccctcagggcttcccttggctaggggagtgagttccccaaccccttgtgcttcctgagtgaggcagtgccccccaccctgcttcagctcgccttctgtgggctgcacccactgtctaaccagtcccaatgagatgagccgggtacctcagttgggaatgcagaaatcactggccttctgtgttgatctcactgggagctgcaaaccagagctgttcctatttggccatcttcagaaaagcatttttttaaaatgccagtatattcttgcctttagggtccttgagattgttttggttggaatttgtttttcataaaggaattgcctgtataaatgtaagtcaaatatttgctttgtgtgtattgattttctttcttaggccagtagaacactgtacttctaggagttgtgtgtgtgtgtgagtatatacgtactcacatgtgcttatagaatggactaagtagtgttaattttctctaaatgatggaagaaataaaagtcagctatgctttttaatataatacatcaagcttccttacaattctaagtggaggattggagtttaggtgaggagggggaaatgataatcccagactcaggaaaggggagaagtcactaggaactaccacttgtcctctgactactatatgatattttttttctaaaagcagatttcaccatctgacaaattccatagatgatcttctcaattgtatttgtcttaacagtgcagcagtgaaattgctgcttgatgattccacaggcattttctgcaagtgtcgtcttcctgatgaaaagcctaacgtggtaaaaatcacgcagatttcaaaaatccaatttattatccaggattagctataactaataatttttcataaactccagttataggtattttttcctgagggaaagtgaaactttaagtcttctgtgaagccataattaaatagtatattttaagacaaagaagagtgatcatcatgtatatacaacacctgatagctgcagaaaccaagactaatttatattccaaagtcaaaatgtcaaatattaagagaaaatcatagccttattagcaaaggagaaatctctctgttaatcacttatttaacaacttgcaaatctgtgagatatttctttactttgacattcgatgatcctcaggaaggggagttgggagggaaaattgatctctgataatgctcgaacagccttggatgcatctgcagggcttgatttcttatttaacttgtgagtgctagcttatcaaaatgcaggtatgcaggagatactgagaaacagattggtaaaagctgggcaatatcaacaaattggtatgtgcttgaagaaaccaaagccaggtaaccaaaggtactttcttcttggactctcttggtcataacattgggattgcctagtttatttgttcgatacgaggtgcttatgaagtcaggttacagccattctctatggtctgctgacgtttacatcctaagcagctatattataaatatggaaaactaaaagtgtggagaaattcgttgaaagcccattagtttcattatagtaagaccaactctgcaacagcccacaatggtgatctgcattaaacaatagctaccattgattaagtaactactgagtgccaggcactggactaaggatttttatttctttcgtttaattatgaaaacaaccctgtcagataggtcttattggagctgggtgtggtagctcatgcctgtaatcccagcattctgggaggctgaggtggtctggatcacctaaagtcaggagtgttcgagaccagcctggccaacacggtgaaacctggtctctactgaaaatacaaaaaattaaccaggtgtggtgacaggcacctgtaattccagataatcgggaggctgaggcatgagaactgctggaatctgggaggcggaggttgcagtgagcagagatcatgccacctcactgtagtgtgggtgacacagcgagactctgtctcaaaaaagaaactggataagtcttatcagtcttattctatctacctacttatctatctacctatctataaatacacaaaggaagtgagctcatgaggtgaaattatttgctcaaggctgtaccatgttaattagaggaaatgggacttaaatgctgtctatccaacttaaaggcagacaagtgatctgaggagagagtattgcataaaaaaaaaagccaattattaacccagaaaggaaaaaaaaaatcctaattaagaaaggaaatatagtcatggtatactacttgtcttagctagaaaagatacttaaatacactctctctaaggccattagctagttaatgtctttggactgttttcctgtcatctaaatgatctgtgttgtaattttagtcagagggccttgaagaaggaagttgtatgtgcctgtgtgtgtgtatatgtctatatgtaagtatcttgtgcaaattggccaagttatttatccattcttgagaagcagattaagttttagaagtctttgctttcattgggaggcaattctccatgggtctgttgtgattctgcccatcttgtgagcagaggcactgctggcctttgttctggaccatctctttaggtatgtttgtatagtgaatggccttggaagacagagagagtgatgtcttccagaacaatcattctcaacttgtggtgattttgcctccaaagggatatatggtgatttctgcgaccacttttggtgtaacaactgggggagtgctatgggcatctagaaggtggtggccagggctgctcctaattatcttgtaatgcacatgacagtcttcacaacaaaaaattctgcagcccagaatgtcagtagagctgagattgggaaactctgttctgggacaaaggctgggtctctttattgtccagtatgataaagacaatgtctccctatggtgcaaaggtcaggcaagtttacttcccattgtgaaagatttaatcccattgatttgtacacttaagagtggttaaaatggtaaattttatgtaatatgtattttactataataacaatatttgaaaaaaagagtttgggttccctaagcttgaggttcttctcctaaaatgcaaactaatgtgtgcataactagcccccttctcattgtgggaattgggtcttgggtgcaaatgctattttggctactgctattgcgtgagcaataaagtcctttgtcactgactcattggtctcatgtttcctgccagcacccatgaaactgtggcatgctaacttgtctcttgctagcagagtgcagcttcagaccttccatagtccttgatagcctctcctggtaccatctagcatgcatgtttgtgtgtgcacatacaggggtatttgcatgtgtatgttacgcattgtggactaattccagctaagaaagagtctgagctctgccccaaggtccagactcttttcattagttacagacaaattaatgatgatggacctggtagtacttccaaacccatggaaagacagaagaatgttcacattcttgcatgcatttagggaggccagaacaaacgtgttttctcagaggtgagtttaggtctaataagcctaagatactctttcaaaactaacctgttttgtgtatgcatgttccaagtcaatctggggttggctgtcagcagtggaacaagtgcctgattagcagatgcctgtgattgctctggcactgatgaccctatgtcaatacgccccatttatatgatggtgcttttccaagctaaggaagtaagaaatgagtctgctccattttaattaagtaaactgcccctagtaataaaggatcaggcaagagaattcaccatctcagaaacacagaccagtaactatgaaataaccaaatacacaattgtatttttagagtttgtttaatttgacagaaccgagtggaagatggagatagtaactttggagtgattttggtttgttttattgcttttcctatttgtagttgattttgactaataaaataatgagaattgaaaaatgtttttatgctaagtagtttcattaaatagcatttaacccagcatcatgaacattaaaacagtaaaataatttttttaaactggaggttgtgatatatactattttcttatttatttaaaatttatttttaatcagaattgtacaagtttttaaaagtcaatcagttcaacaaagattgtaacaaaatagcagccatttgccacacccctcctcaccacagttcctgtttcatacagttacctgatttgaactagtttagctatttctcatggagtactgctatattcctaatcccctctcccattttaatacatctgaggtgcttggttcttacaagtgatggcatctcatagtttaatttaaaattattttaaaaatgattttaattaaactttaatttaaaaaattcttttattttagatgacataaaagaatggagatccctttcattgggtggtatctcaaatttgataaaataaattttgattttgttttgatttattaacattctggatttatcttgctttgtatttatcttgatttattaactttttatgtaattactatggaagatgattatttagattttttcccaaactcgttccccctatcaaaaatagggccacatacatacaaacacatacagatacctttccctttcttttttctttccactataattttgtaatacttttggttaatatctatacattatttctactatgtaaatgttattcttagttgaaccatttaggtgtactctagttacatttcctttcttgggtaaccctttttccctgttgcctaggttaataattacctattttttcacttgctttgttttatatgtacctgttactaagccatctccaaactctgcaagaacttactgtcctcttgatacattcacatacattcagtgatactgaaatcttcattttatttttttctcaatccctccagtcagctgcctcaagctggtaagttgttctctagatctgcttttcagagttatcctggtatttttcttcaccattattttgagaatttcctttgcttccttggtggatggttctcttctttttttggattctatgtcttcctctatcttggttacaccttcaatttttgtggaactcacctctagttgccttcagagaaaagcttcatgggagacacatttttctgagactttgcatgtctgaaaatatcttttttttttctctaatcaaacttgactgtaagtatggtgaagtatacaattctaggtttgatataatttctctcagaattgtgaggggattcttcaattttcctttccattcagaatggtagttgagaagtttggcattctgtttctttaaatgtaaccctttttcctttctctgaaggcttttagactattttctttgttcctggtgttctggaaatttccaattatgtgtcttggtatgggcctttttgcttattggactgggtactcaatgggctttttaattcttaaaatatgtgctttcagttttggaaaaaaattgtttctttgataattttcttctcttcctttccctactgtttccagaagtccaggtatttgaatataggacctccccaagtgattatctaattgtctctcctacttttcatctctgtggatttttaactttctcactgaaaaaaaataaaagcctcaacttttatcttcctttgattatttcctagtcattttatttttaacatctaagagctctttcacattctctgaatgttccttttttagcatcctgttcttgttttataaatgtgatatcttccctcttctctgaggattgatgttctattattttacactttcctttcctgcactatgtttttttcttctgaggttcttttttgttttctttgtctctatgttttgatctctgtatccatgtcagagtcgtttcttggctgtctggttagatttgagagtgaggtattaaggacacactgtgtgcataggtaggggaggtgtcctgtagggtgattcgttttggccatttcattggcaggcctcctccaagtttcagtatctgtaagtattgctcttttggggtctatatcctttgagaggaatctttcagtcttttgccttgttgataagaacctagctgtcaacattttgggatctgactgtgagaaagaggcatggatcaagagatttattctctgtttcagtatagtccccttgttctgagctatacttgagtcgtttccctaaggttcaacatctccagataataaacctcccatatttctcaagggaggtgatctcaggggatctatttgcttcttttaaagactctgagccaatctacctatttttagccacagttatctatcccccttatttcagaggcagatggtgcctccatccccaagccttctttaggtttttaagcacgcaaaggcttgcttcttggcttccctttctgcagtctcacattttagcttcctcaggtctgctgtcatccatccatttgccccacatccatttgctttactctcccaaattttgtggttgatattccctttccactcttctgtgtccttatgggttcatcattttaaagttgtcttaactgatgcttcagaggagcatcagaagggagctaagaaaaaactcccatttattcaatctgctgtgttcaaccagaaaccactttcataatgatccatcagagctgttttcctagaatccgcaatagggatggtagcctgtgggcagattttctatgagggaatcttctttggctggcacagggctaacaacatctgtatctctttagcaggccatgtgttcttcagacttccacaggctgtagcactccctatgcctatcatctgttttcaattataaatttatgttttttgacctgtccctgggatcatttgaacttgtgaccattggtctacacatacataatataatgtgattttaaagaaactgcagcttagaggctgtaaccagaaataggtttaaaaaccaaatatgcctgttgccctagttttattctccatgttctgacttggtctcatcattgactctacccccaactaatggagaattagcagctacctgcagctcctcttgtgaaagttaagtaagatgaagaacttcttgtcttgcttttccatatacgataaaatatgcggaaagataaaggaggctgttttctgtgacaggttccccaaatcgacttcaatgaaatgcatttactaaacaattataaaatatttagaaccagaagggaacctgacctaagcttcttattttgccattgaagaaacaaaaccccacagtggagaaagccattttccctcagagacatgatccgttggtagtagaattagcacagcggtcctgtcttccagtttggtcctctccctgtacatcttaaagaagagaagtgagaagatgaggggcttctaattagcccataaatggcaacatattctgagggccactcaaccttcactgctgtctctgaactaaaagggattatgtgtaaatggtatatttatcattattttcaagtcatatactcttattgaatcatattcacattaggcattaacaaacattgctcatggctggaagggttagaatgagaatgatcagagttcttaatttatctatgcattgtcagtaaggctttttgtggcgtcacgtttgtagacttgtatttaaatgatagaaatggtgttaaacattaaaatgtagccatcagggatttctgatataaatgaaagaaaatcaacatttacttctaacttgagaaaatttaatggggaacttttttctttttttaaatatatttttattatactttaagttctagggtacatgtgcacaacgtgcaggtttgttacatacgtatacatgtgccatgttggtgtgctgcacccattaactcatcatttacattaggtatatctcctaatgctatccctccccctctcccccaaccccacaaggacaaaaaaccaaacatcgcatgttctcactcataggtgggaattgaacaatgagaattttttttattgatgattaaatatattcatgccatctaagtatgttttcagtttatcatatattctcatttgggtgtcacaggaactggtggggcttaaagggacccgggtgagacagcttccaggtgactggccacagcttcactcttcttctgtacttacagggtcatgtctctgaatataaccaccctttttgtaggtctttgtggcttcaaatcatatctaaaccttttttttttttttcggtgaaagtaagcctctgaaagctgaaagcaagaagtggtactttgccatcataaaaaattgaaactgattatttcaaaacacctcattcaacttggataggagatgattttagtttccatgggaacagaaataataaaaacaagtacgataacttctgtattttcaacatctatgcctgaatgctgccataaaatccacagaaatatcttctaccccaaaacctgtaacaaatccacacactttcccaaatttgaaacttcataaatgttacatggaaaaaatggacatctaaggtagtctttttcatttttattgatctccagtttctaggtctaggttattttagggagagagaactaatgggtggcaatgaggaggagggttgggtggtgagacaggatatcttcactaaaaaattctaatttgtgctgttatttatgatagtatatgccttaaacattaaaataatatccctcaggaattctgatgtaaatataagaaatatcacatttactgctaaagtgggctggacatgagctgtggtctctctttagatggctttccccgtttttaatttttgttgctgctgttactgtcagaggtgtgatatgagtttaaagtgtaagtcatttgggcagccccatctgcctgtggaaataccttccaagtaattgatgctttcagtattttgtggcttatttccatataattttcatattccatcttctttccccttaccactcaggaatcctgagttaaccttagtaactgcatgcatattctctagaaaacctgaatacttaacgatttcccctgagccccatccctgctaggatgtagccagaggaaataactaccagaccttttctgtcttcccatacaaatcaaccattttctcagaatgtcagttacaaaataaatagcaagatacacatggaggcaaactcaggcaaaatacactcaaaatgccaacgctggtgtcgaggagaaaagctggtacagcttttctaataataaatattacgagcaattacttataattaataatgtgttttttaaaggtagaagtcctgtcttataaaaacctctctgtttaagggtacatattgtctgtaatcgtacatatatttttaatatgtgtaacatgcccgttaatctagttgcattctggatgcgtgccagagaggctgtgaggctggaatcatctaggtttaaatgacttctgcgatcattgtttataccattatgtacatcagtttaatggggatttaagatagagtataatgaatacccttttttgcctccggcgaaacagaagaattgtgctttataaagagtatagcattccacaattactcataggcatgagctagtcctgaaatttcaagatgtatgtactccttagagaaacaatttctatctgaaaacaggttctcttaaaaattttcatcacaaaattgactgaaaattgacgtaaatgtcagggagatgaagactttgagcataaaatataaaaatataaaatataaaaaaacctttctgatttattgcttttgcagtgatgggtttatttttatgacattgactcttaaacagtggcatggtgatgtaattagaataaatcttgtagaactgtctttatggccagaaatcattttgtcaacagtcagtccttccattgtcttccaactttcagtaaattggtaacttttaagataaaaacaccaccttcatttaaagaggcatgatttcagggcactattacagtgagaactgttaacccaaaatgattttttaagtggcatattcatgagcatattgcattatatgtgatttacagccctactgtgcacagtgtcatttggggaccagcattgtcagcatcacaggagctgagagagatgcagaggctctgaactcatgactcacactttgcatttgacaaggtccccaggtgacagtgaggcactggtcttggagccactaggctggaagtaactcttgaacatacattgaatttaacataaatatgtctttgctctgtactttatcttaggaaaatagttattacaatccaatggtcaaagaattcaaatccttttgtcactacttggagaattttggacaagtttacctaattccctgtgcttcagtttccttatctgcaaattaggatcatcatcgtgtttttcttaaataattgttgtgaggttagtgtaaatatgattatgcatatgacgtgcttaggccatagcactgggtacctggcaagctctggataagtgtgagccttatcatcagtgccttcctgaaggcacatatgaggctgacttttatctgtgggaggcacatttgtgtcttatttaagacgaatatccagagtcagtggtgttgggaacaaagatgaataacaaaaagcccttacttcaagaaacttccagaagacctccatagtgccagggctgatatttccctgttattctataatcattccaaatattttgggggtatctactcaatagcaatttatgttcactattttttttgcacataaatagagaataactgcacagtgtggttagaatgtactagaggtatcttagcaagtattaggagggcacaggtgaggagtgacggccacctgagggagcaggaaggctttctggagaaggtggttctacccatggggaaggaagggcatcctggatgaaggtataaggaacagcatgagtaataggatggcacagcccgtggcccagggctcttttcagtttcttccacagaggactctccccactccaaacttatgtctgggaaggtctgggtttggccttctttccctgccacatccagccatccctctttccattgttgaggaacccaacttccctatttttttaaggaaatagaggagggatgggagagtgagggtgttgggaagggaggtgaaagagtattagtatgagcatgtgtggggctggggagggaaggtattagtatattagtttgctagggctgccataacaaaacactgcagactaggggacttaaacagcagacatttattttctcacagctctggaggcccaaagtctgagatcaaggtgttggcagggttggtttgttctcaggcttctcttggcttgacatgagtcagattggattagggccaccctcatgacctaattttaacttaaattgcctccaaatacagtcactttatgaggtactggggttaagacttcgacataataattgtgagggacggtacagttcagcccccaaaagtgagaagatggggtttgtctctaatttgatgctgcttaacagatggataatattcagggagtagagtcagcttttcaagtttgagtccgtaagaaacatgatcagtgatgagtagagcggggagaaaagcagagacatggctcccagctcagcccagcagcccctctgcctcattatccattggttatagattagaggttggccttagccacgtgccttgttaccatggcgaccagtttttcagctactgaggggaccactgttcttcaataagaagtgtgtgtgtgcgcacatgcacgcatgtgcacgcaggtatgtgtgtttgtgatgctgatgaaagatattttcatctactggccatgtaacctttggcaacttgctttatgtctctggctcaatttcccattctatacaatggaagtaataatcacatctgcccacaggttgggaagataaaatgagaaactgcatgtgaaagtgctctaagaagcacaatatgctacctaaatgtttggcattacatattacatccataactggctactgccaacctgtcattccaatggaagatagagtcatttgttgcttaagcgcgtatactaatttatggaaattatccttgtttagtatgtcttgtttgtacattcgtattacttctgcaagtattaatagctagcagtttggaaacaacaaaaagctattggatggtaaatgtgttgtgaaaaatggatgccaaagaacttggaagcaaagaataaacataactgagagtgaggatgattagtccatatgaatcagacccaacagtcttaatggactacaagttcccagggctggtgatagctctgagtttgtgtgagtggtaccagattcctcttcagtagttttgctacagcacagtgagagaggagtgaaggggatggaggaagggtgcaacttgttcctcctttgcctcttgtatttcttttttatcctaaagaatagttacatagagggagtgcccttttccttctttgcagactgtcaccatggtatagattttatctgtgtgtatgtgtgtgtgtgtgtgtgtgtgtgtgtgtgtgtgtgtgtgtgatgtgtatggatgggtgtaaaacccggtgttccttctggggatgatttgattgatgtgtacactggaaacatctttaataatttaatgtctgcttcaaaggagattacaccaaaaagcacattgcttttcatttattcattacagatctgtcatagcagcatttttatttttttgccctgaattgtagtgtcgttgtaataataaattttgttccagactcaggatattttaaaggtttataagccttttaactaatgttaccgtcttatttaaattgatcaaattggcatttcaacacgataatcttgcatttcttaaagttgaactaaccagatgtggcttcatttgatgactactaaaatagctgtgccgggaaagtctaatagaaataatgggatgaaagcataatactgcttgttagtactggtggtaataatgactatgagacagggcctgaatttagggccagttgtcttctttcctagaaagaaattagggtatataccagccgtttgcattaaaaggagaaaaaaatgtataagtgtttgggaattctggataaagaaagaggtaaggctgagaaatacaaaactaaatactaatatgttattattttgcaatttttaggtataaatccagatgtcagaagaggaaaatagacattttcttatttaggtgtgattgtcttaacataattcagcaagcactggtaatatgttctcagagaggcgaggaccatatccagaatcctaaaaagttacagtaaattatgagttttttgttattttattaaatgctacacaacttctctttaaaactaaaacaaagttgttctgaataatagggcaagtttaggcacagtaaggatcaaaaccatttctaggagagtgatgtataattatccaattttcagaggtaatttaaaaagaaatctgttcctattggccattagtactgcagtattttgggagttttgttatatactgcttcaggtactctgctagacaattcttataataatgtttccttcctagatcacaccaaaagtcagtgatagaaattcccaaaatattttgttttcaggtcagtaattctttttttttttatttttattttttgagacagagtctctctctgtggcccaggctggagtgcagtggtgcaatctcagctcactgcaacctccatctcctgggttcaagcaattctgcctcagcctcctgagtggctgggattacagacatgcaccaccaagcccggctaattttttgtattttagtagagacggggtttcatcatgttgtccccagggtggtcttgaactcccgagctcaggcaatcctcctgcctcagcctccaaagtgctaggattacaagcgtgagccaccatgcccagcctcaggtcagtaattctttaaacagtaaaagtaatgttgcctactgcagatctcatatgttctggccattgaaagtacacgtgagtgtccttattgtagcgacttgtttggttattaatttaaggaaagatactaggactttgggacaagactgccttttgtttacaccctagccctacttggtcacttgccctgtgatgtgggaagtgtgatgcgatttctcatttactctctttgtctaatgggtataagaaacaactcatagggctattgtgagagttgcatgaaatgctgcgtgtgatgtttggcacagagcggtgctcagcctttgcacttccatttgccccgcctttctcacctgtcactacctgcaaacactgtagacacagagttgtagaagtctctatggccaaacaacccactcctttcccgacacatgcccttaactgcttctcgcctcattccacattgtaatgtgatttgtttacgcatctttcctgcctattgtgctctgctctgcgctctttgatctcggagacagtggtatttatctccgaatgccgggaactctcagtactgcttaacacagatgggtgcccttggcccaatcactgaagtcataaggcgtgagagtcccttatgtgtctctcagggtcccacaatgaccatgtatgttattctgcagagtccatggaaggaaacttgtctctgggccaagggtccacagggcttttcctggcttcttctgacttgttcgtggggaaccatccgccatgttttctctgagctggtttattataccttcttcccccttggaagtcccctctctgccttagtgtcttggtaaaggaaaactctcgacttcctggtgtgggctcctttcctgaactccctagaaatccttgctcttcagcgatgcagaatgtaatctttggctcagtacatttcctctgctccattttatttctttttgtggtaatatactcataatggcatatttaccatcttaaccagttttaagtgtacatacagttcagtggtatgaaacacattcataatgttgtgtaaccaccaccaccaaccaggtccaaacctcttttcgtcttgcaaaactgaaactccatacccattaaacaagaactccccatttctccctccctcaacctggcaatcagcattctactctctgctctatgattctgactacatacctcacatgtagaatcatacagtatttgtctttttgtgtgactggcttatttcacttagcataatatctctgtttcatgcattttgcatcagaattttctttctttgtaaggctgaatgatactccattgtatggatatactgcattttgattatccactcatcttttgatgaacacttgggttgcttccacattttaagctattgtgaataattctcctataaacttgggtgtacaaatatctcttcaagtccttgctttcagttcttttgggtatttacccagagggtggagttgctagatcatatggtaattctattttgaactttttgaggaatgaccatactgtttttcaggtggctgtagcattttgcatcccccaaaatgcccaggagttccagtttctccacatccttgtcaacgcttgttttcttctgttttttttttttttttttttttcttgtcattataatgggtgttaggtagtatcttattgcagttttaatttgtatttccctaattattagtaagttgacaatcttttcatgtgattattggccatttgtatatcttctttgcagaaatgtctattcaagtacttcgcacatttttgaatgagactttttgttgttgagttttaggtgttccctatatattctagatatcaagcctttatcagataaatgatttgcaaatattgcctcccattctatgggttgcctttttactctgttggtattgtcttttgatgtacaaaattttaaaatttttatgaagtcccatttatgtatttttttgttgcctgtgtctttagtgtcatatgtaagaaattaccaccaagtccaatgccaaaaagcttttgccttatgttttcctctaagagttatatagttttaggttttacatttaggtctttcattcatttgaagctattttttgtacatatgttaggtaaggatacaacttcattcttttgcatgtagatatccaattttcccagcacaatttgttgaaagactgtcctttccctactgaatggtgttggcacccttatcagaaccatttgaccgtatatgtgaaggtttatttctggactctctgttctattccattggtctatatatctgtcttaattccaggaccactctggttttggttattgtagctttgcagtaagctttgaaataaagaagtgggaattctccatctttgtcctttttcaaagttgttttggccactcagggtcccttgagattccatatgacttataggatgggtttttctatttccgtaaaaaacaacagggattgcattgaatctgtagatcactttggataatattgacctcttaatgatattaagtattctaatacattaacatgggacatatttccatttatttatgtcttttaaattttcttttggcaatgttttgtatttttcattgcacaagtctttcacctcactggctaactcctaagtgttttattccttttgatgctattgtaaatgaaattgtttctgtaatctccttccagattgttcattgttagtgtatagaaatgcaactcattttcatgtgtgatgtattctcctccgttctgtttttataatgacaacacccatctttcccttgccaagccctcctctccttatcacctcaagtgtctgtatctcagtgccttacttagcttgttctctttgaggagagggtgagatgggtctggtggggcagattggaaatgttattctctttgttagagattggagacttttctcactttcagtcatttaggtcacatacattaaacaccagaaacttcttaccaagcattgtgagttatgttcataaatcttttgccttttagcaccagctggcagatccattcccctctggacctgagtttctgtccatcattctgcctttgtgagggacccaccctgacgacatgctgagggatagttaggactctccgctatttgaccttaagcatccgaataaaatttgaacagcctaggctcacggtgtcttttaatctgcataatgacaaacattgtggttttttcagtatctaagaacaactagttttttccttcatttaaaaaatacacatttggtatcatgtaattaaatctgagactttatttttgacagaagataagaattattactagttccaactctttcttcttaaaaataatgtgtggaatttttttctgaacttttagtcttgtccccttcatttccttccttacttccaaaactgaaagcattatgttaacttttgtaatgacaaaaagtttggtcagttgtttggtcagttagaagagatgggcttctagagttggaaaggggggtcagggctaactgggttccaaactctcattttacagggaaggagaattaagtgacctgtccaatgtcaggtagctagaaagaggcaataatgagatcttaacaccaaataaatcattctaccctatcattgaaaaaaaccctgggctgggcatggtggctcatgcctgtaatcccagcactttgggaggctgaggcaggtggatcacaaggtcaggagatcgagaccatcctggctaacatggtgaaaccccgtctccactaaaaaacacacaaaaaatttagccgggcgtggtggcgggcgcctgtagtcccagctactcggggggctgaggcaggagaatggcatgaaccggggaagcggggcttgcagtgagcagagatcgcaccactgcactccagccagggcgacagagcaagactctgtctcaaaaaaaaccaaaaaacaacaaaaaaaccgtgttattttattgatagcattgaagaaatatggtggctccaggagagaatgtattgtaacaaatgggaagggatttccatgttttttaggatctgtgatgtgccagaaactatgacactttatataacttttctctaatcttcatggaagttttgttacgttcccattttacaaatggggaatctgaaactcaccaaagttaggtaacagccagtaagtgcctggtcaggacttgaacctgggtttttctccaaagtcttggctctgaaagctggcctcctgttccctcccccaccccttgttttttttttttttttttttgagatggagtcttgctctgtcgcccaggctggagtacagtagcactatctgggctcactgcaagctctgcctcccgggttcatgcaattctcctgcctcagcctcctgagtagctgggaccacaggtgcccaccaccacgcctggctaattttttgtatttttagtagagatggggtttcaccgtgttagccaggatggtctcaatctcctgacctcgtgatctgcccgcctcggcctcccaaagtgctgggattacaggcataagccaccgtgcctggcctcctgttccctcttgaagcagatttatgtgtatcaaaataacagtagaacagtgaaatgcttgattaaggtttatgaaatactttagtatttattctttttttttttttttttttttttgagatggtgtcttgctctgtcacccaggctggagtgcagtggcgcgatctcggctcactgcaagctctgcctcctgggttcacgccattctcctgcctcagcctcccgagtagctgggactacaggtgtgcaccaccatgcccagctaatttttttgtatttttagtagagatggggtttcaccatgttagccaggatggtctcgatctcctgacctcatgatctgcccgcctcggcctcccaaagtgctaggattacaagtgtgaccactgtgcctggccctcagcatttattattcttacagagaggacatatagtttcttgaccttagatctgcaggaaaatcagttattgtgtttagagagaagctgtcagcttccttaggcattgtggggaaagctgtctacattccacgtcagaaaacatgaattcacagcctggtgccattgccctcatccttagccttgaggatgacaatctttccacaaagactttttttttttaaacctcttcctctgggccaggtgcttcactagacagtggccaaggaccttgcggtttggctttctatctgccatgggggttacaagcactggttctggagtcacaggcctagttcaaactctggctctttctgtgggatcttgggctccacctgtttagttttctcatctgcaaaatgggaatgataacaatttcaaaggattgttgtgaggattaaatgagggaatgcttgtaacatgtggcatgtggtaggtactcagtaaacgtaagtgtattctatactgtaaagtactatgcaaatgtaagaatgttttacttgactgtaatataagtattacattactatgatgtgcagtggaaatgttctgttatgcttcttacttttatccattattccttttgatccatcagaggccagcagaaatagtagacgaggaagaagatggagagaaggcaaacaaggatgcagaacagaaagaagacttttcaggaatgaatggtgaccttgaagaggaaggaggtagggaggctacagatgcccctgagcaagtcgaggagattctggatcacagtgagcagcaggcacgccctgctcgtgtaaatggaggcaccgatgaggagaatggtgaggagctgcagcaggttaataatgagcttcaactggtcctagacaaggaaagaaagtctcaaggagctggcagtggacaagatgaggtatttctattgcttttgcttgcttatgtgaatgcatgaatatgtgtgtgtgtacatgcgtgcattcagagaattaatcaagtgtttaggacttgtattgaaaccacttgtggttgagtaggaaagatccaataccatttaatccctttacttactagttatttcaaccatttaacaatactgccattgacctgacagtttgtgtctgcccttctgccattcatacatttagccattgacccatccatctatttacctcctgcctaattttacaagaaaatgtacagagccttctaagaacatacataatccaagaaagaaatataaaaaagtaagaataagttaagaccagagaaggtagaaaccaaaaaagaatatcaagaccagtgagacctagacatgaaataaggaatactttctctattatgagtgatttctttgatctctagaagtactgaagttagtttgcttttttctactttaaatagattaatcaaattaagcattcaacacattaggcacttgggtagtatacagttctatttattatacagagaggataaagaaatatgtggtgaaaataagagaacagaaaaagtaatatctggtgaaatctctcttttcctagcctgttcttctatgtctgatcctggagttggatactcatcagtcctggcattcttccacgggacaatatgatcctgttgctgccaggctcaagttgagtctcacagcataagaggcaggatgttctccataacattctcaccatctgcttatcccatcccttcctgtctatccgtcagttcaaggtccacctccctcaaggctgtaactgctgaagtgggccttggactactcattcctaatacccactatgatcactgaggtctacttgattatttattattgatgcatctgatttatcttgcttagggaaagcaagtttagcggtggcaaaatgcaaaatgttctggtggccaggtttcagtaacagtacgaagttatctgcaatccactatatgagttattcaaaatgttcttaacatctaaatgaaaatgctcagcatgtctcttatcttttctcaaggtgagataatcatagtcctattctataagaaattccccatattagttctacatagtcctcagcgtcatttatatggcacctgtaatagtaggtttcatacaactctttgttgtagtagcttttgatgaaagcttacaaaatgaaatcaaagtgtaattctgtgtgggactagatagtaagatccaacatgatttttttccagtggtctagcttaattcaacatatcacataaatagattttacagaaatgaatggattgcctgtccttccatcttccataaatataactttaaaaaataatcctgtaatttgcaatgacatgaataaacctggaggacattatgttaagtgaaattagccaaccaaagaaagacacataccatatgatctcacttatatgtgtaatctaaaaacagttaaactcatagaagtagaaggtagaatggtggttaccagggactgagtacagggttggagagatgttggtcaaatgatacaaaatttctgcgagaaaggaggaataagttcaagagatctattgtacagtaaggtgtctaacgtataataacaatgtattgtatacttgaaaatcactaacagagcagatttgaagggttctcaccacaaaagataagtatgtgaggtaaggtgtatgttaattaactcaagccattccacaatggatacatatttcaaaacatcattttgtatgctatgaacatacaatttttatttgccaattatgacaaatgaatatttttttaaaggggaaaaataggcttttgataggaattgggcatccgtcaagatcaaggttatgtaatttggcattgacctgtggtatgtaatgagagtgaatctaaattcttgggagttcaaataaggaagtgcctagtttgtgattttttttttgagacaacatctaattagggactttttttttgtgacaaggtctcactctgctacccaggctggagttcagtggcgtgatcacagctcactgcagctttgacctcccgggctcaagtgatcctcccacttcatcctcctgtgatagctgggcccacaggtgccaccatgccaggccatatatacatattttttaatatggaggaagtctccctccctgtgttgcacaggctggtttttaactcctggactcaagcgatcctcttgccttgacctctcaaagtgatgagattacagccacgtgccaccatgcccggcctaattagggattagtaacagagcagttactcacaaagagatttaatcttatttgactcatctctttcttataacaatgatatattttatcttgttctccctaacatattagtataggtatattttaagcataccgaaatatatgagaaaccaaatttatgtgaattgtaagttaaaaatgaatagttaacttttacagaaggactgtctactaataaaatgactagaaattctgttcaccgtgtaacattttgttccatgtaacaattcttgtacaaagcgagatatgattgtaggaaaataccaggaaatacagagaatttacaagaaacaattgacatttattgagattgaacttgtactatattcaagataccatttgagacatttcacaaaggaacagtgtgaaataagacacggcaccagtcatatatatatataatttcttcaaagcatcagtcatggcctgtgtggtttggggaacctggagctactctgtcccccagactgggtgcccttgtgggggctgtggagcctctaggatttcatagagcagactttgcaaacctgctggttctaatctcacccactcagttttcagtgtagtcggggaaaggtgagttgtacatgagacaatgtcattattaacaggaaaaacccaagtggcaggagcaatagttgttgttggagaaatgctgcctccacattttgattttctgtctttttcttatctacttgctacttgatggtacttggtaccatattcacaacgaatttgtgaattctaggaggaaactaaaattaggagaatgtccctgaattttttcttcctttgtctctgaaaatgctaaactgaaaagtataactaaattgaagaaaagctcaaagagaaatcaagaaaaaatgagaaaaataaagcctgcagcatacaaaatgagtcagggcctttcaagcactagtagattatgaaccccaaaaggacttttgtacaagtgttgagaaaacagtatgtccactgggtaatgatagacaaaaaaacaaagggaaccccaggaactctttttagttaaatatttatataattaaatagaatcttgagtaattttttctttataaatgtcattacctttgtgaaccaaacagctgaatacctttgttttgatctattttcttctaggctgatgtagaccctcaaagaccaccaaggccagaagtaaaaattaccagtccagaagaaaatgaaaacaaccaacaaaacaaggactatgctgccgtggcttagaagatttttaaaaagagagtatatggatcgcaagaaaaatgaagggttatcatacttgaaagataagcacatagttattgctgaatataatgtgacactatggtcgaatactacctacgaattataacattagaagcctagtggaaagaccagataactttaaatggctactaaaggataattacttacttttattgcatgtgttttaaaagtcatatagaaatattaaataagacggacagaggagaatttgcactggaagacaattgccacttgtaaaggatgaaaaataggatcactcttattgtacgctttattataagtttagaaggcagtttattctaaataatttttctctaggaaggcgtagaattttaaagaactggtaataggaaagcatgtactattttcttaaagcaataaactcttgaatgaacagattgcgatttactttcagacataatttggagatggcagtagatcaaaatgtgtccatgacttgttaacatgcctttctttcttcctccttagccaaaatccacctttgaactacaaagacagagcaaggcgttcattttggtgggaggaagcattggttcagagtgttagtgactagtatcgccatgccgtcacttaaatgctttcaggcttgcatgcttgtggctccaatggcgcacactcaggaaggaattgtaaaggagcacccagttatattataaagcctggatgtatggtttgcagataatggaaatcctgtggattttcactgatccagtctatctttaccaatagtatctctctcttctcccttatgttattagagaacctgatattggctattccaaagattaaattattttcaaatagttttcaacaaaaataaaagtgtattaggaagaaaaaagtagactatatgaagagtttgtgactgctcaatttaacttgttttttgccttatttctattaagactgttttactatgtttttgccctagggatatcagcaaatatttatttttcctagcatgatatagttagaatttcaagcagatttctttgtaattagaaggcatctgatagaaattgtaaaactttagaagttattataatgaaaccaattcctgaatcacaacttcatggactgactaaattgatttatagttgccttgtgaggtatgtatggggaaaacataaaaacataattaaaacataatttcgtcctttttatgaattcttaagagatgttcttccataaatatagaaataatatatttttcttaaaggatatatttttaattatgtggaagttgtaagcttgaaattttaacttctagtgcttttctaaaattcacaattacaagtttaaaacattttttctcttccaggtttcatttggaataaagagttggcagttatataaagcacttaataatactatagaaaatagatgtgttttttcttaatatgattttggtattttccacagatcagaagtgtaaacagagagataatgtaacagtatttggaagagataatgacacaaggatatagtgatctgggagcatgaattagaaacagggtactatgtttctggtgtaaaatctaaattgtgctttctactagcgttactttttcaaatgggatgatataaagcactgtgggctataagcaacaatcttgggttgctaggcaaatagaccaattgatctttattattattattattattattattattattttttgagatgaagtcttgctcttgttgcccaggctgggtgcagtggcatgatcttggcttactgcaacctctgcctcctgggttcaagcacctgagcctcccgagtagctgggattacaggcatctgccaccacacctggctaatttttgtattttttgtagagacagatgtttcaccatgttggccaggctggtctcaaactcctgacctcaggtgatccgcccgcctttgcatcccaaaatgctgggattacaggtgtgagccacagcacccggtcccagttggtcttttaatattaaatttgtgcactattactgggtctggagttaatgatttcaaatagtttctaaaaataactgattaaatgtaagaaattataactaattatcaaggtgattctcttttgtttcttcaatggagagtttctctttctcttttcctcctctaataaaaatatttctttttttcctgtccttttattcattatattatgaaacttaggttttaggaaacaccttaagcgtcattttaatgaagcacaacattgatattttacatgaataataacgtttggtattttaaatatacttcaagggggtaataagccacaataactgtaccaaaaaaacttaaaaatggggacatattcatcccttgtgtgtgcatattttaccacttgttgacaagatacaattgtgacctactttgaggggatgaataacgacttatcactttaagacactttgcaaacatgttactaaaaaaaggtgcctagccaaggaaaaaaccattcacttggaattaaaattgtggatgtcacttcagagatgactttaacataaatgctgaaagttcattcacctcacaaatgtggcagttttctctgtggagaatggtggtctccgtggcagactggctctccaaattaaatgaaactcattgacagacctgggaccttttatgtgagtggacagacaagatcttggtttggcttcatgtactgttttctagagagagtgctacgaaaaacttatgatgcttttatgtgataaccaatataatgctttaatatgttaattctttgtgatgctatatacatagtttttatagttttatgaaaccactttgttaaacttatctggattttaagacacttgtaaacaaatggtttgttagtaaaattggggcattaagagttttacagagcaaataaagaagattttgacaaaagtcattttgaggctaagggtgttttacctgggttaacttctgttaaaatagctattgagtgcccattgacttataaaatacgatactatgaccataaaataactttttacttcttattcttctctatgaccttaggatgactttatttttttaagacatttttcctatatgtttttgggggaatgttaggttgccacactcataggaaaagtgtgatgctatcatgcctcctgttttattgtaaaggtgtgaattcttgctatgtggtgtgtgaagacagaactatcccatacatacgtggttcagagtgagatatctctaggctcacagttgtgaacccatattaatatggtattattcctgccaactcttccaatttatagctcataaactaacatcctaaacattgtcattgaatgacctaccttatacacaaaggataaagttcattcacctagaaaaaaatctgtgcatttaaattagtggccgcaagacaacaggaagctttctttcattttttgttcaacaaaccttgcaaaagcaaagtttaaaaagtagattaattcatcaacagaaagcatcacatggaaactgtggccaatctgaagagaaatatagcatgtagacatagatatgtatcaaatacttatacagatgcactcacacactttaaaacattaaaaaggcctcctgaggcacagcgttattaataaaacaaggctcttttgggtgaagttgagagaagcaatgagttaaaacgtgagaggaaatgctaagaaatgatatatattatggtgctttaaatcttgatttcctaagactttaagagatttaaaattcttctccaaataagaaaccagcatgtcaatgaaaaatgtattctagggaggtgttgaaacaaatccggtttttaaaatgtgatatatcacataaaccaaaacagaaaccaagacatatcttgttttcctgaagtaactacagagcatggttcttttccatcaaccttaagcacgatacatttcaggtgtagattcttttataccaatacagattctgttattactgtttgtgaccatgtgtgtgcatgtgtgatttacatagatgtgtcaggactctttttcataccagttagccggggtatcacaaatagaatgaaagactgacttattggtccattagtttatataatgttcaggttcagtgcggaagcattttggcattcttcaggaatgaaaccatttttaaaaggttagtctgttactctaagatgatgaacacatacagttctttgtcattaaatatcatttttgtaaataccacaagatttttcctctttaaaacatatcgggacatttagatgggactgatttttgttctccctacatgaaatttgtatatttcctcccatgaagtttgagtgacatgaatggggaatacaagagtgttcccttatgttgataaggaaaaagatactgttttttgaagaggcataacatcctgtaggagatggggagttaggacagtttttaaaaatgcctggattaccataaggcatttataaaatgaggaggtgtaaccagtggagctctgttgacttaacgccaacaacgacttcagctttactctaagaatgggaccagatgaattctctgtagtttcatcagcttgaacgatatagtttgtttcatttattgtcacgaatgcaatgacatatggaaagagggaatgattgtagtcattcttaggagaattttcgagaaagcctgttttgtcttttgcttcagtgttttttcttgtgccttaaatctttaatgggtacaatgataatgggtgattgttgatgtaagtaaagattagattgaaggccaggcacgctggctcacacctgtaatcccagcactttgggaggctgaggtgaggtggatcacgaggtcaggagatcgagaccatcctggccaacatggtgaaaccccatctgtaagaaaaatacaaaaaaaaattagctgggagtggtggcacgtgcctgtagtcccaactactcgggaggctgaagcaggagaatcgcttggacccaggaggcagaggttgtagagagctgagatggtgcctttgcactccagcctgggtgacagagcaaaagtccgtctcaaggaaaaaaaaaaaaagaatgtctctttaaggaaaattatttgtattttgatcaattatgagcatttaggtttttctgtatcattgcacgctctaaaatgactgaagttcactctatcttttgagcaaggagacctacattttatataatcaaaatgtgtttagatggtttattgcttgtttaggatgttgtgttgctaatatttcatgtattaatcctttttatggcatttttttcacaaacactagaaacatttttgacttaaaatcatgtagaaattcagcacattaaaagatacgtctgtttctgtttggcatggatattcagcttcattatgtaaagaaatttttttacagtttcacatgcatgatatttatttgataaaaattttaggtatattcaaaagtcaccattatttcttttatgaaacataggtgcagaatttttattataaaggtatattttaaaacagaatagattacacatattacatgcattttgtgtacatatgtctataggaatcaatttacaattttccaaaaacatcttgctttagtttgtggatattcactgctttcattctatttttaattaaatagttttgctattttctctatgcatgtttgagaaaccaaaacagttaagcacaagcattttgatttattgatatataataacaaatgtgtgattgaatcccatgactaagagtacattaatatatttcttgtgcacatgatcagtttatctttgttattccatatgagttaaaaaaaaaaaaaaaagcctccacaacaaatgaggcatctaaattgccagagtcaaatctctttagactacgtggttaattgacattagaaactttctaccaccaacaatgtaatttctacaaggtattgcaaaattgctagcatgcattttgttgtaaaatacttatttatgaaaataaacagctttcctgcaggtctccaagtgttttttctccccctagtgggactctagtctattaaagccttgtataggattctcaaatgccctcataatcaaattcagtccttcattaaaaagagaaatgatacaggatatcctacacttatttcacttttggttgatttaacaaattcattgctttagtagtaacagaatcattttaaaaatgcaaagacaaatatacattaagttcaaaactagatgaagcaactcccattggttacactatattctttttggctacagataactattaggattgtcctagttctcttttaatttctggctgctaatttagtggcttctcttaattctttcaatccctaagatctccctgagcaatctcattcacagtcatgatcttaacagctacctatgtgctttcgacttccaaatctgcatctcccggtcgggcttctccctgggagctgcagatccatgtatacagcactcagttgtatatcccgtagttacttccaacttaaatgttcttgtctcttgaaaatttctgttcaacatgttgttgatttctataagtgaatcttgtattcggtaccttactgaacttttttttttttttttgtactggagtcttgctttgtcaccagggtggagtgcagtggtgcaatctcggctcactgccacctccgcttcccaggttcaagcaattctcctgcctcagcctcctgagtagctgggactacaggcgcctgccaccatgcctggc

SEQ ID NO: 15941 - DNA, 44208 bp, Human; identical to SEQ ID NO: 12240

SEQ ID NO: 15942 - DNA, 13823 bp, Human
actatgatttttgcataatatatgtctttgcattatttatatatttcaatattccattcacaggaaatgtggggctatggagcagcaaggagacacacaataaattttacagagaaacctgtacctctttgcagtcaaataaatcgactgacagaccctgaataaacacagcttaggttttcttagattgctcttatcctggctatccaagaatgttgcaacacctttaaattttaagattaagttgtcattgtcagttcttataacagattttcttactcttaagtttatgggagaggaggagaatataggataatgttaatttctctgccacacagctctgctttcttaataattcagactctctccatccagggaaaaaatgaatacctaatgtgagtatatggaatcctgacccagctttcagattgagagagtctatgaatcatcacatttgatgtttatgattcaaaatgtaggattgccttaaactaaggcaattaggaagatagtttttcagagacgttagtctttgttaagatttctaggtccccataagagcacttagtcagataattgctaaagcacatatgtggctctaggaactaaagaaaaagtaaatgccataggaagactattttttaaattacctcattcatcagtctattgtaagagacagcaaatttgaaactaaaggtcacaggctgctttagatgcatggacttaaaaattagagaaagtcatcaataaaacttagttcttattcattatagtcatttcatttaggaaatttccaaaaggtgaatggaatttttaagcccatgaaagatgaatttttgtcaccttggcctcagagtggctcagggtcagagaaggtagagagatcataagttaataacagtttacacactgctatccttgaaaagagtggaaattactggctagaatttcagtttattacatggtataccagaatgatgggtgtaagtgtgtctgtgtgtgtgcacacacatgtgtgtttgccctggaaaactactgcatcacttccccaaaataaactcttaaatcaggggttatagcttgtttgtcttagaagtgggtccacaggatgtttacaagagaattcatttcccagccttcctcatatgactcctgattttccgtgaagtaataattgttccttcatttaactcaactatagaattattaggctggtgcgcaagtgactgcagtttttaccatttaaaagtaaagcccaaaacctcaattacttttgcactgaactacttctttcatattctttacctttagtctctccaagcttctgtttcttcatctgtaaactggagagaataataccacttaacacatatgttaaaatcaaaagaaataaacagatgaagatgtacattcaaagtaccatacagatacgctatttttaaaaagacaaaacacatgtatttttaaaaagacaaaacaaaatgtgtatttcaaaaagataaaacaaaatgtaaaaagcaacaaaatgaaggaaatttaatgacagtgtaacaggggactgaaaatcctgatttctcaatccttattctatatctcttggtatttagtgtaaaaattttaaaatctttacctagcaatcttgaggaagaaacttgataactgataatacatgagattgttacctaagtgaaatataatcctatatattcaacaaactttagagaaataagataaattttaaagtaaatgacttctgtagttttatagatcctccaaaccaatctagtctcagatctcaccttcatcatttctctcatttccttttggcctaattaatcaaaatccttcctagaatgttcatttctggccagtatgtcttcctgaatatgaataagaaataaaataccatttgatgtttgaaattatgggggtaatctcaatgacggaaatagatgaccaggaaaagggaaacgaatgcctgattcattatattcatgaagatatcaaaggtttataaagccaatatctgggaaagagaaaaccgtgagacttccagatcttctctggtgaagtgtgtttcctgcaacgatcacgaacatgaacatcaaaggatcgccatggaaaggtatgtgtgacaactcactgcgttgttggttgtatcaacactcctgtggggggattaatgtgaaattttaactaataacaagagcttgcaggtttacaaggtttagaagcacaatcttatgtttcctctagaaagcaattttacaagggcaccatagaacagaacaatggttctcaaacaggggaatcctctctcagaggcatttggcaatgtcgggagatgttttgggttgtcttaactgaggtggggaagtgagggaaaagtgctattggtatctaatggatagtgatgagagatgctactgaacatccttcaatgcacgggacagcccccagaacaaggaattattcaactcaaaatgccaataatatcaagattgagaaactctggactagaataagactcaaagagtctgtgggtccaatttgccacaactctcaaagggacaaagtaacattttctggttatcaggcctctaatgtggattggccaacttgaatcaacctgatgaaactttcaattgtgaagccataaaatagacactaacaacagaattgtctttcctattctttgtcaatttggttcaagccaaatgacatttcaaaaggaaaaacagactgcctagtaataactaatcacctttactttcttggttgacatttgcaaggaaaataaattagtaacaaccataaaatgtgtttctaattaaatgaagaacaaaaacatgtgtctattttatctcgttttgggctttaaaaatcctttccatgctaaatgtgcagataaatgtactcagagttacagaacatctatccagttgtgaatttcctagacctgctattccaattcctctatctacaaagcacattttatttacacatacagataaaatatacatttggtttcgtcatatgattatagtatgcataaaataaactttttggaagaatcatgtttttgaaaaattaaaagtctataataggaatcatctcaaacaaaaattttattttacaactaacagatttagtcacttcctacactaagcaattttttaggtatttttaagtgtttaggtttaggtactttttcacaaactaaactttagcatttgcctagttttatcttgggcatttctgattgcatttcttaaaggttttgaaggacttaagttttgtgataaacacagttttatattgggcattcttttggggtaatgccactgaagttaacaagtgattttaatttggtagctatctatcgtttctttccttttgaaagtataaattattgatatatataggactgtaactgtccatttgctgagatagcaaattgatgacaaagctttgaaaaccttcagcaaagatcagagtgttttgtaattagagcaggaaaagtggagaaaatcaagctttctggggcctctgttgtgatgtaatcaatcaaaggcaaagaacttgttattctttaaaagtgacagcaacaacctatgtaaacactgagccatcacggctactcatgcggcccccattacacagatgcagattgacagcccacaggtgtacgcgatgtgacaagacgacgtgcaaagaccacagtattggcatcatgcctctctcacccactaatgatacgacttggggaaaatcacttaacctccctaagccatctgtttcatcagtataatttgatgataattacaaaggcccagtgtatctcacaaggttattatgaagctcaaatataaaaaaaatttaatgtttttggcgaagtgtcaaacacatgcatgggactattacgagttagcagatctaaactacagcattatttttatgttagaattcttttcaaactcagtattagcaatcaaacaatcgtgtgtttattcttatcaggcaggatgataaatcgaaaggatcgactgtactgtttttgttatatcagtgtctacaatgtaaattatcagacacacctagttaaaaaaaaaattacaaagtgctgggcagcctgactgctgaaaatctgcagaaactcccaagacattaaactatcttaagagaatgatccaaacaccctagctcagaattaatttaagctccaaatgtttggaaagtacagaagcacttctgggaaacgtacaaaaatgcaggaggtaacccacttctcaaactatatatctgtgcaaacataattatatatctacatttacacagtggaaggcgtttgttcttcccccatcccagccattacagtagcaaatcaggcagctgagggcagtggggagcaataaggctttcctcggcaggattacttctgaaaacctccgtggaataaatcatctcagagtggctcgcgttcttatttaagcagggtccctcctgctgctgctggtgtcaaacctgctcctgtgccagagcgtggcccccttgcccatctgtcccggcggggctgcccgatgccaggtgacccttcgagacctgtttgaccgcgccgtcgtcctgtcccactacatccataacctctcctcagaaatgttcagcgaattcgtaagtaccatgcttctggcttcctccctgaaggagccttcacatgaactactgggctctgctacatgttaacctagaaaacctcccgagccaaatttcaaacgatacattttaacatgtgaaagaagacaccagctcataagatgtggaacaagaagaaagggacagtgccatgaaatctcaaagattctcaaagaatgtaatgacttaaattttttctttaattcactttattttttaaaaataaaaaaatttaaacacctgacctaaagcatgtttaggtggggctgaggagaaggaagagtgttgatttcttgttcttgaatgtagaggtcagactccacaggcattctttacttagcacggaatagatatccaataatgaagaactgcactgcagcaaattgggtggattgaatagaattaaactgagctgaatccatggtggggaaaatatacaaataataacttttcaaaaaccccaaaatgctagaaatcatttctctgagatttcagtatatgggtttataattacaataaagggctagtttagaattggaaaccagtgcttttttctttcttttcctcccttccttccttccttccttccctccttccttccttcttcccttcccttccattccccttccttccttccttgcttcccctccctccctcccttgttccctccttccttccttctttccttccttccttccttttttccttccttccctccttccttccttccttccttccttccttccttccttccttccttccctccttccctcctcccttccttcctcccctccttccttccttcctccctttcttttctttttcagaaatatgtactctatttctgaataacctattttggaaatcataggttaactcttctaggtcaatcaaggagcagacaatagattagtgctttaataaatcaagggcctccacagagaataaacatacatttataaaattatttttactctctgatttcgctttcatcctccatttttgactggccatcttttgtcttccaaatcttcctagtaatttctttagacttttataagttttgctgaagactagtctttcctgtcaatgtgtcagctcattttttattctgttcttatcctcagtccattgtttatatttcctaaaattgtgtgccctgtgtttctgaattattttgtcataatttaaaaaaaagttgtgttccgtttctatcatgaacttggtaaggtataggtgtgtggactcagagaaactttttagagaaaagttatgattttataatgcctattaagagaagtctatcagtttgggcacacagtaaataagagattaaatgaatacatgtaaatacatttgcactgtggcatttggctcaaatgctgaagaaagatgattctcaatacaacatttaatgttgcatatttttgctatttttagcatttgctttccaaatagcaactcgtgtgacttgtgtgaatggtaaaagtaaacaacaagggaattgcaaagaaggaaaaacattgatatttatgaaaactagatgaaaaaatgagtttacagagataatgggggggaagtaggcgaaagggttactttcttaattctttagttttcatttttatgtagctctaattttttaaaattacacatctgccaaaggtattagtattctgctaatggattcatttattcaatgcccaaacaaccccaactaattgaatttgtctcatcatttccaggataaacggtatacccatggccgggggttcattaccaaggccatcaacagctgccacacttcttcccttgccacccccgaagacaaggagcaagcccaacagatgaatgtgagtccttcatccaggctttgcaccaaaacaaccaaggcagtatatgggtattatcatggtgataggtgctgtaatagctagtggtaattgtacatgcagagaaaaatataggaagaataagcagtcaaaaaattacattatgtagttgatgaaatatgagtcaaatcaaatgctaagtaaagatggtggcagcaatctaaatagcagatccgtacattgtccttgcagataacattattttaaccaatgccttgtcgctaggattgtatatacagtttatgaaagtttgaactgaattggacttctgtgggtaaatatacatttatgcatctgtaagaaaaagaaatgcagttttatttattacatattactcgtgactcctacatcaacagcatgttacatgactgacccctgcactattggagccatctgttctggactttcaagactctactctggttctatttctgctactctgacacccactttttcattcttcactgactcttctgccctctcttacttcttagttaaaagtcaccactcccctcacaaaaaatacagatcctgtaaaacataatattttgcttttcacagctacagttgccactgttctgatgactacaaagtctgtatatcaagcctcaatcatgtatctcagcttcaatcttctattgctatgatctcttccttttggttgtctaccataatcacagccttaacatgatttaaaacaaacatctttatatgcatgccacctacaaattcaatgtattctccatttacaagtttaggaatggcaccaacatttctgtctgctatgttcattaataataattatgataataagagaaggaggagaaagagaaaggggagaaggaggaggaagaggaaatatttattgagatctacaggttatcactaaccagaaatcccaaatactgaagaatcctaagttttttgagcacctacatgatgctaaaaaaaaaatgctcattggagtatttcagatttcagattttctaattaggaatgctcaacttgtactacattgtcagacactttgtgggcattactatatttaatcctcataaaaatcctataacacaaggtactgtcattacactcactgagataaggaaactgaggctcagaaaggttatggaatttgcaccagtcacatggcaagtaagcagcgagcctgggcttcattctattcaaaacccttactcttaatcgttgtgttgcaatgctcccagaaaaactacactgacactcactttatgacctgtacctctttatagctcatttctttcatatcctcttacatgtttccattgcaatgtccatttatttcttctttattcttcattttgttaccactagactagttcacggacatctacaaagtaagcattttaaatcagagataatcagctacttggagtctcctacacgatcgtggtagtaagcaaaacctaggcaggcagaactccattgtgaattccatggttattcaagataacattggttccattttatttacctgcataggccaagagaacagactgctctgccagcagcatggggcaggcggttgtgtagatcaaggaaagcatgttgatgaattccatgtcatcttcattgtctcttcgttctaggatcccaaaataaaactacaaatcaaaaatgaatagttcgatgaacaatttgattcattagtatgaacgaatgcttggatgagagtgatttgggccccttggcatggaccccagtggaatctatttctcatgagtcagatactctgggcacctactgagtttcggcaaaactttagtttctccccagggacaagcaaatcaatcaaatacgaaagatcttactaagtggacagatggtagaatttcagaggaaaaacaaaattcttcattttatcaattagaactctcattagaaaaagtggttactgaaataagccggatttttttttaattttagcaaagtttaggccaatagtttcaattttacatttctacaaattctctcacctaaagaaaaatgtacctacacataggaataaaaaaagatatttcagtacagcctctctaagcaaaaatcacaagtaactaaccccattgtattttacctattttaatgcaattgttctatatggtttcgtagcaaaaagactttctgagcctgatagtcagcatattgcgatcctggaatgagcctctgtatcatctggtcacggaagtacgtggtatgcaagaagccccggaggctatcctatccaaagctgtagagattgaggagcaaaccaaacggcttctagagggcatggagctgatagtcagccaggtgagcagcctcctggtgcttctttgtttttctcattaatataagcggtgacctctgtgatgataaatatttccctttgaaagaaggaaatttaggcattccatattatagaccgctattaaataaagcaagagcctagtcattcatagtcataaatttacatacatgtaaatgaatcttagaatgctgtttgacaggtgtcattttccctacacctacacgcaaaactacaaaagacttgccccttcctgaggacaagaagttaagtgttttcaagggagtgaaaactagagaatagaatctgcaagatacatgctttctgcagggtatcccaggacacccactattgaaaattctttctcttttctcccctcgccagaggatgagagtgggaagggagaaagaagaaaaccaaaatcagattggatgggccctcagccactcaccccgatctgctgcacagacttgtcagggaggagcagatattaacatgacaagacaatgacatcagtgcacacaggttgcattgatttcaggaggtcccacaagcacgagattgcagggagtcacaaaagaaggagatataccttttctggaatgtcttcattttgtaatttatagaaagttgtctcattctaaattttgttttttcttgggactccaaagtcaaaactcatgtcattgtacttaatctcccccaaataatctgtcatatttagattgtgttagtatttgcaatagatatctccattcagatgggataatttcaacattagtgagataatacctaaacagcttctgaggttttcagggataatgtaccatctaaagaaaaatatatgattataggaataataacaggaacaattttgtatttctctttttgtgtactaagtacatgttatcatgtatcattttggttattttcatgcgagaaaaatatgtccaaaacaaacacaaagcacattttaaccttggaatgtgtgaaataaataccttgattttccagttattttcttcattactgtaaacctcatttctgaggtcactaatttgttctatagtacttcattttctgttcttttttctctaccacttatttaagtattcttgttcatatcattatcccttacacagtaaattttgtcttagggctcaagtaccaaaaattaaaaataaaaacataaagccagtcaatgaatacacacacgcacacacacgcgcacgcacacacacatgcacacacacgcgcacgcacacacacgcgcgcgcacacacgcacacacacgcgcacgcgcatacacacacacacactttaaattccaatagggaatcccagatttgaaaaatattctcactttgtaggaaaaggtttagcagatcggcgtctacatccagatatatacctaataactctccaaactagctgacatccctaaagttgctaaaatggttacttggtctctaagacctctgggctttcctggtttgcaaaggcttatagagtgtgaagaaacatagcatgccctctgttgtgctgttcagcctccttttgttatcacagccatgcccccaaccctaccacacagccctcaccactgaagggttgctgccagcaaccccctgacctttttttttttagacaagttctcactgtgtcacctatgctggagtgtagtggtgtcatctcggctcaccacaatctctgcctcccgggttcaagcgatcctcatgcctcagcctcccaagtagctgggacaacaggcgtgcaccaataggcacggctgatttttgtatgtttttgtagagatgggatttcaccatgttagccaggctggtcttgaactcctgacctcaagtgatccacctgcctctgcctcccaaaatgcgtgaaccagtgtaagccaccacacccggcctgtaccctttccttgtaggtgcttttcccggcacctcccagcccagggacctcaaaagaaagcaattgtttcccctagaaatttgaggaaatgaaaatctcctgactatgtaagcagcttttcttagtcatggtcatcactaaattatctgtaccccaaagcatcaagtgtgagtacaatcttcatcttttttaaagtttttggaacatacactagataggcaatagattgagttcaaagcaggaagaaaataaatgatgtcaggaagaataaagcacaagggatacatcagggacaagactggagaaatgaaatagttcctcgagtgagagcaccgaagctagctactccattgtctcttcgtcaaatctatgtcaatatttacatagtacctttccagttcttcatctgtctactcctgcaaaaacatacttcatctgtgatcccatagatgtcagagaacctaaacaggtattctgcttctagtttttagattaataggtttctgatacactggcccagatatacaaaaatcattgcctttgtctaaaactttgcattcatatctcattctcaattcttaattcaacagttagaaagaacaaggacatacaaatactaataatatgaagaataagtcactctttttttgtgtgattaggttcatcctgaaaccaaagaaaatgagatctaccctgtctggtcgggacttccatccctgcagatggctgatgaagagtctcgcctttctgcttattataacctgctccactgcctacgcagggattcacataaaatcgacaattatctcaagctcctgaagtgccgaatcatccacaacaacaactgctaagcccacatccatttcatctatttctgagaaggtccttaatgatccgttccattgcaagcttcttttagttgtatctcttttgaatccatgcttgggtgtaacaggtctcctcttaaaaaataaaaactgactccttagagacatcaaaatctaaaatgccgatttgtcaaagtttcttctcttcatttaatagaaaatcaaaagaaaatctatcactcccattaagaagttcttatcagaatgtgtcataaacaacagaagctagccttgcacataagacaattaacagcttactttaaaatcacagtagattattgtgggtcaagttattagaatcgaagagttagattattaatcatgctagtcattctacaaagaagattgaattctctggattctttatgaaagcaggcatgttctgtcagttaactttcagtgttatgacagacaatataagtactgtgcaactgcaaaacctccaaatagtatggagtttactgagcagtctaaaaattgttaggatataaacatgacatggatttctctttttctaatagctatgttcaatcattctctactaaattcccatctcttttgcattatcttgcacacatttcatgttctagtaattctgagtctaacaagtctggtccagtcaggtttcaactccatgtttaagttatttaatgcttttctctccccctgtgttggctcaaaggacctaacagagaaagcagatgtggtcagttcctgcaacttttcttccgcctctctcttctggatctccattcctctggctgtgttggaatgggatagaggactagcagagaagaaaaagttcatacatcactgacttaggtagtactatcgtacccttccccttgttgacagggaccgaccttggattttctctgagtagtgggtgtctttctagtggaattgatttataatttccaagataccaaccagtgaggacaccacacagtatagtttctttcccaggggaaatgctctggcttgattctcctattcgccccatagctctgccatccgtagcattctccacggcctctgctattgctcccctcatcctgcaggaactctgttgaagaaaactggcatgaggtcagctatgtgtcaactgccccataggaaactcatgcatcgtaacctctccaagtaatgaagtagcaataggactaggtcatggctgaccccttcccggggtctctaccaattcccttctcccattgacatagacacagagtagatcagaagttggattcattagcagacattcacctcaggaatgagatgctagtctttccttcttttaaacctagtgagtaattatctctattagcaattatcttggagagtcaacctcacaaacattctctactaggtcactgaattataacaccctcctaaaatacctaatcttctatttattgagtatggagagaggtgactggatgagggtccctaaatttgttcagtggcctctaaagaacctaaaatgagggctaacctcattgcaagctccccttagaaggcggtggtattgtcaggctggttttgcagcagcttctgggctttagcagggatttctagaaaacagacaatggaaaacatcactttcaactttctgatagacattaaataaaaaggtgagggggtagaacaaagaggaagggagagagaagggaggaaagataagaagaagaaaaatgaacaaaaggtttgggtctttaagatgttattagaatactgctcttggtgaagacctaaatctcccttaatttttataccataaaagcaaatattatttcatatactcctttcgcttcccttttctttcttcctttcctgaaactctcgtttgtattaggagcattctttgcccttaccaattgagtggctatagctctagagataagcaacttggcatgtcttcagatcagaattcaaggcaattttccacctctcttcagagaaaactttcccacgctcataggaacactaccccaacctccccccacccccccaaaaaaatatctttcctcatagccagggttgtttttatcggaatccttcctgcccctgcttccagctgtgatgaaccaaacctttcagaatacagca

SEQ ID NO: 15943 - DNA, 92304 bp, Human
cccagctactcaggaagctgaggcagaagaattgcttgaacccaggaggcagaggttgcagtgagctgagatcgtgccatggcactccagcctgggcaacaacagcaagactctgtctcaaaaaataaagatagtgtcacctctaccagtgtcgacaaatgtttagggctatggatcctcaactagcctgaatgcaagactaaaatattcctgagcctggtgcaaggtttaatggaacttttaactcatctgtttcagaaaaggtaacaaggctaaaatattaaggagtcctagcctgatctgacacatcttgtcaggtgtttcatagcactctgagtaagagttttgggaaattaataatagtaataaaaatcttgtgaaagggctcaaggtgttgcaatcctcatcacctatgagcaccaattctgcagctgttttgcacgtaactataaattatgatctagtctctacatacataacttcccccacattcctgcaggggtctcttttcctgctcaatctcaggagcaagctttaattttaagacccatgaatacttgaacaaattcaggagtcagtttgacacatcattttatatttttctgatgacaatttctagtttactttttaaaaaaagacactattttaaaaatactttgggataggtttgagtcgttgtgtttgcttccagtcagagaacttcctacaaaactgaagatataaagtgctgatgcctgggcgtgcctgcgttcgttgggggcacgacgtcatcgtgggaagcgtgtactttttcggattactgcttggcggattagaaacccgtagatcagttctaggttagccctgattaactgccctgggtgtttctgggccagagggaatgtctgctggattcaaaccaatatccgttgtaagacaaaagagttaatttgtactttacccctatccaggctaataatgaaggtaccgggaatgatctggaatgttaactggtgcccgcaatcgcgtctgctgaaccttctgcccccacgattctgtctgcccacatgcttctgtctatcagccccggcctcgggatcagctctcgccgcgtcattggttggatttcaggaagggagaagcccacgatttaaagggctccttttgcacctgccagacatcgtccgcatggtccaacttgcctttggcacgtatctggaaaaatctcctgcgctgttcgtttattgcactgactggtcaaaggaaagagtgttcccttagtcaccttgacaatttccaaaagcgaaacttgggctctagactagatctacactgagtctgcggggcgcggagtccctgcccaggtcagtagcgccggcccggcgggcgggcggggacaggggcggagcctaggccaggcgtggtcttccgtgggagagaaggaaattctttgccccaccccctaaaaactgctcttctgccagccaatcaaggaggcctatgcaaatagggtccctgtcgccccggtaaccatgatgcacggcagccaatggaaaccagcaagtcgcggccctgctccatgattgggactgaagtaaggaggtagcggcccaatgggctgtgggaacggtcctcggcgggttgaggggcggggatatgcaaatatggtttgaaaagccggcgggaaatccgagtttcgcgggaggaccttggcgcgtaaaccgtatcccttcattcattgtcagcagcagcttcctggagccatttttcagctgccggccgcagcacccgggctgccgccgccgcctcgcaatccgttgcatcggccgcccccgacgcctccatccccgcttggggcccgatatccgtgcggccgggaccctcctctctccagagccccgattatttttggcccccggggcctgtgcggtgcggaaaaataaaaagaaaagagagagagggggctcggaagcgccgggcggggaggagagaaggaggagagacttggaaactccgactgcaaataataaagaaattgaaaacaatacattaatataccataacactaaaaagagcaggagcgagagatgagaaagggaatccagcccgctctggagcagtacctggtgaccgccgggggtggggagggggcggctgtcgtcgccgccgccgctgcagcctccatggacaaaagggcactgctagccagccccggcttcgccgccgccgccgccgctgccgccgccccgggcgcgtacatccagatcctcaccacgaacacttccaccacctcctgttcctcctccctccaaagcggcgccgtagccgccggccccctcctccccagtgcccccggcgcggagcagaccgccggcagcctcctctacaccacgccgcacggaccctccagcagagccgggctgctgcagcagccaccagcgctgggacgcggcggcagcggcggcggcggcggccctccggtaataccctccctccccaccgtccccagccccggcgggaggtgggctcgcaccgcgcggggtcgtgggcgcgctgcgggccgctcggggagagcactgggccgagcatcgtgggcctcgggggctgcccctccaacgagggttcattgttagacctgagtgctcttcccggcgccaggagggtcggggggctcggccaggcgcgcggggcggcggggattgccttggcgcgaaccacatcaaacactccaaaacttttcgcggcccccccttcttttcctgcacttttccctacccccactctcccttcccctccaactcgaagcttcctctttctcgggcgtaggaaggggtcacgccccggatggagaagggggtgggggagggagtagtgaactggggtgtggggggctctgaggggttgaaaccgggggactgttggggtgctagcccccagtcggccttggaggctcgttggcggccgggggtccctgcggcgtgctcggagcgcaggggatcggcggggctgcgcttgacacattttaggatctgtaactcccggcaacaaaggggctgggggaggtggaggggagtcgggcgtgggggaggtggggctggaagccgggtgcggactggggcgtgggctgtctggggtgaggggctcgcgggctggcgctctggcctgggcgcatcctggcagtggcagcggcggcgcccgcgtggcccaagcgcccaggccttcctcgccgggccccgggcctgcccttgacccgcctctccccttgccccttccttccccgccctgtccccctctccgccccccggcgacggagggcgggggcagctgggttcccgtcccgccgcctgggtctgtccctctctccgggacccgccggtgacgtttcgcacacgtgcgcgcaggacgcgcctgtgactggggaggaggcggcggcgggagggggcgctggagggggagaggggggcacccacttcctcctgctcgccggctccctggcctgggacggtcccggcgccctcgcacccgcccccggcaccgccaccctccctctcctctccccacccccccaccggcgcccgccctcgccctgcgccgccggtctgttcggccctccgggccccctctccagccggccccccacctccccccggagccaggctggtttcggaaatgcccttacagcagcaggttagtgaccgggacggctcgggggccgccgacgccgcgggggcaccggattctgttgggggctgaagcggtgagggtaggcggttgagcggggttttggagtgggaacggggggttgggtgctcgagggaaatgagtaagcaagaaaaatctaactaagtaaatgccccggcctccggttctaggaacctcggggcgggagtgtctgccccagggggtgggtatggtgtttacgtggattttttttctagggggcggatggatgggcgatagaaaaccggagggggcttctcgccaatggccgagttgagctctgttttctgtcttccttcccttgtgctggagggggaggggggtgggtcagagggtagggtgtctgtaggattcccaggccacccgccaccccctccctttgtccctgtaatttataaagcgcctttgagagatgatttaggtcagtatgcggcttctctttttgttggtactagaaagaagtgtggcccggaggtctcccctttctccttttctctccttcattcccttcctccatgcctccgggtcttcaccctcgtggtgaggcttggcctccacggggctagaaccgaaccagactcagttagatccatggtagcctgattataccaggcgtggacctcaccttgtctcagctccaaatgggtttaatttttggagaatcaagattttgcgggagtctttaagaaagtcagcacataggcagcactttgggaaatgggatgggtttgggaataatgaggcgttttttatttctttcctgttcccagtttctccccgggttcggtcttaactgctttccagccccagagatacttgctgggcatgtgtgatgtagtcttagtcaaagaagctcatcgttttttagtgactagggtctgccagcaggggggaaacggagcacagtacctgcttagacataacagtatccggtgtgctgggttttcagtcgcaagaatattccatgcttttattagcttcagatactcttactgacttgacctaagcatgtttggacatattttaagcatatttgacccctgcacagttctgttactatttcataaacctaaccttaaacaaccagctattgacatacttcttggattagattcacagatttgcagggggtagttttgataatgggaaattatgagagcttcaagttgatttttaaaaaattttaacagtgtttgttgggccaggtccctaagactatctttcaagccaggtttattatatctagttcattgtatttaagtatttaaagtatactaaattaccctcaccatcttccaagttatttcaaaactttattctccttgacatgaaattattattccaggaataataatatccttttgagtttatgtgcacacaaaaggtttttcattacaggaatataaatgttactcatatacatattcagaagcattttttatgtgattgcaatgtatgctgaatcattggttatctgcattttttttttttttttttgagacggagtctcattctgtcgcccaggctggagtgcaatggcacgatctcggctcactgcaacctccgcctcccgagttcaagcattctcctgcctcagcctcctgagtagctgagattacaggcgtgagccaccacgcctggccggttatctacacttttaagagctatttctactggccgggcgctgtggctcatgcctgtaatcccggtactttgggaagccgaggggggcggatcacgcggtcaagagatccagaccatcctggccaacatggtgaaaccccgtctctactaaaaatacaaaaattagctgggtgtggtggtgcgcgcctgtaatcccagctactcaggaggctgaggcaggaaaatcgcttgaccctgggaagcggaggttgcagtgagctgagatcccgccactgcactctagcctggcggcagagcgagattccgtctcaaaaaaggagctgtttcttctgggagggtgtaggaaatttatctagtcaatgcatacaaagtcttaagcactgaatataaagtttgatttattgtttttcttatcgaaattatattagacttccatgtaagtcttcgaattttgaattttgttgatattctttccctaagcaggaaagacaggatggggaaagctaagtgattggctgaacaaagaccacctaaacactctgtgtccaagaagaggttgaaaagtcttcaggtggccagagttgcagacctatctggttctgatcccaagttctgtctcaagaatatctaaggacttaaccagaagcaacttcttcacctttttttcaatgggggtaaaaatatgagtactaccttaccagctgtaaagcatctattatttacaaattgtatgttcattggcaaataacttaatctctcaactcagtttcttcctctgtaacatagggacaaaaacagtgtcacctttaaggttcttttgaagagttaaatatgataatgcatgtgaactatttagcacagtgcctggcaaaaagtagacacccagtacaattcatatttattatacaaatgttaatttttttctgacttagtgaaatagtgtaaggccaggtgcacattgtccctttgtttacatatatgaagagaactgttaaaagtctttaagtgatctgtaattaattatttatgcccaattaatttgggcttttaaatatataaaacatggccatcctaggggtaaaatagggacatttcagtaagacacgcctatatagagatagtggtgttgaactgccaagcatatgccttgaattgtgacaattcaaggccacatcatcctcacttttttgcctgagttccactccgtccatgattccacagacctgccaacttttgggtgcagtttatgcttagcggcttttgttagacctgaactctcaatcttcaccatgtcagagacatgcattagacaaattccatcttagttggtgaactgttggaaatgtaagaactccagagaaaccatagtcagaagtgctactcaatggagcagacaaggcttcatcattttctgctgctgcttctaaaaagaagctgaaattattttattctagaaaatttgggatttaataatgtaagagactatgtcctgtcacagtcatagcaacctactgattctactttgggaaagagccctcagtgcttgaaattttcatctaagaatggagaaccataggtgctatttcagcagggtctcttttcctgtacaattataaaaagaaaagtgccgggttcctgtggttctatactcaataatcttgcttctgctgagatatatggttgatgccaagtttaagctgggagacaatttttagtcactacataccccaaaatggaagttttaatataatgcagtgcccagacttgggcactacaggtagctccactataatcagtaccaagggcgccactctaatcatcctctgaaacaaagcacccttaaatatggcactgtgggctgaagaactccaccttgtgaacaggaaaggattttttgtttttctataaatcgccaccttgtgtattacttggaagaatggattctgagattaatgttatactgtgtaaagctaacttgaaaacagaaaataatactctaagcctagacgtgcataaataacattacctggagattgacagacggggtgaaagcttttattgtggtttctcagaaatatataaagcagtagttttcctttaactcttctgtctttaatgccatctgcaaagatatatcatccatacctttaacctctttcctagggatttggacccatttggcaaatagcttcaagtactcatagttaattttctggctggttttcctaagttaacctgattttacaaatattccatttgtaggaccagtttacatctactttcccaagctagccaacttcaattcccttttagtcatctacttcctactaacagctgtaactaggatgagtcaaaatcaattgcctatgctcaccagatccctgataaattcccatgaagccacctgaaaggtggtaaaagcaaggtaaaacgtggtgaaagcaaggtaaagaaggtagatttcacaattttgttttttaaaaaggggaatcttccctgaattctttgaggtactaagtacgtggtttaatgcatattttcattcttgttagcagtttaaaaataatgtttcagagactgtattcacgattgctaaaaagcattttttctactaatcattgttcatgggacttaacaatggaagataactgggaaagcagtaaatataggaaaccactaatagtgtctccttcttcctaccctgaccctctctttggcttcagaaagtgacgaggaaaatgtatctttcacaaagaaaagttataccacagaaggtactaaaaagcaacaactgcctttggggacaggaaacttacagagtggggattattatagagggataacataccgagtttctatttcaataagagggaaattggtttatattctgttcacacttgtttcaaaccctctcctctaaaagcaatgtgtttttggaattcaaggaatgtacgttctttccccaaccttaactgggggtcagtcttatggccaccatatttgtctacaatataacttttaaaaaatataatttttgccctcaaatactctcctatccaatgcaatgtaactttgaaggagaagtgatgaaggccactggttgccagattgtatcacacagccagatgcactttgctttgatgaagaatctaagtgatgcaggcccccacttagctctgtaaactaaggcaggggtttatgtcagctcgaggtagaaagcagtgagaattggcagctgatggaatagaaaggggacaaaaagaataaaaaataattgactttagtctgctttccattaccgtagcccaactctctggggccatttgtgtggtctagacaacattcttagaacttgacagtccctgagaacgatattctaggttggcatgggcaatagttggcatttacactggtcttggaatcataacatttgagaagtgtaaggcacaagagtcctcatctgcccaatccccttcatgttgcaggtgaggaaattcaggcccagtgctgttaaattacttgcccaaggtcacaggtctttgctagtggcaaagccaaaaccgaaacgggagactcttgaattcttagaagcctcattcaccaagagaaggttaactgtgtctcatgaaccctatatgggaaaattggggtgtgtaggacacattttagatttccttcaggagtggttaccttttttaaaaatgcgcacataaagaagtgtcctttaaacagttggctgtgggggtaatgacttattcccaaagatacaaaataagcaaggctactttggatgttaaatgaaagggaattatttaaaaaaggaaagaatgactcttcaaaacgtgatagtaatatttttaaagatttatttgatattcgcaaatttgtcttctgtggttatatcaattctgttgctcaaaaagtgacacatgcttcatagagaatagaatctaaaaggatttttgagactttcttggggagaaggacacacagtgcccctctggtagtaacggagttttgtcctgggccaccaacatcctgagtgactgtcatgctttcagaggtccccagcccttgcccagtaacattgaacaaggtgttcttcctctgtggttagctccaagatttctggtttagcaaagtggctaatcagttaactctttaagaggaaattgtcattcctttagccaacgctaatttccttaaaatgccttcttttcctttttggaactgagaaagcttaaaaatagaattgcttcaagccctgaggcctgaaagtgaaacataatctaacgtggctgtagtgcactgactcgttaggggcagcgatatatggcttatctgtaatccacaaaccagaaaggtgcccagtgtagatacggtctaacagccagtgagcattaagtaccaactgatgagagtagtaatcagtgaagctgatttcctctggaaagttttttggcgagtagagtttgtcttagagagtggaggatttgaatgcctcttgactttctgctgaggagagcttctgcctgctctagtttttatgatcctgaagggtggtagctctggactctgagaatgatgggcagtgaactcagggtctgtatatttcgttccactctgctcttccccatttctgatgctttgggggctccatttctgatacataaccagagcagcatccctgaggcccacactatctcctgtgtgcctttctgcatctggcagtcccttggagagaaggaggctcatgtgtttataacctgcaccctgtcctaaaaggcatagtgaggggcagctgagtataaggtcaggccacttagcctggagccagagtgcctgtgttcttgttctggctctgctcactagccctgtgactttgggcaagaaacttggcctctatgttttcatttcctcatctgtaaattgggaggaatgatagtacctaccttatggggttaggaagttgcaatgagttcttatttgtaaagtgcttagaccagtgtctggcacgtaggaaggattatgtgttaagtagaaacatggtataattgcccttccttccacaggcatctcatgggctgtccttttgtgatccattttcttggtttgtttttgttttgagaccaagtcttgttccgttgcccaggctgaaatgcaatggtgcaatcttggctcaccgcaacctctgcctcctgggttcagccgattctcctgcctcagcctcccccgtaactgggattacaggtgtgcgccaccacgcccagctaattttatttgtatttttagtagggacggggtttcaccatgttggtcaggctggtctcgaactcctgacctcaggtgatctgcccgcctcggcctcacaacgtgctgggattgtaggcatgagccactgttcctggcctgatctattttcttaactagcccttagtgttcatttcaccccattgcacctctctaaaaatggtgatgatgggaaggagaagtaaaccgtggaatggctctcgcctaatgcagtctttagggtctagggtctttgtatttctttataagctgcccattgacttgggaaaaagaactgaagaataagcttcttgtagtagtgctatcagtagtgatagtgtcatgaataaaacctttatttctgtgattaaatgtattaataaagtgacactactagcatgaatgacactattaacataatttcaatcctgtacagtaaaccatggcttaagactgaatggcaagaatcagggtgtctgagctgctgggccctgccagactcggagcccctgccagtgtgtgtatatcaaggcagggcggggggttgtcttgctctccagaggcaatggaacctgcctctaggcctcccttttcccttctcatctcctcacccctccttttttatgttagatctattcctaccccttccccttcgccttgccctctgcctggctcttagaaggaagcagacttgccaccttcagtggctgcttcccggacttaccaaattaattaccaccttttcctgccatcaagggatggtgaaatcttgccttttcggtcttgcttcccattcctctgcactcggctgctgcgacagtgtggtgctgcaggcaccgcagatttccctctggtgtgtttgctcgtagcttctccctctccaccttactccttttgttgccctcctcccactggcccattgaggcccacatcaagggaaggcgtaggcacagcctcccccagtttcccaggggcttgggcctctcccttcccttgggttactgcttctttcctgtaacacctcatggtctgcctcgtagcctaatcttgcatgttcatgacttactcctcctccaaacctgtaagctccaagaaatcggtctggcttgctttttcatcatgtggtccctgcagtgcccactacactataggctcagctacctgagaagaggcattttcattagacaccttccatgtgcttggtaccccattagtcctattggggatacaaaagaagtatgaggtgtgatccgcccactcttgagtttacagtctgttgaggagacaagctttaaacacaagttgatctgcaagcaagactaaacaggcggtagggagaaaacaagactcatctagtcctcagttgtgtggtgtcgacagaaagtgccagaggaacaggtgagagtcaccagactccagctgggccgtgagatggggaggccacggttgtcaatcttggagtacattagggcacacatgtgaatctcccagggcgctttttaaaaatactgatacctaggccccacccagaccaatcagaatgtctagaggtgagattaagacatggattttttttctttttttaatgtgctcagttggaaccactgggcttggtggaaagggaagattggggaggccctttctggcggggagacataagtcaaaggcaggcaggcagaaagattggcgtcaggaggcagcatttggactagagtcatcagtatggggagataacaggaccgaaggttggatgtgttggcaaaactgatctagaattggagttgcctttctacaagggctgggcggggagtagattgggggtgggaagtttgagtggtgtggggattgttcacgaataaagaagaaacgtactatcaaaagggggccttgggacctggtcacaggcagtgggtgccagaggggatggcaggccttgtgttttgccaggtcttcaaccttctcaaaatgccagaaatctaccagttttaaaatgttggctgaatttaaaaggaaattgcgcaggccaaacaaaataggtctctaggccagatttggcttaagggctgccactcagcagtctctggtctatgggataataatagctaatgtttatcgagtgcccgcatgtatcgagggcactaaactaagtgctttactcgcattagcacattatccacataacaacctatgaagtgggtattattatcatccttgttctacacagggaagcagacagccaggggttaatggcctggctctgggccccattaataagtggggcaactgaaattaaacccaaggagcctggctccatagtctcagcttattcctagtatttatcctctgtggtctctggcattgtattaagtagtaaaaatccaagatacctgtcaaaaagaaataatccagtgtttttcaagtttacctgattgcctgtagcacttgttacagattcagattcccaggctccatccctatcctctgtcagaagccctaagatcttctgatgaaacattctggaagcacggctagttgagcacagggaaaagttactgaaactagattgtccaggtgaaggcaggagccttctgccacatccattcacataatgcttatctcagctcttcctcgtttggaaagaccccagggccccaagcctcatacctgctctcgtggttccaaaacttgcagactcccaggttgtagcccaggcaaaccatacaaagatgggtctcccaaaacttaaaagatgtgaaacaagaagtggtttcttggattctcaagcggttgagaatccgagctcaggaggtcaaagtgggcttggtggctagacgccaggcaccagcaccagctgggtacccttgagtggtttttctgccttaacagtaggaaggcttttcattctgtctggtctggacctgcctgaaacacagctaaccaagtggacagagcgagaaatgtgaatacgaggaccagagcacaccatttagagtacgggcgctattgagttgatgagtctggaagcaggatggcaacaatgatggtgtgaaaaggcaggtggaagtgaagggcagattaagggagaaaagaaatacaagacctttgactcccaaatatttaactccaggggctggaagaatgggtgaggccaagcttctcctctgtctggggtgtgcactgtgtggaaggcatgattagtcagaatggatggggtggttgtgagtgactccatgggccatcccgttttctgaggggctaaggctgagcaccggaagtgggactttggcatagaggttatagtggaagtcttgatgaacaatagcaggccaagacctggtctccctagcttacaaataaaagaaatttaacatggtgccacaaaaacctttcatcattttcacttcttcctctgtaatatgaaaacgagacaaattcatcaggttgatttttggggatcgatgctgtcagggctcgcagagacgagccatcagatgttatttattacatgctttaccccgtctcctagctgctgtgagaaagcccacagtttgcaacctcacaaagcaaagagccagctggaaagtactgtgcatccagacaggtcacatagtcatgtcctgaaccaagatagctctttttgccatgatttcctacactctctgatttttctcattaaaaaaaaaaaatcttgaatttattttcttaagctctagcattctaaagtttaaacatatgagcctttgaatactcctgtctaggaaagagccgtgtaaattctaagtatctctataattgacttttgatatgttacttgtgtttaaacccaatttgcaacaccccttttgttggctaattttgtcgctatgttgggtagcagaacttgtgacgatcacactaataacataaagtttcccacctttcttgttgctgttttccttgttagcatctcagacttcccaattctgggaatagtctctaggaggcaaggttttcagctttggaaatgcatgcgtgacacagtagtgtggtatggaaggcgtgtggacttgaagatccggctccagaaacacgctctgccaattaccgtgtgtgaccttttataaattacatccatgagctgtagttacctaaaatagtgatcctctctccttcactggctggaaggattaaatgagatagtgtttataggaaatgtactttgtgttccttagttgcctccccccgccactccccgtggtaggaactcttgagtacttgtcaaatctgaactctcggcatttttacctccttcagggaaaactattggacaggctcttactgaacacccgcttttgtgcagaatgcacttcctgatactctgggagtttcagaggctactaaggtgtccttctggccctcaaggagttcatctggagacagggagacgacacattttcttcaataactaagaaaagaaagggcaatgaagaccataaggaaataacagtgaagtttcttaggcatccaaacttgatggaggggacaaaggaggcttcaggaagttttaaactagaacaggacttcagcgctcttaacattttggtcagatacttctccgtggtgatagtttgtgggcagttaacagtggtggagggctgtcctgtgcattgtagcaagtttagcaggatccctggcctccgcccacttagatgccattagcaccactagttaacaacaatcgaaattatcttcacactgtcaaatgtccccgggaagcaaaatcacccccagctgagaaccaccgaactagaccttgaagaaagggtagaagaggatatcatgtttgcctcttctatatatagtacatatttaaattttaaaatatgatatacattttaaaagcaacggatttctcatagctggattaactttggaatgcctaaccaccccatggcaccccagaactgggatccactgcccctactcttggtagtgctctgtgcaggccacctaagccctgtcttttttatgatgaggcatgatattaattggctgctggaagcctctctaacttgcagaagaaaggatcaaagtctgcagttcagggaaggaagttttgcatttatcattgacccaactgggtaatttaagagcgactttctgctcagggtcaacttctcagtgtggtttttaatcccacttcatagttagatgatttggtcacatcactttccctccaaaccccatttcctcgtctgttaaatgaggaaaatcatggttcttacctcacagagttactgtaaggattgaatgcaataatgcctgtaaagtgctggctccgtccctggccatgtgctaaacactctgacatttgttgtcttcctcatgtatatcattattgtggttgtcattaagttgggcttccgtttcaggacagttcaacagtaagcagccattccctttgttgctggtgcttctgcagctattttccttgctcacctatacccacgctggccccagtttcaaccacagggccggctgacccatttatttagcagataggtgttaagcacctagcatatgccagccaccattctaggtaccaggaatacagcagtgtcagaacagacaaaattccctgcctctgtgtggtttgtgtcatagttggtgaagattttgccacatcataaataccctggtcttgtctttgatgggttctttttcttttattttttaaatggttctaagtatgtggtgctggaccagcagcattacttgggaacttgttagaaatgaaagttttcaggttgtactccagacccactgtcagaaactcaggaagtggaagtgggggtgagcagcactggtgtatggcttaacaagtccccaacgtcattccaatgcaccaagtttgtgtgtgaatcagtgtttgggaaaagaaaggagtagggggaaacccaggccgtaactgggctgcaatgttatatggtaacatcaaataaggtgttgctcatatcatgagattctagtaacatcagagtttacaaaggatagtcttaggtacaccaagacacttaaaactagcagtaccctttgatctctttcctgggcctggccacccctcctttaaatgggagggctttgggaggcctcctaagtcaccacagcacacgggactcagcaacagaaattcttagccttccctaggcttttccttgcctgatatacaaggaagttgctttccccacttttctccagacttctggcatgtttgacaattattttttcttttaattccttcagtttttattggcttcttacctggcatcattaaaaaatttttatagctgcaatcaaattgccaactggatggacaaggcttatctgaaaatgaaatggtagctctcctttgtatgtctggtaatttgggtatttaaagatacagtgaaaagtaaatgaaatgagagactatgggaaagtgtccagtgtggagctgggcacagggtgaccgtttgataaatgctggtacagtcttccccccaatcccaactcattataaaaaccaataaaggcattaaatagacaccacggttctttgtgtgaaaagctttggattacatacagtctgaatgagtgaataccataatgtaaattgtaaccaaaataatagaatccaaaatcttaagtaatgactttgaataaaaataagtgttttaaaagttagtaactttttaaaaaataagtgtaattaaataaacttttaaatttaaaaagatgttacttgatttttatttcctgataatggatttaaaaaaaaaaaaaaaggcccagatcagactggcagaaatacttttatttctgcactagcccaaagcctggatatgcttataaggcatataacctgtccatttaacagctgtcatttaattcacaaacactaattaattacagccatgttaaaaggggtgtttgggacggtttggtagttccttttgaagaaaacctgtgtcttgaaaatgcatatgaaagattaccaggttctgttatatatagtccaggttcgtcttggtggttctattcgaaaaatatctctctgaccatcggtgggcatttcctctctctttctgtctacctacagccaaaacaagttctggttacagtgacagttttaagtttgccatttgtggttggttctattatagaggctgggggaggaaggcaagcagtcctcacttcttgcttcctgccttgctctagagtgtaaggatcagcttctctaatcccttgacttttcactgctctatgtagtcagggtagacaaggggtggccctcaaacaacagccacctctggaggtctagcgtgactaaaccactgtcttcttttccaaatccagcactggggaccgacgtgtgggcctcccatctgacttgtggagtgaaagaaatgggaatagagcagcgctgtccatatagtcgagttttgtaaatatttgtcagatggaactagagatgcattatcacattcgacagtaacaagtggcaagtgttgagctcttttaagtcttgctttttatttcttataatatgcaaataactgttaaaatggccagccagttggctgtctgttttagctaaggtaggtctcttgcaatttttgcaccctagggagatctcaataggagtaggtctagccctaaactgtgcaggattaggaattctgatttactgatctggagggcggctttgtgttaatcagagttctaaaggcggacaaactagactgtgaacttaatacttaccctgagaagtataactgccaagtggacagttgcagaaattggttattgcctgtgttctcgatcagaaggttattagctgtgtcagagtaaaggcattgaatgatcccattagtaccttccagctgtggtctcctctctagagcgtacctgcaggggagggagtactgctagccacttatggagcatatggacactgtcattcacccacccaggtgtccagttccatgactctggtgtgaaacactgaatttgtttgttaccttttttttttttgtaagaaaatacttgtttttagtacctgcttattatttttttaaaataaaaaatatataaggaagtggagtgaaaatgaaaatactttcttcattccctcttgatcttgcttccttcccagagataaccacaatcacagcttggcctttcctttttataatcatttgcaaatctatattttatttatataaaagtaaaaatgattcaaaaatacaaaagtgcacatcgtggcttgcccttttgcttagtatttccagagacgtaattccctatctgtatatattgttgctcattattctttgtaatagctgcgctgccactcgttatatagatatgccagaatgtgtttagttattcccatttgatggtcatttctgtcatttttcattttaactattgctattatgaacagtgctacattggatatctatgtacataagtttttgtgcttgtgtgtatttctgtaggctgcatttctaagcgttgaatttttatatcacagggcatgtatattaaaatgctgatagattagataggtccaaattaccctccaaaaaggctgaacaaatttatattcccaccacaagtgtagagagttgcctgttttctcatactttttccaacactaggtaacattagtctttttgcagttgctgctcatgctagatagtacctccttttatttatttatttatttatttatttacttacttacttacttacttattttgagatggagtcttgctctgttgcccaggctggagtgcagtggcatgatctgggctcactgcaacctccatttcccaggtgttcaagcaattctcctgcctcagcctccccagtagctggactacaggcgcacgccaccgtggctggctacttttttcatattttagtagagttggggtttcaccgtgttgcccaggctggtctcaaactcttgagctcagtcaatctgcccgcctcagcctcccaaagtgctgggattacaggcgcaagctactgtgcccagccaatttttatttatttattgagacagagtctcattctgttgcccaggctggagtgcagtggtgcagtcttggctctctgcgacctctgcttcccgggctcaagtgattcttcctcctcagcctactgagtagctgggactagtggcgcatgccatcacacccggctactttttgtattttttgtagagatgaggttttaccatgttgcccagcctgcctccttattttacttgtatgttttttaaattattgctgctgctaccaccaccaccgctactattactgctactgactaatgtttattgaatgtttttatgtgtcagggatagttttaagcacgttatatgaaatcactaatttaaaccttaacatctctataaagtgggtgtgattattgtccacattttacagatgatgaaaaagacgaattagtaaatttaagtatctgccctaatttgcatttctgtgagtagcctctttgaattctttatcatttttgtgcccaaggctatttatagttttcttactgaattattggaacttttaatgaactatagataatgggctttctctggtgtgtgtgtgtgtgtgtgtgtgtgtatagtaaatacaggcatacctcagagatattgcaggtctgattccagagcacagcaataaagcaaatgtcacaataaagcaagtcatatggagtctttggtttcccagtgcatataaagtttacactgtactgtagtctattcagtgggcaacagcattatatcaaaaaccaacgtacatattcttaacttaaaaatactatattgctacaaaatgccaacaatcccctgagccttcagcgagtcatctttttgctggtggagggttttgccttcacactgaagactgttgctgtttagggaagaagtcattgaatgctggggcagctgtggcaatttcttcacataagaaaaaatcaagttttccacattgattgactcttcctttcataaaagatttctctgtagtatgtgatactatttgatagcatttttcccacactagaccttctttcaaaatcagagtaatccttcccaaactgtcctgctgctttatcaactaaatttatgcaatatcccaaatcctttgttgtcatttcaacattgttcacagtcatcttccatctcaagaaatcgctttatttgcttatccgtaagaagcaactcctcatctattcaagtttgaacatgagattgtagcagttcaatcacctattaacgctccattttcattctagttctcttgctacttccaccacatcggcagtttctccactaagtcttgaacccctgtcatccataagggttgggatcaacttcttccgaacttctgttaatattgatattttggcttcctcccattaaccatgagtgttgatattggcatctagaatggagactcctttccagaaagtttgtaatttactttatccagatcctttggaggaatcactatttatggcagctataaccttacaaaatgtacttcttaaataataagactagaaattcaaaattactccttgatttatgggctgcagaatggatgttgtgttaccagccatgaaaacattaatctccttgtacatctccatcagagtttttgtgtgaccaggtctattgtcaatgagtggtaatattgtgaaaggaatctttttttctgagcagtagttatcaacaatgggcttaaaatagtcagtaaaccatgctgtaaacagatgtgctgtcattcaagctttattacttcactgatagatcacagagtagatttaacatagttcttttttctgacctgggctggttcacccctccttaggcaacctggtggtcccccactcccaggaggtcgccatattgatgccgaacttagtgcggacacccgatcggcatagcgcactacagcccagaactcctgggctcaagctatcctcccacctcagcctcctgagtagctgggactacaggcatgtgccaccgcgctcggcgatctagcatagttcttaagggccctagggtttttgaaatggtaaacgatcattggcttcaacttaatgtcaccaattgcattagcccctaaccaaagagtcagcctgtcttttgatgctttgaagccagatattgacttctcctctctagctatgcaagtactaagtggtatcatcttccaatagaaagctgtttcatctacattgaagatctgttgtttagggtagccactttcatgagtgatcttagctagatcttctgaataacttgctgctgtttctatgtcagcacttgctgcttcgcgttgcacttttatgatatggagaaggcttctttccttaaaggtcgtgaaccaacttctgctaccttccaacctctgcagcttcctcacctgtcagccgtcaaaagagctgatgagatttagggccttgctctggattaggctttggcttaagggaatgttgtggctggtttgatcttctatccagaccactcaaactttctccatatcagtaataaggctgttttgttctcgtgtcatttgtgtgttcatggagtaccatgtttaatgtccttcaagacctttcccttcacattcacaacctggctaactatttggcacaagtggcctagttttttgcctatttcaggttttgacgtacatttcctcaccaagcttaataatttctagcttttgatttagagggagggatgtgtgattcttcctttcacctgaacacttaagagaccattgtgggattactaattagcctaatttcagtattcttgtttcttaaggaatagggaggcccgagaagagggtaagagacagggtacagctggaaggtggagcattcagaacacgcacaatggctatcaattaagtttgccattatatattgttactaaacattatttagtgacattagtaattgcaatagtgacatcaaagatcactgatcacggatcaccacaacagacataatagtaatgaaaaagtttgaaatattacgagaattaccaaaatttgacagagatatgtagtaagcactgttggaaaaatggtgctgatagactagcttgatgcagggttgtcacaaaccttcagtttgtaaaacactgcagtatccgtggagcacaatgaaatgtggtatccctgtattgttttgcccaagcctattatgtttcttttgatttttctatgatgtatttctttctacatatgtttatttagtttttataatgtcatgtgtcacttaacgatggggatatagtctgagaaatgtgtcattaggaaatttcatcattttgcagacatcatagagagtacttacacaaacctcatggtatagcctactataccccaaggttctatggtctagcctcttgctcctaggctacaaacctgtactgtatgttactgggctgaatactgtaggcaacttaaacacagtggtatgtatccaaacatagcaacagtatagtaaaaatacagtcttataatcttatgggaccactggaatatatacagtctgctgtcgactgaaagcatcattgtttggcagatgactacatgtgacattacagtgctttttttttgagaccaagtcttgctcttgtcgcccaggttggagtgcaatggcacgatctcggctcactgcaacctctgcctcctgggttcaaccgattctcctgcctcagcctcccaagtaactgggattacaggcgcccaccaccacacccagctaatttttgtatttttagtagagacagggttttgccatgttggccaggctggtctcgaactcctcacgtcgtgatctgcctgcctcggcctcccaaagtgctgggattacaggtgtgagccaccacacccggccattacagtgctttttttgagacagagtttcgctcttgttgcccaggctggagtgcaatggcctgatcttggctcactgcaacctctgcctcccgagttcaaccgattctcctgcctcagcctcccgagtagctgggattacaggtacctgccaccatgcccggctaattttttgtattgttagtagagatggggtttcaccatgttggtcaggctggtctcgaactcctgacctcaggtgatccacccacctcggcctcccaaagtgctgggattacaggtgtgagccactgcacacagccgaaattacagcttttacagtttgagtttggtggcttgctttgggaaggcctttcctaatctgcaaaccataacaatattctatatattttttctcctggcttcataattttattattttgatctttaacctcagtggaagggtgtgtgtgtgtgtgtgtgtgtgtgtgtgtgtgtgtgtgttttaaaggtgtgactttatttttcctaaacgaatagccagttaaactagtgccatttattggatggttccgctttccccacgcatgcacttgaaatgcccttttctcagagagacacagagagagtgtgtgtatgtgtgtgtgtgtgtgtgtgtgtgtacatgcatacatgcatgtatgtgctgtgtgcatgtgtgtctgtgttgttctgtctctgaactttctactctgctccattgatacctttatccctttgtaaagaagcagcacactgttttgaatacagtagctttgtgatatgatttgctatagataaggaaaatctgcttcctgttacatacttttttttttcattaaaattacagtttttatgttcatgcttacttgcatttttacaaattgagcttcttctcccccatccactgtgagtttagggttataagaaaaaaaactctctgcacttattagatagtctactgcactgggaatagcagtaagctgtttacattttttctttcatctgatacaacaaaccttgagagttggtgccaatatcctcatctgtagatgaggaaagtgagcctcagtgatgaagcagtttgtccaaggctgcatttctggacattggcagaaccagggttccagaccaagtccaggaaatttcgaaacctctcttaaccattatgcaacccagacacgtggggttttctcacatgacgagggcaggccattgtctagggcgggttatcaggtgtttctccatgtcctgcagggcggtcagtggcttttacagagtagagtgtttattgcatgaagggaagacctagcaagatctctctaaaggatttatccattggggcagcaagagttgaaaaatttggctttgccaagggtatttgttcagatttaggatacaagtcaagttgggaccacaggctaaagtttaagtgagtggggagagaaattatttacccagtgcttttttttaatgccagacactgtaacccttcctcggctcttttctagagttgggtctgtggtttggaatacaaaggtgaggaatacacagccctggacattcagaatggggcagtaggctgggaggagctgtgcgcacaaccccaggaaccttctactttttttttttttttttttgagacaaagtctcgctctgtcacccaggctggagtgcagtggcacgatcttggctcactgcaaactctgcctcctgggttcaaccgattcttctgcctcagcctcctgagtagccaggactacaggcgtacgccacaatgcctggctaatttttgtatttttagtagagacggggtttcaccatgtcggccaggctggtcttgaactcctgaccctaggtgatctgcccgcccgccccgcctcggcctcccaaagtgctgggattacaggcgtgagccactgcgcccggccccttctaccttttagaagaaaatgcaacaacgtgtcttagctctctagtggaggaacagaggtctcaggtggatccagaaatgctttgctatagagtggcatttaaactgggacattcatgtgtctaaattacctaacagtttgagccctcccttcccccgaggtggttgcttcttcatttgaattctctcaggtgccttctgttggttcttagaggtgaacatcagaaaagtaattttctttggagaagtttgaagcagcctcccaaacagaagtcctgttgagctcccactgggagttttggaaaagtaatctcatttattaggaatagtgtattgattttgtgtgtaaaatggactaagaggcctgtgacaatgagtccatttgaaattgcaaatttaaatatctaatacaatagttgtgcggaaatactacaccagaatataaatgattagctgcttagtgaatttctcatgtgcatgtaattaattggcagtggtggtggggatcaagtttgttttcatatcctgagtcctttaatttaccttttcttcaacaattactggtgtaagtataggggaattaaatcttagtgtcttttataaaaatatatagttttgctttgtcattcatttattgttttttggtctacattatccaattttgtattacacaatagaaggcacctaatcaaagatttcttgtttttactgcatgattgcactcttaattttgtgaaagcataggtttacttccagactgagaggtaaatgaataattattttgtgatttatttagcacttgccgccccaatcttgtttttcacgtctgcagttatggctgaaatatctattccattcccagcctctctgttggtggtatctgcctgatctccacctagtgtcattgtgggatcgtggccacacatgggccttccagggctgtgctattggtgaccagtggtgcttgtaaccctgaagtgttggcatggcctcagctgactgggctttccctcatgcccagggcttaaacttgaactctgcctgctctgttagcagtttttctctacatttcttttaaaatagactttcacttcttccttcccatcccccccaatacaactgccctggcatcctggctttttccattcttgacaaatgatctgtccactgtaactgtagctccactgtgctgatatctgttgaaattagacctagaatctaaatgtggctccatgaaactatgggtgagacattttttttcttcaaatagtctatggtttattggcaccccaaaccacctatccataccttctccactgtgatgctgggggaagaaaatggggtaatatatgtgtaaaagtgactgagaatgaaaagttctgcataaggtacaatgttagctggggtttttgcatatataataagaagacaaatgttcactaccactcctgcctgccttccctgggcatatcgaactgattccagcctaatagcatttcttatcatataatgggaatcacaaaccctccctatgtccgctcctacagcgccttcttaccgtaatgaggctttgtaactcaaagatttaaacatctcatttatgctccattgactgagttaaccaaacactttgtatttggccctttcctcttagaagttcagaacaataatatggtcctgaaactactcctgcaaaatctgcttagggaagaagggtcggccagggcaggggttacattggggtttgcagtgtagtcaggcaccagggacctggcaggttgggtgggatcaattcttttcacctcagggctccagtttctcatttgtcaaataaaagtgatttctaaggcccccttctgctcagaccttctgtgactgtccactaagccacagagactcactgtggccattgaattcttggggacctcagggaggttttgctgccgaagtgactgcccattctgccggcatacatttggactaccatttgaggtgacttggagagaatgtcactgtggaagttggccttcctgacacctgccacacaccttccatgccatgcatctcctcttttcgaagtcctaggagctccttgatgatatttactatttacatttgcatctctgatagtgctctttccaagtgagttggcagcagttcatttaaattctgaagcagatctctgagttagggtttggttcttctggcctttgagatgggtgctgcccagcacagcaggcctcggtgaacactgctgttcaccaagggactttggtccctctcctgcaacgattcagtgaactgccttgaagctctcgcagggactctgaagtactgaaatgtttatttctaagttagaggcgaggaaatgaaactaaggtcacagacatttagtgattttcttttctcccaaggtgagggaggtggttaagggcttggactttggagtttaaaatctcaccagctgcgggaactcaggcagtcatttctcttttctagaaccaaacttcctcttttattttttatttttttttattttttgagatggattcttgctgtgacacctaggctggagtgcaatggtgcgatcttggctcactgcaacctctgcttcccggattcaagcgattttcctgcctcagcctcccaagtagtgggattataggcatatgccaccatgcctggctaatttttgtatttttagtagagacgggatttcaccatactggccaggctggtctcgaactcttgacctcaagtgatccacctgcctcggcctcccaaagtgctgggattacagacgtgagccaccacgcccagcccccaagcttcctcatctaacatgggacagttaatgacttacctctcagggttgactgggaagggagcggctgaatgagaaccaatgttgggaatgtagacagggtcagaaaggttagccctctgatacgtgctaagcaaagattagagttggtgctgaaaacaggtctcttgcctaaatcttggattagtacacaacttccacatataaagagttaggggcatctttaggtagataaatctattttaattgttccgtaaatatatttagaagaattttggtcaacatggatttggtgcaaatttcgttgcagctttttttcccccttttgttattctaagctgccctacaatgatatttttagaaatttctgggaactcaagactgtcattgccagggcagagccaaaacaccagaggttctcgtagaccagtggttctcaactggggaatgttctgcccctcatgtgacctttggcaatgtctggagacatttttgattttcgtaactgggagtgggagatgctattggcatctagtgcgtagaggccagggatactgttaaacatactataacatatgtgacagcctccccacaacaaagaattatccagcccaaaatgtcactagtgccaaggttaacaagtcttgctctcagataattctttgcctatcacaggcattctttgtccccagctacagtgtcatataagccatctcaaacaagggtatattcgttgtcccccttatccacggtgttgcttttcgtgctttcagttacctaaggtccaaaaatattacatgaaaaattccagaaataaacaattcataagttttaaattgcactcggttctgagtagcatcattaaataccacctgggacttgagtcatcccctttgtccggtgtattcgcactatgttacactattccccaaccctcattccttactgtataggaaaaaacagtatgtatagggtttggtactatctgaggtttcaggcctgcagtaggggtcttggaatgtatcctcggaggatgaggagagactaccgtattttttccggaaagtctaggaccatttctcaaactaagagaaggacaaagttggagaggaaactgtttctgttctgcatagtttgagatatgtacaattttgagacccaatccaatttttttccaaccactttcttgtgtgttttttttttcagtatcttaacccacattgatgttttatcttctgtaagcactaaacagtggcaagttacacaaataaaatgtgtgcttactacattttaattgctcttttttatgcaaataataatagatggtttttttgttcttacacattgattcctgggggaattttaatattttattaaatattaaataaaatgccctatttttttcctttcaaattgaaccaccctagttataatgagccatcagttctaaaatgaatcctctctgttaaaatggcagcttgttctaactaatcatgctttgagtattctgctgtagttaatcaaagttaaaataggaggttatattttaaatataaattctacttttaaattctaaatttgctatttttccattctggaatattatgatagggttaccagataaaatacacgatgccaagttcaatttgaatttcagataaacaacaaataacttttttagtataagtaggtcccatgcaatattggggatatagatattttttaaatttgttgtttgtttgaaattctaatttaacttacttaatgctctgtatttttatttgctaaatctgataactctaaagataggactcaggataattggaaaataccaggaaataccactcacgtctgacatctccctgcataactttatcttggatgttttactttacaaagtattaagtaataaatctcgtatagttatttgccaaagagaaggaaataaatttctgaagggaatttagaaaatttgtcccataagcacatttattggtcttaaagggtagcttgaataaactggagttagttgttcacgtgacattcagaagtaccatatttgacataacacctcaattccagaggggaaacttggatgggagagaaaaatcctttttatgggttggcttctagagattacctagaacttaagtgaggtgattttactctttcttcttttcataagcagtaggattcacttcagagttgagggcctgttgcaatagagggacatgttgattataaaagaattgggttatttttggctaaagcaggcagatcacctgaggtcaggagtttgagaccagcctggtcaacatggcaaaaccccatctgtaataaaaatacaaaaattagttgggcatggtggcgcacacctgtcatcccagctacttgggaggctgaggcaggagaatcacttgaacccaggagatggaggttgcagtgggccaagatggcgccactgcagtccaccctgggcaaccaagagagactctgtctcaagaaaaagaaaaaaaagaattagattatctttggaaaatagcaaaaaggcccaaccaaaattctcacttaaaacacagaattcacaagagtgtgctgaaaatgagcatgccggagacacggtattcctcaacacttctcgtcatcagctgacacctgaatctacccggtgggaggaatgcaactgtctctggatgccactatcattacatctctgtggcctcaaatgggtccattgcagaatcttgctatcttcagtgaccttaaagatgtttttgcttctggagaaggaaccagctgcatcaacggtgatctgctgacttcatacagtactccgtctgctcccacctcgcatcccatggcccagtgtcccgtgagctgagatttgccttctgctgacggtgtcctgcctcaggtgccaggagcactgctttttgcttttttgtctctctaggagcagactgaacatattgcaacctgtgagtcggaggggggtcaacaccccagggccaccctctaccagtgggaatggaagccagtggataaatggccctacttcctagaaaagttccagggggcattctggatgcttcttgggaggcctcagcagaatgaagcccctgttacctgtagccatgaccttctacacacactcttcaataatacacccacctcactctccctcctcctaggatcacttcccaataaactacctgcacacaactccttgtctcagcctctgtttttggaaatatctaaatttagacacctattacattagtctggtagggctgccataagaaagtaccacagactgggtggcttcaacagcagaaatctattctctccctgatctggagactggaagtccaagatgttgtcagggaggtttcctctgaggccgctctcggctccaagatggctgcctcttcacctggtcgtccctctgtcataagctcaccgggtgtcttttccttcagattggatttgggcttaccccaatggcctctttcaacttaatcacctctttaaaggttcattctccaaatacagccacattctgaggcactgggggttatgacttcaacataggaatttaacggggacgtgggggtgggcgtttagcccaaggcacctgtgaaggagaaaaatctgatttagaatacaagctaccccaacataattggcctcaagattgtggctgttttcaaaaaactcttccatcttgtgtagaactcacctactctggggccttggggaggggggtctgtgaacatggaggccatggtgttcgttggccacctccttttagattaactgcgcagcctgtgtcttcacttctgctctgtacatggagaagacagggaaggcaaggctgctgcttacctgaaggagttcaaagtgtaaataagacaagcccattagatctatcaggggaaagccgtttaggtttgtttgagacaagatatatggtgtagaccacagaccttacgtttagggaaagcgtacttcttcagtgggctgagtttcttgtaacagaaggtgtggtcggatgattacagctggggttgaattagatgatttatggaacagcttctgccctgaaattttctgattgagagatggatgtggtctggagtatgtgaaaatgggatagatggagggaaggttaggggagaggtgaacagggcctcttccagggtcttgtggaagaccctgttcgacgtttcctcacgtagactgtctgatgaggctcttccagggtgtggtatggccagggtgtgttaaatgtagggagcacaaggcaagaaagggctgcaccgagctgcttcctgcctcagggcctttgcacttgctgtcccatctgcctggaatggccttgcctcacatcttcatatgaccttggctccttgtcatctattgactcacctgtcacttcagaaaagcccttgctaccatctggtctgccagtcactctttatcctattttcatgttttattaacattcatcaccatctgcagttagactcttttgtttgcctagtgcccacaatgttgcccgacgctcactaggtgctctgtgaatatttgctaaatgaatgaagaacttgaaggaagctggcagtgggtggactcgctgagattaaggggcatggaagattactcaaggcagcctcagcccctttctaatgttttgttttgtttttaaattcagactctgtggactcagttcaattcacacaattgccaagtgcctgtctgtgtcgtgcattatgctagttagatcccaggaatcaaatgaattagacctgaaggagattacagaccagttctatggttcaggttgttaatgtgggcccctggatagaattctagatattacttaatttttttgtgtgactaccctctaactgaaatttagcgttttcttctagtatgaacgtaggcactaaaccacagtagaactggcagtgtgtttgactgtcacccatagaaatagatattttcatatcacattacacttgttgcagctgtcttgaaatattgtttatgctcatcatgacttcaaaattacagtaatttttgacctgctgctggatctttttatttcacgcactaacacagaagaacatagattactgtatgataaattgctttttaatattttgaatagctatatttcaatacaaagtgtttcctttgtaatcccatatatatatatattttcttttttaagacataaaaaagcactagcctgagaaaaggggtccaatagacttcatcaggaggccaaaggaggcgtctatggcacgaaaacatgaattctggtggaattatgtgaaaagagaagtcctatcactccttaaaatcatgttaatgaagattcctatcaaatgtggtccccaccccctgctctgggtttactgcttccctgtgaatcttctccacacttttgttaattttgggatggaagtttgagagagatacttttttcatagataggttggaagtgatgctcaccttatcaggactgtaagaggatattgcaagctttgatgattgagcagaaaaatctttgcacagctggtcagaacaagcttgtcctgccttgtgggagggacagagttttccaaatgatcttttggttaagaccttaattaaaaacagcctaaattcacttgtggcaagaatttattaaaggaagataaccatgagcaaatccacgttgtggtataagaaaagggagcaccatcgttaaaaaagtcagaggcttgaattctggtgaacttagcacaaagaagcaagaaaactttagactggtttcttaacagtttgctatctgtataactaggggtgaattgatctcaaagacctaagaatctgtggacttaaagacactgatttgtggcataattcgaggtagtttaaactggaatatcaaggtgtcagaagaaaaatgtacaagtaatacatctcagtttcttttctcctacgccacttaaatcttagacccaccgaaagctctaaatgtatcagtggatttttcattatttccaaaaatattctgcttgctctttctgaataaactatagagagaaacacaggtttctcttcaggtgccttattaagtttaactgttgtatagtacagctttgcttctttgtttcatttaggaccagaaggggtccaggtagctgaatatcccttccttgccctgacatccccattcactgcagcaagctttataatgcctgtggtcatccttggtatgaatgagcactggagaccccaccatgggcagtactaagcagaatcaggcttctgttcatcagaatgaacaaaggcacacgcataaaatgagagcgtggcagatggagaggggtggggagcctagagggtgactggctgcaggcctcagcagtggagacaagggcacaggaacatggcgccagggccgacagatttggcgtcagccgtggatgctctgcatagcacccatctgtaaatgggtgtggtcctggacaagtgaggtcctgctggattatttaagaatattttatggtgagttgtatttgttctttccagcaacagctctttgaagtagtttagtggtatatccattttacagtcagcacttcagactcaagtttggtgatcacatgccccaagtctccaactcctgggctcaagcaatcttccttcctcagcctcccaaagtgctgggattgcaggcatgagccactgcacctggccgatgtgccccaagtcatgtaaaaaattaatagacaatgcagaatatatgggagaatgacgtattgctgggcctttttgatttgctagtgagaccagaacactttaacatactaaaagttatagctggttagcaagccaactttttaacttcaaaagatagggaaaaataagcattattaaaactcattgacttggccgggcacagtggctcacacctgtaatcccagcactttgggaggccaaggcaggtggatcacaaggtcaagagatcgagaccatcctggccaacatggtgaaaccctgtctttactaaaaatacaaacattagctgggtgtggtggcgcacgcctgtagtcccagctacttgggaggctgaggcaggagaattgcttgaattcgggaggtggaggttgcagtgagccgagattgtgccactgcactccagcctggcgacagagggagactccgtctcaaaaaaataaataaataaagtaaattcattgacttgctgaacaccataattaaagggattctggaggtaagaaaaaggtgctccttttgttgttatataacaacaataaacattattgttactattattacagcccttatcttgctttcttttcttgtccctatcaaccttccctggaagaaagagaacttttccaggctaagatcatacattaaagaattgtccttttttttttttttttttttttccaagacagagtctctctctgttgcccaggctggagtgcagtggtgtgatctcagctcactgcaacctccgcctcctggattcaagcaattcttctgcctcagcctcccgagtagctggaattacaggcatgtaccaccacgcccagctaatttttgtattttcagtagggatgaggtttcaccatgttggccaggttggtctcaaactcctgacctcaggtgatccacctgcctcggcctcccaaagtgctgggactataggcgtgagccaccatgcctggtctaaagaattgtctttacgatagaggaatgtttgactttagcacatttctggtaaaatcaagattctagatcggggtgtccaatcttttggcttccctgggccacgttggaagaagacttcttgggccacacataaaataccctaacactaacaatagctgatgagctaggaaacacacacacacacacacacacacacacagagagagagagagagaaattttgtaacgttttaagaaacttcgtgaatttctgttgggatgcattcaaagctgtcttgggccacatgcggcccgtgggccggaggttggacaagcttgttctagacgttcttcctctgtctctctatgttagatgctttcccacgttagcagtccttttcccctcctctcttaaatgaccaagcaggactaggaaagcataaaggcaatgagaacacgctgcctgggatttaagcccttgaattccaataaggttctaatatggacttctactaaagcataatggttaattccatttagagagtggggaacatctttcatactttttaaaacatcaggccaggtgcagaggctcatacctgtaatcccagtgctgtgggaggctgaggtgggaggatcacctgaagccaggagtttgaaaccagcctgggcagcacagtgagaccccatctccacgagaatgttaaaaattagccaggtgtggtggcatgtacctgtaatcccagctatttgggaggctgaagtatgaggatcccttgagcccaggagttcaaggctgcagtggttgcagtaagctgtgattgtgctgctgcactccagcttgggcgcagagtaagactcagtctcttaaaaatttaaagtcattattcccaggtggagtgtactactgagaaatagaagtcccttggttggacctagcttataagaaacttcaaagcagtcattgccaactacaggtgatgattggtaatttgagcaaaatttgatagcttttgaaatggcatcaatttaaaagaagtagtttttgtttcttgatccggggcaaggctattattctggtttccaataccctttatccatctgaagagcatcaaaattggcgggtgccaatcaagtttggaaatggaactgagcagcatagtaacctatagaaaattcatgaatatagaaaattcaagatcatacattaaagaattgtcttttttttttcaaaaaaattttttttctaaaaatgtagtgttatattaaaatgtagtgaatattataataattctaaaaatgtagtgtttatattgttttcctgcttaagttaggccaaagttggtaaaatgcattttagaaccctatttttgttaaggagagcacagagccactggtttagagaagtttgtaatatccagaggatgaagaaaacggacacttgtcattctgagttcacgggaacgggagaaactgaacccttttaggttgatcatcagcttgatgtgaagggacttgagagattctctaatctattctttcctttaactggttaggaagcagagtccaagagaaatgccctgcccagggtctggcagaactgatggagagcagccttcgtggctaccaccttcccataaagtctgtgctctccagcggcgcttggtaataagatttatttaatgacacgtgtaactctaagactatttgtgatggcgaataccacagatttgactgggtaatgtgatatttgttatttgctttaagttaactttagcctttagcacagtgtgatggaaagggcaccaaacttgtgatctagaagacttgggttcaagtttcagatttgaattagctttgcttctgcaaatctgaggaccctattttcttaatccatgaaatgggaataataatactcacccaatttaccttacacagtcgtgaggattcattgtaatgggctttgtaaaaatataaagtgctatataaacataagggtgttaatctcctgtctttggtgacaggctaaaaagacatacttgtttcaaattttggatactctaatttgcataatcttacacattctctttctctatttttaactctatgttttccccatcagatttttttctgttaggagttacaatatctctcttcaactgggctttgtctcaaggtgtataaacttaaagcattatctccggtgcagtttgtcagtgtctcggcatatttgaaatttttagtactgcatttggtatatgaaagctgcatcctatgtaagaccataggatatttaaacagatgttcaaatttctattgtgaaaatcctagctcattccttgctagagatgaagcactgaggacagtacaatcaccaccttaaaacaaaccacctaagcacagctttggctgcacagattggaagggaatctggtaattacactctttagttcttctgtgaatataaccaatctgggcaatttgggcaccagagtggatttttaggcatgaattatctggttaagttagccagataattgccagctgtctcccgtgctttctgctctggagaccccagccggagtaattgtcttctgtttactcatgcaagcaagttgctggtttccattttcaaacaaaaactaactgcatgttagaatggtattttaattgagctatttttgttgctgattcagagattcccccaccctttgccaaaggagttgcccagattagaacccattaatttagttgatttggggggttccttgttgactttggggaagacataaatattataaaagagatttagaagttgatggtataaggttttccgaaacattcaaaacttatctcaaattctgaccaaacatttttctactaattttcctaactaaatggaaactccagctgtataaataatgatttttgtttgaaaacattttttctcttgattttagaaccatcgagggaattaaattataaataagtagcaggaaagaacaactttgtcaatgtgaaacagaatgcaaaattactcacattttgaactgagttccagaatgtaaagcaacgctttagcatgggctgctgaagcgagctgctctttagggaggaggaggaggcttactgagacgttttgtttgtttctttattttatttattaatgtatttgccatttctccattagatctgattttaatactgtaagtctttccactgattacaagtgcagtgacatgtccctctgcaaccatcattttcctcccattttttcttttctcttttttaaagagacagggtctctgtcacccaggcttgcatacagtggcgtgatcatagctcactgcagtctcaaactcttgagttcaagtgatcctcccacctcagcctcctgagtaactaggactaggtgcatgccaccaaagcctggctaattttttaaatttctttgtagagaggggtctcactatgttgcccaggctggtgtcaaactcctgggctcaatcctcctgcctcggcctcccagaacattggggttacaagcatgagccactgtacctggccctcctccaattttttcttaagaaaaaagagaattcatacttcatttacctgacagtcctcatcccatttaagtgtatacaatggaaatacgtacatttatgaccaatattggtctctttctttctgtaggtttgagttttgattatagacttcgatggagaaagcaatggcgccacaacccagccagggtgccctgccaggacttcctcatctcttgcagtgaaacccccttatcaaacattacgtgctatctggccccctttgtcatactttcttgcactccacttactacatatcaaggatttgccatgttgtggaaaagttggtttcataacatattttgaactcttatttaagggagttgtttttcttatattcttcattccacaaatacttaaccaaggcatattttgccacaggtacatgacttccaaagaaatcataactatagttatccaaaaaaattaaaataatttagtaatgtccacatcgtcttaaacactcttccagaatgttccaaaggaacaaatggttgcagtgacttttaactttagccccagcctacttccagctaaggcagttctcactgcagatatatgtattcattggtccaaagaaagagagaggaaaacttggctcccgagtatttagagtgaatgattcacgattctgtacatgggagtcttggctccttctctgtctctcaggctttttggtaggaagtcaatgataccagtagaaaaaaggctgtttttctgacttaggatttggtccgctctctgcaacccactagagaaactgaagttttctttccataatgatctgaagtgttgatagttaccatctctgtaaaagctcattaaaaaatgacttattttcctttggaaggagaggtcacatgctggagctagcagtggaatatcaggaccaaggatcataagcctcctgctgtaactctggtttccagatttatttgagcctacttctgccagaagtaaatttggtgggcatcttgaatggagaaatgaacagatgatcaaggagagggaaaagggtcaggagtaggggtgggaagaccccaaaatccagtgaaaagggtcaggggtaggggtgggaagccccaaaatccagtgtggcagataaggggaggcccaaaatccagtgtggcagacaaggggtgagggcatccgaaacacacagtttactattttaaccatttttaggtgtatgattcagtagcattggctacatttacaatgttatgcaagcatcatccatgtccagatttttttcaccgtctctaacagaaaatctaccattgaacaataactcccctcccatccctctagtccctggtaagctctattctactttctgtctgtatgaacttgaccactctagatacctcatataagtggaatcataaaatatttacccttctgtatctgccttatttcacttagcacaatgtctttaagtttcattcatattgtagcatgtatcagaatctcattctttttatctctgaataatattccatggtatgtataaggccccattttgtttatcttttcattcatcaatggacatttgagttgttttcttctcttggctatcgtgaataatgatgcaatgaacatggatgtatgagagtatcttctgtttgagtccccttttaaaattcctttgggtatatatccagaagtagaattgctggtcatatggtaattctgtgtttagcttgtgtttttgtttttgtttttttgagatggaatcttgctctgttgcccaggctggagtgtagtggcatgaccttggctcactacaacctccacctcctgggttcaagcgattcttctgcctcaacctcctaagtagctgagatcacgcgtgggtaatttttttttttttttttttttagtacagacagggtttcactgtgttggccaggctggtctcgaactccttacctcaagccatccacccaccttggcctcccaacgtgctgggattataggcatgagccactgcttccggccatatgtttaactttttgaggaactatcaaactgttttccacagcgggtgccccatcttacaatcctactagccatgcactaggggattgacgcggatcctttctttgacccatccgcatgtcacccaacctttttttttttttgctaaccagcagtttgctcaacaggcctcatcctcattcatcactgggtctccttttgctgtttgcagagtctgcctgcccctttggtgttggctttggctagagaaaggagtatatttgttttgctactgacctggttggacatgcatgccagcctgtttatgaggtgctttctctggctgagggagtcaggggctgtgcaactgtattctttagtgtgaaggtgagccaacacagcgaagtatgctcgccctgcctcctccagaaacaatctgcctttgagtcttttcattctcctggtaaccgtcttcttaatagctgtggcttcatctaaatgaaaaatttatcttgtgctgcttacccaaaggagaggctcctcacatgtcagatattatttcaccaattatctcagtaacttctgtgctttttattcctgaaagcaaagttgagaatgatgcaggtttccacaacatgcggtgtttcgtgcatttttatccttacgtagttacaagaaacaaagcaaaatttagaattatttgaagtacttttaacaccctcaatttgatatgttgtgtgtatatttatatctggacacaattcttttcattgaacggtatagacaaagcatttagaggacagttaagtttctccaataatcatgtttaaacatatctcaggccgggtgaggtggctcatgcctgtaatcccagcactttgggaggccgaggcagattggatcacctgaggtcaggagttggagatcagcctggaaaacatggtgaaaccccgtctctactaaaaatagaaaaattggccgggcatggtggcaggcacctgtaatcccagctgtgcaggagactgaggcaggagaatcacttgaacctaggaggcagaggttgcagtgagccaagattgcgccattgcactccagcctgggcgacaagagcaaactgtctcaaaaaaaaaaaaaatctcaaatctattttttaaatttaacctttgaaacatttgtgtaacgcaggtggctcatgggcaccaccatcttcttttggcagatgaggaaacaaacctgtctgtcaacacagaaagctgggtctgctcaagaattgctgtggggtacagtggcaatagcagggacaagagggatgcaggggtcctgtcttcgtgtctgtggaccagcccttctcaaagtccacggctgcccctcttggctccattctttgtctcttcatggaattgttctgtgggaatagtctgcatatagtgattctgcattccaacatctaacttccctgtgccttcctatttacaaaagacacagtttcttgacctgaaatccccagtttgggattattaataacatttttttgtaacctgtagtgcttcagatactgtctcagcctatgtgaattctggtagcattattgccttatagaaattatttgacaggccagatgcagtggctcatacccataatcccagtgctttgggaagctgaggtgggctgattggttgagcccaggagttcgagatcagcctgggcaacatagccagacccctatctcttcaaaaaaatttaacagggcatggtggtgcacgcctgtagtcttagttactcgggagagcgagaacccatctctgaaaagagcaatgctagaggtaagaaagtctatctttgtttttttaagctggtattcccattctgccccccaatttatcttcacccctttcaaggtgagtgctttgtgatggccctaacatttatttagtctaaacaaaagaaaaattatttgagagttaattgtgtgtgtctgtactgcatgtcttccgtcaaattaaaagttaactattgcattttatttattttaccttaatttcatatcaagtactttcatactttttagcttttaaaatgacagaggctgggctcagtgtctcactcctgtaatcccagcaccttgagaggccgaggtgggaggattactgaagcccaggagttcaagaccagtctgggcaacatagtgaaaccaggtctctacaaaaaaaaattagtcaggcatggtggtgtgcgcccatgttcccagctacttggaaggctgagcccaggaggcagaggctgcagttagctgtgtttgtgcctctacactctagcctgggcagcagagcgagacctagtcttgaaaaataaatataaaataatagaatgctcttcccagctagattgtaaggtttttatatgttagtgtccccatggtatattgtaagttgtaggtacatacccctatttattatatgttatggtgtttttaggcaatgagatttttaatattagctactcatgattcgcaacaagttcggtctttatgaaataaacttcattcaaatctttgaattccatttttaagtgcagctacagttgataccttagacaaatgaaagatttgtctacttcttagttcattcctacagaaaataagaacatctagtatctaatatgatccctcgtgggccctcaagaaatactagtcttttttagaaagtctagtcgtgggtctgtttctctttattccattgtgtctgcctgccttgttattgctgtgtctagaagaaaatgaagaaaattagcatggctcctttcgttgctgttttgtacaacttttgtatcctcactcagaagcaagatccttggaaatgaaatgctatgtcaaaaaccagacgaaaaaaacacaacaacaacagaaaacacattttttataactactcgattcaagattttgttgctaggtcttggaaaatgttgtatgtcaacccaaaggtcttgggaagtccccctgagtcatgaatgggtgtggtaggactgggatgtggacctctgggctttgcttctgatgataacttctcctagggcagcagtcatgctggggacagccgttttgtctgtttatctctaggccttgcactgtccctgtcatataatagatgctcaatacatgtcttttgaactgaactgcattggcctggccatggtttaagcatttggaccaataacaccctgagtgtcaagttcctcctcagtcgggctggagagtcgagagcgggtcatggtgagttggtctttttgtgtaagaatccctagtggcagcagcgccttgtacttaaaaatagaatactaccaacatcatcttccttcccaggatgacaaggcattgagaaaattagaatgtgtatattttctcccttttttttttttgagacagtctcactctgtcccccaggctggagtacagtggcgcgatctcagctcattgcaacctccgcctcccgggttcaagcgattctcctgcctcagcctctcgagtagctgggattacaggcccgtgccaccaagcccagctaatttttgtagtttcagtagagacggggtttcaccatgttggccaggctggtctcgaattcctgacctcgtgagccaccgtgcccggcctctccattttctaagacatgcgttttttcatttgtacatacgtatcttagcattgataccccctctacatttgtttataaaacagtggtacatcttgtaatcagtagcttcttagaactgaggaattcgttttgtcatcactctgaagggcagtttagccagtacagtaagtcttcactccataggttcttggaaattgcaattttaaatgaatgagatatcatgaaagcaatttgaccataggctaattgatatacataagacttaagttccttccaaaatacgtacaatgttaaacactgaaataaaggtaagctatacatacatttaagaaagattaatttaaaaacaagtaagatgattatttaatcagttattccagctcggggtttctggtggatggagcctgtcccagcagctcagggtgcaaggcagggcaccagccctggacaggatgccatcccatcacagagcacattcgtacacagccagagtcactcagactgggacagtgtagacatgccactttgcctcatgtgcacagctttggggtgtgggaggaaccctgaggacccagagaaaacccacgcggatgtggggaaaacgtggaaactccaccgatagtggccatggccaggaatccttttttttttcctcattaatgttataacaaaatgacattgaatgaaatgttattcaaggacctgctgtagttacaaattggttattagacgggttgaagtctctgcttggccactttctagctgacgttaagtttctcatctgacttaaaagtccaggaaagacgaaatgatattatttagcacagcagcctgacttatagtagagcatcagtacatattacctatagttgttttcatgaaactatttcaccagaagtttagggatttatcctcaaaggcattaggagtgcctacacggcacataagggcattgttttgtatcataccacaagtagcacttaaggttggaatcattgctgaccccaatgtaaaatgcctctttctggaccagaaaatggaaagtgaaatttgcaattcatcccatgttatttatttatttagagacagagtcttgctgtgtcacccggactagagctggagtgcagtggtgcaatcttggctccctgcaacctctgcctcctaggttcaagcgattctcctgcctcagcctcccgagtagctgggactactacaggtgtgcgctaccacacctgctaatttttgtatttttagtagagacagggtttcaccatgttggccaggctggtctcaactcctgggctccagtgatctgcctgcatcggcctctcaaagtgccaggattacaggagtgagcaaccatgcccggccctctgtatttttgatgggatggatggttcaacatttaaagagaacctaaaaagttaaaagtaaaagcaaagaagtcttaataacaaaaagcaccttcatgcaatgtcactgttttactgcatcttaataaagaaatgtggccaccttagacccagaatataatcaatttttaattgtctttcttggataatatcaggatagagtgtaataagttaggttaacatattagcttgcatcttgtcagggaaaataggtagatcctctgaacacagaggaaggagggacgtccacgtttgtcctgtttagtgtcatactgaagaagagtatgaccagccagtgctgggcgttctgcagcttgggacagatgttggggggaagggcactgcctttcttgtgaactttcttgcccaagggacaaatgagctaagcagtactacgttattagtgggatgtgtatgtgtgtgtgtgtgtatgagagagagagagagagaaagagaaagagaacagagcctgtaagtcttgccattttgccttttcagacaacccacccccacccctcagcataggaatgtagtcctaaccccaagccactgcttcttctgcttgcagctctaaacttgagcaggtcttgggggcagttcaccagtgcaccacactacactactctcagcaatcttttttttttttaaacagtgatttgcactgatctagcctctaaggggtaagggccgagatgaagcagagaatttatttttatattatgtcatctggtgcagagactgctacaaaatcaggagtcaaaaatctaagggaataggctgtgaagtcattttgtccatgagttgtgttacaacacattcattcattgtaaacaatcaccaacagtcattgccataatttattcttggcagtaaattgggttttctagtgacagagtaagccatcagaattaagcaaccaggagctccagttcatgtgtgctggaaaagatgtttgcgagacttcaggtaccactacctcatattaaaggtgagcaagtggaggcccagagagggcaggtgacttgcccaaggtcacacagtgggttagagccatatcaaggactagaacattggtaatccatcacatcgtccttaaacctttctgccccacttcctgttgacacaataggcaggatattaaactccagtttcattcctggggattgatatgaaaggttttttacttgtccaatcccattttccttgtccaggcagatgacaggtagtaatttcagaaactgagcaagggatggtgaaagctagattgtagtgggctctttttggtttggttgttatgagcgctctcaatgcaaagcttagaaacctctccagagaaataatcagctctccaaggagtgctcttgcagactagcatgttgccttgcttgctggtgtgtatcttcctataaattcctggtatccagtgtccatacaggagaaattggctgacttgttttcttgctgtgttgtatgacagataatcagaaatgtaactctggtgccttgtcatgtgcccagaggaagttaaatgtgcttgcctttaatatgtatatgtatacacacacacacacacacagcagttagaaaatagatgtttgtaaaatatgatttttttagggaatatgtaaaaactggcatctcttcagatagacatagaggtacttaaaaaccttggttaatatgtcttgtttgtatactccatgtggtgtattttacacagtatctaaaggtgttgcctgattttgaattagttaaaagacaggttagagacgtgggagaagagtatgttgtatttcttgtctgatctgaggaattttatattcctgaagtctataattaggtgcttgtgttgattgtttattgaaacaaagctgaaggtgggggtgaggggagtgccacatagtggaaaacactctatggcaaacatctgagctttacttaaaagcatgggctgcaaagaaatgtaaattcattggcttaattggaagagagtatttatagaaattgaatgatccagtaaaactaaaagcctggcttctttcatcttcagagacctgccttagtaaatgctgttctggaaatcccttgcctgcaaagtggactttgccatccaatttctggcctcctggcagtcagtcactttgacctaaccctattgcttgactcgtatttactacgtactttccttttttggcttagggttgtactgaaaatgtacatgtaaagaaaaaaatgtccatgtacactgaagttttctgattttttatatagctccataatttgatttcaataactattacaaagaaacttttataagaagatacaatttgaaaatcttgctgtgcagcctcttcccatctactctgcctgcctactacgccttttatagttcaccatatccattaggttctcgaaaattcttccactgtttatgcaaatctttaaatttttaaatacttttattttccttcttagaaaaggtgacaactagatgctattctgcaccttgtttttacatggaatcatataccttaataagcttttcagacactctttcaatcttctgctattatgaagttgcagtgaataaccttgtatatcacttcatacatgtgcaggtatatctgtagggtaatttcctataaggggatcaggatttgggccagcagatatgtgcatatgtatttgtgatcgtgtggctagcccctcctttttttaacttttattttaagtttaggggtacatctgcaggtttgttatatagggaaactcgtgtcatgaaggtttgttgtacagattatttcatcacacaggtattaagcctagtacccattagttatttttcctgatcctctccctcctcccactctccaccttctctggtaggccccactgtctgttcccctttatgtgtccatatgttcttataatttagctcccacttataagtgagaacatgcagtatatggttttccgttcctgtgttagtttgctaaggataatggcctccagctccatccatgtccctgcaaagaacacagtctcattatttttatggctgcatagtattccgaggtgtatatgtaccacattttcattatccggtctatcattggtgagcatttaggttgattccatgtctttgctattgtgaatagtgctgcagtgaacatacggtatgcatgagtcttcataacagaacaatttatattcctttgagtatatacccagaaatgggaatgctgggttgaatggtatttctggtagtttttttggtccttgagaaatcgccacactgctttccataatggttgaactaatttatacttccaccaacaatgtataagccttttttttggcaacctcaccagcatctattgttttttgattgtttaataatagacattctgtctggtgtgagatggtatctcattgtggttttgatttgcatttttctaatgatcagtgacattgagctttttttcatatgcttattggctgcatcacatgtgtgtcttttgaaaagtgtctgctcatgtcctttgcccacgttttaatggggctgtttgtttttttcttgtaaatttgtttaagtttcttaccgatgctggatattagacctttgtcagatgcatagtttgcaaaaattttctcccattctatatgttgtctgtttactctgttgagagtttcttttgctgtgcagaagctctttagtttaattagatcccatttgtcaatttttgcttttgttccaattgcttttggtgtcttcgtcatgaaatctttgcccgttcctgttttcagaatggtattgccttggttgtcttcccgggtttttataaaagttttggattttacacttacctttaatccatcttcagttgatttttatatatggtataacgaaagagtccactttcaatcttctgcatatggctagccagttatcccagcaccatttattgaataagtagttctttacccgttgcttaatttttgtcaggtttgtcgaagatcatatggttgtaggtgtgcggccttacttctgggctctcattctgtcccattggtctatgtgtctgtttttgtaccagtaccatgctgttttggttactgtggccctatagtatagtttgaagtcaagtagtgtaatgcctccagctttgttctttttgcttaggattgcctttgctattcaggctcttttttggttccatatgaattttaaaatagttttttctagttctgtgaagaatgttgttggtagtttgataggaataacattgaatgtgtaaattgcttatgttttcccatttgtttgtgtcatctctgatttctttgaagagtgtttttaattcttgttgtagagatctttctagagtattcctaggtgttttattctttttgtggcagttgtgaatgggattatgtttctgatttggctcttggcttaactgttggtatatgggaatgctagtggtttttgtatgttgcttttgtatcctgagacttcgctgaatttatgtatcagcttaaggagcttttgggctgagactatggggttttctagatatagaatcatgttgtctgcaaacagagggtagtttgacttcctctctttttatttggaggcactttatttctttctcttgactgattgctctggccagggcttccaatattatgttgaataggagtggtgagagagggcatccttgtcttttgccagttttcaaggggaatgcttccagcttttgcccattcagtattatgttggctgtggatttgtcatcgatggctcttaatattttgaggtatgttcattcaatatgtagtttactgagaatttttaacatgaagcagtgttgaattttattgaaagccttttcagcatctattgagataatcatgtgttttttgtctttagttgtttatgtgatgaatcacatttattgctttgcctgtgttgaaccaaccttgcatcccagggataaagcctacttgatcatgatgggtaagctttttgatgtgctagtgggtttgttttgccagtattttattgaggatttttgcatagatgttcatcaaggatattggccttattttttcattgtgtctctgccaggtttcggtataaggaggatgctagcctcatagaatgagttggggaagaatccctcctcctcaattttttggactagttacagtgggaatggtaccagctctttgtacgtctggtagaatttggatttggctgtaaatctgtctggtcctgggcttttcttggttggtaggctatttattgctgattcaatttcagagttcattattggtctcttcagggattctgtttctttctggttcactcttgggagggtgtatgtgtccaggaatttatccatttcttttggattttatagttcctgtcgcttgccctttcagtggactatttttgtttttttaaatggaatgcttcacaaatatgccccttccttgcacagaggccatgctaattttctctgtatttttccaattttcatatatgtgctgctgaagcgatcaccctaagtactgtttgatttttgcactcctgccaacttaattagggctgcaccaatagagtgggttatcaaacttttggatttttgccaatctcatttgtaaaatatactttattgatatggtttagatttgcataccttttttaaaaaagcaaaagcctggacatcttttcaagatgtttaaaggccatttgttggccaggtgcggtggctcacacctgtaatcccagcactttgggaggctgaggagggtggatcacgaggtcaggagatccagaccatcctggccaaccaacatggtgaaaccccgtctctactgaaaatacaaaaaaattagctgggcatggtggcacacacctgtagtcccagctgctcaggaagctgaggcaggagaatcgtttgaacccgggtggcagaggttgcagtgagccgagatcgcaccactgtactccagcctggtgacagagtgagactccatctcaaaaaaaaagaagccatttgtttttcttgtttctttctttttgtttgtttgtttgtttgtttgttttgcaaactgtacttaattcctgtacgtgatttactcttctgttggattcttgctctttttcttgttgatttgtaagggctctttatataatagggagattagctctaagtctgtgatatgatcttcaaatttttcttggtttatcatttcctttagtatttgtggggtttttttggtcttatacagaattttccattctttcttttatggcttctggatttcgagtcacagaaagcatttccaccaaccccttccacacatacacgcacaagaattgacccatattttcttgcagaatttctatgctattactttttttacatttaaatatttgctccatttgaggtttatcctgatattctgttaagtatggattcaagttttttgtttttgtttttgtttttgttttggaaataggctctcactctgttgcccagactggagtgcagtggtgcagtgacggctcactgcagcctcgacctcctgtgctcaggtgattctcttgcctcagcctcctgagtagctgggaccacaggtgcacaccaccatgcctggcaaattttattatttgtggagacgaggtctcgctacattgtccaggctggtctctaactcctgggctcgggcgatcctacctccgcctcccaaagtgctgagattataggcaggagcagtcgtgcctgactcaactttattttttgtagatggctacccaatttccctaaccacttagtcaaaatgcccacctttcctcccactgaagtgccaccattataaagtaaatattttgtaaatgaaaaatgcccactattcccttgtaaaacaagaaactgtgggtcaccattttttggaaagaatgtttcagttctctttttaactcaagacagctcttccactttgtcctccaaggataatatttactccagagtgaatgaatgaggttaacaacccacctgcttgtttctccctagtggaatgttaacattttgcctcttggcacaattctcaagatttatcttaagaccctgtctcctttcactcaaagtatttgtctctttatcacaaagcctgaagaaacatttcttgttactcaaggaccatgccttttatgagccctaagaacaggagttatcaaagtgtggtcttccccagaccagcagtctcaacatcagctgagaattgtcagaaatgcaaactgctatccttgagctacagaatcagagaccctgtgtggacaagcccaacaatctgaattcaacaagcctctcaggtgtttctgagcatgctcaagattgagacccatgaccttagaggtaatatttaatttcataatggcagtttacaaccctatagcactgccttgtgggcggatgggtttggtcctaatcttcttgacatgtaaaaatgtagactcacagcaggaagtgataatatctgttctttaaaggtggtattcttagagtaggaaacttttctgagttttttccaggagtcacaaagatacctcactaggaccgctagtgctttggactagaacaccttacatccagaatcttgccactgggtcagtgcttccctttgtcatataataaaaaaccagcaaaactggtttctataatatgctaaggagttttgtagcgttgaagacttgtcttacccccacaaaagcatcattgttccttctcatcccttgcccctctgcctttaaaattaatttgataccagaatggcaaatacttctgatgactgttagccacgccataatggtgcttgtatttggcaggttaaggcagagttcccatacctctgagcctaattgccagccagggttcagctcagagcagtagttctaaagtttttctggacattagactccactggatagcttttgaaaattcaactacccgggccaaatccatgtaactaattctatatctcaggggtggaacccagggatcaggatttttttttattacccagccgatgacaatgtatatcgaagttagtttaagaacaaaggatgtgcacacttgttttaaagtagttttggttatgataataagaattataagagggaccaaatatcaaatgcaagaaaatggtcctgaatgccaatacaatcagaataagaaatgcataaatagcgacttgcttgaagctgaaatcaactcctttttggatgcctttcttgtcttttgaagaacacatgttgtagtatgtgtttctctccatatcctgtgtgtttcattgtaatagtcttgctgattgattttgttggctgcaagcaaagtgataaaatgccagtgggtgcctgtgccagggaggtcaggactggactttcccacttggctctgttttgatgcatttagcagattgattccaaccctctttggagactctgacctacaaaagtgtctgttatctttgagagctccagggaaagctatggacctttctagatcttttcccaccttttggcccatcagatattgccttgtccacagcagaacttgacgattcatcatagaagcctatggttttatttattgacactgctgtacaattttccctgtagcgagtcatagttggctgaagagagagtcgaagattaagtacaaaactttctaaacatcctgttttccctcaagacagggcactgttcttaataaactgaacattcttttgcactggccctggggcaagggtgtcccaaaagctttgacaggggtgccatttggtcataaacagtgtggtaatagggtggagtcagaaagaaattctctcatcccttttacaactccaggcaattctagaaccaacccttgggaacccagggaaagaactctgaaatgatacgctggctgaggtttgccgtggccacacctcagggttaagcattgaaggagctaggcaaagagtgtgtgtgtttagctacaaactaagtcacagatcaagaggcttttggtattcttccatttttgcttagaattctatgatggtttttgaaatatattgtccttactttatgttcttacctgtaatctcataagtttctggtaaatttagcttttgccaggttccggtgggtcttacccagagatggtcagagtaaatgaacaaaagaaggaattgattaggatgtgaaacttcagatacgctcacaggccttcaagccctagaaagtagtatgccagtgaattttctagtcctctctacactttgtacagatgaagaaaccgagacccagggaactcaaccaaggtttcttgccattcctccagtcccccagttaaaaaaaaaaaaaaaattaggttctattttgcaaactgacaaggagaattatacaatggaaataacactcattttaatgtatctgttcttgtagtttcttattttattcacctttataaaccattctgagaacattgtcataaagagcattctcctaaattggaatgtgattcaaatagtcctgtctcctttcctccttgctttttatgaaatgactgcctacacgcactcgcgcacatattttagtgagcaatgcaatgtgcgaatacaaatagaaatagattttgttaaaaaaaaattaatgtcagtccactagttaaaaaagtaccaaagtcattacaagattcattaactatgtttaagaaaagtattgagggctttttgggggattaaataattttaatttataaataatggcctcagattcataaaccttaactgattgtagagattatgaaggtttgtttctcacacagttaattatttgttgctttttaaataaccagataattactttgcatttgtaatgattaattgcaaaaagttggttataagaatccctagatgaattctcaggtaagatctcatgcagaattctttgaagttcatttggggtcatttatcaagaaaagcaatgcatttcaggtttatgaactcactttgcccacaggtgaggtttccaggcttcgaaccagcaggaggagagtcagtgggaggatctgacgtaggtatggcttcagagatgaagagagtatttctcctccgcaccccctttgcctacacctagaaataagtttagcctagggaaaaaatgttccctgacttgtcaggttcagctagtgtaccctttgagatccttcattctctctttttctttttgagaagaagtcttactctgttgcccaggctggagtacagtggtcccatcttggctcactgcaccctccgcaccccaggttcaagcgattctcccgtctcggcctcccaagtagctgggattacaaaagcacaccatcatccctagcttattttttctttttttttttttttttttttagtagagatggggtttcaccatgttggccaggctgctcgatctcttgacctcaggtaatccgaccacctcggcctcccaaagtggtgggattacaggtgtcaaccactgcacctagcccgttctctctttaatctcccaattaacgaacatctactgcgacagcatccattacctagaattgtaggaaggtatataggatagacgtagcaaagaggtaagtgggtaagaaaataaacactcataaaaaggagacaaactgtcagagtggtcccctagctacacctgccacaattgcctcctgagaagtccttgttctgcacgagctaaaattcccattcaaataaattgttgctcttcctataatcattgagctgctgaatagagccagggtccttgatagacgtcatagtttgttattgactttatcaccagtaaaagttaatactgtcatccctttcctgcagcaacacactaccatttttttttccaaaattaatttaggtaaagaacatttttcttagtataattttcattgaattcagtattatcaagtttgtatatttttagagcttttggatcgctattccagcccacatttttcatagcaatttgtctagtatttcttcaagatctttttatgttcatttgaaaaatgaacatgacttcatatgtattcattagcaatcactgccgtaggcctttctgtttgatttttcttctgaacctcagagatagtggctcattatgaagtagaaaaaggctaactaagaccttgttctgaacttacagtgggtaagcaagaggcttcagatccataatctctatcaaaatgtttgcccacattactgtaacagggagtcattcagaatgagagtggaggaatttgactccttttaaagaatcgcgtgtgctttttctactttcatggttgtgtcgttttgccggggagattttgaaagagaagactcatatcttgtcttccccataccgaggggtctttaacccctaatctataaattaaataggtaggtcaagcaatacctaccagagttggttgctctgcccactggctcctctctgcacctccctcccagaccatttctccacttcctcagccttagaaaaaacagctcactcatggtggtgcttgccggtggaccttggagataagcttctattcttggttgtttttaagaaaactgaattctcttcttagagccaacccatatcttatcagtgtaactttactcactctccaagccctaattccattctgtcctttaaacattaggagatttcccaaaaataggcttgtcagtaaaactctggtgtgacaaaggggcaaaagtgttgcttttttgtgtggagattgcatttttaatattctgttccccagaagtggttccaggatgcttccctagaagtctttgggaagaacaattagagtaagaaaggttcttccattatctgccccaggctgggtgtcttcggatgactctgtcacctcacaagttgtttaatcctgtatttagcttgtcagggatcatacgaaatggggtctacatcagattttccacagttgtttttttctttagtgatatagcctggaagggctgggggcggtggctcacgcctgtaatcccagcactttaggaggccaaggcggctggatcacctgaggtcagtatcacctgagaccagtctggccaacatggtgaaaccccgtctctactaaaaatataaaagttagtcttagcctagcgtggtggccgacacctgtaatcccagctactcgggaggctgaggcaggagtctcacttgaaccccagaggcagaggttgcagtgagccaacatcgtgccactgcactccagcctgggtgacagagtgaaactccatctgaaaacaaacaaaaaaaggtcatatagccaggaagagcttcagtgggaagaacagcaggaggaatgaagtcccacgggttatctgaagagatgtactgatttcagaacagtgatgccagctatgaaaactaactaccacttatatcattagatgaagagcctgttctgaaacctcccgttaccactatattatgtttaaaaagtatacatctgaacagtcagtgtagctgaaaattgatgtcaccgtttacattgattttttttaatacatagaaaatttttttatcttaacaaattaaaggtttgttagaggatccactttcctttaattaaaataatcgatatggaagtacacagtaggcattggatacatttttgtttccttttgaaaatctgtgagttacagccagactcttcgtcccagcactttaggaggcctaggcgggcagatcacttgagtccaggagttcgagaccagcctgggcaatgtggtgaaaccctgtctctccaaaaatacacaaattagccaggtgtggtggcgtgcacctgtagtcccagctacttggggggtcgaggtgagaagattgcttgagcccatgagattgaagctacagtgattgcaccactgcactccagcctgggcaacagagcaagaccctgtctcaaaagaaaaagaaaacttgtgagttacctacctttggggaagtggagaactgatgttatagaaatgggcaataatcctaaaatctgggggttcccattgctcacctcttttctctcatccgctcattcattctttcactaaatgttattctttgtcagtgttcatagaggcttcccacgacttgtctcccagaagcccagctgtctcagaacttctcacgggctgactggttcctccaatttccctagacttttttgtttgtttgtttttaacatgtgtatcctttgtttttattctattttcaccaattttacaaatgaattacacagattatgtattcccacacacattctatcagaagtatataggatgtattagcgtcttcagcccttccccttctcctcacttatggacttccttccaggcctttttctatgtattttcaacagtggttattttggctttacattggaaaccatgccttatctacagttctgacttgtttttttccttacttgttaaaggaaagaggtaccttggccatagaatactgcaggtacataatgttctataatatgggtatataagataaaatggtttatttaaccattcccttttaatgaacaatagtcatttagatttttaacttacccctgttgattatagtgctataataaacatccttatacatgccttcctgtgcatgtttttcagtatttctctaagataaattgattcccagaagtacacttgtagagtcaaaaagtcatgcatgttttggccaggcatggtggctcacgcccgtaatcccagcactttgggaggccgaggagggcagatcatctgaggtcaggagttcgagaccagcctggccaacatggtgaaaccctatctctactaaaaatacaaaaattagctgggtgtggtggtgcacacctgtaatcccagctacatgggaggctgaggcaggagaatcacttgaacccaggagatggaagttccagtgagccgagatcacaccactacactctagcctgggagacagagcaagactctatctccaaaaaaaaaaaaaaaaaaaaaaaagccatgtatattttaaatattaacactgccaggtaatcctccaaaacagttatactaagtctcatgcccattcttctgcctcactaattgacacttgtttttaattttttaatttactataaaacatttcagatgcaaaagatagaaagaatagcacccatgaaatgacattaacaatacatttgaaggtcgggcacggtggctcactcctgtaatcccagcactttgggaggccgaggtgagtggatcacaaggtcaggagatcgagaccatcctggctaacatggtgaaaccccgtttctactaaaaatacaaaaaacttagccagttgtggtggtgggcacctgtagtcccagccacttgggaggctgaggcgggagaatggcgtgaacccgggaggcagagcttgcagtgagccaagatggcaccactgcactccagcctgggcgacagagcgagacaatacatttgaagtcttgtttctctccccaaatgcattgttttttccactacatttcccttcatttctcatactttgcctgtgttgtgtatgtctacttttactacgtatttattaatctaatgctatttagtaatgttttcaatgtttttaaaattttataaaaagatgccgtatacattctgaggtttttttgtttgttttttactcactactatatttgtgtgattggcctgtgttgataactatagcctggtgctaatgctgctctacaaattcttgtgtacacatccttgtgcatatgcgcaagagtttatggtgcatattgagaagttgatggttttcactaaatattgataaaactcttctcccgaggggccctccccgtcaacccctggcttcaaacatagtatcagtttctcatattttcagcacttggtatttttagactttgtcatttttgccaaccttgtaagtgtgagaaggctatttcattttaatttatatttctctgacttcgtattttaatattttcaaccatttagtagtctcttctaggaatcccctattcctgtcttttatctaatttttctcttgggttatatgttcttttcttactggctactcctaattctttacctattctggataataatgctgaggtagcttacctttccattgttttactgtggccttttgttgacagatagcacgtgtgatttgtgctgccctcccgtgcagtctcttgtttatacctcagtatgtctggagttgagttttgtatgtagtttgagggatccaattttatttttccgatacacagtttattaaattgtccattctttgcagtatctgcagtgtcccatttgtaatatatgacatcttcatgtatgtgtggagctgtgtctcggttttctatactattcttttggtctatttacctatcggtatgcctgtacatatttcactaattctttttttttttttttctgagacagagtctcactctgtcacccaggctggagtgcagtggcgtgatcttggctcactgcaacctccatctcccaggttcaagcgattctcccacctcagcctcctaagtaactgggattacaggtgtccgccctcttaccttgcaaatttttgtatttttagtagagacagggtttcaccaggttggtgaggctggtcttgaactcctgacctcaggtaatccgcccacctcggcctcccaaagtgctgggattacaggcgtgagccaccacaccctgcctagttcactaattcctatagttacacaataaaaacctgggtatcgggcagggcaggtctctctatcttgttctttttgttttgttctctttctctctctctctttttttttttttttttttttttttttttttttttttgagacagggtctcactgtatcacccagcctggactcaaactcctgagctcaagcaatccttccacctcagcccccattcactctttagtgcagtcatagctcactgcagcctcaaattcctaggctcaagtgatcctcccactttaacctctaagtggtgggattacaggtgtgcaccaccagacttggctaatttttttattttggtagagaccgggtcttgctgttgcccacgctgttcttgaactcctggtctcaagtgattctcctgcctctgcctctcaaaattctgggattacaaggcatgagccccactgcaccaggccaaatctctttaaaagataatcaattttaaaaattagtaaattgtggccaggtgcagtggcacacacttaaaatcccagtgctttgggaggctgaggtaggaggatagcttgaagccaggagttcgagaccagcctgggcaacatagtgaagtcccctatctgtaaaaacaaagagagagatttaaatgtaacatatttacccacatagttaccatttctagtgctcttaattccttcgcctagatctgttttccatttgacatcattttattctgtttgaggcacttcctttaatattttctctattctactggtgaagaattctttcggctttcgtatctctgggaaaaagtccctattttgccttgagattttaaaaggttttcgctgggtatgtctgagaatatagaggaactaaaaacctcagtttctcctactgtagtttcacatcacgcttctgacaccagatgtgctgagtcagggggtactttccctagacatcaagcaagcaattcattctgcagtggacaccagctgggtgtcccccagttcaattctacttcatctacccagagatagcgtcagatcccacaggttgaaggctgagccccgcacaactgtcccccacttccaatgccagtcgcaagccccagattgtcttacctgtttttttctgactgaatagctataaattggggttcccacaacccccttcttgggtttgattaatttgccagagcaggtcacagaactcagggaaacagcatttactggtttattataaaggatattacaaagggtacagataaagggatgcacagggcgaggtatgggggcaggagtgtggagcttccatgccctccccaggtgtgccaccctctaggaacctctgtgtgttcagttattcagaagctctccaaacccagtccttcgggggcttttatggaagctgcattacataggcatggttgattgcatcattggcctttggtgatcagatgggctgttgtctgttcaccttgaaactgccttgaaatgcatcataaacacagcagttctttgtcagtcaatcagagagctgtttatcagacactgaagaatccagcagctcctcacacagttccagagtcaggcctaagggggaggttatctcctccttgcattcctcaggtaggtagcatgatctcttataaaccatttccattttatgatagaactcttctgggcactgccatccccattacagtgttcctgtgacatcacccccagacagcatggttatttcaggtttcagggtcattttgtgttcttcagtctaggctccacacaggactatgcctccaggatatgtctccaccagcagtcagcttctgctctacgccctgtggccttgggcaaccttgctggctcccatttagcacgtccaattaatattgctcaaagggtggatttgcatgccttctgttttacagtactatgtagggggagcatttcccactcagatgtaatgtccattgcatgataaagagacacagctatttcttatgaagtgtgttcaaatataccacctctctctaaacttttaccttagttccatcaacccttactttcctaactgtagccttcattaggcctttaccaacaggtttcggtcgtacaattcagtactagctaggggaagtgttccctggacagacataatatccattcctataaatcatttaggtaaagaggcacaacttccttatataaagcctacttaaacatcccagctttgatcatcctagcaatccttacatttttatgttctcacaatcttaactgtagcccaagtcagggcttgcccagtgggttttgatagcacagtgcttaaggctcccatatcgaggagtcccaggaattattcttcacctcccagacgattttcccacttgtgtccataaggctgtgggtacccagcaggggactgggccaagacacctttgctgtctgtcagtctttttcttgattaatctgcctgactattgccccaggcaatttcagatcagatccttcattgtaatctctgcctctgactttttaaatttctccaaactagggtaaatgtagcaaacatttttcaaacccctttatgtcgagagaccagcaggacttccctttgatctatccagccttccacagtgttgcattaaaacatttgttttaacctcattttatttcagtttccattttattcatcccaattttttttattttccataggttattggggaacaggtggtatttggttacatgagtaagttctttagtggtgatttgtgagattttggtgcactcatcactcgagcagtgtacactgcacccaatttgtagtcttttatccctcactcccctgcgtccccaaagtccattgtgtcattcttatgcctttgcatcctcatagcttagctcccacctatgagtgagaacatacgatgtttggttttccattcctgagttacttcacttagaataatggtctccaatctcatccaggtagctgcaaatgccattaattcattttttatggctgagtagtattccatcatatatatatataccacagtttctttatccacttgttgattgatgggcatttgggttggttccaatttttgcaattgtgaatcgtgctgctataaacatgcgtgtgcaaatattttttttgaataatgacttcttttcctctgggtaggtacccagtagtgggattgctggatcaagtggtaatttctacttttagttctttaaggaatccccacactgttttccataggggttgtgctagtttacattcccaccagcagtgtagaagtgctccctgttcacatccacgccaacatgtttttggggtgcggggcggggggtgtgggcagagtctcgctctgtcacccaggctggagtgcagtgtcgtgatgtcagctcactgcaatctccacctcctaggttcaagcgattctcctacctcagcctcctgagtagctgggactactcatgcacaccaccacgcccggctactttttgtatttttggtagagatggggtttcaccatgttggccaggctgatcttgaactcttgacctccagtgatctgcctacctcagcctcccaaaatgctggcattacaggtgtgagccaccatggccagcaattattttttgatgttttgattatggccattcttgcagaagtaaggtagtattgcatggtggttttgatttgcatttccctgatcattagtgatgctgagcactttttcatgttcttagctgactttttggtgggattttttgggttttttcttgctaatttgttttattcatcccatttcttaatagccatctaaagatttccaccatactgggaaaagtcccatgactcttctctttgtttttcctctgtttcatccctatcggtgtgttcttttttttttttttgagacggagtctggctctgtcgcccaggctcgagtgcagtggcgcaatctctgctcactgcaacctccgcctcccgggttcaagcagttctctgcctcagcctcccaagtagctgggatttcagctgcctgccaccacgcccagccaatttttgtatttttggtagagatggggtttcaccgtcttggccaggctggtcttgagctcctgacctcgtgacccacctgcctcggcctcccaaagtgctgggattacaggtgtgaacaaccgcgcccggcccagtgtgttcttattcaccttatttcttaacaaccataaaaaatttccaccttcctgtgaggagtcctgtgactcttcccccctacccttcatcattctcttgttaattaacctaatgtttgtattagcatctgtaagactcatgaggggaagctgagcaagtacatctcataaggcttcttgaactatctctcgattttgtggcaacaaggttaaatggggcatccacattaaaggggcgcccctaatcgcatcatttaccatgacttgggtagcaaggcatattcagtgcttgaataatctggtggtcataaacccaggccccacatggcatgaatacaaagtgtatcagctgtttcagcttgacatttataggtggagtcaggcagtcccccttcttccaacattcaaaaccaaagacactgctcctaaattactctcacagtgcattttagtaaagcctcctcaggaagctgatgataccaatctaaaaaatgaaacaattccttcacactataccctctgctttcaatggcttcttgattttgccctttcctgacactgccttcttggtgcccaaagtccttaggggtgctttctgatgtcgctgcataatttttcccttgtgggagcgaggttctgtgagtctactggctgaagcatagattgactgaaatctgaacttggtctggcatcgaggtttggcccagcactttctttttactttcattctagctattacagataacaataaccaaagggttgcatattttgtttttttcttattagttcgcatttcttcatgcattcagcaaaccaccttccagggagttagattgatccacctctaaattccattggtaacttttacctttagtgactgatgccactccataccatgggtatggagctgccactccataccatgggtgaccacatgggcacccaggaatcaaaggtttctcaccccccaacccctttatctgttttcttcccaaacatgagctagggatgttctagcagtcccgattctgacaccaattctgaaaatgctgaggaatgaacaaactcggtttctcccactattttcgcatattacagttgtgacaccagatgtgtggggggtttccccaggcatcaagcaagcaattcattctgcagcggacactagctgggcgtcctccaattcaattctgacaccatctacccagagaagtgtcacatcacacagattgagggttcagtctcacaagaccacccccaacttctgatgccagttgcaagccccaggttgttttacctgtgcctctggccaacctgctgtaaatcggggttcccgcggcccattcctcagattcagttaatttgctagagcagctcacagaactcaggaaacattgaggtttactggtttattataaacggtatcacagaggatgcagatgaagaggtgcatagggcaaggcatgtgagaaggagcacgcagcttccatgacctccttgcatgcgtcaccctccaggaacctccttgtgttcagctacctggaagctctccgtaccctgtcctcttgggttttttgggaagcttcattatgttggcatgattgattaaatcactggccattggggatcaacttaaccttcagcccctctcctctccttggaggtttagagatgggtctgaaagttctgaccctctgatcctgccttggtttttccagtgaccattgtccatcctgaagccacctaagggcagccggccttcattcaaatcatcagcacacaaaaagatacttcatcttctatagtaagtgggcctaccttacaccaagactgataaagtgaggggttttctaaacataggagagaaagttcaggtgctgggcactcaaatcaagtgacagatgttcacctcgggcatcagcacagtgtatgcagtgaaggaaaactgcagaatgacagccatgcagcagacctggagaacccctagctagtctcaggtctggatatcaggaggccagagagcttcaggcaggaggaaaagtggagatttggtagaatatctgatatgatggagagttggaaaaaatttgaggatttggtgagggcaaatggtgccaacgagctagaaagacaattggaaactccaaagaaaacaaacaagctttacaagaaaggatatatagtctcagtatattatttgatactgcagtgaatactgtttatacagtcatgatgtatagcactggttttttatttaaccaaaactaattatgtaactattggggggaaatggaagaagtgagatgggtatcgtatcattgaaggatgtcagtacattagaactaaaatggctaaaccagaaatagctgtgtgagcatatcacttagagatacagaggtgaccaccaggagaaatagtaaaggtggttcccccagcaaggtagccattataggctctctgagctagtgggttttgaaaaaccatgtgcatctatttgttttttaattgtcttaaattattcttaaaaacaaaataagtttctataggaaggaccgcagtcaccagttcataggttaaatggcttttattccaaaagttctaagtcagtgagattgcttttcctttagaaacattcatatatatgtggttagatccccaaactagtccacaaatacaggttatagtgaaattaaaatatcctagtttagaaatcaaaagaagaaaaatgaccaactttggagtccattctagtaatccaagtgagaaaggatggggatacggttggagttttctgcacacctgttcagttcaccagttattcttctctgagatagtctggtttgtgattaggcttctcacccagcggctcacagaggatgctactctcattagattctgcacttacctctcactgtaaaaagctggagaagactttggagcccttcatcttaggtaacctcgtcaatgacaggttgacactaggagtgcatttagcttggcatgaaagggaccataagctgtcccccttcctcatcattctgtactcaaagcccctcactactcacaagcacctccgaaccaggacttttcaaaatctctgcttctgttcttatttggacagcccattcaactcctctgacttcactcccttatctgcataacacagctcaagagctgtcacctcttaacaatctctccagacctctacccacttctccatgcacccctcttcatgccctcctggacccaccctgggctcactgcagtattcattcataataaatttcccattgtttcccattgtttgcttgcctgtatacttgttgatagcagggaccaccatgttgcctttataatcatatgcccatgcagggcttggtacatagcaggcactcaataaatatttgaatggattcaaaaatgatgagccagattgagttaatacatagttacagctgaaaactaacttttcttaaaatcctcatgccctgacccactaacctaatggccagagtccaagtgaggttcagctgtggtctgctatgaagctggaaattccctcctttgggttatttcactgatgtacttaacttggtcttcattctttttatttctattttatttcattttccttcttcctttgttcaaaatacctgtctcgtctttggttttgagacaaaaggtatcatctatccagttctatccctttcctgatcgcctattaactagggagaagggagtttattttagcattcacagtttgttaacatacagcaggccatgccttgtgcttgatttaatttttcctgtggctcagtggcatggtggataagaacatcccttccctccccaccacgaagctggatgccctttctggtggcatatcccatttctgttttgaacccgtacatattgaatggtacataagacattcaacagtctagaaaataagccaccagatttctgtttaaccccaaatggaaatgatattgcttttcttgttatgcaagtaacccacgctcactttaaaatgattttcaaatataaaaaagctaaaaagaagaaagtaaaatcaccataagcctactatccaaagattaatgcttttcaactatttggtgtgtggtatgtatccttagatacttgctttctatgcatataattttcttacaaaaatagttttactattcacacctgctttttttaagttacatatgtcgctgtacatcattattaattacataacatttcaagatataaatgtataataacttactgaatttttcttctgaggttgggcatttatgttgcacatataggccgggcacggtggctcacacctgtaatgccagcactttgggaggccgaagcgggtgcatcacctgaggtcaggagttcgagactagcctggccaacatggtgaaaccttgtgtctattaaaaatacaaaattagccgggtgtggtggtgcacgcctgtaatcccagctacttgggagctgaggcaggagaatcacttgaacccaggaggcagaggttgcagtgagtggagactgcaccattgcactctagcctgggcaaaaagagcgaaactccactcaaaaaaataaaataaaaatatgttggacatatgtggaaaaatcaaatattcaagaaacaggctgtgctgtttttaatagacaaaccctagaaacaacctaaatgttgaggatgtactccaagaagtagaagtgccagttagtatggtaataatgtatatgtagacacattgctttttcaaataagatcaaaaattgcagaaatgtaaacatgaagtcattactcatttaatttgacttcccagagataaccaccattaacatttggtgtggatctattttcaggcctttttctctatggatttaggaaaaattttagtgaagtctgtggtttcatatttttttatattacacatatctctgcaactttaatttttctcctttatatttcttgaaagtcttttgaagtcatctatagagattaaactccagcctgccccccctccaacacacacacacacacacacacacacacacacacacacacacacacactcacatctatcccttctgcaggttggtaacattggagctttgtaatttacctgccaagggactttgggaatttattccttggttcattcaaaataagtcaatttgactgagtgcatgccatatgcaaggctctggggaaactaagctgcttatgacctgagcttagagtccagtgaggaagcctggagtatgcatttgtcatggtggtaaaatcgtgcagtggcagcatggatgttgctatggaagcagaggaaggaatctcaataaggccaagggtgtcatggtcactgacaaattattgcatagactgaggttcaaatcctggtatctgtgctgaacgtggaggctcacatctgtaatctcaacactttgggaggctgaggtaggagggtcatttgagcataggagttcaagattggcttggacaaaatagcaagacctcatctctaccaaaaaaaaaattagccactcatggtagtgctactcaggaggctgaggtgggaggcttgcttgagccaggagtttgaggcttcagtgaaccatgatcacaccaccgccctccagcttgggtaacaaagctagaccctgtctctaaaaaaataaaaaataagaattctagtatctgtcccttgttaactgagacctcgggtaaatccttaacttctgtctcagtgcaagctgggtgtaataatacctaccccacaatgccagcatgattattcattggaaaaatgattataggagaggagtattgaatgtccattagtagatgtctgcttaagtaaataaatcgtggcatattaattaatacaatattatgcagctatgagaaatgagatcattccatgtgttctgataaggtctaactcggacatatgttattaatagaaaagtgtgtgttttgctacgatttatgggaaaaactttttaaagatgggatggtagatagtctaggtaaatacaagtatgtatatagctatctgaaaggatatccaagtaacttcatagtgcttgcctttgaggaagggaactgggatcaggagtagggagaaagtttgctttccatttatactcatttatgctgcttaaattaccatatacatttattatatgtaaagaagagtttttaaatcaggaataaaataaagtgtgtcattaaggcaatatcaacttaatctagctattcaaatatttttacatgggacttttcacaatcttttcatgaagtagttataagcatggacttgtaggtgtgcttactggctatagaatcttggaaaagtcagttaatcacactagacctcccttttcttctataaaataagaattaataatagccaccttattaagggtgttgtgaaaataagataacaaaattgagtggaaaacagttaacatggtgcgtagcatattataagcactcaaatatttgttgtgtaataattaatactaaaggtctgtatctatcagtggtattaataataatctaattcagctgccttataccaaaaagggatatttgtgggctcacacaaatgaaagtctgtggcatatgtgcctttgggtatggctgtatctagcacctcccttgaagggattgggactcagcctttccccagctcttctgtgttggctcacttcccaagtagctccaggctcgcaccctactggcctaataatgcccagtgaaaagaacccagtactttcccagtggttcccaagaaaaatcccaggattgactgacccttcctgcattggtcatggtctcatctttaccccagacacttgagccttgggattgaggccaggattcagtactcacctctgcaactttgatgggaagagtcgtcctaatgttgatcagtctcaagtcttgtcttttcatgcttggagactaatagaaactaagaacatcagtagagctccttccccagtggaaaaaaaataggggcaacaaatatcaggcaggcagactatagatgttccccactggctccagtggtaattcttttggggttttgtggtttttttttcgttttgagagagagagatgggagacttgctgtgctgcccaggttggtctcaaactcctgggcccaagtgatcctcttgcctcagtctcccaagtacctgggactacaggcgcattaccattgcacccagctctaactacatacattttcctacatagattttcagaactgcttaccagtacaactgtttctttgcagaggcatgttaacgtccatggggctgaggttttaacgttagcacataccttgtttatagtacaagttacccttgaaagtactgccggaaggtgccacatggagttccacacagaatctcacagagccaggctttaccactgcttggaaccaaatggcccatccttctgttgattactggataagttggctgttttactggtaggggccatgtaatgtaaagatctgtgcataaacaatgaatacctctccaatcagtacgatgctcacgctgtgaactaacaaaaattgagatgaccaagagaagagatttccatctaccctggtgctcagcccagggcagggtggtgtagacagagctcacccgcactatttaaatcctgtcatatagttttttgttttaccaggcatgtgtgcttgaatttgctaagttaagcattaaaataatgctgctccatcaaatatcaaaattcttagccctttttcaagagattctaattattgcacccatgttcagatctgagaccaaacaggtaatatgtggtccccacaaatccagttccgccctccctgttcactcaacaggggaggaaaaataacaggataacccaacgggaacctcccttctgaaaaggggaaatgacataaagtgctcacctcctgcttcttgtcatgtcctccacagggacagcagtttgtagagcctataagtccaccccaagttccacctcctgggaggaattctggggctgccccttcttcacacctcacttatttctggcgtggcttttggacctagtgattgatttccttagaggttcaacatcatggaccttcactttctagacttagtgattctttcgcaataaaagtgccttgcaattttagtagcttgtccatctagcattcaaatttggtcaatttatggtttggtgcttagtaacgagagttacacatgaagactagtcccggtctttcgaagttaagtctcagtcacttagcagcagacatggaaatttccctaacctacagtttaatggttccataggcctttgcctcatggcagtctgaaacagcagcctgggagggagagataaaactagtatgcccccagcctgctgaccagtgggtggttctttactgctgaggcacggccctaggtccctaggagttctgggtcccagactcttttccaagtttgccttctttctgttcactttattttcattttttgagacaagagtctttctctgtcatccaggctggattgcggaggcaccaacctccacctcccaggttcaagcaattctcatgccccagcctcccaagtaactggaactacaggtgcatgctaccatgctgggctactttttgtatttttagtagagttagggtttcaccaggctggtctcaaactcctgacctcaggtgatctgcctacctcggcctctcaaagtgctgggattacaggcgtgagccattgtgcccagcccatttgttgactttaatttgggcagagaatacagctctatgtctccttagattgctttctgtagagaaggcctccatagcaaagctgttttctttgaggcgggccagcctcagatgaagtttctctctatctgtagtatcttcctggcggtcacaagaagtgaccaacacactctgccactctctaacaaggcctgccaactccctgtcacaccatagccatcttgactcagccagttccataagctgtcactggcaacagcacaattctaggttcccgactcaaaacacttgaagcagctgggcacggtggctcacgcctgtaatcccagcacttgaggaggccgaggaaggcggatcacgaggtcaggagatcaagaagatcctggctaacatggtgaaaccccgtctctactaaaactacaaaaaattagccgggcgtggtggcggacgcctgtagtcccagctactcgagaggctgaggcaggagaatggcatgaacccgggaggcggagcttgcaataagttgaaattgcaccactgcactccagcctgggtgacagagcgagactccgggtctcaaaaaaaaaaaatgctttaagcaaaaaggagagtttattggctaatgtaactggaaagtctgggaaagaccaacagttgcccccagggcatgaccagagccagagttttgagtggtggtctcagacccctctctctccttctctccactctgctttcccctgggaaggccccattctcaggcagctttaggctcctcacttaccaaccttactggaaagacatacctgcttcttgccagatagttccagaaacattcctggggttagcctttgctcctccagccttggtcataagccattcaacctgttcgcggtgggggcggggagggcaggatgggccacaatgattagccaggcctggatcacctgtgtgcacagatgcgcttagaccaggaaagggatggctccccaaggaacaaacagggagcttctgcctgataaagagtgaatgtttgctggaccaaccacagcaggcccacacaaggacttgacagaatggctgggaggggaagatgaagtccagcaagcagattgtccttccggagccattagaatgatgtttaacttagcactgcagtagaaagataaggtgtgccactgaggcaagccacatcgtaaaatatatatataaagaaacagatgaaataattttaatgctacatctgacccattaacaacattggggttagaggtgccctgacacagtcaaaaatttagatagatcttttgactcccctaaacttaactaatagcctgttgtttggggttttcattattattttagtgatggggggtcttgctacgttgatcaggctggtcttgaactcttggcctcaagtcatcctcctgagtagctgggattacaggtgtgatccatgcacccagccctaatagcctactgttgactagaagccttaccaataacataaacagtcattaacacatttcatatggtatatgtattatatactgtattcttacaatgaagttagagaggaaatgttatcaataaaagaaagtttggaatgaatgaaagtggaatccacaggatagatttccctcatcagccaagcaggactagaggtgagggtgtgtgaaataggccgtgctgggcagagctgggctttgcctgagtgtcttactcttttcccttatgatctaaagccaggtttctccaactttaaggtgtatcagaatcacctggaaggcctgttagattgctcagccccattcccagagtttctgatccaatgcatcttaggtatgctctggaatttgcgtttcctagcagctgaacttggtccagggttcaaagtgtagaaggcatatgggcatataaagcagctggatgaaaaaaaaatcataaggaagagaaaatagatttactattcattactggaagtggatcatcataaaattcatcctcgttatcttcacattgaggaaggtgtggtgaaagaaaagaggaggggttggtcttactgtctcagggatgacagaggaagaagaaaacccacatataggtggacacactcatggccgggtgcagtggctcacggctgtaatcccagcactttgggaggatgaggcaggaggatcacttgagcccaagagttcaacaccagcctgggcaacatacagaggccccatctctacccaaaaaaaaaaaaatttaaattagccagacatcatggtgtgcacctgtggtcccatctactcaggaggctgagatgggaggattccttgagcctgggaggacaaggttgcagtgagctgagatcacaccactgcactccagcctgggcggcagagcaagaccctgtctctaaaaaaataaaatcagtggaaacggacagtccaaacccatgttgttcaagggtcagttgtattttatttatttcatttaacatgtgatcactactaaaattgttgagatattttaccctgttttgtactaagtcttcgaaattcagtgtgtattttacaattatagcacatgtcagtttggatgagctagtaaccagtggctatcgtagtagacggtgcagggttagctggtaactttccatagaggggctgaatatctagcttccgctgataagttattacttacgttttcacatcacggggagttgttttgaaattgcaactctcggctgggtacagtggctcacgcctgtaatcccatcactttgggaggccaaggtgggcagatcaccaaagatcaggacttcgagaccagcctggccaacatggcgaaaccccgtctctactaaaaatacaaaaattagctgggagtggtggcgtgcacctgcagtcccagctacttggggagggctgaggcaggagaatcacttgaactcagaggcagaggttgcagtgagccaagatcgcgccactccactccagcctgggcgacagagcaagactctgtcttaaaaaaaagaaactgcaaatctcctcattagaagaatctgcctgaaaatgagcctaaatacatatttttgtgctgagtgtccagttggtgccatttattttctaaaacacctgtcatacccatacaattagtacttaacaactgcttaaccatctatcttttctcttggactcgaagccccttatctatcttgcttactaagcccaatgcctaggtacctagaagacgctatgtggatattttaaaatttaattggagttaaattaaaaacttagataagggcttctcatttgctaggcttgataagaaaatggagaaagtaatagtggttgaagcccaagattgcatgtttgcagtatttgttttcccgatgaagggccgtttgtagtctgtgactagttgtgttacgatccaatcaccctttctctcattgaatatacagtatatagagagagtgattgaaaatctacagaaacccaggctctgtgccaagcactgggtatacaaagataaatgggaaacagtccctgccttaaaggaaatgagaaacagataagtcttacagtaataccgaataagtgtcatgatacaaataaacacagagtgtttggggagcacaaggaagggggtccaacccaggtcggagaatgggagatgggcaggaaagactcactgtggaaagggaatttaagccccacggcgcctgtgatattcttagcatccaaccccatgccaggcacatgatgtgttgaatcaatgaacaaagtgactcctgaacctaatgctgaaggatcgctgtgtttgtccatctgggtgtggacggatgatcacggcaggtgaagagagtgtgcatgacaacccagcctacaacgctagaatcctggctctagggaatgacaagatgctgagtggggtggagcagaggggtgagagctggcatgagcctgcagcatttggcaggccagcccacaaactgcctcccttcttgttcttgtccatatgaccggtgacgagagatcgcactttcttattacaggcaaagcgaaggctggagctaggagaaagcggtcatcagtacctctcagatggtttaaaaacccccaagggcaaaggaagagctgcactacgaagtccagatagtccaaaaagtaaggatcttttcatctctttccttattctccttggtatggcatttccaagtttcaaagcttatggccggaaggatgccaaggtgtgaataattctggcatgttttgttctttttcatttctttctgtgcttatccaaaaaaataaatacaatgtcagcagacaaccagtgaaaggctacagagtcacactggtaccataagggaagacttcttttaactgtatgtagtttcatttttcaactcggaatacgaacttttggcaccattctatatcaaatttaattttaacttcccttaatggacattgcttcagagtctgaggcaaactggatgtccacgaactatgccagagtcaccagtgtctgtgccgacctcaatctccagctcagcatatgatagcgtaagaattgattgagcccgataaattgcaggctgtttctctttctatcaaatactattaccgtttcttgtgggagagagagaaacgtaggttagaaatagccaactagtcccattatgtatgtgtttgcatttaacataagggctaaattagactttgttctctctcttcctttagttcatgcattaggcaatccacaaattgtgtgacactaaattaaaaccttgacctgtgcacctatgggggaacaagtacaatattaagtaaggaaatttcctttaagagagatggggagatttggcagaagacttttccaggtaattatttatcaaaatgaagcattgtttggaaaattggtgaacaggtgatacacgcacacacagataccagagcctgaaaggccatttgagatgggtctgtttaagaccttgtcctgcagtgctagtgagactcatagcctggctccatcaccgtaggcctcgtgtgtgctggtcccctgaggccacagcactctttcattcatttgacagatattttttagcgcccgctatatgtaaattcttcattggagccagggaatggtgtaagtcaaggtagaaactcttgagaaattcaaggtgaaatgctttaatcaaaccctggaatttttaccttcccttcctgctctaataaaaaactttcatagctttctatgacttgccaacaccaacagcaacgacagccttgcttcagatactaatactttggctgcagtgggaaagagagcttgcttgactgcaaagacacccttcatttctttacctttccccctatcccccacccgctcggtttttgtttttctttaagctccaaaatctccctcagaaaaaacgcggtatgatacgtctcttggtctgctcaccaagaagttcattcagctcctgagccagtcacccgatggggtattggatttgaacaaggcagcagaagtgctaaaagtgcaaaagagaaggatttatgatatcaccaacgttctggaaggcatccacctcattaagaagaagtctaaaaacaacgtccaatggatgtgagtaggagtcctccccatgccccggctctgagggggtcgtttcaaactgcctggtttcttagttcctcactttcacatccacgcccacacgttcttttcttttctctcctactgttttcttctctctcattctctcttccctcctcagcttctaagccagaagtttgaagtctctttacaaagagactttgtttagatactgtcagagataaaaggatttatatttgatgagcatccagcaacggcatccttaaagaggtccctgcagttggaaagtggactgctgttcatctgttacatagatgtctgtgtgcacccacgtgtgtatctgacagatgtgtacacgtcttcagcttgtttctaataagaatctggaaatgatggcttatgggttatctatgtgtatacgtacaactgcatagttacagaatatctttatccatggttctaatagcagattaactcactttctgggtaaattaaggcaagacttaaatgcctccatttcgtctgtagagcagggatggtagcatgatacttatacagccacacgtatgattacatatgtaatatattttgtgaattttagagcatctaaatagccactataagcacagtattgaattattaaagcattttggaaggaataattctgttacaggagggctttgaaaaaatactaattcagatggaagatgaatacatacctttttttgcacattttggaattttgttgacagtttggtaacccattttggcctctggtttagagaaacatattgtgcactagtctcagttcttgcatacatcacatacatctgtttcctttactttcttttctttttagttgttgatataagaccctcagtaattacctgagtttttgatgcttttttggatgggttgtttttttgtttttttttttttttaattttgaaccattccatcttctctgtctttctctatctttttatcctttttcgcctttcttcccccaccacctgggagccatgaggcaagggaggaaggtggttgccttcttttgccctctgaatttgaaccttctgaagaagtagacctcccctggaggaaagaatcctgaaaatagcagtgcgctttcactaaatttctatgctgtgaaaagtgcagaactgtatttatgaaaaaaaaaatatatatatatatatatatatgtgtaaatgttctaattttaacacttggctaacaagcaatgtgacctcctatgtcaagaggagacatttacccaaaggatcatttctccttcccctccctcccatgagtagccatgaagagtctgtgtttgggtttctaggggctgcagtctgtctgaggatgggggcatgctggcccagtgtcaaggcctgtcaaaagaagtgaccgagctcagtcaggaagagaagaaattagatgaactgatccaaagctgcaccctggacctcaaactgttaaccgaggattcagagaatcaaagatatcctttgtgccgccagttctctgggggttagtgcttcctagactatttccagagttgacaatctgacttatgcacaaggtagattattattctgatgtcatgcaaatgagtacctgtgtgcctgtgtgtgtatgtgtgtgtgtgtgcacgtgtgtgtgtaaacccagttagctttgcctaaaaagtcagtatttatggtaagatagtcaccaactcgatcctattattatctattttgataccaggtgggaactgttttttaaagcattttttcatgtgtggttgagacatgggtatactcgtagcgtaaggccacactattaaaagatacataaggtgtcggtattaatattaatgacaacactaagcagattcgtctttggcttcccagatttttggtgggtgttagctgtcactgttggggttctcacattctattttcttctcaccagatatcgtagcaattgaaattggttgaatctatctgattgggctatagttgaagggtttgaaagagtagagaaaaatcatactataactcttaaagtgcattctgctgattcccaatgaaaaaactgatttcaaaagcaccccaagacctgagaaacccctctcaattcctctgttccactacaaacattagtcctcgcaaataaaaatacaaaaggtcagttcttgttctcaacttcctgacaatctattgacgatctcaggaaaacttgctcttcatcatctcactacagacaaagtaagagagagattgcctcattatgtcaaacaagacttgccaatattctcagttattagaagacaaaaaacagtactgtaagttatcccatctctagttttagttccaaacttctgatgattgcacatttaccattatttgacaaaaactaaaaagtgttctgcccagattcttctagtgtctcatctttaacaggctcccccttggagaatatggagatatttattttcttccaatgttggcagtttttcaaacctgcaattgttcatttcctgttgaccaaagaattaaccttgtcagccgataattagtgagatggaagagaggcgtagtgatttggacccccagtggttggcagagtgggtttacaggggaagaaaccaacagttgggctgtttcattcattgtttggttgggagccccattgtggaagagatgggtggttacatgtgattggcagccttccgggacatgtggcttatggcattgtcacctatattagctctctctggggcctttgttgcagaaaatgaaagcttccttgcagggaacttcgaacccaaggagtaaattcaggagggagccacaaaggaagcacttttaagtttgtaagattagaaaatacatttgcacaatttatttcagttcaccattcagttcccaaattggtacagcttgttcacaaatgtgttgaaattttccttcctgcagcatgttgagtaatcgtagatgagtttttcttttacacttgatcttagccaaaaggccaagaagtgatgagtttttattttaataagttcttgtcatacagctttttgacagtgagctgtagtgtaagtacctggttgtcagttttttccagtgttctcagtaaaaaatcagaactgcctggccctctataaaggcatccgttgacttctttgatgggttatgtagtgacctaaaacccagaatcctgcaagagcagccactacaagctcaacactgaattagccatcatctcaactgtaaagatttgaaggagatagtctgtgatagatcccctacatgtgtatgcagatttcgtgtgaatgtgctttctttctggagtagtagttccatagctgcattcagtttctaataagaagctactacagccaggcacggtggctcatgcctgtaatcccagctactcgggaggctgaggcaggagaatcacttgaacctgggagacagaggtggcagtgagctgaaatcgtgccactgcactccagccttagtgacagagtgggagtccgtctcaaaaaaaaaaaaaaaaagaagctactatcgtaagggacatgatttattctagggtctctaagcccccccttttttttatattaaacatattagatcacggactctattagccattaaatacgttatactacctgctgaaatgccttcattggtttgttacttgctgttttatcctaggaattttttgtgggtacatataaaaaataataacgggctaaagacattgtacattaattgaatacttttgtcatatcgtaagtaccatattctttcatgatagccttttaggcttggctgtcaggacatttaaaagaatggttcagtgcttagaaaaaatgaccaaggccgggcgccgtggctcacacctgtaatcccagcactttgggaggccggaggcaggcagatcacttgagtccaggagttcaagaccagcctgggcaacagggtaaaaccccatctctactaaaaataaaaaaaattagccgggtgtggtggtgcacgcctgtagtcccatctgtttgggaggctgaggcacgagaatcatttaaccccagagacggaggttgcagtgagctgagattgggccactgaactccagcctgggtgacagagcaagattctgtctcaaaaagaaaaaggaaataactaccaagagtactgagatattatacttttctcttttcctaaatcagtgtttctcaaattcattcaagtcgcagagcacctggaaactgctttcttcctcatgaacactgaaatattgatagagttaatatagtatcacgcaaagcataatttttctaacagaaataatgacactcttttctgtaggcagtacataatcacaaccagcccaggtgcacttaagaaaacaagctgtctgcctgagcagtattctgagttcctccactaatgtatttgttacttatttatttacttggtggctgctgacacttgcttgtagatagaagtaactggagtttcaaaaaaattatggctaatagagattacatttttttttcctgcaaattggaatctgccatcattcagtttgagtgacagaacactttattggagttcatggaatgcctgtgctgcaaaggaccctggcttcaagataaaatttctgaccacttagttttttattttcttatgatcatttattttaactgttctgtttctatgtttaatattttaaatagccatagtctttttagaaatgggcgggataaagctattcatttctttagttgtttagagtgtcaaccagaaatgaagattcatgggagaccctaaacatttgcacatccagaaggggagacatacacatacttttttgagaaggagtctcgctctgtcgcccaggctggagtgcagtggcgcgatctcgtctcactgcaagctccacctcccgggttcatgccattctccggcctcagcctcccgagtagctgggactacaggcgcccgccaccacgcctggctaactttttgtatttttagtagagacggggtttcaccgtgttagccaggttggtctccatctcctgacctcatgatccacccgcctcggcctcccaaagtgctgggattacaggtgtgagccaccgcgcccggccacatatgcatacttctaagtcataaaatactttaaaatattccatgcatctattttgtcattttcatcatacttatatctgaggtaattagatggaagattccttgacactctttacgttagcttatgttacatatcaagatattcgaaaaattagtggccttaaagaccaaactgttatagttgtgaaagcccctccagaaacaagacttgaagtgcctgactcaatagaggtaaggagacagcgtctttgttcatctgcaaagatctttgtggaatgcctgaaattgaatgactcattgactcatagttaaagtctgtccccctcctatgaacttgatggttctttcccatttattttacttaaccatacatttgaaaacatttcaatggtttgatgttcattgagtattcaaacaacctaactttgacctagcaggatgttcagttcaaagtggtatatgatgcgctgtccctctcatactttctctttttcataatttgtcatcaacggttttgatcaatttgaatcactttggaaagtttatattgattatcctgtatatggtccccaccacgaacagatatataaatgttttaaagtctctccctaacttataacattttgagagatcacatggggctttgggttagctgatagactagaatattgcaagaaagtagggggcatatttttgtaattttcagatatacttggataatagaggcctagactacaactataacataaagagttgtagtaaaaagaaaatgcataggagataaaaagagaatgaaagttacacgcttccatctagggtagacttcttaccttaaaagataataatagctctttgacctagatgaaaaagatttttaaatgttggtatgctgcattctcttaatagatgcagttcctagcacttaagaatactattcatcagtatacagttcaacatgaaaaagtcctaccataaaggaacaataacatggagatactgaatttggaacacttaaaggaccttgtaataatttgcagaaaaagaatatatccaaagaacacaattcacctcacccattgtgctattttcagaatgactcccctctcccccaagccccactaaaatagttttctttctctagggcaggactcagcaaactttttcattgaagtgccaggtagatagtaaatatttttggctttgcgagccgtacagcctgtgtctagactattcaactgtgcacctctgacattgtgatacgaaaacagccagaggcaataataaacaatgggaatggatgtgactctcttccaataaaactttatttacaaagccacttggtgaactggatttggcccttaggctgtggtttgctgacccctgctctagaggatgacagtctttcatagagttggactagtagggaaaaaacaagtgaaaaacgaacattgttcttactttccatttttagacaagaattactatggcttttatttctaaaagaacttctgattcgaacttctcccacttctgttcatagagcctacaaatacatttggcaagtacccaagggcccattgaggtttacttatgtccagaagagactgaaacacacagtccaatgaaaacaaacaaccaagaccacaatgggaatatccctaaacccgcttccaaaggtaaaaactccacttttgtcttttagaaactatgttaaaaatgagggtgactagaaccatctgtattggaaccacaagcctaggcaagaaacacaaacttctattggtattaggtaacatgttttaaaagacattctgactggtttgcagaagaaaataatgatttgggaaaaacggctccttcacccacttatggagtcgcttcaggcttttgctattggcagagaatgtttccttacagcatttttgaaaaccagctaaagtgaggagcaaagctgtgaactgtcttgttggatcatcagagacacttggccacacacctttgaatcacactgcagagctcatcagagagggaaatgaaaaaggtttgaggagaaaagcctttgttggagaatttttgtcttattttcccccccaatgagatggggagaggatatgggaggagaacgctaggaaagtaagtcttgccgggtgcggtggctcacacctgtaatcccagcactttgggaggccgaggcaggcagatcacgaggtcaggagatcgagactgtcctggccaacacagtgaaaccctgtctctactaaaaatacaaaaattagctgtgcgtggtggcacgtgcctgtaatccctgctactcgggaggctgaggcaggagaatcacttgaaccagggagtcggaggttgcagtgagccgagatccgccactgcactccagcctggtgacagagtgagactccatctcaaaaaaagaaaagaaaagaaaagaaatctaacttctccttcccgctctgcaaagagcaaaggaagctctttgcagtatatatttttccatttcctaacttgaggagatatatatgcaattgtttcccttagtgtctccctatatagcagcaagaataagggtgatttaagtgaataagtctgatttaatactgagcaaaagtacatcacctgaaatggtaaaacaaaaggccatctttcttcaccacagaaatccaaagtggatctgtcttattgtatgtatttttagagatctttttaataagctggttgttcaaaaaagactgagttaaaatcagtgaattctgcatgtagtcccagctatagggaggctggggtggcaggatcgcttgagcccaggagttcgaggttagagtgagctatgcttgcctgtgaatagccactacactccagcgtagacaacatagcaagacgccgtctcttaaaaaaaaaagttcttttttcagttggtgagtttctactaggaagccaacttttcagtatgtatatattgttttgttttgattttcttaaaacaatgactagatagcagagagaagtttttgaacttgttatcctctcatcattgaagttatttgcattcttgtttattgacagtagttatttgaaaaatgagtgagtagactagggccaaagaaagatggccaggcatggtggctcacacctgtaatttcagcactttgggaggccaaggaagacagatcacttgagcccaggagttcgagaccagactgggcaacatggcaaaaccctgtctctacaaaaaaagattaaccaggcatggtggctcacacctggagtcccagctacttgggaggctgaggtgggagggtcccttgaacccagaagttcaagactgcagtgagtcatgatcacaccactgcactccagccaagagaataagaccctgtctcaaaaattaaaagggggacgggggtggcaaggaacttttttgtacctgttagcataaaaggtgatctgcatcataaagtcgtctcattgtcattatttgcggaaggtacatgcttttttctaacagcaacatatacattcttccagaaaaattcatttgatttttctaacttattttttgtttccatcaatgttttcttttcagacttggcttcaaccaactcaggacatagcgattgctcagtttctatgggaaacctttctcctctggcctccccagccaacctcttacagcagactgaggaccaaattccttccaacctagaaggaccgtttgtgaacttactgcctcccctgctgcaagaggactatctcctgagcctcggggaggaggaaggcatcagcgatctcttcgatgcttacgatttggaaaagctcccactggtggaagacttcatgtgtagttgattatgcttcgtgtgaactctccttaaaaaccgatatttttttatcatggaaccagaacatctgtcatgcagtgttgtcccttcctaccttcttcctccaagagagtatcatgaagtaaactacaaacttcagaagaaagctgacattttaatgaattttttaaaaaattaataaacaaattgtctaaacgcacagttgcaggctcccttgggaaagccctgctttgctccaggctccaagatctcctggctaagtcagcaagtgagaaaatgtgcaatcaggtgtctctcaccccgaattgtccttcctccttcctccccggattggcttgctgtgcctgacggatgggctgtagaatggggtctggccacctggcctgctgggaaacagcaatcttccttaatagcatttcaagccgtgccttctccgcagaatgcatgtctttgaggtctgctaatatggaatggaactgcagcaaatgcaaacttgaagtcatgcaaaagtatgaaatggatttcttcagctcttcttaggaatatttaaattactgtcataattcagtttaagctatgaactgtgtgtcccagtaggaggtcaagaaaacctccacagccttctggatgaagaacctgttttcaaatatacttgttgcagatacagaagactagtagagttctgccactctaagctgttgtggattttcctgtctccatgaaccactcccattcccccgtccccaatgtgtttgtgagtttccagttgatttgtagcaaatgcctacttagttctttgtggattgttctagaacttttaatttttttagctgccatttaagcattcctgtggcacccatcaccatttcaatttaattgtttactttgaagcggtttttgcaaattcatattacttaagcagagggagagaacctctactgatcagagcatctaaacctgtgtgatctaaggtttatcagcctctgcaaggagctttgtcccatcgtgcttccattcccaggagggggagcttggagcgagtcagtcctggggcttgctgacatgggtggcccattggaaaggagaaccaggtcagatgatgtaacagccccaaggagcagcaggcatgggtccctccatccttgggcttcccgggcccctgtgacaggggaaagggctctcttacaccgcactcagggagaccacttctcaggatggggtcagatggagagacctctagggagaaagacatccccattgtgtgagtggcatttccttaagctggcaggaacagggagcagccctgtgtcgggggctggaatagttctggccagaccccgttccccttcctctatgaaggaataagttggaccaagggaagtcggggacgtaaaaaatgaagcaaaacaatgccagggtgtctcccgctttactcttcaggaatggtgtcccaagttggaggctttgtgtcagctgcaaatcctaccagttatgtccaagaatggctttccctcgggcaggtggcagcggccatctcccactgggaatatggcgtagtatctccggtccattccttggatgctaaggactgcgggaatgagggagtcagataaagaacaaacctcgaaacgaacagttaaattgaaatgctatgtgcctgacccaatggtaggcacatagtaggcactcaactcatatgtttaattgaattgaaaatatcccttaggaaaaaaaaaaaacacacaaaaaaccacaagagccccagccagtttactccaggtagatttccacaatatgcaaagtggtggtggggtcaagacagatgacaccagcactttaaactctttgtgtgggtatgcgtgggtgtatgtttgggaagaaaaacaaaggtgcagactatcttcctttttttcttcttcagcctccatccctggcctcctcccctcacacacactggacttggtacaaaatgtcggtgtggtcctagatgaagcattggggtgggggagggagagggagctttgtgttaagtgcctactggaaatgcactgtggggttt

SEQ ID NO: 15944 - DNA, 93532 bp, Human
gaaagtgttagaacactgtaaatacagtgacatcatgtgattcaaagtgcagtggtttaaaaaaagtcatcaaacaacaggttaaaattaatggatatttctatcaaactacaacagaggccaggcatggtggctcacgcctgtaatcccagcactttgggaggctgaggcgggtagatcacttgaggtcgggagttcgagaccagcctggccaacatggtgaaaccccgtctccactacaagtacaaaaattagctgggtgtgagcacatgcctgtagtcccagctacttgggaggctgaggcaggagaatcgcttgaacccgggaggcggaagttgtagtgagctgagaccacacaactgcactccagcctgggcgacaaaacaataataataataataataaaagtacaacagaacatctagttgtctgggtaactgagggagaaattaggccgaatgactctgttatttgttctggccagataatcttggccttaaattaaatcacctttggcctaccttcttcaaaacgaaataattttctcttcggcaaaacatttcttatttgaccaaatgattaccatcatatctttggaagcaaacaaaatatcagaatttacatcacacaatttacatatgcaaagcctgattttgccagctagggagggataagctaaacaaagggaagtggtgaaaacaaagtagtaatgttatgatgggtcagagagcaacacttggcaagttgtgccaaattagtcgacgaagcattctattgggaattgcaaagtaggaagtcctatttttgactctgctgatctcggtaaatatttccttgttttaaaaatgggcataattttctgttacctaagaaccctgttatgaaaattaacgagtctataaaatgttctgacgtctctagaagcccttcctaaacacacactataatcttgtattcatacagtgcctgctcctgctttttgaagatatgccggtctttattaatgacatcttctaccactgttaagttcactgtgagtcctcgtaaaattaattaatgaaacagtcactattctaagtgggagactgccttcagaagtggtttctactgcccatatggtcaatgctacggaattaaacactgaagtaccaaaggcaatgcgttcctctttggagggaggcggcaaacgggaacgggactgaggcgagagctagcagcactgcgcggggagcctgagccgctccgcacgccccgggccgacgggtcctagagcgccccggggcctgggctcgcggcggccccagcggggctcgattactctcgcctggacgagaagcggcgcctcggctccgaggagccctacggtggggaggtggggcgacgacaacaaaaagaagtcaagtgggaggggattcgccggcgaggggggcgacggcggccgccaagggagaggaggcggacacctccgaagggacctgcggcgccgggagcccagcgatcctgcccacgagcgactggcgggcccgggaggacgcctcgcggcgcacagccgggagccccgcggcccgccccctcgcaccgctcgcgcctctctcgcgcctccgtcccgccccctcgcctagcgccgcccgcgcgcagcgtctcgcgccggcccggcccgcccgccgggaaacagccgcgagagcagcggccgcggcggccgccagcgcgccttcccctcccgcgctcccgcgtcgcccccgccctcggcgcctcgtccccgggccgcgcgcccgcgctccggccaacgttctctcccggcctcccgggcccgccgcctactcccgcgtctccgagctcctcaaccgccgcggtctccctgggcgcgcggcccgccgcctgcttccggggcgggcggactgggcgcctggtgccggcggccgcagcgacagcgcccccgggaagcagaggaggaaggagagaagaggtggaggtggccgcaggctgagtcgcggccgggatgtccgggcagccgccgccgccgccgccgcagcagcagcaacagcagcagcagctgtcgccgccaccgccggcggccttggccccagtctccggagtcgtcctgccggcgcccccggccgtcagcgccggctcttctccggccggctcgcccggcggcggtgcgggcggcgaaggcttaggggccgcggcggccgccctgctcctccaccctccgccgccgccgcccccggccaccgcggccccgccgcccccgccgccgcccccgcctccccctgcctcagcggctgcccccgccagcgggccgcccgctcccccgggccttgcagcgggccccggcccggctggaggagccccgaccccagctctggtggcgggcagcagcgccgcggcccccttccctcacggggactcggccctgaacgagcaggagaaggagttgcagcggcggctgaagcgtctctacccggccgtggacgaacaagagacgccgctgcctcggtcctggagcccgaaggacaagttcagctacatcggcctctctcagaacaacctgcgggtgcactacaaaggtactgggcgtgtgtcctgcggtgggagtggggcactgacccgacgtggccggccgccgctgcgccgctctcgacccgcccccgacccccgccctcgcgggctctgccctcggaggccactcgccgcctgttgtgctgctccgggtgggcgcgggggtcgcggtgaagggtccgagggtgaggggcgagattcttggaaaaggaaggtgagtagaatgccccagggtagaaaggagctggtaatcctagaccaggagcaggacaccttgagggaatccgggatgacaggacagaactggctttctgatttccctgggagataaatcttggggcttgggtagaggaatccatggactcggagttgggttacattgttctccaggtggtgggtcaggcgttctcctcttacaaggggggaagagaggcacgattctgaggtatgatttctaattaagagagagcagggatacacagggggaggagtaatcaaaattaggccagagattgtctagggggacaaaaggacaaggggcccaagtttgccatcaatatattttagtaaaagcaaccgggagggtaagagaagggaaccccaggaacaccctttttcttaggggagcagaaacctacccctcccgattggaagtgccctatacaggtccttaggtgttgatatcacatgaagtcttgttgaaaacgaagatggaacaaaatgcagcttagtattttgaagaaaattggcttatgttttgcacttgcagttaaaaacaacaaccttaggcttgtgcttgcccctttcctccctcacctacctctcctaggttaaaacaaagctggaagcaaatcagttgtatataaaattatgaattgctatgggaactattgaaatgtagcccaatttaatagcatgtatcaagtttacttgtgtggaagaaaaaaaaatcaacctaacgtatcagtcttgtctggaaacaaatccagggttttaggccccaaacctaaagcagaagcttttacattcacggcagcctcactttgattggctgtaaaggggtctactcagatcctagtgacatgtatgtagaggagataaacaaccttgtggttaaattcttaacttatacgggactgaaatttgagaagaagcttgataagtaagttactatttaatcagaaaggcgaatggcaatagaaatctaccaaatgatttggctgcaaagaatcacgcacaaaaataggccttgttgaacattctttttattctcgccatacatccaaagaagtacttccaagtgttatcctccttaatctaaacgtctgaacgtttcattcacaatatcaaatctttgttttttctcaagttaggaccttttgttaatttccttgtgaagtatttctacttttatgttttaatttgtgtgaacggtgctatgttatgaggtgtttacttctgatctggctgccagaaagctattgttagatgtgacagaattttataattttaaatttatggttgacagtaaataatttgctcataaagtcagagccagtgtagatgaacaaagaattctagatttcctgagttctgcagttgtttgtggttgtagatattttacaagactgagcctcagtttcttcctctgagtggtgtgtaagttgagctggacgattggtaaggaaatttccagctctgaatttccgtgatgtctaagattcgtgattactgtttatttagtactgtaaggtgtcttgattagttttagtcttttacataaaattgatgattaggtcagagaaaaatacacgtttatatgaaattagttggagtttggaatatttctgacactgctgtctcagttgtttttattcttggcctctttattactttctgttgtgtaatactaaggttcactttctgggaacataactgttttataaacataaatcattatttctggaagaacagattttgttgttatccttttatttttcctctcttctatctttcctttgtctctctcttaccccttgtcagaaagtctttttccctttctactgcctcttcctcttgtcttgttactgtagactgtgtgtgtgtgtgtgtgtgtgtgtgtgtgagttttccgttgttactgttgattttctgcgtgttttgtgagaggaccacgccgattgtggtgggcaactgtgtcccagtagcagtagcagtagcaaaggagaagtatcatagagagtagataatactttaaaatcacagaataagaagagtgaatttttatttaacctatcattgtgctgcattggttttacctaagtatcatgagacacttttaacagtaaaaactactattcatatattcacgtattacagaatttcaaaagaatgattttaattattttccagagtgacgagaattttccttatctttgaaatagaagtattttgctttcttttgctccaaaggtattctggttttttgttgttgttctggtgtttttgtgtatgtgtgtgtgataggatttcaactttgttgccttgatggagtgcagtggtgcgatcatggctcactgcagtctagacctcctaggctcaagggatccccctgcctccatctcccaagtagctgggaccacaggctcctgtcactatgctgggctaagttgtaatttttttttttgtggagatggggtcttactgtgttgcctaggctagtgttgaatgtttgggctccagtgatcctcccaccttggcatcccaaagtactggaattacaagcctgagccactgtgtccagcctgtattctgtttttaagatgttcttctaaattgaaattactgcttttggaagcagtattgttcctgaaatgatttgaagagattaatgttagataatactagacatgcagataaggttgattggattgcagaggaacaacagggtatgtatagtatatgtgaaatttttttaaaggccttttgcttagcagtcacacaacaactattgaaaaacccagggatggcccctcttatttttgaaattgttgtcagtattgaataagtacaaatgtgacaagtttagacttagttataatgataacgggaaaataattttaataaatatgacaatggacttagtttaaatgtttcaacaacagattgcatttttatatttttctagttattaccactatttggatattttatagagtgctttatatatacacacactagtggatctggacaagatcctggaattttcattttaaattttagagagtggtagaacctggaggttagatcttcccagtcatgagtaaatcaggattgaaaattttcactaactccagatttagtgttcttttcacaatcccatagtattgcctctttaagttcatatgagacttaattatctcaagtagataaaatcctgtgatcacatttagaacttttaaagaatagttgagattgaaaatacttactctgggggaaaaaggtaactggaacacagtgcttcagaaaagtccagacaccttgattttactaatttagaacagtttagaagaaatccaaggtaagtcaaagttgggaattataggaagcaatgaaatagtcaatttcagtgggtgtggtggcttacgcctgtaatcccagcactttgggaggccaaagtagaaggatcgcttgagcccaagagttctagaccagcctgggcaacatagtgggaccccgtctctacccctaaaaattaaccgggctaagtggcacacacttgaaatcccagccacttaggaggctgagggaggaggattggttgagcccaggaggttgaggcttcagtgagctatgatggcctgggtgacagagtgagaccctatcttaaaaaaaaaataagtaaataaatagtgaattgcattttttttttttttttttgagacagagtcttgctctatcgtccaggctggagtgcggtggtacaatctctactcattgcagcctctcctgggttcatgcagttcttctgcctcagcctcctgagtagctgagtagctgggattacaggcgcttagcaccacgtccggctaattcttgtatttctagtagagacggggtttcaccatgttggccaggctggtcttgaactcctgacctcagatgatctgcccgcctcggcctcccaaaatgccgggattacaggcatgagccactgcgcctggcctgaattgtcctttttttttttttttaagatggagtctcgctctgctgttgtcaggctggagtacagtggcgccatcttggctcactgcaacctccgcctcccgggttcaagcaattcttctgcctcagcctcctgaatagctgagaatacaggcatgcgccaccacgcctggctaatttttgtatttttagtagaggggaggtttcaacatgttggccaggatggtctcgatctcttgacctcgtgatctgcccgcctcgccctcccaaagtgctgggattacaggcgtgagccacagtgcccagccagaatttcactttttaattgaaatgttatgaacaataaccaaataggttgaacttttttgttgttttttgagaccgagtcttgctctgttgcccaggctggagtgcagtggcgccatctcggctcactgcaagctccgcctcccgcgttcacgccattttcctgcctcagccttccaagtagctgggactacaggtgcccgccgcgacgcccggctaattttttgtatttttagtagagatagggtttcaccgtgttagccaaggtggtctcttatctgctgacctagtgatccactcgcctcggcctcccaaagtgctgggattacaggagtgataggttgaacttttgttatacttactctgtctttcccacctgtacccccagtcattagcgcttgaacacttcctaaatataattgcttatctaatttcttgcactttttaagtttgaacagatatttcagcatgcttgcttacaagtgcaaatgtctgttaagcattacgggggtgatataaaaatgtttcttttttttttttttttttgagacggagtcttgctctgtcgcccaggcccaggctgcagggcagtggcgcgatctccgctcactgcaagctccgcctcctgggttcagaccattctcctgcttcagcctccccagtagctgggactacatgcgcctgccaccacgcctggctaatttcttttgtatttttaatagagagggggtttcaccgagttagtcaggatggtcttgatctcctgaccttgtgatctgcgcgcctcgtcctcccaaagtgctgggattacaggcgtgagccaccgcgcccggcctaaaaatgttccttaaaatgaaggaattgaagaattacttgccaagattttgggaaattaggtttaaaaatgccagttggtaactgcaagaatcaagtaaatctaataatcatgcagaacagtagacaataataatgtatattctttttttttttttttttttttttttttttgagacagaatcttgctctgtcgcccaggccgaagtgcagtggtggcactttgtcagctcactgcaacctccatctcctggattcaagtgactttccagcctcagcctcccaagtagccgggattacaagcgcctgccaccacgcctggctaatttttgtatatttagtagcgatggggttttgccatgttggccaggctggtctggaactcctgacctcaagtgatccgcctgccttggcttctcaaagtgctgggattataggcgtgaaccactgcacccagcctaatgatatatattctgctagactagacaatttatatgtgtttttcactgttcatttcttcatttatttaatgagcttttagtgaatgtttactttgtgctaggttctggacactcagaggtggagaagatactgtcattgaattcagagagctcagaggacataaaatagagtagtaagggaaatattatagagagtactgtggaaaataggaggagcgtataacccaggctgacattggaaagaatgaaggaagtgtaggtatcagggatagcttcttggaggagtcgaggctagtggtcagtcttaaaagatgagtaggatataggagaaagggaggggctaggtgttgcaaatgaaggaaaagcaaaaacatagagaattactttatgtgtctggttttacaagcaattttgggttggcatttagagtatgtgacaaggagcatctgggaaaagatcaattaggaggcttttttttttttctcttttgaggcagggtctgactccattgtccaggctagaatgcagtggtgcgatctaggctcactgcaacctctgcctcctgggctcaagtgatcctcccacctcagcatcctgaatagctgcaactacaggcacgtgccaccattcccagctaattttttgtatttttttgtagagaagggggttttgccatgttgcccaggctggtctcgaattcctgagctcaagccatctgcctgccttagcctcccaaagtgctaggattacaggcaggagccactgtacctggcccagttaggagccctatggaatattttgttgagtttagatcttattctgtaggagatggagaatcatcaaaggattttaaatgggaagtgactggctcatatcttcatttttgtcagattacgcagctgattggaagatagattcaagaggttacaagagtgggaatagtaaattcatttagaagactattgcagtagaccatgttagaattgacctcagctgggtcagtggtaaggacagagaaaggcagatatatttgtgagatatttaaaagtaatactgagaggatatgaggaatgatagtgagagaaatcaaagaaaatgtttgggtttccaactctgttaggatgatgtttgggtctttagctgttaggctcttgcagtgaaccatgaataaaataatgattgtgaaggagactgtattacagtatagttggagataagtaaaaatgggaatctcagccctgtgatctgacttcatggaaaccagaagaagccaaagaaacaagccttacagaaagaacaggaacaggtcttttggagttaaggggactctaactggtcttaatagtcatgacttaattctattctattaaaatgactcagctccaatcactagtttctggttgttttatttctttttccctactgactggcttatcctttccttcctatgtcaaattcctgagagacttaacagattggcctggctaattgctatgattcttagttgggcagagcttttcaatacagactatgttgtgaattggtggccttcaagtcaggtgctaacctgtgttgaatcagctgtaggaatggtggtaattataaaatacaaaataccctgctggtacaaggatagtctgggtctcacttctttcggtaggggcaatgtgtgaggcagtttctcctaggaagggttggcagttaaccataattgatctgaagcttgggagagaggtctaggtcgtgactgatttaggagtcacttgtaggtggtagttgaaactcagagtatttgaaagagagagggagaatagagtgagaaaaagcagtgggccaaagatggggaccctgaagaacaccaacattgaaagactagagggagcacaaaagaaatggtaggtccccagacatcaaggagattggtgtcacagaagctgagcacgggagggtgcagtggctcacacctgtaatcccaaaacttggggaagtcgaggtgggaggactgcttgaacccaggaagttgaggctgtagccagcggtgatcatgccactgcattttagcctgggcaacagaatgagacactgtctcaaacagcctccccaccttccctagaaatgaggaagtgatatttagtgtctgttgcaacagataggtttagtaggataggcacagatagttttccactacgtttggaaattagatcattgtgactttagggagagcagtttgaattgagtgatggggcaaaaaccagatttcagtgggttgaaagagtaaatgaaaggaccaagtagagaggatagtgaatagagattatccttgagaaatatagatgaaggaagagatgaggcatttcctagaggaggatggaggttaaggtaggattttttttttcttctaatttttaacggctgatagtggagttacgttttacctggtgtttagcttctaatgtcagcatagaagatgaaaatcctacataaccaaaattatccttaaaaattcctttggaaagtattgtgttagagaccactgtgtcatttcttagtcaatcttgttttaatttggttgtataggtaaaactgaagcgacataaattaaatgaaaatactatattatattagtccaaggtatggtgttccaggaaatgtatacaaaatttaacattttaacaaataaaattgattagcctacctggttattattactattttttcttgaacagagtctcgctttgtcaggccggatcccaggtttaagcaattctcctccctcagcctcccgaatagctgagattacacacacccgccaccatgcctggctaagttttatgtttttagtagagatgggatttcaccatgttggccaggctggtctcgaactcctgacctcaagtgatccacccaccttggcctcccaaagtgctgggattacaggcatgagccactgcgcccagccttgttattacttttaaggtaaaaaattatataccaccaactctggtacattactgacaatgatttatatgtagcacggaggcatagaatttgtgaaaagtgtacattttggggacattgtccctttacagattgaggggaaggagagattagagaggaagataatgaaatacaagcttgagaggctgacagagaggcttctagagaggaaactggttccagagtccagaatggttggtcttggagaggagagtacagactgttctttgataatagtggaagaggtgaagactgccgtggacatagatcactttgtaataaaagagtggagagttgaatatgaccatagctaatggcctctcgttttttgtttttttggttttttttttttgagatggagccttgctcttgtcgcccaggctggagtgcagtggtacaacgtcgggtcactgcaatctctgcctccagggttcaagccattcttccgcctcagcctcccaagtagctgggaatacagttgcgcaccaccatgcctggccactttttgtatttttagtggagatggggttttatgttggccaggctggtctcgaactccagacctcaggcaatccgcctgccttggcctcccaaagtgctgggattacaggtgtgagccaccgcacccagctggcctcctgttttcttgataagaggtgaggtactttgctcatgaatttgagtagaggatgtaaagtttaaagtaaatgatgaaaatgtggactaagccattgagagggatagggaataagctgacaacatttctaaaaatattgttggtagcattgagagtgctcagttgacatcattagttcatagcagtggctgttcataagattttggactttattcattggaagtcaactgtccagtgtgggagtatggaaggtagattatgatactgagagtgtcattttgctggttggatatgatagaatgatgggcatatgagggaaatcaaggatatttgagagctttaagtgattaccatgtagcctgtcctggaagaggaaaaagggagaaaaaacacaaagagtttgaggaattagagttcccatgatgttgaagtatagacgtgaaggctttagaaaggggatagaacaggatggtgtgttctggaggaagataccggtgtttctgcaataatgtcctgaatgcgtggctggaaaaccatgttttccacaaaatcaatgcgctaaaagtaacaggacttatgcaaactataaagctggagcaaccccttaaaaccttgggaactttgtaggcattaatcagaacactacaaaaattacagtcctagtaaaataaaagcccagttaaattttcactgtgcccgatattacaggtggcttggtctgttgcagctttagactctgggtcttgagcttttgcttcttcaagaaggaatgattgaagttagagtggaagttagcgggaataaagaggttcaggaattaaaacgcagggaaaaaataattaaacgtgagtgttaagtgtgtaaatgtgcaggagagatacatgttgctatgagggcttgtaaaaaggagcttcaaccaagttggagagattagagaaagaatatttgaggaagtaaagcttgagctaagatttaaagtgtgagtaggacctacctactcaggctaagaaggaaaggtggagggaatagcatgtttacagactggcctgatcaatgtgaagaattgaaatagtgctgatgcggctggagcagaaaggaggtggaaagtgcaggtggagagcaagaccagacaaggtgctcaggaagcgtgtctttttcctaggccaaagaggaggctttggaaggaatcttagttgtattgagggctactgatagaaggacggctgatttatatttccagaaaggcactggctggctgcatgttggcgactggaagggagtgggaatagggtagaatggtttattcaaactctttccatcagattgtttgaataaaaagagctaaacttgctagccttagaattaggaagtattacatatgttttcttctaaagccacatagaaaacacttaatactgaagactttgtagttttaaaagtttaaactttggtagtatgaggttgttttttggttaccacagaatttgaggtaataataaactttcaggtgatgagcattgttagaaataggccctttgctgctgatattacaagtttgagcatcccaaatctgaaattcaaaatgctttcagaattcaaaacttgattttttatttttttatttttgggacagagtctcactctattgctcaggctggagtgtagtggcgctgtcaggcccttgcaacttctgcctcccaagttcaagcgattcttgtgcctcagcctcctgagtagctgggattacaggcgcacactaccatgccaggctaatttttgtatttttagtacagacagggtttcaccatgttggccaagctggtcttgaactcctgacctcaagtgatcgcccgcctcagcctcccaaagtgctggaattacaggcatgagccaccacgcccggctcaaaggaaatgcccaatgaaacattttagattttggatttttggatttaggatgctcaactggtaagtatgcacaaatattgtaaaatctgaaaaaaatctaaaacacttctggtcccaagcatgtcagataagggatactcaacttggactggtctcatttaagaaataatatgaaaccttataatcttgcatttaaacttttccttataccttttacatctaatttaaattttaatttaaacatgaaacaaatctttttagttttaatatttacagaatttatctgcaattagtgaatcctaacaaatataatggatccttgaagatttataactggtactttatagtaatttttgcataatggaaaaatgtatgggattttaattcatgcatggatctaatatatgtttctaccaatttggggctgggtatataatgtgtaaacattttatttttttttctgtaggcccatgacagattacagatttcttcatttcaaaaagtgaggttaaataatacctatttcgtaaatgttgaaagagaaaaatccatacaaaagcacccaactctttgagagactgtttactttcaaatattggtttctttctcttttcccgtagaagtagtcagaataggacatggggatatgtgaagtgatccccgaatgttcattgtaactaaatccttcatgtgggttcagagctcacactagatcaggtttcttgaatttaaatcccagcacaaatcctggtttggaattcgcttttagcagtatgactttgggcgagtttcattatcttcccttggattcctcaactgtgaaatgataatagatagtacctacctcatggggttgttttggatattaaatgagttaataaacttaatgctcttagagcagtgcctttcacacggtattaaatatatgtaactattatttgttattaagaatactttgggattactttatcactaaaagtttgggtcactccccttaaaaaatcagtggatttagaactgcagttagattttgtttagatagttttctatagatttatttgtaacaatctaatttttaaatatgtagtttccatggccttttctcaggtaacttaattatttgaacatattttgactgaaaaatgtgttttactgccaccataattaaattttattaaaaagtgactagtgcacagacttgtgcaattgtttcttttctgctgcttagctcagtgtaaatctattacctgcatcatatgttgaagtagttttgatgcatgtaaatactgttgcttccatttttgtcttgcctagccaagcttgttgactccttatggtcaccaggctaaaagaacttctgcccataacccaagttttcatggtaatggaaggagtggcagaattcattccatttttttgtggggggagtggggggtgtgaacatgtactaatttgcattgcaagtgtaaacttaagtgtttaatagtaataaggcatgtgttggaaatttgataaatttggtcaagtgtgtggtaagggaggatatgatctcattcatgtgtgatgattgtatatcttaagatacaatttttgacttacaagaaggtatttagttttaaaacaatcataaatttaaggagaattctgctacccatgaagataattttatagtatgactgaaagattaatgcgaagtttgtattgcgtggagcatatttaactagaacaccccaataatgatttagagtattgtttctcatgcagtccttttggggatatggagacttgtctcactcatactctatgagtactttctgacatgctacttcaacttctttctttattcttccatggttttgtggacatattttctcttaatattgtctacatgctagctttcaaggtaatttgtgtcttgggcgagaggtaggggaagtgattgtgagtttagcaaaccctgtgggattagaattgaggaatagctggtttaaaaagtttgaaagccattatctaaaagattttctaaagtgtcagcagtggcatggtgttacttctgttgtttaaaaagaaaaaaatacgtttagaaattagatgtatttctcaataagctattattggcccaagagattttatgaatcagctttaattaataagactataccaaagaacaaaactgtaaattcttaagaaagctgttttgccaattcaatctaattgtgtaagatttcacttagaaatatacaatacagatgcttctggtttaaagagccaggactttggcaagagtgtacagaaattatataagttatatgcaaatttagacctgataaaattgagatctttctctcatgttcttcatacagcctttttcctcttaaaaatatagtgtactctataatgtcttttatttaatttgcataaaaggctgctaggttcaatttccatatttggattctgcaatcttaataaaactagtaatagtgtgaagagttctgtggttaacttgggctattttgcatattgggttcatggtgatgataaacgttttattgagtatttgaactgataggagcagaaataatacatcattccaaaaacctatatgttcctgaattgtttaaggttttcatctttcagtgaatatctcatgtgacttcttttttccttcctgtttctatgcaggtcatggcaaaaccccaaaagatgccgcgtcagttcgagccacgcatccaataccagcagcctgtgggatttattattttgaagtaaaaattgtcagtaagggaagagatgggtaagtaaattttggtgagaaaaatcgtttgctagtttttttgttttggttcataatgtttatgatgtaattggaaagttggaatcctggaaattttgctaattggaaaagtggaatctgaatatttcagtataacagattggatctggttatgcttaaatactagctgaagttaaagcttgagttggtgatattaactaagcttttctggtaggtttattattaaaatggagaatttggaattaaggaatgaagggatggtgactcattttccatgacttttcttacactgctttttcgtgaattctgctaagaagttaaatcctctcaaactagtaatcatagtcagttggtgattcataggtattttacagatgttggacttagaattttaggtttcagctgggaaatgtgtatttgtatgctctcaactagaggagattttcaaggtttaggatgtggtttagaaatttccaaatgagaattccatggtagggcctggaaccaaattttatatcattgcttttcagcttgggattggtgtgtggtttgtatgggtatcagaattcacttatgagactattaaaaatatagtaatttttgggccttaccccaaaagttcctaaattaggattttcagaagtagagctttgggcaagataggcattttgagaaagctccacactgaattttggtgcctatccctggttaagcactaattacctagaatcattggatctatcctatagtatttcctgataactttattgcatatcagaggtctcttaaagcagtcatagggtctttagttgagttaccaagacaaagcttattgagctgtgtggataagttgccctgtgaggtcagtcagatggacctcaaatcaaacccctcttagtggtcctcctgtgtttaattaaccaaataagtgtattcagtagattactcctttatcggctgaatattctcgatgtcaacagtatgagcaacagaaaataaaaacttggaattcagtgacagctttttatgtaactgcctcagttttcttagggtaatcaagccaaagagaaaatcagagatgccaaggatagagtggttgagagaggcccatattgaaataggcacacgattgtcaccatttctcactttacaagctgtataatcagtaagctgattctttttatacttcaaattatatgaacttgacctcatatttggctgcaaataccctgatgattctcaaatctaatgctacatcttagcttattccctcgagctccagacaatgtgtctaaccaaatgtttgcatttgaatgtcccacaggcatttaaatttagcttgtttaaaatctttttctgaaaaaaaaaaaaaaaaaaaaaaaacatttggttggtggtttcactattgctagaaacttgagaatttcctgcttttaacttttctgttcatctctactgcctctccctttgtcagatctcaattatttatctgctgaattactctcagatagttggttgatgggtctccagttgctgcctgttttgctcttattctagtctataactgttgtcagggttcttagtaataaaaaactgagttgcctctacccgttttttgagatatctgttgcttcaaggataaaatgtagagcttcttaacaggacccctcagatctgactagctcttgggtcatttttcagtctctttgtagccaggataccttaccctttttcttttgtttttaaaattaggtatattttacacatagtaaactttattctttttagtgtactgttctgtgagttttgacaaacatgtatagtcatataaccagcatcgcagttgatatgggagactccccttatctgtgggggatacattgcaagaccctttgtggatgcttgaaactgcagatagtactgaactctatatatactatgttttttttcagtctgataattgagagggctactcagtgactaaagggcatgtggtaaatacagcgttgatatgctagacaaaggaatgattcccaggtggggacagggcgggactgaatccaatggcatgagattttatcatgttattcagaatggcatgcagtttaaaacttacaaattgcttatttctggaattttccaattaatatttttggacctcagttgactgtgggtaactgaaacactgaggaaagcaaaaccacagataaatgcggactgctttatatagaacagctctatcatcccccaaaattctgccatactcttttgtagacaacccttccccatatctagctcctggtaactgttgactggttttctgtctctatagtttgtccatttcaagaatggcatataaatggaatcatatagtttgtagccttttaagtctggtatctttcacttagcataacacattcgagattcctccctgttgtatatattcatagaacagtccttttaaatctaattttgtagataagtgaaccaaagtttgcttacccactccccagttgaagaacttctcagtttccagttttttggctggaactgtaaacatgtatatacaggtttttgtgtaaacataagttttcttttcacgagtaagtatctaggagtgggattgctggattgtagttaagtgtatttttaactttgtaagaaactgccaaattgtttcacaaagtggctatactagtttgcattttgttctttttgtttgtttgtttttgtttttttcctgagccagagtctcgctctgtcacccaggctggagtacagtggtgcagtcttggctcactgcaacctctgcctcccgggttcaagcaattctcctgcctcagcctcccaagtagctgggattacaggcgcccaccaccacacctggctaatttttgtatttttagtagagacagggtttcacaatgttggccaggctggtctcgagcgcctgacctcaaatgatccgcctgcctcagcctcccaaagtgctgggattgcaggcatgtgccacaacacccggcctctagcttttacatatatacgtttttcatatatacatttttttctcctgagccagacagtaagttccttacagacatacttcttgtgtttcatgtgcttgttgagtgacagaaaccagccatgctgtggagggatatgatatctgctgccacccccggctaatcttttgtatttttagtagagtcggggtttcaccatgttgcccaggctggtgttgaactcctgagctcaggtgatctgtccgcctcggcctccaaaagttctgggattgcaggtgtgagccactgtgcctggcccactggtttgcatttctaccagcagtgtatgagagttcctgttgatcttagcactaggtattgtcatttttttttaaatttttagccattataataggtttctagtgatttcttgctgtggttttaatttatatttccctaatgactaattatgttgaagaatccctaattctcacctgctcttcacctataaggtaccatttggagttctctgactacgcatgctggcttatatttctagttccttatgcatgcccttccttcaccttctcttatccctttctctatttgcctagctaattaattggtcttcaagtcctagtttaggagtacctttcttatggcattttctccttaaagtaggaatatgccttttctatgcctcctttacattttggccagactgtaattatgatatttgtattgtttcaattgtctgcttactgccaacatgaccctacagatttaagagtaagggactattttaatttctataactccagtacttaacttatagctggcttttaaaggtatgaataaatgaatggattagaagaagtactatttcttgtatgttcttggagaaaactatttttttgtttgttttgttttgagacagagtcttgctctgttgcccaggctggagtgcagtggcacgatcttggctcactgtaacttccacctcctgggttcaagcaattctgcctgtctcagccttccaagtagctgggattacagacatgtaccaccacacctggctaatttttgtatttttggtagagatggggtttcaccctgttgcccaggctggtgtcaaactcctgacctcaggtgatccgcctgcctctgccacccaaagtgctgggattacaggtgtgagccactgtgccctgcctttttgttttttgtgttttttttttttttttttttttttttttgagacggagtttcgctcttgttgcccaggctggagtgcgatggtgtgatttcagctcactgtaacctctgcctcccaggttcaagtgattctcctgcctcagccttccgagtagctggattacaggcatgcgccaccacggccagcttattttgtgcttttagtgtgttttgccatgttggccaagctggtttcgaacccctgacctcaggtgatccacccgcctcggcctcccaaagtgctgggattataggtgtgagccaccgcgcctggccaaactattgtacttctttggtcacattcatttatctctctggtaaacgtgtcgaacaaagttctaggcccagcccattgtttttggaagcaaagaacaattcatttatgaaaaaaaagcaactcatattgctaattttggccaactaatgtttttctggagaaaagattatttcctaaaaatctcaacatctttgtaaagtatggaccagaaagagtagctgttaggaaccttttgtttgcagtgatgtgtgcccatctgagagtttattctgcttaatttaaaactgaattttcgctgggcacagtggctctagcctttagcactttgagaggctgatgccggtggatcatgaggtcaggagttcaagaccagccttggccaacatagtgaaaccccgtctctactaaaaatacaaaaaattagccaggcgtggtggcaggcacctgtaatcccagctacttggggggctggggcaggagaatcgcttgaacacaggaggcagaggttgcagtgagccgacatcacgccactgcactccgtcccaggtgactgtgcgagactcagtctcaaaaacaaacaaacatacaaacaaacaaaaaaaaaacactgagttttcttttaaacagtgtttatcccagatctcagtttttaaaataaattgtccttggcaacaaattttctcatgaaatggcaagagttggatgtgaattgcctctttcaatagggtagaaagaactggtgttaatgtattatgtgcttgtaaagacttttaattcctatggtgtacgttatttctaggtttaccctggaaaattaggaatatgactgtcatgattgttacttgtatttctttattgcctagaaaatgagacctgaagaaagttccttttattgagtgaaagaatatatttcattttctgccatgagttttcatttaaactgaacctaagttttgtatatgtgcagctaaataaatttattaggactaaatagtctttaaatattattaatttaaaaataaaatctaatgcatttcacaagaaaaattaaatcactttatctacatgactttttttttttttttttttgagacggagtctctgtcacccaggttggagttcagtggcacaatcttggctcactgcaacctctgtctcctgggttcaaggaattctcttgtcttagtctgtcctagtagctgggattacaggtatgccccaccgcacccagctaatttttgtattttcaggagagatggggtttcaccatgttggccaggccggtcttgaactcctgacctcaaaatgatccacccacctcggcctcccaaagtgttgggattacagacgtgagccaccatgcctggccctgcataacttctttagggcatatatttaacgggtgtgtgtttactttcccttctttttagtgatcattgaccgttgagatgaatttctttaaggagtctgtatcttaggtactttcagttcagggatttcattcaaattttaaattatgcatattaatagaggcagtggacatacagttaattctaaatgtgagagagaacaaaatttttatttgaaagtttttagaattataatttattatgaatggtatttttagctcttcaaacaaaatattgatgccactctttgacagtgtttcagtaagaactggcaagtaattcagtctctctgttctgttcctaaattcttctgctgataataaagtgcactctttcagaatgttccttttatgcttgctgactttctagtttatttcttggcgggggaggagaacaaaggtctttcttcctgtctagctttgaaaactagaaggatctttccttctaggtttgattcgttgtaagcagcaaatggaagcacagggtaaatgtgaacaaagagtaaacaatacatttattataagtaagcaatatatttatttaacaaatatatgttgaacacctatgatatagcacatcgtcagcagctgagtggggataagaaattattttattgatttgtcttattcatagttcttactagaggacctgacatttagtagaaactcaattaatacagtgagtgaactgaatgtggtccctgcccttgaggaagatcaaatttagtgtagtcatatgtcacttaactacggaacatgttctaagacatgagtcattgggcgatgtttttttatgaacatcgtaaagggtacttatgtaaacctagatggtatagcctactacatacctgggctgtacctactacatacctggtctgtccaacagaggactacatacatagtcctttgttgaccaaactgttggtatatggtgtttggaagatatggtgggacaaggcaggaagcagaaatatgcaactcttaagacataatatactaagtacttagaaatgagaccatgtatgggaaaactgaggagagagtaattaattttggctcaaggaaatatttatacaggaagtagtagttggtagaccttacaaaatgagtaagaatttgagaggcctttttggggaagaacattccagactatggtaaatggccagaatagtctcacaggaagagtgcaactttgtggtctttggcagagatacatggttcagtattgttggggacttggattataaggaagagttataaaagtaagaacaggctgagtgtggtggctcatgcctgtaatcccaacacttagagagcccgaagcgggtggatcacctgagataaagagttcgagactagcctgaccaacatatagtgaaaccccatctctactaaaaagtacaaaaattagctgggtgtggtggcacatgcctgtagtcacatctacttggggagccaaggcagaagaatcgcttgaacccaggatacaaaggttgcagtgagccgagatcacaccactgcactccagcctagcgacagagtgagacttcatctctcaaaaaaaaaaaaaaggaaaaaaagtgagaatggaatcagatgttatagagccttgatgatagttctagggtgaaatatactctataggtagaagggagctttcagttttttgttttgttttgtttttgtttgcagcagagtcttgctctgtcacccaggctgtagtacagtggcacaatcaaggctctctgtagccttgacctcccttacttaagtgatcctcctgcttcagcttagcctcccaggtagctgggactatgggtgtgcgtcaccatgcccagcattttttttttttttttttttttgtggagatgggtctcggtatgttgcacaggctggtcttgaactcctggcctcaagctatcctcctgcctccctaagtgttgggattacaggcatgagtcactgcacccagactgccttcaatctttttgagtagggaagatatatgatacctgctttagaaagataatacaaagtggggagaggatgaagtgtgtgatggcggtctgcaagactgctacagagtttacgggctagggctaggagttaggttgtgaggcggttgcctgaggatagagtgtgatagagatttaaaaaaaaaaataacaggaggaaaataacagacgaggagatttagtttgtcgagtacctgttatgtgccagatactgtgctaagaacctaggattgacagagatggagacagggctgtaaacatggctgagaaagggtacctactttccagaagtttgcaggtaagaagggaaatgaacatgtaagtaactaataaaatccagtatgagatacacagtagtagacatataaacaaattagagaagtatgttggaggaggtaaccaacactgttggaagacagggtggtgatcagggaagtctatctaggaagcttacataaaattacagaagaggaatacagttaaacataagcttctctgtccttcagttgctcaggtatccttcacaagataggatatgaacagagatgttaaagattagtagctgttttagaagctgactagttacttttgttgagaaatatagtggagatgtaaatcttggctctgctacttaactggttctgtggttttgtattttttgacagactctctcagtctgtgaaaaggaaataatagtgccaacctcataagactaaattacataactcacttaaagcacttattagagtacctggtgtgaagcaaactcaaggtagcttgatgctgctctgaaaaaagatgcctggtgcacagcaaactcgtgtcttcttgctgctgctgttgctgctggctgctgccactgctgctgctggaggaagctcagcataaagttttgtgggaggaatgtgtctggagatgatcatgaagggacttctaatgctaatgggtgttaccttttatctttcaggtgctagttttaagcaagggaattatatggttggatttgctttttaggtgggttatctgagggtaatatggaaaatagatctgagactgacttctagagatcagttgggttattgtaataataaattgagggtttaatctgtgtggtggggttgtagaggaaagtagacagatttgttaactaattaggacttaattttttacatgaaatctgtctttatttccttgattaggaagtaggagtagtaagcacgtaaaggtagttgttgagagaatgttaagaatgactccctagcttttgtcttagaagattaaatggatagtgatgtgactaaatacatcagaaaataccagaagaggatttttttttttttaagagatagggcctcactttgttgcccaggctggagtgcagttgtgtgatcatagctcactgcagcctcaaattcctgggctcaagggatcctcctgcctcagcctcccaaagtactgggattacagttgtgagccatcacacctggccaggaagtggatctttaaagaagatgatgatgagaacagtgtttgagctgctaggggaatcccagaaaattaatagcaaaggctttgactaaaaataaatgggatttaggagagtagggctgaaggtagattttggagtggtcagaaggttaagttgttaaagccatgggaattgataggatcacccaagtatgtaatgtaacaaaaacaaagagggcctagggtggacacctgaaacaccatatttaaaggacatatagaaggagggaattcgtctgagattcttttcatgtacttatgaattttttaaaacaatttcttcttgttacataatcatctaagattctataaaagaatggtcagagaattagaaggcagatcctaggtgttttcagaagccaaggaagtcagttcaaaggaggactgctaagtctccactggtttgtcatttggggggttaattagtccttgtgatagcagtttccttaaaattggggtgatagcaggtgcagtgtgtcaaagagaggtaaggaatggagataatgtgccagtggacttagtagctgtgttgctgttgtgagaaacaataattcacaacccatttagaaaagtaatacactgccaatttgataattcaaggccaggcgtggtggctcatgcctgtaatcccagcacttttggcagctgaggtgggaggattgcctgagcccagtagttcgagaccagcttgggcaacaaagcgagaccctgtttattaggctgggcatggtggctcatgcctgtaatcccggcactttgggaggctgaggtgggtggatcacctgaggtcaggagttcgagaccagcctggccaacatggtaaaaccctgtctctacccaaaatacaaaaaaatagctgggcgtggtggcgcattcctgtacccagttacttgggaggctgaggcaggagaatcccttgaacctgggaggcagaggctgtagtgagccaagatcgcgccgctgcactccagcttgggcaacagagccagactccatctcaaagtataatataaataaataaaaataataaaattagccgggtgtagtggcatgcacctgtggtcccagctatatgagaggctgagccaggaagatcgcttgagcccaggaggtcaaggctgcagtgaactgtgtttctgtcactacactccagcctaggctacagagtgagactctatttcggggggcgggggggggggggggaagaaattttggaaattcaggaaagaaaaaaaagtacagaaaaaatgtaagggagaaaactaaaccatgatttttgtataattaattgctatcaatacttctgctcgtttctttcggattttatatatacacttatattttaagcttagttatactcttttttttttttttgagacagagtctcgctctgttgccaggctggagtgcagtggtgcaatttcggcttactgcaatctctgcttcccaggttcaagcaattctcccacctcagcctccctcccattagctgggactacaggcgcacaccaccacgcccagctactttttgtattttcagtagagacagggtttcaccatgttggccaggatggtctcgatctcttgacctcgtgatcctcccacctaggcctcccaaagtgttgggattacaggtgtgagccaccgcgcccggcctggtatcctctttatacaggtttttacatcctgtgtttatcattgatttatttagtatttttggggagacagggtatttctctgttgcccaggctgtagtgcagtggcgcattcatagctcactgtaaccatagctcactgtaaactgttgggttcaagtgatcctcctgcctcagccactcgagtagctaggactacagagatgtatcctatgcctggcttatttttgaatttttttgtagaggattattattgatttatttctatgtagcagttatagtatgtttcttacataattataagcattcttctatgagattaaaagctctgaatatctttttatttttggctgtggcatagtctaagtttattaaggcacatccatagctgttctcctgttgccagttatttagattgttttaattctttcactattctaaatactcttttttgcatgaaatttgtctttatttccgtaggaaagatttcttgaagtggaattatggatcacaagaaggggtatgcacatttttaaggcttatgatgcacatggccaaattactctccggaaaaattattgcaatttatgtttgggtgggagagaccttgttgtatgtatatgctgaggagaaggaatcactagtgagtccaggagaaggctgaggaggcgaatgaggcaagtttctttgcccagtaggtgggatatggggttttaagtataaattaggaaggtgggatgctgtgcggaatttatttattggcacttatcactacttctggaagcctgtcttgacagccttttcacctccaaacaagatgaggctcctctgttaacaccctttcacagcatcttgtacttccccttcatagcatttaatcaccttcataattatttatttaagatctgtcctacccgttagagtatccctttagggagggcacagacttttgtctttgccacagctttatctgtgtcatcctacacatagatatttagtaaatgttcattgatcagagaagtgaaggtattgaggaactgtgagatttaaaaccacaaatttgtgacagcggtttacatacttacaattttttactatatacccagctggttagagaggaaagttgaattgtatgattgatgcaaaatgggaaactataggttaggtaagttggaagaacaattgtagtaattgaggttacgggtgagggaatatctaaatggaccattttagttcaggctgggtagggaaaaaatgaaatcagcacggagctgatatactcagacaaaatgagagatttatatattgctgtttttagtgagttttaaggagatgcagagggatttctgaggtggatttgctgcatttggctaagtgtagggcataacaatgaaagacaagagaagaaaatctttatcagagaggcttttttggtctgttttgtttactgctatatccatgttgtgtagaacaatgccagacacaaaataggtgctgcataaatatgttaactaagtagaggtgggtagggataataacatcttttcttttgtaatcccctagcacttgctgtgcatagtacagagtatagatagtcaatatttatggaatgaacagaatgtgagtcttggattttggatatgttctaaaaaccattaagaatggtaggagccacatttttggtggagagaaaaattggttatttaagaaggtatgaaatatgggaaaagtgacctaaagatatataaccatcatgtttctcaaattattcttgaagtggttatctttagtgcagtttaaatcccaaatcacccttacctcttactctgtcagttattttatacttaacaagtataggtgttttttttttcccaagaaatttttttttccaattacaaggtaatgcattcttaatgcaaaagggaaaatcaaataaacaaatcctgtgaaatagaaaaaaaataacatatttttaaaagcatatacaatcctaccacctggattaatggcagttgacattttggagtatattctctccagctttttttctctattaaaactgctttcaacattagtctaagaaagaaaaataggtttaagatgtatttgagtcacatgagagattaaaaaaaattattctcatgggtaccagttcttatactttcactttaatataaatttaattgaaaattcaggaagaaaatttcattttaatgtcttaaagacacccatgtcatataactttaagattgtatatagttttgtcctgatgaatatattacttgaaatcatatttcagtttttcagaaccaggaaaacagtttataaccattctatttatgtttatctcagatatattgaattcttgctctttgcctattgctggaatcacttaggttgattaacattccaagataaggagaaatgatctgttggtcctagacctttttggctttgtggatgatttagtagtatggatagttttttggaggagtggttgaaatgttttaaaatggttgatgagaagtaattgttgtcagatggaaaaacagactggttaagagttgagattcatcccagtgattctttgtgatttgtatagtacagaatctaaggagttttcctccccaacatttacaaacatacagaagacagagttaatacagtgaatacccttgtacacaccacctagattttagaattaagattttgctatatttactttattatagatctgtacatccacaccccatctttttaaaatgcatttcaaagtgagttcatgagttgcagagtttccaaatcagttttaaagtctctcattttatacttcttttttcttattctgagaatctttgattctagtgatatttacatatttatttgctttagcctagaatatcttgatacattgccaaattaaaatatcagtaatttgggaggcagaggtaggtgggtcacctgaggtcaggagttttgagaccagcctggccaacatggcgaaaccctgtctctactagtaacaaaaattagctgggcctggtggtgggcgcctgtaatcccagtgactcgggaggctgaggctggagaatcgcttgaacccaggaggcggaggttgcatggagccaagatcgtgccattgcactgcaggctgggcaacaagagcaaaactccatcaattaaaaaaaaaaattatgtattaagaacattgaatactgtatgtttttttgcagtcttttttttttttttttttaattttgcttcagtctttagaatatatcccattagggatggatattcaaaatactgtgttttaaagtcacttgaagtaattcttttttctgtatttctgccaccaacttgatatatactagtttcacttacttaaaattatcttccattcttagggactgatttttaaatttttgttttaattatataaaacatttacattgtttcaaagtaagactgttgaagaaggcacttggcccaggtgcggtggctcacgcctgtaatcccagcactttaagaggccgaggtgggaggaacacctgaggtcaggagttcgagaccagcctggccaatgtggcgaaaccccatctctactaaaaatacaaaaattaaccaggtgtggtggcacgtgcctgtaatcccagctactactcaggaggctgaggcaggagaatcgcttgagcctgggaggtggaggttgcagtgagccaagattgcttcactgcactctggcctgggtgacagcacgactctctctcaaaaaaaaaaggaaagaaggcacttcacagaaggttcacgtcatcctttttttcttcccccttcaggtaaccattttcattagttcttgatttattcttttgttatttccttttgaaaatggaagcaaatatgccatcgaaaactttgaagaggtatcacaaatagctgatgacactagttggctgtaagtagaggaagtggttaaatggggatgggagtgaaaggaaacttgaaacatttttgttgcttttgaatttttttattttatctattttgtttgctcttttttttttgagaggtttagtatatttttacattgagagaggtacatttatactaatacctatagtcccctccttttaaggtactcttgtattgtgagcaataatgaaattagctagtaacctcttcagcaccttttcttccctttccccagtgtctgtgggttttttgcacttaaaatgtattattgattaatgtgcagtaaaatacatttttttcagtgtatagttgtgagttttgacaaatagaattacataacaaccacaactaaaattacataacaaccacgccaaactctctcttgttgcccctttatctcaaaccctcctcccacccccaactcctcacaaccactgatctgtcttctgtccctatagttttgccttttgaagccagaatgttatataaatgtaaccttttgaaaatggctattttgtaatcacttagcatgatgcatgtgatactcatccaggtagttgagtgtatcagtaggtcattgctttttctgtaaattctcttttttgttaattgttttatatctatattttatgagcatataacatttgcatacactatactgttatctttattctgatcacttagtgttaattttaaattatattcaatactcatcatcagaccttatcccaaagatacttcgaggattttttggttatctgaagctcacattctacaagtgagctcatgggaacaatattcttttaagtccttttggttcaaactatttgcttgtgaccattatactcattatatttgaagctttgattgtatgtaaaatccctggctcatgttttctttctttcttttttttttttttccgagacagactctcacttagttgcccaggttggagggctgtggcacaatcatggctcactgcagcctcaacctcctggggccaagcgatcctcccgcctcagcctcctgagtagctgggagtacaggtgcgcaccactatgctcagctaactttattttttatttttatttttatttttgttgggacagggtcccattgtgttgctcaggcttgtcttgaactcctgggctcaagtgatgatcttcccacctcagcttcccaaagtgctgggattacacgcatgaaccactgtacccagccatgtttttttatgagctccatggacattttcaaagtcttcagacatttttttcttacaagaaatttggtcatttgcctgttacctgaaagatttttctttttctttaaagaaccattacttgactatgtcttggtgttgatcttggtatggtcttaagagtaggttcaagtgttttatttcagaaaagttttttcgtatgatggttttcagtatttgttctgttccattacatgggtttgttttttagggactctaattatgaatgtatgttgggtcttctttgactaacttcttctattattttgtttttttgaagagttttttggtaaaaactggaaaacctgccagagaaattctaaaggatctgtaacacttgactaacttcgttattttaaaaatttcctccattctctttcctcttttcttgtggggtcttttactttgtgttccaattagcttgtctttatttctgaaataattttcctttttttccttgtaattcttaagtaaataagaacactattttttgaccgatttatattaaaaattggagacttcctgtgaacaagtcttgaacatccagtgtaatttttaagttatagcacttgtgaagagaaatattattgaaaaacaaaacagtaaaacgcatctcagtctccatagttttataggtacatctcatttggtacaagtagaacctgtaatgtttatagaattgaaatgtaaatcagtttcttctgaacttatttgtgtgatttaaagttgctactttttatttattaatcttatagggatatgttgaaaaacaagattttaaatatggattaaaatataaataattttattaaccaaaaatgtcagtttattggaaacataaacaattttgtgtctgttgggtgaaaagtagaatatgttgttttatgcatatgatagattattttccttaacatttaacagtttaacaagttattttgtgttttgttgttgttgtagtagttaactacagatggaattattcgacaaagaatcgtcagaggaactctcaaactaataggcttttcttgtttttagagccttattgtcttaattattaaaaggcaggataaatgaataggtactttgaaggccatcttagtaaatatagccaggccttaattttaggtattgtatatttatatttttatagctcttcgagaggtaatgggagaaagatgcagctgaagaaagatgcagcttggtgtatattattgtgaactttccgaaggcaagaaagaatttctgtttttcatgattctttatgctttgggaagaatgtggtagagaaggtgcagtgtagagagagataagtagctgctttactgtcagcatagaattagaattggaacaaattttttttttaatcacagcagaatgttctaggtttgaaaaaaggatttctgttttctgttactttagttttaagtttcttacctcagttccattggtgcagataatcatctggtgattaatatttcactttgcaatattttgagcatgcatatacttaaatttattttgtatattaatagtggctattctaagaatgtaggtgttggatacggtgtggtaaagtctgggtagctgcagggggatatgagaataaggcttagaaggaagaattttattatactcacaggtctcagggagggtcactgcatgctacacaggggaagcaccaggttttagtcaggaagcagaagacaggagccacggaaaagtccaggccagagtattgggatttcctgggaaaggcaagggagggcagagtaaacagttgaggattgaagagtttggatgattcctccaggctttgagctgtagaggtggtctctaattgcctggtacctgactctggaatgatttagggcaggaaatactggcttcgtatgtgagcgttagataaggaggtggatttggctgtagactcaggattggttggtttgtatatggaagacatgctcctgtgagccctcttatctctaagaaagcactagccctggccagcaagcttttaaaaagccaaaacataataaaatatagtaaataagaaacatgttttaaatgcagtggccagctgaagttctgtttaccttgtcaaataatttctgtgttaataatctttgagaaccatagctttctcaacaattgctttccttttggttctttattattttttataagttctcatttcttttagatagtgattgccttttctaaacactgaaatacgtctcaagtatgtaacctgattgaaatattttcacaggagcatctgtaattgttttttgtttgttttttgagataagatctcactctgttgcccaggctggagtacagtgacgtgatcactgttcactgcagccttgaactcctggacttagtgatcctcccacctcagcttcttgagtagctggcactgcaggcacataccactatgcctggctaattttttatattttatgtagagacggggttttgccttgttgcccagaccagtttcaaactgttgggttcaagtgatccacccacctcagcctcctaaagtgctgggattataggcttgagccaccacacctggcctgcagttgttgctggaatgtttttggtttgattttataacactactatgtgaatcaccagttggtatatatcacttttaatattatttcacttatgatggttgaaagatgttaaagtttgttcttttacatgagaaaaaaatgggtatatgttcataagcttaaatgtttaagattggtaacttgtgaattatagacaagtgccctgagtttcttaatataaatagatatacgtatactagtgtatcttgctgtagtaactaacttttggtgctcttaagtcttattatattcataatgccatttggcagaaataaaacattttatttcaaaggtattaagtaatttttaggtcttgtaagataaaaaaaagatccctcttactgtgtcagtaacttatatacatgaataaactattcagaattcgaaattttaaaatttgagtcttcctgtccatgaacataggctatttttctatttatttagcttttctttgagtatttcagcagttttatagtttttatggtatcaattttgtcaatatttgttagatttatgcctaattatttcctttttgttggtgctaatataagtggtattgtgtgtttaaaattccagttcattgctggtgcgtaggaaattgacttctgcatattaaccttgtatcctgccaccttgctatgattgcttattttttccaagaggtttttttctgtcaattctttgatgttgtctgcataaacaatcttttcagctacaaaagtaggtttattttttctttctcaatctatataccttttatttccttttcttgtctcattgcattagctaggacttcccctatgatgttgaataagagccgtaaaaggaaatacctctgcctttttcctggtcttaaagagaaagtgtctagttttagccattaagtatgatactaattgtaggttttttgtagatgttctttattaagttgaggaagctccccctctattcctagtttactgagagtttttatcaagaatggtgttggattttgtcagatgcgttttctgcatctattggtctgatcacgtgatttttcttctttagtttcttgatgtgattgattacattgttttttttgaatgttgagccagccttgcatacctgggataaatcccacttagtcttggtgtatagttctttttttaaaattttaatttaatttatttattttaatatccagacttcaaggaggtatagttcttgtataccttgttggatttgatttgctaatactttattgaggatatttgcatctgtgttcataagagatatttgtctgcagttttcccttcttgtaatgtctttatttggttttggcattagggtaatgctagactcagaatgacttagaaagtgtaccctctgagtgtattttctggaaaagattggagacagttgtgttatttcttccttacatgtttggttggaattaccctgaagccatctgggcccagtgtttgttttttttggaaggttattaattgttactattatttttttctgagtatatgtttttatttagcttttacaaacaataaccacaataaaaaaaaataatgaatgcagataacttttgaacacaatatatcgtacacccttattggatatattctgaggacaaacattatgcaacaaatattcttgaattttatttaatagatttattatgggtgtgctttctactcttgggtatcattgcttctaggctctttcaatggatggagtttattttgacactacaattcgatctagttaccagagttcttcctcttctttctcatttctgtaaaggttattaattattgatttaattttttaatctatagaggcatattcagattttcattttctccttgtgtgttttgataaattatatctttcagggaattgccttgaaatccatttcatctaaataatcaaatttgtgggcataaagttagttataaatgtttctttaatacttttttaatgtctgggatcagtattgatattattactgataataatagtttcttatgtctttgattttggtattaataatttgtgttttttttttgttggttatcctggctagaggtttatcaattttactgatcttttcaaagaactggcttttaattttgttgatttttattttattttattttattttttaaaatttcattgctatctctatttctcatttcttcttctttctctaggtttgtatttattgctccagtttcctaaggcggaaagttaaatcattgatttttagatcaccattacattcagtgctataaatttctctgtaggcactgctttcactgcatcccacaaattttgataagttgttttcatttagttgaaaatagttttaaatttctctttagacttctttgatgtgttattttaaaatgtgttgtttaatctccagatatttggggattttccagctatctttcttttgttgatttctagtttaattctattaaagtctgagagcatagtttgtatgactttagttaaggcatgtctttcttatgtcccagaatgtgttctgttttggtgaatgtttttgtgagcttaagaagaatatgtattatgcggttattggataaagtatactataaatgtcaatgaaatccagttgatggatgatacttttcagtttgactatatgtttactggttttctgcctgctgtgtctgccagttgttgatataggggtgttgatgtcttcagttatagctgtggagttaactgctgcttctcgtagctctatcagtttttgtctcacatcttttgacactttgttgttaggctcagacacattaagtgtggctgactgccacagttactacttgagactgtcactgagacagttattactgttactacttgagaccatcattatgagactgaatcaagggggacagacatagaaatgaaaacttaagacaaaggtaactactttaaagtaagggtaacatggggaaggagaagagaagaagaaaagggctccctgcttttagtgagcaaaggcagctgcctaagactctacagcccttagtatgtattgggtagaaagagcagcaggaggaggtaatgattggtcagctgctggattgatcacaggttcacattattgctaacaggtttcagttatgcctaatcagaagaaacacttgtgcctgggtggtggctgccctcagcattccttctgggcaacagacacagtttgtcagtttgccgacatcctgcttttatgagaaacagtttgctgtttgcacatatagcctccagtactatactgagttgatcacgacccttgacaattaaggattgttatatcttgtttgataattgatccttgatcattatgtactattcctgtttttctccgataattttccttgttctgaattctgctttgttagaaattaatataactagtccagctgccttttgatcagtgttggcattgtatgtatttctccatccctttaacctatctgtgtctttatatttagagtgagtttcttgtagacaacatatatttgggtctttttgttcactcttgtcagttctgtcttttaattggtatatttagatgattcacattgaaagtattgttaaagttgggttttagtgtctaccatatttgtttcttactcattatacttgttccttgttgcttattttaaaatgtactttttttttttttttgagacaaggtctccctctgtcacccaggctggagtgcagtggcgggatctcagctcactgcagccttgacttcctggactcaagtgattctcccacttcaggttcccaagtggctagaactacaagggcacaccaccacacctggctaattttttgtattctttatagagatgggattttgccatgtaggccaggctggtcttgaactcctgggctcaagtgatcctcctgcctcggccttctgaagggattacaggcatgagctacgtgcctagcccattgtctgattttaattgagcattgtatattattccatttttcttttctgtataaaatactaattgtacttctttaaaaaagattttttggtagtttcccttagagctcatctaagttcatttttaaataccatttacactgcttcacacatagtgcaggtaccttataacagaatataaccaactcctccctcctgtcccttatagcattgctgttattcatttcacttatccatagtcagcagttacccaagatattgttactattttgaatacttatctatgtgatcaattaagattaagaaaaataaaagagtgtatcttcatttattccttcttggactctccctttcttcataaggattctattttctcacctatatcattttccttttctctgaagaacgtgtaacatttcttgcaaggcaagtttgtgggccacaagttccctctatttttgtttgtctgagaaagtctttatttttctttcacttctgagggataatttctctggatgctaaatcctagcttggtggggttttttcccaacacttaaatatttcactccactctcttcttgcttacatgatttctgaagagaaatctgatataattcttgcccttcttttatatagagtgagtgttttgttttgttttttcctgatttctttcaagacctactctttgtctttgacctaggtttgaagatgaggtgttgatgttttgatgtttatcctgtttagtgttttctgagctttctggatttggggtttgggggatctgtcattaattttggaaaatcatcaaccatcattacttcaaatacttcattttctttgtttcttctccttctagcattactattatgaatatttttcaccttttatagttgtcctccattctcaaataccatgttccagttttttttcaagctcactgattgttgttttttttagtctgctgattgctcgtcaaaggcattctttatttgtgttaatgctttttatttctagcattttgttttgattctttcttatagcccttagcattttaatgagttatttaaaatgtccagtttgatcattcaaaatctaccttatctgagtttggtttcgatgcttgctttgtctcttcagaccttttccttgcctgttacatgccttgcaattttttgttgaaatctggacatggcttattgagtagtagaaactcaggtaaacaggtgtttaatgtgagattttaggtttatctggctgggagttaggctgtgtttaatgttcactaggtatttatattgtttgtaggtataagacatttcattttcctctactttcctggtttttgtcttgttttgagtttccttagaaacttttattaattaaaaaaagtctatttcttgtaattttctcagttgtaatctgttatattggagccctgtttagtagagaggagaagtgttctataatcatatgatgaaatctgttgggttttttagtggaccagagttcctgaacggaccttcaaaagaatttcttaagcttttttcttccctcctctcaggcaggttagagggggctggaattattgctcttactctaggtcagatttcaaaatggttacttttcccttttccctactcaaaatggagggattttactctaataaaaaccaggtggagctccttttctcacctatattcttccttaagactgagccctcacaagttaaagctcaagttagttcactctcagtctccagcagtttgctacttacttttaaagtgttccttccagttattggctttagagtaaatatagctccatatgtctatattcacatgtttcttcagtttttctggaggtgttgtgacctgtgaactcagttttccagtgcttctaagagtagttgattttcagttgttctgctttttttcttgtgaggatgggagtgatgatttccaagctgtttacgtaatagagtggaacaaagttgtcatctttatttttttaatgagagttgtattgagatgtataattcatgtacatattcaccctttaaaaatgcacaatttggtaatttttactatattcacagagttatgcaacccttactatttaatttttaaacatttttgtcacctgaaaaaggaaccccaaaacactcactcctcccagttccaggcagcaactaactattttgtttttatggatttacttattctggacatttcatataaatggaattatacaaaatgtgacctctcgtttctgacttctttatcttaacatgttttaaaggttaatgttttaaaggttgatttatgctgtatcatatatcaatactccattcctttttgttgccaaattaatattccattgtattaatatatcacattttgtttatccattggttggtggaaacactttttgactgttaagaatattgctgttatgaagaattgtgtaacatagtatggctatgtgttttcatttttattgcagaaaatgggagtgtaatttctgggtcatagataccctatgattaactttttgaggagctgccagacggttttccaaagtggctgtaccattttacttactaccagctatgatagttgcagtttctccacattcttgtcaacacatatcttcttgattctagccatcctagtgtatgtaaaatgagagctcatagtgtcttttgatttgcatctctaattactaatgattaacatagttttacttgcttattggacatttatacatctttgaagaaatgtctattcagatcctttgcccattgttttagtagggttttccttttattgagctgtaagagttctttatatatactgtaaaaagttaccctatcagatatatgatttgcatatattgtctgccattctgtgaattgtcttttagtttccttgacagtatcctttaaatcacaaaaattttaaattttatggagtctagtttgtctacttttttttttttttttttttctaagatggaattttgctctgtctcccaggctggagtgcagtggtatgatcttggctaactgcaagctccacctcccgggttcacaccattctcctgcctcagcctcccaagtagctgggactacaggcgcccaccaccacgcccgtctaattttgtttttgtatttttggtagagacggggtttcaccgtgttagccaggatggtctcgatctcctgacctcgtgatctgcctgcctcagcctcccaaagtgctgggattacaggcatgagccaccacacctggcctagtttgtctattttttcttgtgtttcttctgcttctgatgtcatatctaagagaccattgtcttaagccactatcagaaagacttacatctgtgttttcatctaagagtttcatagttttagctcttcagttagctctctaatccattttgtgttaatttttatatatggtgtgagatagggatccagctacattctttttgaaaatatttttttatttttgagacagaatcttaatctgtcacccaggccagagtgcagtggcacaatctgagttcactgcaacctccgcctcccaggctcaagcaattctaatgcctcagcctcccgagaagctgggactacaggcatgtgccactgcacctggctaatttttgtatttttagtacagatgggcttttgctatgtcggctaggctggtcttgaactcctgacttgaagtgatccacccaccaccttggcctttcaaagcgcggggattatagacttgagccactgtgcccgacctcagctgcattcatttgcatttgtatgttttcccagtaccatttgttgaaaaaaaaaaaaccagttctttccccactggattgttttttcctgcttgtcaaaaatcaattcatctaccagatgctgtggctcacacctgtaatcccaacactttgggaggccaaggtggacagtattgcttgagcccaggagtttgagactagcctgggcaacatggagaaaccctgtctgtacaaaaaatgcgaaaaaaagttagccaggcatggtggcatgcaactgtagtcccagctactcgggggctgaggtgtgaggatcacctaatcgggagaaaaaaggctgcagtaagctgtggtcatgccactgcactgcagcctggttaaagtgagaccttacttgtcgcaaaacaacaacaataacaaaattaattgatcgtgaatacaagagtttctgaaatctcaattctatggcattgatctctatgtctgtttttaagccagcaacacattctcttggttactgtagctttttattgagttttaaaattggaatgtgtgagtcttccaacttttttgttctttttcaagattattttggctctactgggcccttgcatttgtgtatgatttcaggatcagtttgtcaatttctgcagcaaagcaagttaggattttgatagggtttgtgttgaatctctagattaatttggggagtattgctattttaacagcatttagtcttcaaatccatgaatatggcatggggagtctttccatttacttagcagttctttcattttttcaacaatgtcgtttttagtgttcagatttcacacttcttttgttatatttattcctaagtattctttttttttattctgttccaaatgaaagtattttcttaaattcattttcaaattatttctagtgtgtagaaatacaactgatttttgcatattaatcttgtatcttgtagtcttgttgaacttgattacttttaataattttgggggaggagattctttaggattttctatatacaaaattgtgccatctgtcaatagaggatgcttatttcttgctttctgatctgatggcttttatgtctttttcttgccctcttgcccagggtagaagtttcagtactatgttgaatagaagtggtgagagaagacatccttttttttgtccctaatcttaaggtcaaagtattcagtcttttaccactaagtatgctgttagctggggatttttcatagatgttctttatcagtgtgaggaagtttccttctgtttcaagcttgctgagtcatgatttttcatgattttttttaaatcgtgaaagggtgatgagttttgtgaaattctttttctatgcctgttgagatgattatatggattttgttctttattttcttaatatattacattgattgatttttgtttgttaaacgaacttcatgtttttgggatataaatcccatttggtcatgatttataatcttttttatgtgttgctggatttgatttcctagtaatttgttgaggatttttgcatttgtattaatgaaggatattttttctgtagtttttttgtgatgcctttatctagttttggtaacaagatagtactggctttgtagaatgagttaggaagtatttctagcttttttggaagagtctgggaaagattaatgttaatttttatgtttggtagatttccccagtgaagccatctgagcacgggcttgtctttgtgttttaaaattactatgcagtttcagtagtttgtgtctttctaggaatttgtccatttaaaggaggttatgtaattcattgttcatagtatttaataattgttttcttatgatcctttttagtttagtagtaatactcttgtaattcctgatgtttagtaatttgagtcttcttttatttttcttgcttagtagaacctacttttgaatttgttgattctattgtttttctagtctctcctcttatttctcccctaatctttataattccttttctgctacctgctttgggtttagttcattcttaatggtagaaattggattactaattagagatctttcttttttatttaattttaatttttgacaacagtaacaaaaaatgtgttgcgtaagaatggggatacgttctgaagaatgtgtggttaggtgattttgtcattgtaggaatatcatagaatgtacttacacaaacctaaatggtatagaccataccacatggcttattaaacacctaggccatgttgtgtggtctattgctctgctcctaggctacaaaactgaatagcttgttattgtgttacaatagggaattgtaacacaatggttttgtgtatctaaatacatcacataggaaagatacagtaaaaatgtgtggtataaaagatttaaaatggcacacttgtatagaacagctccattataatcttataggactattgttgtacatgcggtctgttgttgaccgaaacatttgttatgtggaacatcactgtaaataggtttttaaaagtgtttcttgcattgccagcatgtgatacatatactaacttaatcaagaatgtaatagatcaaagatgcattaaaatcttaataaggtagtcattaatatactgccaaaaggtatagcagaaaactaataatggccataaaacaaaaataagaattaaaaagaacacagaaaaagatggagagaacagatggacagatagcaagatagtaggcttaagcctatcaataataggaattaaactagaatgctgttagtctccattgtatgttaggcacaaacattacttacataactgttaataaatgcataatttgtgatgatctacgttgacatattgatctgaaaaatcttcatgttcattgctcttggtaaacacatagtaccacaataataaatttcttgttcacataaattttgcctgtccctcactgttggattgagtttgtttttatatgtcagatagcctttatatatctaccagctattcagtttactgtgtgtcatgagccacacccagccacaactggtattacaaatttccctttgtcagataaccctcctttcatcacttcacagtaactcacaagtggtaactcttatgacacccatttcccaggcataaacttaggtgtttttcaaggtaaaatactcactttcttgtagtatttattccataacaattttttgttgttgttgttgttttgagacaaggcctctgtcacccagactggagtgcagtagtaccatcatgtcttactgcagcctcgacctctcaggctcaagtgatcctcccgagtagctgggactacaggcaatgcaccaccctgccaatctttttttttttttttttttttttttttggagagacggggtcccaggctggtcttgaactcctggactcaagcgcttctctcaccatggcctcccagttttgttttcctttgggattacaggcatgagccactgtgcctggcctattccttaataatttaattggtgtaaaattgtttttattgggttcttatcttttcaaaaatgtgttactgacatttttgcatgctgtgcttccaatcccatttccttcgtaaaccttgtagcttttattgcatgattttgtataatgtggtttttttgaaactcgtatgtcatgatatagcggacctgactataattattttataaggtatctctttattcctcttttcatcagttgatccgtcttagtctttgatacatttcagtgtaggtatacttccctcctaatcactacagcatgtatatatcattaactagagtttgatgtcagcttacttctctttttgtgtgtgtgtgtgtggtacagtttacatttggtgaaatgcacacatcttaagtgtactctttgataagttttgcagatgtgtatgcccatgaaatacaaacctctatcaaagtatagaacatcatcattctcagaaatgttccctcatgctccttcctagttaggcccttgagccaccctttcagaggcagccactgttttgacttgtttactaccttagattgatttttcttgttgcaaaatttcatataaaaggaattatatgacatatgctcttcttgtatgtaaagcttccttgagtcagcatgacattttgagattgatccatttgtgtttatcagtaattgtatttttgtttttgttgctgagtagaatataccacaatttgtatatctgttcgcttgttgatggatagccaggctgtttcaagtttttcactgttgtgaagaaatctgccatgaacctatttgtacaaatttttttggtagacacatcttcatttttcttatgagtggtattgctgggtcgtagggtaggcaggtgttcagtcctatgagcaactgccagcctttgtttcagaggttttattgttttaaattcccaccaaaaacatatgaaagttcctgttgtgccatatgcttggcaacactgatcttgttggttttataaattttaattattctggcaggtatgcagttgtatctcagtgtggttttaatttgcattttcctgatgactgacaatttggagcactttttcatgtactccttggctgtttgcagtatcttattttgtgaaatatctattcagaccttttgttcatttttgaaaattggatcatctatgtcttttgttaagttttaaattttgctaaagttttatttatgagtttactcttttatgggtcttcctttttgtgtcctaataaatctttgctttatcctcaagtcattaagatagttttacatgttttcttatagaacctttatagtttttaacatttatatttaggactgtgattcatcttcatttgatttttgtgtattgtgtgagatagagattaaggcttacttttttccacatggatgtcagttatctttttactatttgttcaaaagactttccatcctcttttggactgtctaggcacttttgtaaaatattaaatgactataaatgtgggtctctttgttagactccttaatctgttgcattgatctatttgttgatccttaagccagtaccatactgtttagattactcagcccatgctatgttttgaagtcagattgtgtaacttctacagctttccaagcttttttgggatgttttagatccttcacatttccatatacattttacttatttaatttaaattttttatagctgcataataggtgtccatgttttgggggtacagtgataatacattcatataattgtaaagatcaaatcagtgtattgggggtatctgttaccttaaatatttgtctttatgctggaaacatttgaattactctcttctagctattttgaaatgtgcaatagaatattgtgaactatagtcatcttactgatctaacactaggtcttatttcttctattaagctgtgtatgtacattcattaatcagcttctatatacactttagaatcagcttttcagattaaaaaaaaagaaaagcctattgtggttatgctttggattgtgttgactctgtgatcagtttgaagagaattgcagttgaggtgcccaattcgtagacatgatatgttttgccatttatttacgtcttttaagatttcccaaagtgatgtttggtaatttttagtagagagggctgcatggcttttgttcgatgttttatgttttctgatgctgttgtagatagaattggttttttaaattttgtttttctagtatttgctgccaaatacagtggactttgtatattaactttgtatcctgcaaccttcctaaattcacttattgcagttattttgtagattccttaggattttctttataaacagtcatatcatctgtacatagagccagctttatttctttttgatttttatgcattttatttctcttttttgccttgttgaaatggctaggatttgtagtatggtgttgaatacgagtggtgagcactggccttcttgcttttttgttggtccttggagaatagtgttcagtatttcactattaagcatgtaagttgtagagtttttgtaggtacaggttgaggaagttcccttgttagtttgccaagtgtatttattttgaatggtgttaaattgtatcaggtgttttcactgcagctatttcatgataggaattttcccctagtatagaaaaatacattgattggttttgaatgttaaaccaatcttttgttcttgggttaaacactatctagtaatcatatgttatcgttttgatacattattagaatttctttttatttactgacctttatgtctctgctatttttagccattctagattttgtgtatcttttttcataacctgttgagaattaatattgaaccattttatgtaaaatatagaaacttgcatttctacatttatcacttcctcctgtccttgctgtaattgtcatatgtattacatctatggtatgttataaactacacaatacatgttaccatttttgctttaaagagtcgtgttttaggaaaattaagagcatttttttaagtgtaggtttgctagcaacacattatgtttttcttttatctgaaaatgtgtttgtttcacttttattcttaagaatatttctcttgaaaataacattttgtgttggcaggcttttgggttttttttctttttagcacttttaaagatttcattccactgtcttctggccttatattttctaataagtcagtggaaattcaactcagtgttcctgtgaaagtaatatgtcgtttttctctagctgttttctgcactttttttcttttttgttagttttcagcagttcagctgtgatttgtgcctaggtgtggttttctttttatttaattaatgtttgctgagcttcttgaatctatacgtttttgtcttttaccaaatttggggaattattttcaatttcttttctgtcctattctctttttccttgggattggttatatgtattttgatactgttccaaggactctttccccccatacccctacctttttttctctgtccttcagataaggtctgttttcatgttactatttgttttgccatcttcagtctgccattaagtacatcagtaaagatttatttcatacagttttcagctccagaatttctgtttggttcttgtttttgtttgggctgcagtaacaaaacaccttaggccgggtaatttattgtataaacagcatacatttattgctcacagttctggaggcttgaaagcccaagtttaaaaggttccagcagattcagtttctggtgagaactctctgcttcatagaaaacacctatgtgtccttacatggcagaaggggcaaacaagccttctcacgcctcttttattagggcaaaaatcccattcctgagggtggagccttcatgacctcccagaggccccatctcataataccaccatattagggaccgggtttcaacataagaattttgggggacacacgcattcagaccatagtagtccctttttattgattctttttcttttctggaatttcttttcattcaaagcaagagtatttctccctacatcttgtgcattgtaacagtacctggtttaaatttttttgtctgctaattctcacatctggattgtctcagggccattccctgtttgtgctttcttttgagcatggatattttttgttcctttgtatgtcgggtaattgtgttctagcacattatgtatggatgatagattttaaaactctgaatagtattttttaaattgataatgacttttagtgatatattttgtcattttctgtgctgattgtttccttgtccatgcttttcttctattttcacttgtctccctgctgctaaagtatgtcgtcagatagttcttttgtgacagtctgtgtatagtaaaccattagcttttatgtgtcttaaaatatcttattttttccctcattcttgctgcattacctgggacctaagttctaggtagacagttactttactttcaatactttgaacatattgtgccattgtttttcgtcatcagttgttgctggggagaagtctgaagtcagtctaattgccatttcttgctaggtaatctgcttttctttctggtagcttttaagattatgcccgtgattgatattctacagtgtgtcttatgtgtgacttaatttttatcttcctcagtatgtagtgtgtattttcagttcaacaacatgtttttcaattctggaaaattactatctaaattatctcagcaaatattggtacaccactgtccttatatcttagtgattatgtttttttcttttagtatattcctaaatatacttatttttatgtttttttaaaatcatactatccattgggtgatatcatctagaatgaattcatgttccagccatttattttattggtctttctctttttttctcattttttttcccacatgcctgttgtgtcacatttgttgatattatattttagaattttgtccttgcagccttattttgattgggaagtttaacatttttcttcattttgcccatctgtctttttctatgcttattttctttcttacagtttttacttgattttcaattcattcctcccaatccaaaactaggtttgtattagagtttccgggttcttgcttcagcatgatattgagagtattgcaggttctgtcatggatccattcaataactaactggtttagatcctggttaagaggtttctcctctctctttccccttaactacaccacaatgtcaaataagctctagcttaggcaacaggggatatcagtatattcttagcttcctttcaagaggagaaggctattccagcctttggctttaagcagtaagcatagctaatactcctcttatggaacatttttagtccttgtttacccagaggagggggaactttgagccactattgagtgctcatagactcagagctttgcaggtccacagcttatatccccattcacagccttgtgtttcttctcatcttcttgtgacttagcctttctaaataaaaagtaatacttaacattttatattgtacttctagcaaaggggctgaatcaaaatacaaacttaatgagccttcttgactagacatctatgtgttgtttcttaatgttttgtcactcttgtctcacttggcatatgctcatagtagtaatattgctcttgtgaatctgagttttaatttctagtagggaaaactctgagttttcttttttaaaattttgtcttgatcaaaattatatatttttacatatgaactttgaaataattttgctcagttttaaaacttctgttggaatatgtcttgaaatgtataaatgtgtgtctacatcattttagaaaggttgtcctcctttttttgtttttgccctccagcctgagtgacaagagtcctggtctatcactcagggtggagtgcagtggtgtgatcattcatgtctcactgcagcctcaacctcctggggtcaagcagtcctcccacctcagtcccccacatagctaggaccacaggtgtgcaccaccgcacacaactgatggttttgtttttttttgagacaaggtttcccaatgttgcccaggctggtcttgaattcttgggctcaaaagatcctcctgcttcagtctctgaaagtgctgggattccaggtgtgagcctctgtgcctatctgaaagattgccatttttatgctctccagttatccagaagttaactatatccatttatatacagcttttaatatgtaattttgagccttccttgagaaccttattcctgttttatgttttctgtagttattgtggctgtccagctggctatactagaagaaatattaaaatgttcctcttacatgtagtcactttgccagaatgcctaaataattataaaaggttttggtagattctgtggttttctatgtatataatcataccaactacaaataaaggtacttttatatcttttaacatttatgctagtcatttagttttcttattttattaagctttctaaagcccctaaaacagtatttaacaattataggcatctctttgttcttgattttagtggaaatgccttcagtgtgttttactgttgaatatcttgcttgctgtatttgggggaaaagtctcatagttaaataatttccttttattcttattttattggagttcttattaggaatggtggccgaattttatcaaatgccatttaaaaccttgataacaataatgggcaattagccttttaacaaactggattcagtttgctttttattttgtttttccttttgtgttaatacttacaagtgtattgtgttatgttttcttcctttgaactatatttatcaggttttgttgttaatgttttataagcacttgaaaaataattgaataccttaataatcttcccttgtgtattgtgtggagactgttttgttctaactttataaattgataataaagaaccctctgtttaggtagattttgtcagtttgctcagttttagaaagctagtatagaaaatacataccttggggtaattttattaagatatttttatgtgagtttgaaattttttccaaatatgaatccatatttccgtgtgtgtgtgtgtgtgtgtgtgtgtgtgtgtgtatgtgtgtgtgtgtggggtctaaatttgtactgtgtcccttgggaaacacatttgtttccttaacattttttttccttctgcaatccctctgtgctttttttgtgagaaatcttaatcccaaacatttatctgtaaataagttggcgagattttttataggtgtcagtagagtgcatagctgtatattaatgctttgtgtgtatttatgaattattaccatatgagtttgctgtgaagtctgagtattactggtacttaatattgcccgttgttgttacataataaattgtaataaaatttttgttgctaccttaggagttccaacttgggcttggttctgatattgtttgagactgtttggtaatttatacatatatgactgtaataatgtccttttcttctctcccccaacctccgccaacagttacatgggaattggtctttctgctcaaggtgtgaacatgaatagactaccaggtacacttgtaattgaattacagtattatgtcttatgagtagctctttctggttaaatttttcaagtaagaaattgtaatatttaaagatactgattttctgtgtttttaatcatcattatgaattttaagtgaaagctgagtggggtttttttgttttgttttgtttttgagacagagtctcactgtgtcacccaggttggagggcagtggcgcagttttggcccactgcaacctctgcctcctgggatcaagcggttttcctgccctcagcctcccaagtagctgggatcacaggcatgcgccaccaggcccggctaatttttgtatttttagtagagatggggttttgccattttggccaggctggtctcgagcccctgacctcaggtgatccacctgcctcggcctcccaaactgttaggattacaggcgtgagccaccatgcccagcctgctgagcggtttttaataaatttaaatttcacactatttagtaaaacatatagtatatatatcatgcttttttttgtatttttatatttttaagttttagtacatagtaatatcagctactttaaatattttaatgtggctagttatattggctacccatcacatttttgacttttaacccatcttaatattcagggaatatcgactaatacttaaagtaaactaaggaagagatgaattgagatccagacctgtttcccagtaccacttatgagaaggaagtgattcttggattatgtcttctaatactctctttgctaaaattaaaaattaattttggcgagactttttgaagtacaaggcaaaactgtcaatgtcaaactacatgaagtaccttaaagaaacaaaccaagacaatgtagttgcatctgattgtaatcacatatgttaccttgacatgctttgttttgtacccttttgcttaaaattatacttgaaagagggtttaattgaggtttttattatttgaaaactccttatagaagtaactgataaggtaaaaatctcttaatgatgatataaacatatctgtagtgtggtaagaccacaccctgtttggcttttatatttggatcacagtcttgagaaacttgcagtgattgaataggatgtaatctcttatgttatataaaacgtgtatgtgtttctttaaatcaaaacaaaattattttggtgtattagcaaacggaatatgcacagaaaatgtgtcctcctgtggttgttgcatttatgtttgttttttctggtagggggttctctctgtttaatatttgttttagtgttctgtgtagctatttttcttaaatttgtaaactgtattttaatatagaataaattatgtagtgtaattgttgagaatttaaatgtacattgggaatttcatctttatattatcttgtactgttctgatttatcataatcttagtgaataaacctagtacagaggaaccttacttttcattgtaaatatgccggaactttctccttaggttgggataagcattcatatggttaccatggggatgatggacattcgttttgttcttctggaactggacaaccttatggaccaactttcactactggtgatgtcattggctgttgtgttaatcttatcaacaatacctgcttttacaccaagaatggacatagtttaggtactgagataatatattgcatgcaaaataaccaaatatggagattattatacttccaggatggtagttgtatttattatgtgattctcctttatagatggatgcctctggaaatggtttctttctttttcccagacagaagctgaggaaatggtgaatatttatattcaccctatttatattctgtgaaggccatctatataatacatatatgtataggagttactgtagaaataatccccacactgagatacttattctagaaatagaaatgccaagagttttctactttaaataaaacgctacacagtataatctaattctctgggtaacaggtgctaagaaaaaggggcagtcagttgttaggatagtgtggggaatagtaacaaaggaagggaaagcttgatgccacaagcatatgaagggcatcaacacactcaaaggtcagatctgctaacaaagatggctaagttggtaactacaagtttgttctatggaaggaagcagaattaaacaagcaaacagtgacaaaactgagaataaaaaacttctgaaaataaaataggttatggaaaacttgaaacccatacattgtaagactaatagtaagttaagattttcagtggactattcatgtactcatagcacttcaaatttaaagttatatgtggtcattatattccattttcttagaagtttttttttttaaactatagaaaatataaaggataataacactgatgctttttgttttataaaaaaagatttcaccttttactgctggaaaaatctttgactcaaagcaaattatttttaatgaggtaaaatgaaaggaagcataaactgagtaaccctagaaggcagaaactatttacaaatagtatttagaaattagacttaaagtagtatgcttagacatataatagatgttctttaacacaaaagctgttttttctgttatttcatagtataaaagaaaattctgaatttctggctgcattggcaatactcttttaagagtgtttcaataaagttaacttttttcatattcagcttagcatttctatttctgattactgatttttaattctgaagtccttctgtattatctgacttaaaagtttttctcaagtccacaagagatccttttctcactagtacaataatgttaaggaccccatgcaaattatgtatatttgtgtgtggtttcattgttgtggccacctggtttccaagaacaatacaggcctcttgaatttatttgttgttactattctgactgttcatataatcttagttggcttgactgcttaagatgttggaagttttgaatccggagaaatctgcttttaggtgtgacctttggctcaaaaaccaaaaaatacattttgaaaaaaccacaatctctttaacataaactttttaaactttccagagaagaaatttcattttgggagataagacaatcacaggtgataatgattttattttttccctattttcacaaatatttaaattaaatttttctcttggctaagaaagctatttttaaaatgtaagatgtgtctttaaaaaggtgcacctaataatggagtcacattataaatttttattttttgtttattttatttatttaatttttgagacggaatgtccttctgtcgccaaggcaggagtacagtgatgtgatctcggctcagaacctctgcctcctagtttcaagcaattctccttccccagcctcctgaatagctgggattataggcacgccatcacccccagctaatttttgtatttttagtagagatggggtttcaccatgttgtctaggctggtcttgaacctctgacctcaagtgatacacccgcctcagccttccaaagtgctggcattacaggcgtgagccactgtgcccagcctacattttaattttaagtaaacctgaatgtttggcattattcattcttaaatttaatgagtattaagcacatagagagatggtataacagtggttagtaagagttctttagtcagacttgcctgggattgactcccggcctatgccaggtaaccatatgtaaattacttaacatttctgtgcctcagttttcttagtttgtcaagtaggatcactgtaatacctatctcactaaggtggttagactaaactgcaatagtatgtgcacagttctggcatctagtgaataaccattaaatgttatttagtatcattgtttgtcagcccctgagctaggttcctgggatccactggtaaaccattgatgagcagaaattacttctctagaacaggagtctacaagctatggccaagttagcctcctgtttattttaaaataaaatttcattagcaaccagccacacctacttaaatattgtttatggttgctttcctgttacagtggcagagttggatatttgtgataaagaccatatggcctggaaagcagaacatattagtagtccttcataggaaagctttgcctacctctggtctaggttctggcatcttccaagataaaatactgttaaatatttagttactattcccttatacttcctaagtggataatctgtgcccaaaacttgatacatctttagtttctgtctcatggaagattttcagaatgtatatttgtttactatataaggaaaaatagaaaggttttatttgagaaaataagagaaactttgcagtatataggttaatgtaatttgataattttttactttgttttattgaatatcgttcaccaattgaagatcacttttcaaaaagcctgacaaatcaggaaattatgaatatagaaaattgctttctgtgtaaaattcaaatagttatgccatcttgttaaagtggcatcttttcgtggtctgattgagcaaaaacatgttgtggtaactatatttggctgtgttaaaaaatgttaacctttggaattaattttgaatttttcgttagagtttttggtaaagtgaagatttcagtaattacagacaaaggatttttgctaaagatagaatatacagtgttgattataactagacatctttgagaaaaattattttatgaaaaatattagaaatatgtatagtttatagtatattaaaatattctcttgctttctgtattctttttacttttgtgaaatttttgggaaagttttttatttgggctgatagtacttgctttctgtgttattaatgaagttaaatgtaatgataatgttttacgtggggaaaacaggaaccctaactttgctttccttttaacaagccaccatgaatttactagtttttaaaaatcataaaaacagggctttactaactacaaaagcattaattttacacattattttaaaagtataaaatttattttcagtttgtcttttaactttattaataaatagagttagatgttttctgttattacagcacagtcatagaggaataaaatgtcaagtaggaagagaccttaaaaacaatttaatggaaattccctcagttttaagatagtgatcaagactgtagaagcagtggtgctggcttggttttaatgtttgttttagactggaagaattgagatcagctgactgactcaccaatactgctctcccattattctagagctaaatctttaaaaatatatctacagaaatactttattattttcagctaagttgtatattggaatatttaaaggaggtcgttaaattgtcacgttgagttgacagtagacttattccaatgatattgccattgctcaagttgtatctagaacatgactgttgtaattactgtcaaaaggtattcaagagaaattctaaactgtgcaaaatcgttcatcctttgaaggaggaattgatttttcccacgagtaaatcataagttaaagaatttactttcataagaaacattttttaaagaagcaaaaatatactgtattttcccttgtttgccttttataacagaaaaactcttttctttccagctaaaattatttaaaagctaaatctagatgatgattattaaacggtgagggtacaaattgcaacttggggttaaaaaataaactgactattttgcaaccaactttcttaatgtgttttctaatgtagctttgaagatatatctaaaagtatttcaaaaatcctggagacaatggcagcatctcagaaataaaatttgtgtatgactagcaaggctgattatcttgaaaggggacagcgtttgttcactcagacatatgttagtattattgattaaaaattagtcttgttattttttatttaggctttaatgtttttttcttttgccatttgtttcctccttttagttagaaattcagcttgtcagtatagtctgctttgaaaaacagcttctaatgccacttttttttttctttttaggtattgctttcactgacctaccggtaagactttttttaaaagcagttttccatttttaattacaggaagtataaagaaactgatactgggcatatttagaaagtttaaaatacagtcttattgatatttattaggtttatatgacatgcaaagaaagagatcttttctctaaccaccttgggtgtagaccctcagaaattaagctccaacttgcactggattcattgtataaaggaaaataaatcagaattgattctcaagtgtctttttaaatgtcaccattcattcatttgaaatgtatttccttggacttttcagcagaaggctgtatagcagttataatcgtttattcatccaagctatatagaggcctactatgtggcaggtaaagtgcttggaatatattattcaacaggtagtaaaggtctctgccctcttggactttatagtattcaagctgtgaaagagaatgagcagtacatgaaaaacaagtaaagtagaacatattttaagggtgttaagtatactttggaaagaaagggaaaaaacagagaatgggaataccaacggtaggacacaaggttgtacaagttgctcccctttgctcaaggtgagacttgagctgaagcttttggaggagtgagggagtctgccaagtggatatgtagagcaagagttttcaggcagagggaggttagagaaaaggtgctcaggcaggagcacagatggcttgtttgaagaagagtgtgaagtgtggtagagaggagtgaggagggcagagcatatgtagtagcagatgatcagagataataatggggttgggggtaagctattaatagatcatctagacctgggcaagccattgggagggcttggaaatttactctgagtgaaatacaaagacattgtggacttttatttgtcatgataggacttcagtttttatgggatcactgtgattgcttagttgaaaagtagactaggccgggcatggtggctcacacctgtaatcccagcacttagggaggccgaggtgggcggatcacgaggtcaggagatcgagaccatcctggccaacacggtgaacccccgtctctactaaaaaaaaaaatacaaaaaattagctgggcgtggtggtgggcgcctgtagtcccagctactcaggaggctgaggcaggagaatggcgtgaacccaggaggcggagcttgcagtgagccaagattgtgccactgcactccagcctgggtgacagagcaagcctctgtctcaaaaaaaaaacaaaaaaacaaaacaacaacaacaacaaaaaactatatgggagtaagggtagaagcaaggggacctgtgagaagactattgcagaaattcaagcaaggggttacagtaactctcttcggtagaggtttgattccacgtatcttatttaccaaacccaaggcactgtcagttgtaatctgcatcatctgtgacaccaagggggaaaaaaactaacaaactgtgacataatgcctcccttatcacttagcatttttattttatactcactgaatgatctcttagggttatttaaacttagattttaatatgtgtctctttttaggtgttgcacacctaaaaaggatgagataagcaatataaattgattaaggtattcctaaaatttcatgttcagagtctaaccttttaaatcagttttttaaagactggatgccatgattttctttgatctcactctgtcacccaggttggagtgcagtggtgtgatcttggctcactgcaacctctgcttcccaggctcaagggatcctcctacctcagactcccaagtagctgggaccacaggtgcacgccagcatgcccgactgattttttgtatttttggtagagacggggtttcgccaggttgccgaggctgatgcccatgattttctatgtgatactgtcttctccgtcatcaagaacattttttaagattactcttattatgtctctgggattaatctccaagctgctgattacatcgtgcacgtttgatactgtcactttcatgatgttaaccaatatcacgaaaatgaaaatttcatcaggaaaagcaactcagtcccaagagtttttcagtgagctcattctttaacaaatcgctcctgtgcaggcattgacagctgtgtcatgacagctgcctgaccatagtaaggtgtcatcaattataaaatgcattccagttttcagagatgttttgaaagagatgatggaagattcagaggtagagaatagataccaaatctatagactatttatatcccttaataaaatgctaggaaaaaacagaaatcaaaattataatagaaaataattttaagccaaggaatatttgaaccctaccgatcaaaagtactcttcaagaagcattatttggctctgggtgtctgaggtgggaggactgcttgaggccaggagttcaacaccactttgggcaatataatgagatctcacctctactaaaaaaaaaaaaaacaaaaaaacacaacaacaacaaaaaaccctgccgcattatttagtaaatagtgatggaatgagtctttattatttatttttttaaaatacatattgttaggacaaagtgtaaagtaagttctagatggattaaagagttaaatttttaaaaatcccaaaataatagtaacaaaaatatgattcttttaaaaatccaactgaaaaccaagagaattggctaatggattggatctgaaaattacataaggtctgagaattgacaattgtacttagcagagtagaggtcgttggtgacctggacaagaaagtttcagctgtgggatggagacatcctgattggaatggattttaggaataggtgagttataggcagtggataactctggaggactttggccatggtgaggagtaaagaaatggagtagtagccagtggtggaagtgggggcagtagaaaaaaaaattaagttaggagattgagtatgctgatgaaaatgtcggtgtcgcatagaaagaggtagacagatgtgtaattgaggggatgggcttttgagaagagcattgtggggacaggcagagtgtgtaggtgcagattctggttagtgggttgatttggtctttaacagttaagagactggtgagaatgctgtaagtttcatttggagttggttaaagagtttagtgacttttttttttttttttttttctgttgtggcactaagcaactagtcagcgtgagcttttgttgttgttagctttcgttttcttgttcatagatagcggagatcatttggaaaaagcttggttgcttgtagacatgttgtttattttctctcccacttttgaatcaccagttatgttttttccctcaggtagccaatgatcatgtgcaactttgttgtaacaatgggtacagtggtggttttaggtttccttttagtgtagtatttttcatttttaatactgtaaatcttctgggacttccataggcttcatatcaattcttccttttaaaggaagcatcaaggaagtgtttatatcttctatacctgtgatctctcacaagctacccataccattgaatcctgagagaaagtatatttgcagaaaaaccagtttacctagattgttctgcacctgttatggaatataagtgtttatacagctttgaaaaccttagatttttttcaaaatagtcttttttcctcagcttacctcaccagtttgagaaatgacattaagtataactaattcagtttgggatttaattatacaattaaattatgatagttgcacagttctgtgaacatactaaaaaacattgaaggctgttgctttttaaaggcttttgttacagtagctgttctcattttaaatgatgctgttttcgaattctgggcactgacttgaaatctactttttgtggatacattatttgtatagtcatttttattaaaagagatcgaatgtagaccaaagctgtgctattgagaatataaatttatattgtgtacatttagcttttaagcaatttctagattgaaagtatgttttgcaagttaatagaaatgttttcctattcttttcataaagaacctattctgtctatatactattctacatgggcaggagtatttttctagaagacattattacatataaatctacagtgacaatgcacctgctgcatggatgaaccttgaaaacatgctaaataaaagaagccagccatctgggtgcggtggctcacgcctgtaattctagcactttgggaggccaaggcgggcggatcaagagatcaagactatcctggccaacatggtgaaaccccgtctctactaaaaatacaaaaattagccaggagtggtggcatgtggctgtagtcccatactcgggaggctgaggcaggagaattgcttgaacttgggagttagaggttgcagtgaaccgagattatgccactgcacttcagcctgggcggcagagtgagactccgtctcaaaaaaaaaaaaaaaaaaaaaaaaaaccagtcatataagatcacatattttgttgttccatttatgcaaaatgtccagaatgggcagatccatagagttagaaagtagattagtggttgccagggggaacggggaaatgggaagtggctgctgatgggtactgagtttctctctggggtgatgggattgttacacaattaaattacagtagttgcacagttctgtgaacatactaaaaaacattgaaggccgttgttttttaaaatctgtaatatagcaagttaaggactatgtccttaatcctcttctcccaattctccagttttaaggttgagtaaatggtataacaattatacttacttttcagtgagccaaaactgacttaatattactaaaagtttttttaatcaatatcagattacagaagtaatgtatagtattaaatacttaaatgagaaatgtttatatatacagaaatgtacaaaagagaagttcttcataatcccagtctctttggctataatgtttgttttaacttgaatatatatccttttagacttctttctaaacacatataagccagtatgttcattttttgaatgtttatgtgaaagatagggtcataccatatacaatatgttataccttgctttagtgtgtataggacatctttctgtgtccatatatacatttttcattctgttctttttgcctgctttatgttatcttattaacttactaccacaattgatcaattataaaatgtacatttttttcatattttagtatttctgaaatgagaatgcactgtagaatcaatgactggtcagagtttaatttgcattatgttttcctagacacaaaatagtgatgtttgttactattagattttgagacttgatgaatatggtataatatcacatatctgtgaatattttaaaattttgtttgtgttacaaataatgctacaagacatatctttgcacatacttatttttgtaggaatacactcttccaagtgaaattacttggtcaattttaatagatttttccagatttctttgttaaaagattatgtcagtttacatttctgtgtacagtagatgaaagggttatttccccaacccttatcagcattgggtattctcagcctttcaagtcttaatctgatgtgcaaaagtttttaaatcttgaacttttaattgattttatttttaagtgcgcattaaaaatgttcatctaaaaagttgagtgtgattaagcttctctttatgtgttgtcatttttatttcttctacaaattgcctacatattcattgccttttttaagaatttgaactggtagtctttgtcctcctgaattttttctgtatttgtaaaacacattttgccatatgtgtggcagatttttttttctagagagtcatttgtctttgccatttgtggcatgttttgtcatagggaagttttaaatttttatgaaatagttttatcagagaattcatgaatgttgattgtctttgatagtgttgatagaattattttttctgaatttgtaagaaaatttagatgagcagtcattttaaaaatgtctttatttagacaatactgaatatcatcattataaactgcttaatgaacagaattgtctttcactcaattgtgtttggcttatatgcttttgtgttaaagtatctcataactctgtagtgttttttctgtttttttgttttgttttgtttctgtttttgtgtttttaagacagagtttcactcttgttgcccaggctggaatgcagtggcacaatctcggctcaccagaacctccccatccccggttcaagcgattatccttcctcagcctcccgagtagctgggattacaggcatgcgccaccacacccagctaattttgtatttttagtagaggcggggtttcaccatgttggtcaggctggtcttgtactcctgacctgaggtgatctacctgccccagcctcccaaagtgctgggattacaggcgtgagccaccatgcctggcctgtttctataaagtctttaggtctcagttttctcattggtgaaatgggaaggctgtactatctcacctgtttttggcttaaaagtttataaacttgttagctctgttgattattaagaatcaatacatttgcatactttgctttaaccatttatttccataatccagtagtactttatatttttgatattttgatgtaatattttgtttctgatttgttctgcttgattgaacggttgtttttaaacacaccctctttgcattttactgtgaaatctatttaacatattcacacagaaattatccgctcttgatctttaccttgttttgtactgaaaaatacttgttataactattaaagatataagacataaatacagaaaatgaaaatatggtaggatttggagttgcaagaggaaaaatcagttttggatgtggtatcagacaaacttgtgttccaattccatctctgccatttgttagcagaacgaccatgagcaagttatttaaccttgaatcctcattttctctgtctttgaagtagaaataataatagtggcctcacagaattatgattaaaccctggcatttagtagccactcagaaactcattctgcctttagatgtaacaaccaattagtgacatagccaaaagaatgacccctgtattttttgtttacttgaagttatcaccttttcatcttgattaaccttgaaaccatggagtgtacctgaatgcatttctgagtttgggtatattcagattcatccttttcctcccttgaaatacatatatttgaggttttgtgttttttttttaatatagagaatctccactcttcctggcactgtgttttgcttatagttatggtcttatccccttccctttgtaaagttaggcatcccaaatatacagaatgaaaacagtaaatttaagctattaaatgccagactagctgagatcatacttttatgataactagctttaacatgcagtttatagaaatgtatcatatataaaatgtgggataaacctgagttatgtgtttatagttgaatttctgtaactactatatgacataatcttagaacaagaattacatgcacatatattagtagcataataccacgtggtataatacaacgtagtccctgaataaataaaacagagatcttgggtctctttgttttttcttgatgattacattgcaggaagtgatattttttcatctaacatataatgtattttagatcatttgttttagccttctaatattttgattgggattttaaaatatgaagtaaatttatagttctattcttttaaatgtaacattaaaagaattattaaatctaacataaaatggatagatgtttaatgaaatatgctatcttacagccaaatttgtatcctactgtggggcttcaaacaccaggagaagtggtcgatgccaattttgggcaacatcctttcgtgtttgatatagaagactatatgcgggagtggagaaccaaaatccaggcacagatagatcgatttcctatcggagatcgagaaggagaatggcagaccatgatacaaaagtaagagtgaagaaatttcaattgatgctattcagaatctgttttttataagacatttattctgttggtatccacagaagctttttaatccactaatttatatactgacatatctattatattattgattttaatctctcaacgaaaagtaatttactccactatttaaacaaattaaaaacaattgtttgacacacgtacagaattgtatttcagtctgaattaatttgatgaaggaaataaaatgatgttaggtcacctaggctaggttaattcatttgctattcttagtaataggatttaatgatttctgtaggttatacaatttaacttttaataatgttaatggaaaagataaagttgagagataatctagatcttataatcaggatctgtggtttttggtcatgaacttggctatgtccaagctcttaatatctgaactatcagcagtagttaagtatggacttaaaatttaaataaataccattaaatttaaaaagtcctcttcactattataatccaggtcaagaaaatagcagactttcagatacagttggtccaacacatttcatctttaatgtccttataattgctttgaatattcttaactttaaaattgtaataaaatgttgggggtattttttagaaaaggaagtgattgggagacatgatgatgactctgaaatcacacttcgtccctggagctattatcatctgtattacagagattggacactagtttttttgtccagcccagttgagaatagacaaccctgatgcagaatcctatagtcaccacgaagtgaagctagaatgggttgttctggggccacactgttttaatgctctgaaaatggttaccactgagtatcatggcaagatagtagaaaacatttatcttaaccttataaccaggatccttccacccacttcttcactgacttgatgttcaccatgaactcttgagaagtccattctaaaaggtcccctcccccttaaattaatttgaacaattgggtaaaataagatgcagatctgtttcttagacattttcctcccttttctccctccgctctttgcctcagtctcctcctgtggtgaaccactgcttcccacgattttctaactggcccttagtagtgtcaggtggaggcaagtttaaaaattgactgtttggagataacagatatttgggttaatattgttgcatcaccagtttttctaaccacatcttgtgggtagatgtaagtatatgttttgactacctggtacgtttttaaaagattattgtcttggaaatgtgtcacttacatgtaaaccatatttgataaatctcttgggtaaaaccatagtaattgatttagattagaaggctgattcctcctttaattagtagtacacttatagacatgttctggaagattgtctctctggattcaccttagtattctgtacatactttgtgatcccacttcatttaaccggtgtgtaaagaagatggttgaactctggaacattaagagttaatcttttattttaaagttggttattttacagaatgccagcaatactggaataagtcatatgataaagtcaaaatagaaattatggttagtagggctgaataataagataggaagggacctgggggtaatgagagtccaagaatcaaagaaaaggtcatttaatgtccttgattctcaagtaatatttattttagggagagtagtctcaacatagcatttgcagttatcttttcgaaaatagtacatgaatagaacaaaatgatgtttttcaaaagcttactttaaaggtgaggttcttaacgccttgtttcaaggaaataggttcgtttttataacaccagaatagattttgtttatataaattgtagtatgaagcatgtattctcttcactaaaagatgtatgtttcttctttttattttaagaatggtttcatcttatttagtccaccatgggtactgtgccacagcagaggcctttgccagatctacagaccagaccgttctagaagaattagcttccattaagaatagacaaagtaaggacactgtggtgcatggctaacatttgttttcagattatagatttggttactttaatttttagaaattttgtttttttaattaaaaaaatttcaaatatattaatttaaaatggatgcctctgaattttattttcactgacatttttgaagatcagtttaaaaattcacataggactatgtcagaattctaattctagagagattttacagaagttttttgaaggaatgtctttaccatttttttcttaaatgttttcttaagctttcaggaaataaacatttaataaaaagatttaaaaataataataaagtagtcctgattagttggaggagatagtatgtgaaagaaatgtaaatatctttgaatttaaatggctaatacagtattgatccataagtatttattatttagatcctagtgctggcctctgtggccagagataaaacaggtcctgtataacaatggcaagtcagcataactggtccatagttagccatcctaaaattggtgctgtttgtccatcagggtgggtatgacttgacaagagtatagagatgaaaacaaaatagatgggtgaaattaatgggtgaaaacaactatttcataggtcaaattgctgtaatagcactgattacattgggttgtagttaattgtgtgctgtccttttctactattttaataagctctgttgaacagagatcacttactcattttgtatccttatcatctaatttaacatataacagatcaagtgaatgctcaacgagtctctgttaaattggaatcttagtcaaaagctagcatttttcagtcctttgttcagaagattatgtttgataaggcattttagtatccctttaaaacagtctttttaatctcagtgtttgaaacttcaatattgcataataggtattttaactatattactcgtatgttcgtgattttaaaaaaaaaatttgtgaccgtacttgtttttctaattttctagtatgtctgaaatgtttcctggattgcctaatggaaactatgatgttagagaaagaaattgaaattaatcataatttatttaaagatttcttactaactttcttttctgaggtcactaagtttatgttttatctacttttgtaaaagttaatcgtttgctttcttttactgaataggaattcagaaattggtattagcaggaagaatgggagaagccattgaaacaacacaacagttatacccaagtttacttgaaagaaatcctaatctccttttcacattaaagtgagtttgcataataaaatgctatatttgttatatattataaatatttgtcaagttatgtaataaaagacattttcgtgcttttgtaattttagtttttttcgtttttcaagtatatacaattttgtaatgtcatttaagcaacatgttatgaaaaatacttttgtgttaaggaccataagcagaaggtgtcttttgctatgtatttgcttttattattctatttatgtgtttaaaaatgtgaaaatcttatttagaagatgggtgtctatttttccttctcagaagtaccttacatttaatctctctggcattttaaaaaattgtggtaaaatatacataaaatttaccattttttacattcacatcattgtgcaaccatcaccaccatccgactccagaacttctccatcttcccaaactgaaactctctattaaacactaaccatccattcatccccctagcccctggaaaccaccattctacattttgcctctatgaatttgactacccatataagtagaatcagagtatttattcttcattactggcttattttagtgtaatagccttaaggttcatctttattgtagtatgtatcagaattttcttccttttaaaggctgaattttactccattgtttggataatactgcattttgtttatccattcatccactgatggacacttaaagtttgcttctacctcttggctgttatgaataattctgctgtgaacataggtgtacaaatatctgagtccctgcattagatttttttggttatatacccagaagtgaactttctggatcatatggtaattctatgtttaactatttttttttaataatagccatcctgatttgacaattttaattggttttatgaatctttgttacttaaaaaatgagatgttactgagcttcagatttcaacttgttaagcaacagatatcctttgtaagtcaaatgacagaattgttttgctttagaataagaattttaaatgaggcccattttggttaagaggttgggaatgggacgggtggggagaaaggctacgctttatatgtatctcatatacataaaatcatgtccttaggcacaatttgatttgctaccaagcgcaaatgttattttgattaaattacttgtagccaaaaaaatggggttcatatcttcttataggtaaatttccatttggtaaatcctgattaaagggggtaatattattatagtgtctattacattgtactctcatttttctggaaattctaaaattctaagcattaaagcataggacaccatatttaatatttttagcttactaaagaccaatcctactgataaatcaaagttttaaaaatatttttagaaatctgttgctattaaataaaaggccatttgaagattgtgtctaagtaaatttttcttttctcctttagagtgcgtcagtttatagaaatggtgaatggtacagatagtgaagtacgatgtttgggaggccgaagtccaaagtctcaagacagttatcctgttagtcctcgaccttttagtagtccaagtatgagccccagccatggaatgaatatccacaatttagcatcaggcaaaggaagcaccgcacatttttcaggtgagatttaacttatgacattatttttagatttttcctctttataatcttaaacctttttccttttgaaaatctgtatatttccagctgggcacggtggctcacgcttgtaatcccagcactttgggaggccagggtgggcggatcacgaggtcaggagttcgagaccagcctggccaacatggtgataaccccatctctactaaaaatacaaaaatcagctgggcatggtggcaggtgcctgtagtcccagctactcgggaggctgaggcaggagaattgcttgaatcctggaggcagaggttgcagtgagctgagatcacgtcactgcactccagcctgggtgacagagggacactccatttgtctcagaaaatctgtatatttcctttgtagctgttttcaaatgtgtatacttaagatttttctgggtgaaaaattgtaggttcagattgacatgttctcagtaccaggaagtcacttgaagaacagctgtctgagaataggttattagcagaccttcctaaatgaaagtcagcattcacaatgagtagtcaccagaattaaattattgatttttaatagtgaaaaggtaattgtgtgttttaataaaatataaatttaaaggtgatgtggctgtgataccttatgccactggttaccacatctagctgggctgccgctgcctccctcctctccccccacccccaacctttcccaaccaagcctcttgcaaaagtcagctctgcctagttcgttttctcccatccgtttgttggctcaccagtcttactctctgtgactttgggctttctcttaattaaaattctctcctttcttggcttttgtgacatcacttctacaggtttttttggttttgtttttgtttctttttaaagagttggagtctcgcaatgtttctgatgctggtctcaaactcctggcctcaagcactgctcctgcctcagcctcccaaagtgctgggcttacaggtgtgagctaccgtgcccagccacagatttatttctgatgcttctcagtcttctgtttgcccatctctttaattctgcatttcccaagatgttatctttgtacatttaacattcttaaacaagtcagatagtgtctcctttcctttcatgaagtaacaccattgctttttcttatttcaatttattctcttttctgcattacttcctctcagtttatttacatcaccactctgtacaacaagtgtgattcccatgtctgttcttagccactactcctcttgaatatcatacagtcacttcaggcttggataaattctgagcctcagtgtattcatatgtaaaatggggatgatcataatattgccattttagggggattttgaggattaaatgagatgtgtaattaagccttcaataaatgttagatgaggtaataattaagatctcacaattaagtattcttagtatcctttcaaagaagttacctgtttacatcatccattgactctcctacgttctagaagtcttagtacaaaatcaacatggagacttgtttacaaccgtattaataaattagtgtttgtttctgtttctacgtggtatctttttcttcaggttttgaaagttgtagtaatggtgtaatatcaaataaagcacatcaatcatattgccatagtaataaacaccagtcatccaacttgaatgtaccagaactaaacagtataaatatgtcaagatcacagcaagttaataacttcaccaggtaagtaatttcactgacttttgcactaatataagcaacctagttataggtgtaatcgttgtaataattttgaaagaacttgaattatgtgacccacagaggggctctgggagttcttaagcccccagagaataaaagcgtagggagtcagttccccaaagctttttagtctcctattatgcacatgagctctttccttagtttcttcctcttctctactaccttcttccctctagtaaagttataaggacaaattcagggcttcatgcattgtcttcctgccagccacagagctatacaaatgatcacataaatgccatttgttatgttttcacagtggttaagacacagtagcatatttaaccttgaacggtgacataagataaatttacaactgattttttctctgtgtgtgagttttttttggtgtaaatgtgtagaatgttttccaagttcaaaactaactttacaaataatcttttttgaaagcctgcctttaagtagcttgcatatagcagatggttaagtcatttagtaaacattggtgtgaggatggttttgaggatttgttgggcaccaaacattctgctaggtagggtgtctcactttgaagaggtttgaaagatgatatctcagtcagtgtactatgacccttgatatactcaggtttaatatttatgaaacctaaaagttcatgaagtgacattatttgaattaaatactactgtgcagtagcaaattattgtgaattcaccctgcccaaatcatccaggactgggtcaatttaatattggtttggtctataacaaaccagttggttacattgcattttcaggaaatggtcatcagtgccacattttcttattaaaggagagagagcctaacttttagcatggaatcttaatggaaatatgattttgcagaaaggattgtatgtaaaaaaaaatctgtatttgaaaattgggagattaatctcaatttctgggttgtctgtcacacgtgacaaaaatttactgaagtaatagtgtgtgtgattgatataagttgtaatggagaaccacaaaagtgtatgagaagagcagaaaaatcgtctttcacagcagaggtgatatattggaaaatataaaatcaaaatattatagtttaaaaatagatggaaatgtaaaaagttaagtacttcatcatgctttatactaaatgcattggtactttatcattgatcaaggctcttgccaatgtttgagggtaagattgcagtcagtttgtgagtttttctcttgaatactatccctacagcaggaagttgctaaacagatctattattacctgagttcagggaagcaagcttaacggaagggtctgatgacacaacatcctcctttgtctgcagtataaaagggaaagaaagtcaactttgaactgccttaagctataagttattttgtagttggtaatggctttcctaactgtgaagtaggcaaagatggtattaactatttaaaccattttacagatgtagagcgggatatcagaaaagtaaatgacttttttttcttaaggtcaattattagtagctagtaagttgcagagctgaggctgcgtttcaggatttgacttgcaaacttgtgctttttccctgataccgcccaccatctgaaatgctcttcttcctaccctccctcacctccagtataacttctgtccaggctgagaaaattcaagttcagatgtcagttcttccaggatgttttccttgatttacatcccatcaaatatgtcatgttttgtgattaacttccatcatagtactgatcataattactctgtaatataataacttaattagctttttataggttgtttgctacaggaaggcagaggctgtttcataatatccttagcacctaacagggatcatacctcagaggctcttaaatgtgtgttaaatgaacgagttccttccaaatactaaactgagttatcaaaaaaaaaaaaaaagtttagtattttttaaaaagccactgaaagctgtgatggtaaggattttcttattcttaaagtttggtttttcttaccaattttcgaagtttgttaagattataaacaagctttcctggttgagtaagtctgctctggagtcgtagggccatatcccccttttccctagatctcttgttttttttttttttaccttaacaattttactaacaggagtgtatgcatgcacacacacacccccaaggtgttagaatttgttacctctggtggtattacgcatagtggtttttgctcatctgtgtttttttttctacaattgaatatatattgcttttgtaatgagaaatgtcatttttatctaagcattacctaaaatttcatcgagtgtttacttctagattgtataattattacctaggcttccataggataaatcctaaagattagatatttattgttgcttataagagtgcggatggttctgaaggacatacattgacagcttaaatatgtgcaaatatagttattggcagatagatattcattgagtggaatgagtgaaaactggaaactatccaggacatcagtttaaaagttaagattcagcaatactttagccaataagatagcctgtgagttcactctctgtcgtgtggtgaaaagggatgagagaatgaagctcaatcattttttaagttatcagttacccttgaaagaatgtatatttttaagtagtgaggacaaatgccagaatgctatttaaaaacagcctaggagtggattgagtatgaggtccggaacgaggtgaagcgggttccaggagtgagatgtatttgttttgagagtgaggttttccccttacatactagaaatcagtgctgggggtagggggagagggctggctggggagttggtggggcagcagttgattaacgaagacgtacagatctgaatttgaaaaataataggattgtgtggaagtatgatttctccatattgatgtaaagtcataaaaccactacattttagcatatgtactttttttcctcccttacctccgggggtacaaatttgttaaaagtcagcgacatgtttggctttgaatacgttcaagatttaactaaataccttttttgcagatttctgttgccttatgaaattagtttattcgtaggctatgtagttcagtagtgatttattttaaactaagctgcaagtatgatatttctaaaattaggtttgttttttcgttttcagtaatgatgtagacatggaaacagatcactactccaatggagttggagaaacttcatccaatggtttcctaaatggtagctctaaacatgaccacgaaatggaagattgtgacaccgaaatgggtctgcagtgatatttcttacatttttaataaaaaatgatggctacaaggttatgtttttacttgtactgattcacagctgatgagcataaaccagatttaaagatgtatgtgctgtaggacttgacagtaatgcatagcacttaaactcttgtttgagtgggctgctagagaaagtagagttacctttcagctacaggcagtgtttcttgctgaactgcttaggctcaggtttagcgctgtcactaatgcagcagtactgacttactggtgttgagcctctaggctattttaggttggagatgatagaacttcttatatttatgtcagtatagtcagtaaggccaaatggttagatgattttacaaattctaatcagtatttcttaaatgagtttaacgtaaacgtgtgtgactttgcatagtactatccctggtatatagtaggtgcttaagtatgacctccctcaccaaaaaaaaaaaccccaccaccaacaaaaaaattatgtggctccaagacacattagcatgcataattttattttgtagacaacttaagtagtaaattgcctgtcccatcagcaaactatcccatcaaatggagagtgaaaatttatttgttggaatacattttttcatttatttgttggaattccatggcaatgttagatttcttattattttgagattgagtggtattactaaaattgttttttaaaaagaaatgcagctttgttttactcttcaatatcagccacctcagtttctgaagagtaatttaagtacagtgataaagagcaggagttctagagccagattacatagatttgatttctgcaaaactgccatttactagctgtgtgaccttggaaaaattacttaactgctctgtgtctcagtttcttcatctgtaaaatgggtataataacgacctcataagttattgtgaaagtaaatgaataatccaaaaagctaatagcacaaagtgcttgggaaatattaaccatcatcatcgtcgttaccttatttttaatgacttataagtaatttatacagttaaattattttatcaatcaagatatataaaactattttcttagctgggcatggtggctcacgcctgtaatcccagcactttgggtggccgaggtgggcggatcacaaggtcaggagtttgagaccagcctgaccaatatggtgaaaccccatttctactaaaaaatacaaaaattagccaggcatgatggcgcgtgcctgtaatcccagctactcaggaggctgaggcaggagaattgcttgaacctgggaggcagaggttccagtgagctgggatcacaccactgcactccagcttgggtgacagagtgtgagactccatccaaaaaaaaaaaaaattattttttcaaagtggtatttttctaaaagtagtgcatttaatcttttcagttagtataatatgctgtcttctgtatttttattgtagtcatttagcttttcttagctttcaggagcattttattacatctctactacgtcagttaaggcagcctgagtggcattattaacagttttccttttttttttttttttttttaaatgttgcttaatgtagttttagggaattatactttttctaaaatttttttctgacataagtaccctctaacactgaaaggttgtcccctctcaactgcatgctgaatactggatcctagactcttgagagctaaataaagtatatcttttagctgcagtttcatattaaaaatgaatttttaacaatctgcatatttagatgaaatattagggaatagttactaaatgtacaaaatggtataagaaatgtatgttcgtgtcctcattatactccattccataaggtagtaaaatacttgtctgtttttcttacagaagttgattcaagtcagttgagacgccagttgtgtggaggaagtcaggccgccatagaaagaatgatccactttggacgagagctgcaagcaatgagtgaacagctaaggagagactgtggcaagaacactgcaaacaaaaaaatgttgaaggtgaatatattttttcttgaaaaattatgaatatgtcagaggaactaaaatgtagttttgtgaaacactgagcagtgtaccagaaattcttgttagggaactgggacctgaccttccccctggctccttgcccatctgagagtggaaatatttgatgaagttaggcagttctgatctactggaaagagcattggactaaagcaaaaaaaaaaaaaaaaaaaaaaaaaaaaaaggattaaatcccagtgctagtgcttatcaacattgtgtgtcctcgttaacttagtttcttagttttattttctcagctgtaaaatcagcagttactaggagcaatgtgggcgtgcagataaaactataggtctgagatctcattttagtaaatgttgttcaggtttatagcattttggatgtataacacatggttctcattttgatgggaattagtgaagaattgggtcacttttcatggccagaatagttaaaatacattttaaagtctcttctggattgttgtccatgagctgataggatggatacaatctaattcagtaaagtagccacagttttgtgtaccagttgaaggtggaggggctttctcctaacttaagtcagcattgcagttgtagagatgtacagctctttaacagttggttcattgtaaacattttcttctgaatattttggaagaagactgaaattaaaggggagatgaatgcagtggccttgagactaatgtttgggtatggtaggaaagggcaagcaaaagattcctgccgctgtttcttcctgacctggactgaaagttagtacaggttgagtatccctagtccgaaaatctgaagtgctccaaaatctgatacttaagagtgccgacatgatacacaaggatatgctcattggaacattttggactttaagatgagagatgctcaattagtaatgttttaacatttgaaaaaatctgaaatctgaaacatagcacaagtgtaggacataacatgcttgcctggcctaggatgtgttatagagcacctcaagttaaaggcatgcaatcttgtattttccctagctgagatgggaagtcaggtgtatttatcatactttgaacttcatctactccatagtataaaaactgctgtttctagtggttaccctgagctatcaaaaaagttaaattatttttatgttagataaaaaataattgataattgaaacaagtttaatttaaaaagtcaaatcaggccgggcgcggtggctcacacctgtattcccagcactttgggaggctgaggcgggcggatcatgagttcaagagattgagaccatcctgctaacacggtgaaaccccgtctctactaaaaatacaaaaaagtagctgggcctggtggcgggcgccggtagtcccagctactcaggaggctgaggcaggagaatcacttgaacccaggagttcaggttcagcctgtgcaacatagtgagaccttgcctcttaaaaaaaaaaaaatagaaaaatgagaagagtggcattgctttatatttttttgtaagtctctttaatgcttggtttaataggtgagctgtattcgcatacagaccagactgcctttagtctgttgtgatatcacatgtcttgtgcctctggaaaattccactatatagtcagaggaaatgaaagagaaaagggcaaggaacatcttagtactattatacaaatacttttgacttcacagatcccctgaaaggtttttggacccaggtgtccctgaatcatactttgagtactgttgttttagggcatatttggaaataaagaattttttttttttttttaagaattcttaagactttttttacactaggtcatctgacttggttttctttttaaaactttatgctaattgagcaggatgaaatacctttgaaaatttaagattatactccattagcttactttgtgtttgattcttatttacatgaagctcagaagatggcattatatggccaattctcaaagatattccttggttatatactgaattgtgtgaagatgtatcatctttatttaaagagtatagatgtctttgattttgcacctctaacttctaagcaaatgccagctactttcagagactttcttaatactctgagctgcttccatctcatttcccaaacttatcttgatctagatagggataaggtgagcaactgacccaccttatatataagtagccaaagaacaaggccggatgatttgagggcaacatgaagagaaaacaggtttagaaatcattccacttctttttgtcacttcagttcacttgtaattgtagcattttttaaaattgtagcatcgtttttaggtttgcataaactttgagtcatgtgactcagaagttcatgcaaatacacacacacacacacacacagagagagagagagagagagagagacagagacatgagagagagagattgagagatttgattaatgttgaaggtcaggtggcacactgtttctcttgacctttttccttttagttttttcaaagtcttctttcctcttttcctgttgtctttgttccttatctgcctacgtcttccagtggctcccaaaagaactcttgaattgtttgttgagcagctgtttattgaatttttgcagtgtggagaggcattgttgtagggactgtggaaagtccagtatgaatgaacagccccagcctgcaaggaccctttagtaactgaagtagcaagagaaccatttagagtcaccctatttagaaactgctccagattctaaaccaaatatgagtacaatttgaaaatcctacctaaatgatgtcacatttccctcagaagttattccactgaggtaatgttttttgctttaaaataacccataatgctacatatttcaggtattttcagttttgtgccttaactcccatgtgcatgtatcttaactagctaataactgtagtgacactattttgtattctgttttgtcataagaatttatttcctcccagtttctatgcattatttccaattatttttaaataactacacgaggctgggtgtggtggcccacatctgtaatcccaacactttgggaggctgaggcaggaggattgcttgagcccagaagctcgaggctgcagtgagctgtgattgcaccactgcactgcagcctgggtgacatagcaagaccctgtctcaaaaaaacaaaaaggctcaatgatattttattgttgctgtataggtttatttcaacattgctctgttgttggatttttccatttgcttttatgtcagatgctttagtgaaatctttatacatgtatctttgtttcttaaaattattccactgagataaagttctagaagtagaattgagtcaaagaatatgaacattattgtggctctcactgcatgttgctatactggttttcagaaaccctttaccaacttttaccagcagtaatgaaggaatgtaccaatggcactactacattaatgctactttagcgggtttaacatatgttagtatcttaaaattgcttatttgcatttctttggttatcatcaccagttaacttttacagcaggctttaaaccattagtattgttttgccagtttcattcattttcctttgtgaagaaagaatcaagtcctagatgtttacgactgggagtttgatggtataaaccattttttatttttaaggctctgttagttttgttgcttacagcttcactctacttccaagccatgttttatagtgtttttgtgtgatccttctaaaattaagtctaatccatattggtttccttcatttaaaaccttatttccttattggaaaaacttgaagctttttagtatgttttttggggtattttagctcctaacccctacccatgtttccaaccatgcttttttctcctttctctcagcctgagtttgcatgtattaagtcaatagtaatgtactgtgtgttatttatttacatgtaagccttctcttgaagcagtgactaggtcctggtcatcactgtatcctcaatatctgacagctgtatgttgaactgtactgaaaatgaaataccagagaaaaattttagatgttttttcttcttaacatttagattggtaactaaaagaatctgcatcttactattcactgcctcagtttgcttctctagatgatagacatgataacaaccttagatgattattgtaaggattaaatagatgatccatattagtgcctaaaacacttcttcacacaatattagtgcacaatacgttgttgtcattttaaagaactttttctctgagtttttaaacactgcagtgtagtagtatttttttttcctttaagttccagggtacatgtgcaggatgtgcaggtttgttacataggtaaacgtgtgccatggtggtttgctgcactagacagtgtagtcttaatttaagatttgggagtgcgacatttcacattttcggtggtgtgttaggatataggctatgaatatagttttgtacttgaagtttttgtttaccaagtattccttggaaaaattgttcagtatttctttttaaatttatctgtactatgggtatggtaccctcatcagatggttgtggggtaaattaagtcttgagcaaagctcagtccttaaaaataacgtgattttttttttttttttttttttttggagatggagtctctctctgtcgtccatgctggagtgcagtggcgtgatcttggctcactgcagcctccgcctactgggttcaagtgattctcctgcctcagcctcccgagtagctgagattagaggcatgcaccaccatgcctgactaatttttgtatttttagtggagatggggtttcaccatgttggctaggttggtcttgaactcctggcctcaaatgatctgcctgcctctgcttcccaaagtgctgggattacaggtgtgagccaccacacccggccaaaaacaaaataatgtgtttgatttgagttagctttacaggataaagggtcatatattctttccatgggttgggaagtgtgggttgggttaggggcgggaagtagaaccaagtagctttgtgggatgcataaaacatcttcattgctggaagaagcaggtcttgctctcaacaggcatatgaattatcttcctgtaccaagcacctgcatagcttcaggggattcaaaatagtatagtaaataatttttatcttcaaagaacttctattgtaattggaggagaaaactacccagaatgaaatactcagcaatataaaacaatggaggagccatgtgtgtttgcgtagaggcacgtgtattccatgccttgtggtctcagactgacttcacagcatttcttcatgggttattcttctttaaatccacaatattagaggcttatttggatgagaaagggcaagagtacagttaatcagaagcctttcccccacctctgctttcataacactagtaagataactagagaaatgatggaaaatgggtgtggaatctggttttttgagcagctgaacctaggagatggtgctctttaggaatttcagtagtcagtattttcaaagtgttgtgttcctgaactcacaaattgacagtttctgcagcaactctccatgtctgccttccaaattggtaagagtgttctgaatttctctatttttatatttgtataatattgctctggattagggtattgacttttggcataataataagacgtcatttattgaaagattagaatgaactgatactgctaatttcatttagtcctcatacaaatctaggaaatagggcctcttatagtccccattatgcagtaatgaaactggcacttagattgtcaattgccaaaggctacacagccagttagtggtggagcttggacttgaagccagtatctgaaaccaccattagtatgtgcctcccatagaaagaagacaaaaaatataaagtagttgtttgaaaagaagacgactgtcagtcattttaagttttgaagaggtgtggcttgagatagttggaaatactgaatgcataaacaggtcctgaagggcagcctgtttaattttttcataactgaatttgagaagatgacatcccagtgagatgtgtccagttcctaaatctgttgaaaaaaggaaatgcagacaggccctgtcctttgactgtcacattcatatcagtagtaataaattgtgaagtaaaacatctgaatgttttgccttccactctccctacaccagtactagttcattcctttgaaatttttttttcctgttttgtgtttagggatgggaggaagttgaatgagaatggctgtccacaggaaaaatgaaaataaattaggctttgctgcataatttaatgttcaaaaatgtagagcgtcccagtgctgggagtaaatgggtttaaagtttacattattagtctgtgcctggaagccatattttacctctcaacttggaaacatttgtgagcataatagttgaactatttgaattaaaaccaaatcgatgtgttttcaacaggatgcattcagtctactagcatattcagatccctggaacagcccagttggaaatcagcttgacccgattcagagagaacctgtgtgctcagctcttaacagtgcaatattaggtaagtaaagccaaataaggcacaatttcagttagattctctgaaaatttaagagagggtgtttgtactggcatttacactttggtaaaatcatcaggaaaatgttttctatatttttaaaatataaaaatacctaaaatatagaaaccccctcctttaattccagattcaaatggatttaaatagaataaaaacagtaagatggggtacaacttgggatgtttgggaaatagaagtttttgtgtgcatgtatgtaagcatttctggtagccacgaatgtctacttctctcattagaatgagagatttggtggtccttgtgtataattcaaaatactaccctaccagagacattccttacagccctctttagtgaaaggcattttctgccactgatttctaggctaggaattgggtggcattctctcgtttggctgctgtagaaggaatcggagaacgttaagaacatagactaataattgtcacaagagttaggctagaagggaacagggtacatttgaagaaaagaggtcaagaaaggttttgatggagagaatgaaaatggaagtaagggagtgaagagcttgaatatcagagaagctcaaactgatccagtagagggcaggattcctagctggtcctcccctgttacctggttcccaaccattttgcttgagctaaatttgcaatgggtagcagcagcctaagccactggtatcacagctcccaccatgcttatgaatatgggcacaaggggcttcctgatgacttgtgagtacccggcaggatcaagccttgatgtcacattctatttgcatttatattagccggattcaactacatgcccttacccaataaaaagggtgggtgaggaagagaaaagcaatttaaaaggcgaggcttagccaggggtgagcatgaagtgcgaaacgctaattcgatgttcgtttggttgccattcctatgagcagctcactgtagcgtttgtgattatagtatttatatactgaacaagtactttttatatgaattgtgtaactgcacatattgtgcatttctatataaatgtgatagggtcgattgtttacataaaacaagtttgagttttgggcagttctcatcaaaggtaatttatataaagagtgagttttcatttgacttcagagtctaattcccaggtaattgggactccagtctagtttagaagtctgtgctgtgctgtttggccctgcaaggttcagggacttttagtcacatatttcaaactagtttaggaagatgagggcagtgccacaaaaagtagatgaaagagtagtttagatagggagacttgcaatgagggccaggactcttacagcaagaatgtaaaggaagcaatgaaaagcattcatatttaagactcagtctgtttctttgcccttagaaaatttattaatttgttaaggaccaatactgaagtttgggaataggagtagtgtcctcagtgttgtagttctccggaatttaggatttgtatataaatgtgaattttctttggttaatgtgttatattttcattggttctacaaaattcatttagctccgttggtaaaagtaacttagtaataatgctggaattgtaaggaaaattatggtttactataaatgtctttttgaagttatattgtaggtaatcattaagacctaattattagatgatactaatctttaaagtgaccagttttcttacaatttagtttcttgagttcttcaagggaatttaattgttgagcaccattatctatagacacatatactcttacatattgtgctatattatgtagattcagccataaatagtgcttaatcttattaatataaatgtatgcgattcctgtaaaattaatgacacaattattaaactgctatagatgggcatgtatatgtttataaataccatgctatattatgtaggtccatctatatagtgttatgaaaatttcatacatccaaaaaagttaaagatgcatcgccagatgcttcctttggccaaaataaaattaaaaaaatattccctgtagatgtttgtctttgagcacggtcttccctgtgaaccctcaagacaccacactttctcatcaatctatgtgcccttttttgcacacgtttattcttaatcctgtttttgttttctcttctacctttaagtcctgaatttgcttctttctgatattgtgctttttcccttttggaaatttcctcttctttcttccaccatcaaattgcatcctctgaaccaagagtggagttaaaccatatgaagccttcctagccatgtgtcaactgtttttgccctttgttgtcaactgtgcctataaagaactgattagtaattttattgattagtttggacattgccttctcataaagagaaattaccagcttctgagtctggccacttttaccattagttcatttttttccatctctggcaaggaacaaattttgttaattattgcatttgtactacaaatgtctgacaaagaaacttatgatatgcaggaccctgaaaatttattggcgtttttttaaatgtctgaactgtccactgtaaattagcacctccaaaactgtggggtggctctgctgtatgttctctcactgtcaccaccaccacttactccccaccagcccaaataacattacctatatatgccttggagatggctaggcagcctgtttggtcctatccacagaggtggaagaacccatcagtggaaacttgtaatgaaaacctggtgccttttttagttttagttagtatcaactgactttgatcaaccagaagggaaataattccttactctccactccaaatatcagataaaaaattgtacctttcccatcatagttaatatggaagtattttagtatctgatactttaaaagtctgattctgccagagtttatcttatagttgaatacacaatacccacactaccttgtcagaatagtatgtccaaggcggcatctgtcttttgcttagaaaccttcatttgctgatatttcagagtggtatgggagtggtagtttttaaagtcattgcagtattctcctgattgaaatgttttttaaaatgtcttgctaattgctgttctcatttttaaattatttttcctcagaaacccacaatctgccaaagcaacctccacttgccctagcaatgggacaggccacacaatgtctaggactgatggctcgatcaggaattggatcctgcgcatttgccacagtggaagactacctacattagctatgcatttcaagagctcacacttatattgtggcatatagtcaacatggaagtagaccagctctgctgatttgaaatttagattttttaaattatgtactggggacaggtttttgtcgctttacattgcttcctagtttacagcatgatgcaaatgattttctaacttagtgttaggagaaattattttccatctttaacctcttagttgtctaagagttaaatattactgaatttcagacgttcaaattgatcatcacaaatcctttaaaacaattacctaaaagaaaccaaaaatcctgccttctttgtgggggaggggggagagaggggaaggaaatggaacaagttgtgtttgtgttagcatgtgggtgatgtaaacttcaaattgggagatgttccgacccccactcccatataagcattcaatcagtgtaacttgcaaaatgcataaacatccggacagtttgaatttatagtgttgatggaagaaatcatttttaatgtgtactgtaaaacttgaaatactcaggagctgagtgaatatgtttgttgctacttacaatcccgacctgttagtcccagtagttttgttttaacatggtctttttcaactttgtttcctgtttaactacagatgacttctgttgtagactcacaagtttaactgttgtattataacagtattacatgtcaacggtgtggttatgacctttatttatataaaaaccaaatatttagtcaatttaccgtgtcttaatttaatctttgtacaccttccatttttaagtgcttaaatgagtactatattgcaataaaatgtagtgatataattaaccagccattaaaaatttacttctacagatacagtgtcaattgagtttatatattaggtacttgcatactttttatgattactatgaaaattagagcaattaaaattaatggtttctacaattaatctgagttctacaacctaaaattgccttcagtttactggcatccctggattagggttagacctgatattgtggctgacacagaaaggcaacaggaaattaacttcattattttcatattcataatatggcatatgagactcaccaggcaagcaaatccccagactggttaaaagtaaaaatttaaaagctgttagctatattttgtgcactgaatctttaatagcaaattgtctacaggctgcagttagagactttgctggaatatccatttctccttttagtccgtgccatttttgccacccctctaacccggggagagtagaagaggtgctgttgctgatgtgggtatggcttgaattcagttaaatatattaaaaagaaaacaattccttcttaaaccactttttcctctaggattgcaaggcacagttctactccagaagaatgaaatgtggttgagcacttcctcaaataggtttatgatttttataatgatcctttaaaatgatctatgaatgatttattagataaattctatacatacaaagtacagattcttcatttagcattgatttacttcttagttttcatctttctgaccatccaccgtcttttaaacctcttggcattttgttttttttggattcctagaatataaagttttctgcagtaagtatattagaaaaacataattcaaaatttttttaattactctatatgaatgtaattactaaaactgggtgggcttattatacattagatgtatatacatactacattgacctgtttttcacaagtaacttaatatataagccattataagggggaaaagtataattatgaactatctccttcaaaagaacattattcaacatataaagctattagagacaggagaataaagctggatcttaccccaagcattattcaaaaactggacagcagctcttttcactggtaacctcttgttggcaagagacaggaacttatttactagaaaagaaaggtatttatcatttcacagttttatttgcagtaaaaagtgagaaaaatagtccataaaaaaattaccagtagtcctgttggttcctggcccatataatgaattatgtatgaaggcttgtgctgcttgttgccttgaatctctcagatcttggtcttttagccttacggccaagtagcttttattctggctgttgatcaatataaaaggttaaataagaattacacatgcttactttcttttttttttcttcctgagacagagtctcgctctgtcacccaggctgcgcgatctcagctcactgcaacttctgcctcccaggttcaagcaacttgcctgcctcagcctcctgaatagtgggattacaggtgcctgccaccatgcccagctaatttttttattttcagtagagacggggtttcaccatgttggccaggctggtctc

SEQ ID NO: 15945 - DNA, 31623 bp, Human
ccctagtccacatggagtccacgttcaagaataaagagtggggccaggcacggtggctcatgcctgtaatcccagcactttgggaggccaagacaggcagatcacttgaggtcaggagttcgagaccagcccggccaatatggcaaaaccctgtctctacagaaaatacaaagattagctgggtgtgatagcaggcgcctgtaatcccagctactcgggagactgaggcaggagaatcccttgaacctgggaggcggaggttgcggtcagctgagattgcgccactgcactccagtctgggcaacggagcaagactccaactcaaaaaaaaaaatgagctgtatgtatgtaggggcagatggtgacaagtgccaagcagacatgaagacatgaggggcgtgtgacttcagagtcgggggcagcctgagcaggtggcagaagagccatgcaggtacctaggggaacagcatttcaggaggggggaacagctagtgcaaaggccctgaggcaggacagagcttggcatgttggaagaacagcagaaaagcccacaggcggagggaaacagggcgctgtgagggcagccagtgaggacttgggctttccctgagtggaacaggagccatagagggctgcaagcagacgaggaacaggccaacagcgtcgcagccaccttctcacctctgtggggtgaggaggaagccaggataccagacggaagagggtagtggtggtagtggtggtggtggcggggagcggggggcaaggctgtgcagatgcagagaagtggccagatgcagggccacctggatgtgttgtgggggactcggtgtggggcaaggggaaggtgtgttcacctgtgcccctgaagttcaggtgcaggtgttcgggagccagcgcggctgctgcaggactcatccctgcatcctgcaccttgaaggccaggtgtggggacatcctgcgggctaggatggagggggggtgcagcagtgcctggggagatggcggtcctaacagaggtgaccagtgtcttcctcgatggccttcagtggctttgggcacagggccttgtcaatgaacagtgcattggaaagtcacttatggtggtcccaatgatgtcacagtcgatccagattgggagtccctcccacgttggcacccactcctgcagcctctctgcaactcatgtattaacctgatgttggggagcccccccccccgggttccccagggtcacagcagcaagtgaccctcagagaaccccctaatctcagcagcccccatcacacctttgtcccagtagcccgctgtgcagacctgcagaagaagatgcctgggaagtgcccagggtacccgcgtccaagctggaaccccattgccaagctcctggtgtagggcagagagctgcgtctccactaggtgcgcctcccaacgccctggcgtgggccgtgtccttttgaagaatgagaatgtttcattgagcctacgcctcctgaatgcgggagggccacgggatggtcccaagactgtgccaaggcgtgccaggcctcgggtccttgagaaggagcgagggctccaagaacggtgaggtcggagcgggccggggcgatggagcgggagcggcgtggcgtgctggagggccgggagaagcgggggtcgccagtcgaggggactgcctgctagtgtcccccgtgccccccgtcacgggcacggcgcggtggggtgggggagcggggggcgcgcggggcaggcatgggggcgcgacacggcggtgcgcggggtctctcggggtccaggtccaacgggcccccagctccggcccccgcgcctgggtttctctgctgggaaacgggcaggggcgcgggcccgcctccagggcgccccgcgtccccgctggccgccccccagccgcgcccccagcggggcggagcttgcgccggtcccgcccctccgccctccgctctcccgcccgcgcgcccccggcccagctgcggcgcgtgacgcggggcgcgcggctccgtcggctaccgcgggcgggcgcaggcgacgggcacggcgggcgagcgggcggtatggcggcggcggggcccgcggcggggccgacggggcccgagcccatgccgagctacgcgcagctagtgcagcgcggctggggcagcgcgctggcggcggcgcggggctgcacggactgcggctgggggctggcgcgtcgcggcctggctgagcacgcgcacctggcgccgcccgagctgctgctgctggcgctcggcgcgctgggctggaccgccctgcgctccgcggccactgcgcgcctctttcgggtcagtgtggccgggggccgggacgaggggaccccggactgggggaagccgggaccggggacctggggccgccggcgcgttcctttcttccagcgctggctgctgcggatgaaggggtcgccggaacgtgggtgggggcctcgggctggagaggcccaggacgttggagccccaggataaggtctctcgggccgccgcgcgcccccttcagacagtgctgcgtgggggaaccgggtagatgcgggggtgtggccgggctggggtgagtctgggacatggggggcccgagacaggtgggatgtttgagacgtgggggaccgaggcacggccctttccggtcagtttgggaccagggggccccgcgcggtggatggctccggccaccgcgcgctctttccggcagggccgagccagacactgagaagcccaggaccgggaacgggagggctcggcgcaccgcggcctgcgccatgcgcctccctgccatgcgggctgcgccccggcccggagcgaggtccgctgcccgttttctgctgggtccgtgcggcggcggggccggcttgcccgctgtaatcgggaagaggcaggagctgcccggtcgctgccttgtgcctatctggggtcagcgccaccctccgaccagggatggcaagggcctgggtgctctggccacgccagtggtcgctcccttggaggtgacatggcccggggcttcagggttggactgtgctgcctccaagaggcgacagcagaattccccagtttctgcggagaccatcgcccctgcgagagagtgaccatgatggtgacattggcgcctgaccccactcacttccctggggaggggtcgctgtggcaggagctggttggaaggtgtttgggcctttagcttggcctggacacccccgtggaccagctggtgtcaccccgcccgtctggctggagggtgcagggacaatgtgcccagcgccaacaaaggggcctttctctgctggccgggaagaggctggcccttgtgaggtcgatgatgggatgttgtctgactgccactctccccactcccgtccccatatcacccacatgagggagagaccccagccacacccctactgtgggagggggagacagggctgtccagggcccctccctgggtccgcagtggtctttatcctgcttgttgcccctgccttcttcccagtttccagctgggaagcccgagacccaggagggcaagccgtcccccacccctgcgggacaggaggatgtggcggctggtagactaccagggccgagccccgggggccctccccagccccttgggtggggtgctcgccccatttcgaggctcgcccttcctcagaaatgggtggaggggctgccgggtgttccaaagctgatcttcttggcagcagcctggttgccaggggttaccggagccggctccagctgtctccatgacaactgctgggtgctctgggctccggccccctcagcctctgggaagggggtgggacttgtccaggggtggggcttggccgggcagctctggagccgcgccccgccacccacccacccaccgcactccccaacccctgccttggagccagcagcttcctctgcactcccaatgtcccctcagggtctcacctcgcctgtgacaccttttccgcctcctgtcccctttttctgcctccagcccctcctcccctttcatcgcccccaggttcccatgtccccgccacaccttccccctagtctctcccagccctctagcctctccagaatctcccactgagggggcggcttcctcacaagttcttcctctcccctctgtgtcggtcccatggggctctctgtgtttcccaagatgcccccatataaccccctccatgttcccttcaagggtcacccccaccagcccaactcccttgggctgacgcatccatccgtctccctcatcgtaagcccaagtgtcccccttctggcccccagagccctcctgctcccctcggggcctcccccctcactcccctcccagcaccgcggcggccggacagctgggcactaagtttagccttggcaggcgcctgtgggctctgtttatgctccaggtggctgtgggcatgggggacaggccttcccagtgctgcccggcctggggagtccctgggcctcagtttccccaccccaaaggagcagtctctggcccccagcaccaatggctgcccgcctgtcttctcccccatagcccctggcgaagcggtgctgcctccagcccagagatgccgccaagatgcccgagagcgcttggaagtttctcttctacctgggcagctggagctacagtgcctacctgctgtttggcaccgactaccccttcttccatgacccaccatctgtcttctacggtaggggccctgaggggatggccgggagggctctgcttaaaacacaaagacgccaggcttgtggtcccagctactcatgaggcagaagcaggaggatcactggagcccaggagttggaggccaaggggagctatgagcacgccactgcactccagcctggacgacagagtgagaccctgtcttgtatcaaaaaagaaaaagagggccaggcgcagtggctcacgcctgtaatcccagcactttgggaggccaaggtgagtggatcacgaggttaggagatcgagaccatcctggctaacatggtgaaaccccgtctctactaaaaatacaaaaaattagccgggtgtggtgggcgcctgtaatcccagctactcgggaggctgaggcaggagaatcgcttgaacctgggaggcagaggttgcagtgagccgagttcgcgccactgcactccagcctgggcaacagagcgagactctgtattaaaaaagaaaagaaaaaaagaacagtgtaaggggatgcttatcagaatcagagctcctatgggtgtctcagaagttaagccagccccaagacaaaggtgatccctggggacaggaaagggggtatctggccgtgttggagctcagggaagacatcctggaaggacccctgtgtgggtccaggcaggcattccaggtgtcggtaacagcacgtgcaaaggcccggaggcactcacgtttcatggggacaggaggagggtggctgcagagagctgaggcagcagcttgagttctgttctggatgtggttgtttttctttttttgagatggagtctcgctctgtcgcccaggctagagtgcagtggcgcgatctcggctcactgtgagctccgcctcctgggttcacgccattctcctgcctcagcctcctgagtagctgggaccacaggcgcccgccaccacgcccggctaattttttgtatttttagtagagacggggtttcaccgtgttagccaggatggtctcaatctcctgatctcatgatctgcccgcctcagcctcccaaagtgctgggattacaggtgtgagccactgcacctagcctgaatgtgatgtttttaagcacagcatggagaggattgggttttgtggatgacaaaatgcttcctctggctgccctatggaggtgggagggtcccctcggcttgcaccatcttggtgaggagataaacatgatgaagcctggtgcgatggctcacgcctgttatcccagcactttgggaggctgaggcaggtggatcacttgaggtcaggagttcaagactagcacggccaacatggtgaaaccctgtctgtactaaaaatacaaaaataaattagccaggcatggtggcgcgtgcctgtaatctcagctacttgggaggctgagtcaggagaatcacttgaacccgggaggcggaggttgcagtgagccgagatggtgccactgcactccagcctgggtgacagagcaagacttcatttccaaaaaaaaaaaaaaagatgagaatgagaagtgggctgggcgtggtggctcactggctcacacctgtaatcctaacactttgggaggcggaggtgggaggattacttgagcacaggagttcaagagcagctggggcaacatggtaagacctccatctctacaaaaaattagcctggtatggtggggcacgtctgtagtaccagctacttgggaggctgaggtgggagaattgcttgaacccggtaggtggaggttgcagtgagctgaggtcatgccactgcactccagcctgggcaacagagcgagaccctgcctgggggttgggggtgtggaggggaagatgataagaagtggctgtgtccaattgattggagtggatgtggcctgagctccgggtgggctgggcagggaggtgactgcagcgcgctctgtgtgacctgtcctggcagagaatgcagggcagggccggcatcgccactgggcaggctgatgtaggaaaccccatctgcgatggggcagtgggggctgcggcttctctgccctgcgaggaccaccagggctgtgggccagggacacacatgatagctgtttcctgccatgtgatgggaacagcctagagggctcctggtggcacggagcccagagtgtacagtggatgtgccacccatggggccagttttcccatgtaacacaccttgatcccctagaggggaggtgttagctgttgctcagttttccttctagacggatgacccatgatcgaactctcataacttttttttttttttttgagacagtctcactctgtcacccagtctggagtgcaatggcacgatctcggctcactgcaatctccacctcccaggttcaagcgattctcctgcctcagcctcctaagtagctggaattataggcacgcgccaccaccctcggctaatttttgtatttttagtagagacgaggtttcaccatgttggccaggctggtctcaaactcctgacctcaggtgatccgcccgcctcagcctcccaaagtgtcaggattacaggcatgagccaccacgcccagcctctcttaacattttgggcatggacttgcctttagctgcttttttttttttttttttttccccagacgcggtcttactctgttgctcaggctggagtacagtggcacgatcacagctcactgcagcctggacctcctgggctcaagcaatcatcccacctcagccttctgagtagctgggaccacaggtgtgtgccaccacccccagcgaatttttttgtgttttttggtagagatggggtctcactatgttggccaggctggtcttgaactcctggcctcaagcagtcctcccacctcagcctcccaaagtggtgggattacaggcatgagccacctcgtccagccttagttgctttttgtaaatgacactcacaagttagctgattatttccatgtctatttattgagcgactactgtatgccacagctgagacacagctagtaacgggtcagagaaagccctgtgccctcatgaagctggccgtgtggcaggggcaacagacggtgcagtacgcagtctatcaacagcaataagtgtggatgagaaaacttgtgtggagagaagaggcagtgtgctgtgttggggaggtggggaggggcagtttttagcagggacaggggtggccccacttaaggggactgagtgagggcctggaggtgcctggagcaggcaggagaggcagggactgctgtccaggcaagtgggggccatgccatccaggcctcggaggccacggtcaggatttgttacttatctgtgggctgggagcagaggagggatgtcaccctgggttgggcatctaccccaggggtccaggagggggctgacagcaggagctggagcctgaagggactcccaccaggattgagctgaggggaggggatgggagcaaagtggccaattttagaaatgtttagaaggcagagctgatagtatttgctgccaccctagaggtggtgtgaaaggaagagggtgaggatgatgctagggtcttgtgagatgggggctggtcagggagaccaagattctggattcagggatggagacaaggcaggggtggcattgagtgtcccaacagcaggtgggatatgagtatgaagaggtgggacaggccaggtgcggtgactcactcctggaatcccagtactttgggaggccaaggtgggaggatcacttgagcccaggagttcgagaccaaccttgggaatatagtgagacgccatctctacaaaaaataaaaaaataaaattagctggatatggtggcgcgtgcctgtggtcccagctcctggggaggctggggcaggaggctgaggctgaggcttgagcccgggaggtcgaggctgcagtgagccaagattgcaccactacattccagccaggttgacagagtgaggccctttctcaaaaaacgagggagaggagatttgagacctctgaactaagccaggacttcccccctatcctgtggggaaggagctacaggacggttggggggcctctgttggaaaggtgggcaacagatccagcagggtggccctgggcaaaagctcgggctcacatgtttctggagagtcaggatggagaggatcagggcatttcagagtttcagacaattttcattgaaattctggaagagggctgaagtgggccgggtgcagtggctcacacctgtaatcctagcattttgggaggctgaggtgggcggatcacttgaggccgggagttccagaccagcctggccaacatggtgaaaccctgtctctactaaaaatacaaaaattagccaggcgtggggatgcatgcctgtaatcccagttactcggcaggctgaggcaagagaatcgcttgaacctgggaggtagaggttgcagtgagtcgagatcatgctactgcactccagcctaggcgacagagcaagactctgtctcaaaaaaaaaaaaaaaaaaaagaaagaaagaaattctggaataggggagggttttttgtttgtttgttgtttgtttttttgagacagagtttcgctcttgttgcccaggctggagtacaatgccacgatcttggctcaccacagcctctgcctcctgggttcaagcaattctcctgcctcagcctccggagtagctgggatcacaggcatgtactaccacacccggctaattttgtatttttagtagagacagggtttcaccatgttggtcaggctggtcttgaactcccgacttcaggtgatctgcctcccttggcctcccaaagtgctgggattacaggcatgagccaccgcacctagcctgtttttttttttttttttttttttttttaagagacagggtctcactctgtcgcccaggctggagtgtggtggtgtgatctcagctcactggaacctttgcctcctgggttcaagggattctcctgcctcagcctcatgagtggctgggattacaggcacgagccaccacacccagctaattttttttttgagatggagtctcgctctgtcacccaggctggagtgcggtggcaccatctcagctcactgcaacctctgcctcccaggttcaagcgattctcctgcctcagcctcccgaatagctgggactacaggtgtgtatcaccatgtctggctaattttagtattttagtagagctggggtttcaccatgttggccaggctggtcttgaacttctgacctcaagtgatccacccaccttggcctcccaaagtggtgggattacaggcgtgagccacctcagttggcctccatttcttattgaggtaaaatgtatgtaacttgaaattaggcattttagccaatcacaaaaagacaaatactatgtgattccacttatatgaggttcctacagtcatcccactcatagagacagaaagtgggatggggggtgccagggctgggggaggggaatggggagagactgtttaatggggacagaggactgttccattggggaagaaggagaatgttctggagatggctgctggtgatggttgcacaataatgtgtacttaacaaatggcttagatggtaagtttttgccatataaatcttaacacaattttttttttttttttttgagatggagtttcactcttgctgcccaggctggagtgcagtggtgtgatctcggctcaccacaacctccgcctcccgggtttaagtgatgctcctgcctcagccttcgagtaggtgggattacaggcatgcgccaccatgcccagctaatttttgtatttttagtacagacagggtttcgccatgttggccaggctggtctccaactcctgacctcaggtgatccacctgcctccacctcctggccaaaaattaaccattttaaagcgaacagttcatcagcttttagtccattcacagtgttgttcaaccaccccctctgtctaggtctggaacattatcatcccccacaaaaggaaaccccgtcccattagcagtcactcaccagtcctctcccccagcccctggcagccaccaatctacttcctatctctgtagatttgcctgttctgggcatttcagatcactggagtctcacactgtgtgaccttttgtgtttggcttctcttactcagcatcatgtttttggggttcacccacattgtagcatggatccgtgcttcattctttttcatggctgcatagtattccactgtgtggaggtaacctatctattcttcatccatccactgatgcacattcgggttgtgtctgccttttggttgtgtgctgctgtagacagggacacatgagtatctctttgagtccccgttttccattgtcaggcacacaccctagtggacttgctgggtcatggtgaccgtttgtgtgtacatggccttcagggctgagtgaggagagtggacaaacagtcatgggggccagggatcgctggagagatgtgggcaggagacaacagtgcctggactggggtgggggtggcatgggccaaagaggggaccctggatgggggtcctagtgtaactcggctgcagaaggggccaggccgagatgaaagttgtcgcagaggcggttcatggggcatctggaggcagctgggctgcagggcaggtcaccaaggcaggggccaggaagccgcagatggaggctggagggtctgtcttgggggtctgcagaaagggagtggccagagaacagggagcaacccagagagttccaggttggtgtgggcagagcacagcatggcttcccgcctttttttgttgtttgtttgtttgtttgttttgttttgagacagggtctggctgtgtctcccaggctggagtgcagtggcaacatcttagttcctgccaccacctctgcctcccttcaggactcaagtgatcctcccacctcagcctcccgagtagctgggaccacaggcgcccaccaccacacccggctaattttttgtatttttagtagagacggggtttcactgtgttaaccaggatggtcttgatctcctgaccttgtgatccgcccgcctcggcctcccaaagtgctgggattacaggcgtgagccactgcgcccggccccagctaatttttatatatttttttgcagagacagcgtctcaccatgttgtccaggctggtctcgaactcctggactcaagcaactctcctgcctcggcctctcaaaatgctgggattacaggcatgagccaccgtgcccgtccagagcatagcccttgaatttggtgtctggcagcctctggggatgtggctgaggagaggaggaggtggacgtggtggggtgggctggtgtgtcacccatcacctgagcgtggtggtcaggtgcaccaggaggcaggaggaggggaaggtgaggcaggacccgcttggcgggagaccctgcgcttggtggcatggtgtgcccgggcatggcaagactccgtgggcagccgcatctgtcagggccagggatttgcagggagtgggcccaggacacccgcaaggcagggctctgttaaagacaggaagaggccgggcgcagcggctcacgcccgtaatcccagcactttgggaggccgaggcgggcggatcacaaggtcaggagttcaagaccagcctggccaacatgatgacaccctgtctctactgaaaaaaaaaaaaattagccaggcatggtggtgggtgcctgtaatcccagctacttggcatgctgaggcaggagaatcacttgaaccccggatatggaggttgcagtgagccgagatcccgccactgcactccagcctgggctacagagcaagactccatctcaaaaaaaaaaaaaaacaaaaaacaaaaaacgagaaggggcgctgggctgggtgaggtggctcatccctgtaaccccagcactttgggaggccaaggcaggaggattgcttgagcccaggagttcgagatcaccctgggcaacatggcaacacaaaaattaaaaaagaaataaattatctaggcatggttatgggtgcctgtggtcccagctactcaggaggctgaggtgggaggatcacttgagcccaggaggtcgaggctgcagtgaactatgatcacaccactgcactccagcatgggccacagagcaagccaactctaaaactatatataaaacattttaaatgtatataatgataataatgtgtctatattagttcagcatttgtagcaaatataccacttaaagccagggaaatggaaatctgtgggtatgttggggcagaagaaagaaaggaactttctgtcctatctgctcaattttcctagaaacccaaaactcttcctaaaataaaaatccctgctggccgggcacggtggctcacgcctgtaatcccagcactttgggaggccgaggcaggtggatcacctgagatcaggagttcaagtccagtctgtccaacatggcaaaagcccatctctactaaaaatacaaaaaaattagccgggcatggtgtccagcgcctgtaatcccagctactctggaggctgaggcaggagaattgcttgaacctgggaggtggaggttgcagtgagctgagatcgtgccgctgcactccagtctggtgacagaacgagactctgtctcaaaaaaaaaaaaaaaaaaaaaaaagacggctgggcggggtggctcacgcctgtaatcccagaactttgggaggccgaggcaggtgaatcatgaggtcaggagatcgagaccatcctgggtaacacagtgaaaccccgtctctactaaaaatacaaaaaattagccgggcttggtggcatgcacctgtagtcctagctactcaggaggctgaagcaggagaatcgtttgaacccaggatgtggagctgagatcatgccactgcactccagcctgggcgacagagggagactccgtctcaaagaaaaaaaaaaaaaatagaattgggaatggaaagccagcaatcagacacgcatggttacctgggtactgggaggacacgtgtggcttggagggtgtcaccgggtcatggaggcgatcgtctagaggcttcgcagggccctgactgtgagatttggctctccccagactggacgccgggcatggcagtgccacgggacattgcagccgcctacctgctccagggaagcttctatggccactccatctacgctacgctatacatggacacctggcgcaaggactcggtggtcatgctgctccaccacgtggtcactctcatcctcatcgtctcctcctacgccttccggtaaggacaggatcgggtggcagggggccgaggcacagcccacacagagtgcggaggctgatgttgcggcggggcacagaggaggccgtggaggggatcacatcaggtcggagtgctcagggttccaaggtcagagtgctcaggggtccgacgaggggacagaccagaggcaggaaggctgaggaggggatgtgggcccggagattcctgagggagattccgctgggatggggtgaaacaggcccagagagccatagtcaccccaccccactcacccacccagctcttcagacgctgcccttgaccagccaggtcacacacccaggagttcctgagcacctgccacgcccaagcaatgggggcatggctgtgaacgcagctgacacaccctgatgttctagagccaaccacagccgtcagtgagcctttcagatggagtctgtccaaacctcaccatgctgtgtgcataaaacccacccggcttcaaagccttcacatacaaacgagtgaaaatatcttatccacccttttatttctctctctcttttttttttgagacaaggtctcactctgtcacccaggctggagtgcagtggcgtgaccattgctcactgcagcctggacctcctgggctcaagtgatcctcccacctcagctccccgaagtgtggggattacaggtgtgcgccaccacgcctggccttgttatctcgactccatattgaaatgacaatattttggatatactgaattaattagaatgcattattaaaattaatattacctgttcttttctctttcttgttaaatgtggccaatagaaactttaaaatgaaatacactgctcatatactattcctacgggactagctgctctagctgcgataatagggtagccacgccccacaaatatagagcaacaaagaggtggccctttcaactttaattagacttaaataaaactccaggagcagtagctcatgcctgtagtcccccagctacttagaaggctgagtcaggaggattgcttgaacccagaagtttgagttcaacctaggcaacgtagggagaccctgtctctaataaataaatttttaggctgagtgcggtggctcacgcctgtaatcccaccactttgcgaggccgaggcgagcggatcatgaggtcaggagatcgagaccatcctggctaacacagtgaaaccgtgtctctactaaaaatacaaaaattagctgggcgtggtggtgggcgcctgtagtcccagctactcaggaggctgagacaggagaatggcatgaacccgggaggcggaggttgcagtgagccgagatcatgccactgcactccagcctgggcgacagagcgagactccgtctcaaaaataaacaaacacgtacataaatacatttttaaaattactttatcttatttatttacttacttatttttttgagacagagtctcgctctgtcgcccaggctggagtgcagtgccatgacattggcttactgcaacctccggctcccaggttcaagcaatcctcccgcctcgcctcagcctcccaagtagctgggattacaggggtatgacatcacaccggctaattattatatttttagtagagatggggtttcaccatgttggccaggctggactcgaactcctgacctcaagtgatccacctgcctcggcctcccaaagtgctgggattacaggtgtgagccaccacgtctggttagtttaaaaaataattttaaaaagcccctattccattcctcagccacacaagccacagttcaagggctcagtggccacaagtggctggtggctcccatgttggacagtacaggtttagaacattcccatagttctagaaagttctataattcaaggctctctagagggcagaatcagatgatagaaccaaaaaggaaggaaggaacagttcatttgaaggtgataagaattatggagaaaaggccaggtgcagtggctcatgcctgtaatcccagcactttgggaggccgaggtgggtggatcacctgaggtcaggagtttgagaacagcctggccaacatggtgaaaccctgtgtctgctaaaaataaaaaaattagctgggcatggtgatgagtgcctgtagtccaagctactcaagaggctgaggtgggagaatcgcttgaacccgggaggcagaggtggctgtgagccgaggcattccagcctgggcaacagagtgaggctgtgtctccaaaaaaaaattgtggctgcaggtgttaggtgttagttggtctgggggtgacagatgagcagatgagcagatgagcagagactgaaaggagtgaagggaggtgctgaatgccaggcactggcatgctgggtcatggggacagcacgtgcaaaggacctgtggcaggagcccaggagctgtcaggagacagagcaaggaacagggacttggtgagagacacttccccacgtccagggtgaatccaggaccctcgggcagctcatctgtcagatggagactctgtggaaggacaggggatggccttcgggcttattaagatcctaatggggccgggcacggtggctcacacctgtaatcccagcacttcgggaggccaaggcgggtgggtcacatgaggttgggaattcgagatcagcgggaccaacatggtgaaaccccgtctctactaaaaatacaaaattaactgggcgtggtggcacatacctgtaatgccagctacttgggaaggctgaggcaggagaattgcttgaacccgggaggtggaggttgcggtgagctgagatcgtgccattgcgctccagcctgggcaacaagagcaagactctgtctcaaaaaaaaaaaaaaattaaaaaaaaaaaggatcctgatgggctgcggcagaggcctttcctgcagcgatggccaggctgcacgtacagacctggaagtctcatcatggtggtggtgtccaaagtgagggacaagctcatggaggatctggacacagagtaccccaggcctgtgagagtcgggggtcatagagggtcagaggtcaccaagatgaggaggggccagcaaggaacttccaagaccgggcacagtggctcgcgcctgtaatcccagcactttgggaggccaaggtgagaagatcgcttgagcccaggagtttgaggccattctgggcaacatagcaagacccagtctctactaaaaattaaaaaaattagccgggtgtggtgttgctttcctgtagtcccagcttctccgggggctgaggtgggaggatcacttgagcctaggagtttgaggctgcagtgggcccgatcacaccactgcaccccagcctgggccacagagcaagaccctgtctcaaaagaaaaataaacttccagggagctccctgggccacatggggacactgaggcagggaagatgagggtctggttgggggtgcacggctaagtgggggacagtgaggaaagggcatcctgggaagtggagatgggcagggcaggcgaggcaggaagggtggctttgaagaggcccacggggagcctgaggtgtagcccagggactctgctgggggccttagtgcagagtggaggtcccccaatgtgagctgccctctcctctctgcctgctgctcccccaggtaccacaatgtgggcatccttgtgctcttcctgcacgatatcagtgacgtgcagcttgagttcaccaagctcaacatttacttcaagtcccgcggcggctcctaccatcggctgcatgccttggcagcagacttgggctgcctcagcttcggcttcagctggtgagtggtagggagtgctgggcagggagggaggtgtggcctggtgaggtgggtgtgtccagaaaaggggcgggaccaggcagggaaggaggcggggcccagtgaggtgggtgtgtggcatgacaggggaggggcctcatgatttgggtgggactgaaggggcggggctatacaggaaaggagtaggacaagggtggggccaactgagctaggagtggggctgggcagaaaaggataagccaggtgaggtgggtggatccaggaaggggaggggcctggtgagataggttgggccaggcatggaaggggaagagctagactaatacagagcaagccaggggtggggccaagcagggttggggtagggctaggcagagaaagaggtagggctttggtgtggtggggaagacctggcagagaaagggaggcgctgtgcagggaaggaggtgggggcttggtgaggtgggcggggcctggcagagaaggggagggactgggcagggaaggaggtggggccttggtgaggtgggtggggcctggcaggaaaggggagggactgggcagggaaggaggtggggtttggtgaggtaggtggggcctagcagagaaggggagggactgggaaggggaggaggtggggccttggcgaggtgggtgaggcctggcagggaagtggggggccaggcagggaaggatgtggggccttggcgaggtgggcggggcatggcaggggaggggaaggacagagcagtagtagaaacaggtgggcagaggtgggcaaggatgggataagggggcaagggtgggtctaggacgggataggacagggactgggtagggcaccgtccccctccacccacggcctcctgactcctcccaccgcaggttctggttccgcctctactggttcccgctcaaggtcctgtatgccaccagtcactgcagtctgcgcacggtgcctgacatccccttctacttcttcttcaatgcgctcctgctgctgctcacccttatgaacctctactggttcctggtgagtcggccccggctctcctccacagtggcggtcccgtcctcgtcccaatccctgtcccctcctcaggcagtcccggggaggggcacgttaggtggcagacagcccgtgtggagggcccgggacaggagcacatggctgtcagcagggcagtggcgtgggggctttcttctcactggcacctcccctctcctctcgcagtacatcgtggcgtttgcagccaaggtgttgacaggccaggtgcacgagctgaaggacctgcgggagtatgacacagccgaggcccagagcctgaagcccagcaaagccgagtgagtgtggaggggcccgcaccccgcgttccctcctttagtgtcacccgtccaagcgtgttcgtgggcaggcccccaagacccagcagcagatgaggccgacgcggatgctgccccccaagcctactccaaaacagagactgcaataaaggcgtggacgatgtggccagtaccctgaaggacaggacagtgaggaaggggagggagaggctggggaggggcaggcagggcgacaggcagggtctcagcggtagggacactgagggccaggcctagtggctggcgtggcgggagtggcgagccagggccctgtgggtggtgaggagtagttgctggccagcctggatgacgacctctgacccatgtcgccactggagctggtggcagtggggctggggaggaaggaacgccaagggccgcagagagaacccaggctccatctgggccgagacatcctggcctctgagtctgacaggggagcccactgcccggccaaacaggagctggggctgggagctcagactcagtccagcccaggtgggagtcctggggaaggagatagcccacgagcctcaccagccctgggtgacagccagatggtgtccgaagccccaggcctggggcaggcagggggtgtctgggccagggatgaacggaggccaaactgggtaacaagcagagtcgggtgtgcagtgtctcataggcaacgtgaggagtgtttgagcaggagccggggcaggaggttgtggaaggccctggaaggtgccgaccagccaggccctctgatttggccggtgggggccatcggtgacgtgggaacgatggtttcagggaagcagtggctcagagctccgtgacgttttttggaacgggaggtgcgagatgcagacatttaacacatccggggctgtagccaggcagaggagcgtcagaccccccaccctgtttggaagggagaacccatcagattcgccttgggtgtagatgaaacagaaataaaagaatcaaagacgactcaagacttttggctcgagctggtgttgactgagatgggattggggcagagggtcacgtgggttctggcagatgcggcgttaggagcctccttttgagggtgttagattgcgctgtcctttgagcatgagtcaagaattctttttttttttttttttttgagacagggtctcactctgtcgtccaggctggagtgtgcagtggcacgatctcggctcgctgcaacctccgcctcccaggcccaggaagtgatcctcctgcctcagcctcccaagtagctgggcccacaggcatgcaccaccatgctgtgctaacttttgtattttttgtagagctggggtttcctcatgttgctcaggctggtctcaaacacctgggctcaagtggtccacatgccttagcctcccaaagctgctgggattacaggcatgagccactgcagccggcctgagtcgggaattctccagagatcagctaggtctctccaaggagtcttccaaaggtggcaatggctaaagggggcaccagtttggccacatctagacaccaggaaggtcctcttgctgtagaacagtgagctcatggtggggacatcctcggaggtgcagaacccagaacaagaggaagccagacctcccagccccaccagtgtctggctctgtccccgctgaggatgtctcatcagaacacagggtaagagctggcatgtcctctaggacagcaaagcatgcaccctgtacagaagtgccagagagtatcagggaacaccctgtgatgattgatcccataggcaccaccagcagaattcgattctccaaggacagccggagttagtgcagttgggtataaaacaggatgggacgaaggcagtcaggctgagagacgtcttccaaaagagcccgtcaggatgcccagaaactgtcaagatcatgggaatcagggaaagaccgaggaacaatccagggtcagaggagaccaaggagacagatgccacctgcagcatgggctcctggaccaggaaagggaccttcaccaagaagctggtgaattcaaatcatgtggagagtttagttaatagcaaagcaccaatgtcggtttctttagctgcaacccatgtgccatggaaatgtaagctgtaatgtcaggggagctggatggaggtgacaggagctccctctactccctttgtagcatctctgtaaatctaaaattaatctaaaataaaaaagtttggccaggcgtggtggctcacgtctgtaatcccagcactttgggaggccaaggcaggaggatggcttgaggccaggtgttcaagaccagcctgggcaatatagggatatgcagttcctacacacacacacacacacacacacacacacacaacccaatcaaaacaaaacaaaacaaaaaacagccatgtgttgtggcacacacctatagtcccagctactcaggaggctgaggtgggaggatcacttaagccagggagctgcagtgagccgtgatcacaccactatactccagagcaacagagcaagaccctgtctcaaaacaaagaaaaaagacaaaccaaaacaaacaaaaaagtttattttaaaaacaggtatgagagaccatcaaaaatggcattgaagaccaggcgcggtggctcacgcctgtaatcccagcactttgggaggccaaggcaggtggatcacttgaagtcaggagttggaaaccagcctggctaacatggtgaaaccccatctctactaaaaatacgaaaaattatccaggcatgatggcgcacgcctgcaatcccagctactcaggaggctgaggcaggagaatcgcttgaactcgggaggcagaggttgcagtgaaaaaaaggcattgaatgttactttcccaggaactctataacaaaaggaacacaagcttgtgacttaaaaccacaggaacttattctctaatatttctggatgacagatgttcaaaatcaaggtcagctgggcggtgctccctctgggaactctaagcgaggatcccctccttgcctcttgggcttctggtggctccaggcatttcttgttttatggctgcattgctccagtctcagtctccgtcttcccagggctttctcttcttcttttctgtctctcttctctctcataaggacacttatcatggtgaagcaggtcagggtcactggtcttgttgtctaaggtgttgtctgagcttgtggtctcatgaccaagaaaattaaggaacgtggccacaaaggccgaggttggagcaaaagtttaataaaagaaagctctccacagcagagagaggattccaggtggattaccgttttaacagttgaatccaaaagcttcttttttttttttttttgagacagtgtctcgctctgtcgcccaggctggagtgcagtggtgtgatctcagctcactgcaacctccgcctcccaggttcaagtaattctcctgcctcagcctcctgagtagctgggactacaggcgtgtgtcaccagacccagctaatttttgtatttttacaaatggggtttcaccatgttggccaggctggtcttgaactcctgacctcaagtgttcctcctgcctcagcctcccaaattgttgggattataggcgtgagccaccgcgcccagcctgtttctttctttctttttttttttttttagagacggtcccactctgtcgcccacgctggagcgcactggctcaatcatagtccactgcagcctcaacctcctgggcttaagtgatcctgccgcctcagcctcccaagtagctggaaccacaggcacccaccatcatatccagctaattttaaagtgtttttgtagagacgagatctcactatattacccagtttggtctcaaactcatggcctcaagcaatcctcccacctcagcctcccaaagtgctggcattacaggcatgagccactttgcctggttccgaaaattcaatcaggattggaacccttcagaaaaccaagaccgagaaccacttttaggtaactcaggaggcgtgaagcaaatcagagagcaattaattggcttgatctcttcctcaccccatctcaccccattgctgcttcttgagcagcctcacctccagggtcccctcatctgtaccccttcccctgaattccctgtcctcctcatggccctcaggggacccctggtgatgtgggtagccagtacccttctctcctacactgacgcccgtagcttccttgtggtcactcccatgtccttgtcatgactcagcccctctgtccaaagtccccattgccctctcaggggctgccgggaccggccatccgttgagacactctcacctctctctggatctggtgacctgcactcaatgctccgtaaatcccattttcacctctgctgcacctgccactgcccctgcagcagttctaaagaactgggctgggcacggtgactcacacctgtaatcccagcactttgggaggccgaggctggaggatggcttgagcccaggaggtcaaggctgcagtgagccatgactgcaccactgcaccccagctgcggtaacagagcaagaccctgtctcaaaaaataaaaatagaaaactgtgaacttcagcgcctacatctggcccatgtaggagcatcttctctcctgagggttcctgggcaccagctgtccccatcatcatcatctcctgcactgataatctggccaacatgtccccaagaaagcagaagtggccgggtgaggatgtccagctgctgctacagtggacaacagtccctctctctgaggctagggatgttcacccagcttgcctattcaaggacatttcaacccaggagagaacgtgctctctgctcttctccatcactggcctcatcagcctgttttccctcccttgtagcagaattcctagatcctcctgggtcctcctcaaacccagctgtgccccatcttcctccccccatcccgaagaccactcctgtccagctcccatgtggctctcttggtgctaaccccagagagtcccctccccttcttcttctttttttttttttttcgagacagagtctcgctctgtcacccaggctggagtacagtggtgagatctcggctcactgcaacctccgccttccaggttcaagcgattctcctgcctcagcctcccgagtagctgggattacaggcgtgtacaccacacctggctaatagttgtattttttttagtagagatgaggtttcacaatgttggcccaggctggtcttgaacacctgacctcaggtgatccacccatcttggcctcccaaagtgctaggattacaggtatcagccaccatgcttggccccggctaatttttaaaatttttgtagagatggggtctcactgtgttgcccaggctgatctcaaactcctagggtcaggtgatccacctgactcagcctcccaaagtgctgggattacaggcgtgagccactgcgcctggcccttgaagccctttatttactctgcactcctgctctgtctctctggcctcctggctggcctccttctcttctggggccctttctctacccacacttaatccacaccgactcctacatttctctcctagccacgcagctcccctgagtgccattctccatctcccgtgtttgacatttccagcatcttctaaaatatctcaaatcagcccccaatttcaccccagactccctctctagtgatagactagtgtcaacactagtctatcggtgttgacagcaatttggggcaaaacccttgcaagagcccagggggtcttgtctcctctgtctccctctcctcctcatctatgaagaaacatctagaaagtgcctgcatcatccttctctctctgcacactcgctctggctcttttcaccacagtggtggatagaagccaaaaggtgtccatcagagtaaggccatctcggcccggcatggtggctcacgcccataaatcccagcactttgagaggctgaggcggatggatcacctgaggtcaggagttcgagaccaacctggccaacgtggtgaaatcccatctctactaaaaatataaaaattagccaggcgcggcgctcacgcctgtaatcccagcactttggaggctgaggcgggtggatcacctgaggtcaggagttctagaccagcctggccaacatggtaaatatactaaatatactaaatatactaaaaatacaaaaattatctgggcgtggtggcaggcgcctgtaatcccagctacttggggggctgaggcaggagaatcacttgaacccaggatgcagaggttgcagtgagccaagatcgtgccaccgcattcccgcctgggggacaagagcgagacttcgtctcaaaaaaaaaaaaaaaaattaccccgggcatggtgttgcatgcctgtagtcccagctactggggaggctgaggcaggagaatcccgtgaacctgggaggcagaggttgcagtgagccaagattgcgccactgcactccagcctgggcgacagagcgagactccatctcaaaaaaaaacaaaacaagaaaaaaagataacagagaaaagctatctcccccaaggtgggtacaccgccacccacacctcaaaaggcaaatactgacagctgtttctgagtgggtagagaacactttgaagcttttgcagaaaaaacaaacaagaatcagcaggaaagctctgataaaaagccccagggcgggggcacccatcaccgaggatgctaaactttaccattagaggaatctatactctctgtgggaactgagtggagaaactaacctaagaccttaaaacctttagcaaatactaaagaccatcctggagggcaggaatggaaagcacggggaccctctggaaaacacagtgagggtgtgtctttgtttcccataagccttagggcaaacccccaccttataccaaaggtgtcgatgcagaaatggaatccctggagtcatcccagagccaaaaggggacagtgtgtcacggaggtttgtttatgggaagaatcgagaagccacaagggtggatgaagaaacgccactcacggtctcaaggatcacaggcaaaatcagaagacaagtgacagatgggaggtccaagcaaggcttatctcctctcagataaagaccaacagtccttggatggggacagccagttggctgtgaaatgcatgcagagaagctgagcttcagcctaagagaagagcgaattaaagtgacagaagccctttgggaggcggaggagggctgactgcttgagcccaggagtttgagaccagcctggacaacatagcaacctcacctctacaacatagcgacctcatctcaacaaacaataaaaaaagttagctggggccaggcacggtggctcacgcctgtaatcccagcactttgggaggccaaggtgggcggatcacctgaggtcaggagttcaagaccagcttgggtgatatggtgaaaccctgtctctactaaaaatacaaaaattagctgggtgtggtggcaggtgccaccacactactcaggaggctgaggcaggagaatcgcttgaactcaggaggcagaggttccagtgagctgagattgtgccaccacactccagactaggcaacagagcaagattctgtctcaaaaaaaaaaaaaaaaaaattgctgggagtggtggcgtgcccctgtaatcccagctactctggaggctgaggtgggaggatccattgagccttggaggttgtgccacagctctagcctggaccacagagtaagaccaaaaaaaaaaaaggaaaataaaagaacatggaagggaagtaggtggagacagcagatgccagccagggccactggagtcaaggactagccttcgtggggtgggtggcagaggagaggaggatgtgcagggtcccactgtggaggcggtggagttgtcaggcccaggccggtacgtgggttttgccctccagcggcctggagaggcagggaggaggggaagaggaaggtttaattggagagggggaagcaaggaggaagtgccagggtgccaggggggacatacgtgcctacggggcaggttgaaggaggggcagggtgaaggcaaggaggggcagggtgaaggcgaggaggaagccacaaggcgaggcccgggcctggccgggtaaaaggagccagggggtgtgaaacggccagagaagaagcgggaaagagggccaggcggccgcgtggggctcccaggctaacctgcgccggttctgacccccaggaagccactgaggaacggcctggtgaaggacaagcgcttctgaacccctcggccccgcccccgtggacccggccccaccccgaataccccggccacgctccccgtccttggccgcccctccaccccctccaactctgctcctctagggccgccgccacctcccctgggaccccgccccctcatcctgcctccatttcccggccacgccccccaggacccctgcccctccggggacaccggccccgccctcagcccactggtcccgggccgccgcggaccctgcgcactctctggtcatcgcctgggaggaagatgccaccgccgcagcaaggtccctgcggccaccacctcctcctcctcctggccctgctgctgccctcgctgcccctgacccgcgcccccgtgcccccaggcccagccgccgccctgctccaggctctaggactgcgcgatgagccccagggtgcccccaggctccggccggttcccccggtcatgtggcgcctgtttcgacgccgggacccccaggagaccaggtctggctcgcggcggacgtccccaggggtcaccctgcaaccgtgccacgtggaggagctgggggtcgccggaaacatcgtgcgccacatcccggaccgcggtgagtggggctttcgctggggacactggtcctggaggccagacctcgcagggcgagcctcgagagtggcccggggatgcccgagcagctccgagggtccccacccgccctgtccaggctactagcaacttcggccaccgcacctcaccctttcctcgtcatctgctgcacgccggggacacatgtcagggggttcccaagaccagtccttctgcttgatgctgaagccctgtccccaccccatgcccacccccacctcttgacactaatgccttcctgcagatgccatccccacaccctagcatggcttccccaggggcccaggttctggctcatgtctcccacttcggccacccctcctcctatgccccccgccgagggcagcccaccccccccgccgcaccccgcagggcgccttccttggaactcatgccctgcccccactccatcagcccaccccgccgcttcacacccttcccacagacggtgcgccccgagccccagcgttcaccttcctccctgtccctaaccgagaccccatgggcaggccggggacgcagcgcgagccgagttcctgtccctacctccccaggtgcgcccacccgggcctcggagcctgcctcggccgcggggcattgccctgagtggacagtcgtcttcgacctgtcggctgtggaacccgctgagcgcccgagccgggcccgcctggagctgcgtttcgcggcggcggcggcggcagccccggagggcggctgggagctgagcgtggcgcaagcgggccagggcgcgggcgcggaccccgggccggtgctgctccgccagttggtgcccgccctggggccgccagtgcgcgcggagctgctgggcgccgcttgggctcgcaacgcctcatggccgcgcagcctccgcctggcgctggcgctacgcccccgggcccctgccgcctgcgcgcgcctggccgaggcctcgctgctgctggtgaccctcgacccgcgcctgtgccaccccctggcccggccgcggcgcgacgccgaacccgtgttgggcggcggccccgggggcgcttgtcgcgcgcggcggctgtacgtgagcttccgcgaggtgggctggcaccgctgggtcatcgcgccgcgcggcttcctggccaactactgccagggtcagtgcgcgctgcccgtcgcgctgtcggggtccggggggccgccggcgctcaaccacgctgtgctgcgcgcgctcatgcacgcggccgccccgggagccgccgacctgccctgctgcgtgcccgcgcgcctgtcgcccatctccgtgctcttctttgacaacagcgacaacgtggtgctgcggcagtatgaggacatggtggtggacgagtgcggctgccgctaacccggggcgggcagggacgcgggcccaacaataaatgccgcgtggtctgctccgctggtctccttggactccttgcctggggggtggggagggcgcccctcagtcttggtgatcggataggcctttccacctccaggccacctgccagaggcctaacgcgccactccggggagccgcccggacaggcccaggtgctgcctacgggaagggcccaggggcaggggtcgcccttcagtcctgcaaggcagacctgtcccttctgggctttgcctgtctccctctggcctccttcacaccccaacccgtcactcagccaaggcaaaaccccagcaccctccaccccctgcagtttatccaaccttggtgtgaagtcaaaactgtttattaatatttggtgacaaaagaacttaaattgaccgaaaatcaaaagttacattgccttggtacagtgcgcctgggtttgtcaaggctgctgctacaaagctggagaacacagcacagggcgaagcagaggcaaagcggcccagcccaacagccgggatggggcagggagcgtccctcaggccgccgcggggtcaccgcggaaacctacccggtgcatgcctctacgcggcctaccggaagaaggggaaaccgaaagccctagagcaatgggaataaataagagtccctgccagaaggaaggtggcctgtgcgtccccgtctgtcccatgtagaagccggaatctggaggtgttcggatcagggccagtgacagccccaggcccggggcaggggaagctggaggcctggccgccaggcagaatgacaccccaagccaggcgttcgaggggctggggcagctctcctaaaatgaccctctgccaatgacaccacaccctcagtcccttcacacagaacgcggtaatttctgtaacttgtttccttaccccccagaagcagcaatcaccccatcagcaaagttgccggcaggcagagctcccaatttgggctttcggtgtgcagcgctccgtgtctaaccagcacagggactgtcggtacctcctggggacggggacagggacaggccctcttgtccttccaccaaatcttccaaaggcccccgggaaaaagccgtcaatccgggaacagccaccttctcgcctcctggccacagggccagtcctggccaaggcccctcgcaatggggccaaaagcaccttcctcaccggtgcggggccctgcgccgagtctaggcgggaagcagcttggcttctgagtccagcggagaacgagcagcttccaggctcggcgggcggctaccccagcagcctgatgccccgcagaaagaagccactggaagctaaaaccaacaacaaaactcctccggccgcggcacaggtgttgctcctcttctccagtagcgctggcttgtttaaactgtttctggaagcttctcaaatctcccaggtccaccgctaagattttagagacaaacttaggaaagtattcttcagtactcctttaaaagaatcttgaaaaaaacaaagagaaaaacccaaaacacccttattttctttaaatgaaggccctcggagaacacaggcagcgcgacctcggcgcgtccggtaggcgtggacagacgcgccctcccggggctctgccccgcacgctgctgtctttgcaaggagcctgctcgggcacagaaatgcgaagttttttttcctgctaagacgtagtcccctttcaatcaaagagaaaaagaaataaaagaacagaggaaagggctactctgagatgagggtcttcctccctccgccctggccgcagccccgatgggacggagcggggcctcctggtggccgcggctcccgcgggccggcccctcctccgctccctctgctcctcgccgccgcgggccagcagggggcgctcggcctcggctcctctccctcgtgcgctctcccttcctgttgctcacacagtggtgcttcagttttagcagtggaaaacaggtatccgtttatttttattttttattacccagaataagatgctgatggactaagccacg

SEQ ID NO: 15946 - DNA, 156950 bp, Human
  misc_feature (1)...(156950): n = A,T,C or G
agggaaatctgcagctcagctcttttgaaataatgcatgcaaggcctttctcagctacataccttctaatagacacagatactttcaagctacagaattatgtgacaagcacaaaacacactctgaatatgaaaatcaaagactccctttcccaactaaggaagataatctttttataacccagccaggaaatttggtcctatgaaaaacttggaaagaaggatccccagcaggtcaactttccccaaaatggaagggaccttaccaagttctctttagtaccccaactgcagttaaaaattctgggaataaacagctgggtccacttatctcaaattaaacctgtctcttatgaagtcctataggctggcggaacacaagagactgatcctgtttattcccatgagccagtgacctttgactcctgttcagaagaaatgaaagggataggtaacataaagatatagactggcattctacttttgggtataagttggaatcatgcagagagtaacttatttactgagtgagcacagacttcatcctctctacataatcaaacaaactgttgggcatgcagacattttaacagagacccaaaaggaaacctgtgctttgatcaaaaccaaatgttgtgtgtatgcttcagactattcacataatattacccaggctataaaagttttaagcactcatatctctgccatttttatgcactatcagtcaaccacgtatcagcttggttccaacaactgcccacttcttgcagagccttcctgtttagtttacctgggataattttactaattttgctttgctgttgtgaaatatattgtggttttactctttgtgtagaaatgcaagacaagctcactaaatgctttcttgaattggacatttattagtcttccagtaatcacctttttttggaacttgaagttatgaacgaccttcactatacaaacactgtctgactgagtttctctctactctgaatgcaagaggccccaacagttagtcaggaatatcatcgcccctactcagcctgaaaaatttacagaaggtgaatctttgtctctctgcaactcttaggattaaggatcctcttgtaaaacaagggggaaaatatgtcagaagcatttataccagagctactccattttgagagagggctaggaaaatgatgctgagacttgctgggctgcattctcagcaagttagacattcctagcctctagatgtttacgattaagggaacgaattaatgtttactaagcagaaccagacttaggactgtctagatatcccaatatctggagaacagaggcattcctaattttgctttaaagataatatcgagttggcggatgtggtgaatcacgcctgtaatcccagcactttgggaggctgaggcgggtgcatctcctgagatcagaaggccgaaaccagcctggctaacatggagaaatcccgtctctactaaaaatacaaaaattagcgggtgtggtgttgtgcacctgtagtcccagctactctggaggctgaggcagcagaatcgcttaatcccagcaggcgaaagttgcagtgagccgagatcgtgccattgcactccagcctgagaaacaagagcgaaactccgtttcaaaaaaaaaaagtttacattttgaatacattgaaaaaaagagagagcaaagaagagagagaattttcccgtgctctgggattggcctggctcagctcagggaagaaaccttgcctgaaaaggctacaacttaggctgtcaatctttcttctttcagtccaacctctgaccacatcttccatcactcagggcctgagaaggcgggggtcttaaacgttatccaatcagggacgctgtcctgggaactgtccaatcagacacacagctggagggaacagggcggcttccggtatttggtggggcctttgcctctggcttcagtcgttcctcctggtgttgtcctcattcctctgtgtcttctgcttttagaggcccagcctctgtggccctgtgacctgcaggtattggacattcacagctgagacacgaggaccccctggaagcctagaaatggtgaaagtgctgagtccgacatcccgagagaagggacgagcctggttggaaccggtgggaagcggttgatgggactcaggcctctccgcagtcatctccacaatctgcgcccagagttctccttgcccagctcggcctcagtccccttcagccataagatggcggctgcactgacagccgggccccccagacggcctgtctcttccctgcgcagtgaccatgtcctggcctggagccctctctgggcagctctggacccgcagccccgcatctctcccagattgtgcaagtaccatgggaggaaggtcagggcagaatcctgattcggggtgcaggttcacgaatgggaagagctttttgtccgtgggattcccaggccctttttttctattaaaaatttatgggcatcaccacgaaaatattaaataacttaatcaaagggtgattcaaaaattgttgagcagcaccctgctgtagtttgtaatttgcaattcatggaaggcgcttgaaggaaaggtttttataagaaaaccaaattcaataattggcttggtacggttatgtagttttttgtttttgttgttttgttttgattttctattttttgagacaaagtctctctgttactcaggctggagtgcagtggctcaccccaatccccgcctcccaggttcaagcgtttcttctgcctcagcctcgctagtagttgggactacaggcgctcgccaccacatttggccattttttttttttttattttttgtagagacagggtttcaccatgttggtcaggctggtctggaactcctgacctcagatgatccacccacctcggccttccaaagtgctgggattacaggcgtgagccactgcgcccagcatagtttcttaatttttataatcaaggtaaagctggttatgtaatcagcttaattggcagtttatagttggttaagcctgaattttgtttcctccaatgtagttatttaccaataaatgctcttcagtttagattttttttttttttttgaagtagaaatccagggactagagccacctcaatctaatttcctgcctcttactgattttcacactccacaggggactgattttttttctgaatttttcacacgtgtcacaagcagggcctcaagttcactcctcatcacctattcctccagtctgactctggcttgcagtaaaatactaaattttcagtttcgtctgacattcccaaataccaatttcccctccctaattcactttatcaacaatttgtcatttagtatacattttaatacctattttaattaatctttttttttttttaacttttgagatagagccttgctctgttgcccaggctggagtgcagtggcttcatctaggctcactgcagcctccacttcctgggctcaaacgattctgttttttgtttgtttgtttgttttgttttttttttttttttgacacggagtctcgctctgtcgcccaggctggagtgcagtggcgcaatcttggctcactgcaagcttcgcctcccgggttcacgccattctcctgcctcagcctcgcgagtagctgggaccccagctaattttttgtatttttagtagagacggggtttcactgtgttagccaggatggtctcgatctcctgacctcgtgatccgcccacctctgcctcccaaagtgctgggattacaggcatgagccaccgcgcccggcacaattctcttgtctcaatctctcaagtagctggaattacaggcactcgccagcatgcctggctaatttttgtatttttggtagagacgggatttcactatactggccagactggtcttgaacttctggcttcaagaagtccacctgcctctgcctcccaaagagctgggattacagacctgagccactgcccctggctaattaattattttttgacaaagcatttgatggcacatttaaaaagattttttttgtacatatttcctatgagagttaagcaaagaataatctgacactattgtaaaatatctctgtgggttttttttccttctattttccgttgacacagatatcttatcagaatgtttttgggtcaagttttttttttagaaacattatagggtgatgtgttttcagtcacccttccggttttcttggacctggatttcagtattgtatgggaaaaaccacaatacctaccataactatgtctgctagagtctctagtgaatatcagccctggggcttatttgctcatagggcaacctgaggtattgagtgtagcttctcaagtgcacacatggatgccctcaggctaagaggcatttcctggtgtactttttttttttttcaaagttaaccccttgagacattaatattgtcttcatccaacccaactttcatttcttggagactcattgctggtcagccaatcagataccagtattgaggagaaaaataatttctgtgtcctggattcctttaggggacagaaaaatagtacaagaaaaacagtaaaaaaattctagaaaaaaaatcagcactccaaagacaagaaaaccaccaaaccccaaaaagctgactccattgagatggtgtaagaacttgcagagtaaaatgtgcctgaggcactctctgggtcatagttcagagtctcctgagacagggttattgagcacttaagtgtgcagggtggggtggggcaatctctcaagtaacggaatggcctgatgtgacacatgaataagacatatctgtaccttgaaaagatttattcacttaatttacctaaggtttatttatttattttttaagacagagttttcctctgtcacccaggctggagtgaagtggtgccatctctgctcactgaaacctctaaatcccaagttcgggtgatgcttcagcctcccaagtagctgggagtacaggtgttgaccaccactccctgctgggttttgtatatttagtagagtcagagtttcaccatgttagccaggctgatctcaaacttctggcctcaagtgacttacctgcctgggccttccaaagtgctgagattacaggtgttagccactgtgcccagctgtttttttttaattgtatattgcattttagtagtagagcttgaaaggtaagaaaatatttacaaaggacataaaaaaggtgagtcttttttttttttttaattgagacagtttcactcttgttgcccaggcaggagtgcaatggtgccatcttggctcactgcaacctccacctcctgggttcaagtgattctcttgcttcagcctcctgagtagctgggattacaggcatatgctgccaagcccggctaattttttatatttttagtaaagacagggtttctccatgttggtcaggctggtctcgaactcctgacctcagatgattcgccctcctcagcctcccaaagtgctgggattacaggcgtgagccaccgcgcctggcaggtgagtcttaaaaacattaatatctaataatacattttgtttgttgaaaattttcacttacttttttctttctcagagtgagtttagaaattttctcaggtgtgtgtttttatggcagagtgatttcatacagtccatctagcttttagaatggtagctaccaaggaagaaaacaaagaaaaatttctcttcaatttcagctatagacaatgaatacatttccacacacacacacacaaaatgtggttggtaactggttagttacatagattcctgaaaacttcagttccttttgttagcagggtaaatttttgaccgtgaatatctttgttctatatcctgtttttgtgtgtgtgtgtgtttttttttaagatagagtctcacaacgatgcccaggctggagtgcaatctcagctcactgccactttcgcttcccaggttcaagcgattctcctgcctcagcctcctgagtagctggcactacaaacatgtgccaccacacccggctacgttttgtgtttttagcagagatgggttttcaccatgttaggccggtcttgaactcctggcctcaagtgatacatccacctcgacttccgaaagtgctgggattacaggcgtgagccaccatgcctggccctgtatcctgttattttgatttttgagtttattgctaaattttatgtaatgaaaattggtgcctcctataagtgtttccaagtgactaatttttttttttttttgaaacggagttttgctcttgttgcccaaggtggagtgcaatagtgcaatctcagctcactgcagcctctgcctccctggtccaagcgattctcctgcctcagcttcccgagtagattgaattacaggcttccaccaccatgcccggctaatttttgtatttttagtagagatggggatttcaccacattggcccggctggtctcgaactcctgacttcaggtcatccacccacctcagcctcccaaagtgctgaaattacagacgtaagccaccgcacctggctgactaattgtttcctacatgagttttaatacaaataataaaataatacatttattgcctgaaaggaataaatacttttgctattctttgaggtataaagtgtaagcgccttaaaatgttcttccgttacatgaacactgtgtttgagtaattttgctgaatgtttctaacacttagttttagtttcaaaaaccaagttaataactctgatatggaaattaaagcttacgctgcaggagggtgcacatgaacaaaggaaagtaggggttttttattacctctgatgcagctttttcttgttactgtgtcctgcctccgctggctggagttggactgcataatctaaactaaacccatttggctaacttgaaaaatgcaggaatgcagttatacggttgggaaggcaggaagatcagtttcggcggaagtagccattgcgatgggaggggaaattcacagagtcgataatagatttggaatgtgggctccatagataaaaactgggagaaggttgtttaccagggcagggggaacatacagaataagaaagtctggccttgaaaacagggaacagaagggcaaagaaacttaagctagctaaacatttgaagaagaatttcttatactgtgttcaaactctatgcattacacggttaagaaaatgctcatttaaataggttggcatttattacctggaaagttctgaaaaaataccaggagataactgcttattagggtgctaaagaaagaactacttaaaatgactgttaaaaatgttagaacataggccgggcacagtggctcacgcctgtaatcccagcactttgggaggccgaggtgggcggatcacgaggcgaggagatcgagaccatcctggctaacacggtgaaaccccgtctctactaaaaatacaaaaagttagcttggtggccggcgtctgtagtcccagctactcgggaggctgaggcaggagaatgacgtgaacccgggaggcagagctcgcagtgagcccagatcatgccactgcactccagcctgggcgacagaacgagactctgtctcaaaaaaaaaaaaaaaaaaaaaaattgtagaacatggaagatacctgtatcttgtactttccataaaaatgatgttttcttatggttaaattcagacagtaatttagtaggggccatatctcagtagtgatgctgtgtccttctgggtggatcagcacactataaaaagttttcctagtgcagttgatgttaataactcacttaataaactctcttacagagtttttcactatagagttatttttctcttcattaagtatttttatgcagttgatgtgcataaaccatcacatttaatctggcagctgctttttttttttttaaaggttttctttgcatttatctttctttggtaaatgaaattctcatctttgtttacaggccagaaaaactgaaaaaaaacacaggctcttccacttactggatgtttgacaaaatagtattttggtgccaaaccattggcataactggtgagcttggtagagcctagtacctcagactttatttcagatctcctgaaaaaataatctgccttaataagatgtccagtttattgtacacattaaaatttgagtggtaccgtctaactcaacatgtctattttgtctgaaatatataaactatgtctttttcttctgaaaaatatacacaactaattctctattatgtaaatatagcactcaaaaatgtacatgttcgtgatatgccctcaattttacacttttgtcattcagacaagtatcacatatacactgaggttgtggatattatgccactctcttatctcatagttagagaataccttagaaaacgtttgtgtgttgacaattattttattggatagtttcaatcattcttttaagtcagaaccagttctattcactttctgattttaccttgtgtcaaataaaaaattctattcatagccactttgtaaatatgtgtgtttgtgtgtgttttccagggactgttgacatttagggatgtggccatagaattctctctggaggagtggcagtacctggacactgcacagaagaatttatataggaagatgatgttagagaactacataaacctggccttcctgggtgaggataactttaatacaaaattcctcaatataaaataaaaatttcatttctctttgtagaatgttttctggtacttatgctttcatatttctgttatcaagaaaatcctggggagttgtctgtttagaaaaaatttattgaagatgtttcatcttgacctgaactttccacattcctgagctgatctgtgtccttcattttagattagtggtaatttcagaagcttagtggcataaaatattattcacaccttaaaatctatctgcttcaccaattttttattcagcagtggcaggcactgaaattaagaacctacaaaattaaaatattttctaaatatttaaaaatttctgttataaattagtatattgggataaacttattagaataatctattatatcctttttactgagcacattactaagtcggtaattggagaatatgaacaaaattcatgttagctatttttaataaaacaggtattgctttctctaagccagacctgatcacctgtctggagcaaggaaaagagccctggaatatgaagcgacatgagatggtggatgaaaccccaggtaggtgagagtgaatacaacagacgacatggatgagaggtccaaagtcaagaagaaagtaagtctttaaagcgatttgggaagctgtgttcctaaggaaatagtttctgggaagcctgaaattgtttaaaaattacactctcacatagggccatcttctgcttatgcttataaaatctctaagaattctactttcccttcagtgatcttcgttgaagtttacagtgacagccaaagtactgttcatggcatataaaagagtgcacaatctgacttcttgtttttgtggacagatacatatctgcataattttgagatactctgttaaaccattttattttgttttatgttattttattttatttgagaggcacctttgcttttgttgccaaagttggagtgcagtggcgcaatctcagctcactgcaacctctgcctcacaggttcaagtgattctcctgcctcagcttcctgagcagctggggttacaggcacacgccaccacacccggctaatactttgtatttttagtaaagatgaagtttcatcatgttggccaggctggtttcaaactcctgacctcaggcgatctgcccaccttgccttcccaaagtgctgggaacacaggcgtgtgccaccatgcctggcctaaactatttttaagttctctttttgcatcacatctggaattttgatagggagtttattgaatctagagatcactttggataatatggcattttcacaattcttattctttcaatagaaataaaatatttttaaatttatttgtttcctaatttttttattgatatatctttcatttaaaagatttatgagctcttggcctggcttggtggctcactcctgtaattccagcactttgggaggccgaggcgggtggatcatgagatcaggagttcaagaccagtgagatggtgaaaccccgtctctactaaaaatacaaaaattagctgggcatggtggcgggcacctgtaatcccagctactcaggaggctgacgaaggagaattgcttgatcccgggaggtggaggttgcagtgagccgagattatgccactgcactccagcttgggtgacagagcaagactcttgtctcaaaaaaaaaaaaagatttatgagctgcttaattaaatttgttctaaaatggattattttatgctatcataaataagattgttttttcctctgtcagagagtttgttttaagtgtatggaatgattactcagaattgtatgttaattttatattttgctaattaactgagtgtattcattagtttaaacaggtttttatgtactttttattttttatatattaatattacatgatctacaaacaaacgttttacttactgcacttcaacttcaatgactttaaatttttcttttgactatttcttctttcacatgccttcagtgcaatgttaaaatagaagcattgacaataagaaacaatagttttgcattggtgtgtgtaaatttgaaggagcaaacacctcttcaggattttataaactggtttcagaaaggaaaaatctatttttattgggccaccagagtgatagaatgcctctgggtttgtagtgaagaggggttttaggttggttttaagccttctggatttgcacaagaatccatttaagtggtcttgttaaaaggggcttggatagttgtaattctcatttaatttttggacagagtgaatatccttcaggacttaggtgctctgcagggcaaacccaagggcaggtttctgcagtcaggcctgcatatggtgggctttatatcaggatgtggatgagcatggctttcaccaagtacaagagagaattttcccaggtcactttgggtttctacatgggcagaaccggccatgaactgtggctcagggagctggaactgcatcatggaactgcttcagggaccacagtaaaggcaaaggtctgtaggcctactgcatggctataaatgcaggtcttcctccaggcctctggaagggcaagacctcccccagactatggctgggaagagtttgggattgttacagagtaagtttaaaattctcagtggaaccaagttaggtggaacgttttcttgtctgtagccaaaaacagtagtcctgtagtttgccacctgaatgagggcctgtcttctaaacagaattaccttcagtcttgggcttcagcagagtttcacagctcccttcctggatctcagagctcttttaaaggcacttatttttgaaatgggggtcttcctacataacccagaaaggtcttaatattttgactgcaggcaattctcctactttattttgccacgtagttgtcattacaggtgtgaaccatgatgcctggttctctcataaaggcgtttttatcaggaatggctgacaaattttcttgctttcaggggataagcaagtagggcacctttttaaaaaaatcttattaatgtcactctccatatacatttttactttctattttctacttcaaatttgtctgtaattttagattcagaaatttagggtactatactagaatttacatgttgtgcctgaattaaattagataattagtgtgcaggcagacaaaaaggaattatagaattttcaacaaatttatcagcctatatctaaataataacataatttattccccaaatattcattttatataggaggctctgaccatatgtgtatatatatacatatatatgtgtatatatatataaaagcagtgtaaggattttctttgcttctaaacttggattacagtagttatattttgtttaaaaatagcgtatatttaaaacgtaaaaattggcactagtttttttaaatgcttaaatctattaaaagtttctcattagcatctcccatttatgattgttctgcattttctctgaaattttattgccataaaatggatgccagtaatttcaaatgcctgccttccatgaatgcacagttacagtcaaacattgcagttatctagacaaattatttgttaatgtacattaatgttgccaactagattttatgactaagcatttctgttattattgtcttgcagttgtacttgcagttagtgtgctttttagtgtaagtttgttaacatcagtttattgtgtctattgctattatttaagtattataattttagacaattagcagttgtttgtatactttaagttaatgtaagttttaattaaaagataaatgagccatgtgtatcacaatcaaattatatatatgtgtgtgtttttatctgcaaatatgaccccaattttggctataccttatcttgtatacattcatacattcttagctcattttctttcttttttttttttggaaatggagttttgctcttgttgctgagcctggagtgcaatgcaggatctcgtctcactgcaacctccgcctccctggttcaagtgattctcctgcctcaggctccttagtagctgggattacaggtatatgccaccacacccagatacttttgtatttttttttttttttagtaaagatgggctttctccatgtttgtcatgctggtctggaatttctgatctcagatgatctgcccacgttggccaccaaaaatgctgggattacaggcatgagccaccttgccctgcctcttagctcattttcaatgttggttttatcttttctaagtgagtggccttggaaatagtcttattttcaccatgtgtttaatgatgaatatgtatttcctttgtgtgagagaaacacttttgtgatccgaaggtaatttttaaaaagatttataattctgtattttttccagttttaaaaaaaaaaatgttgtaaaaacacataacataatttaccttcttaaatctatttaaatgtacatgtcagggccaggcatggtggtggctcacatctgtaaaaccaggattttgagaggcaaggacagggggatttcttgaacccaaaagtttgagaccagcctcggcaaaatatggagacaccctctctaataatattttttttctaagaaatagctaggcacggtggtgtgcacctgtggtcccagctacttgagagattgaggggcaggattacttgaccctgggaatctgaggctgcagtgagccataattgcgccattgcacacaatcttgggtgacagattgagacccagtctgaaaacaaaaacaaaaacaaaatgtatattttaggcatgtcatgtatattcacattgttatgcaaaagacttcttgaaattttacatcttgtaaaactaaaactcagtatcattaaataacgtttatccattttacactctctccatcccttgagaaccgcccttccacactctgtttttatgaatgagactattttatatgtcttaaataagtgaaatcataacatccatcatttcattatggcttatttcagttgacataatattctcagagtgtatctttaaatgtgagaagatttttttttaaggctgaataatatttcattgtatcgaacatgtcttcaaggtcctatgttgcatattttagatatagattcataaatggaattgctgtatttgataatttatttttaattatttgaagtacatttataacgttataaaataatgggtgcatccttattttccaccgacaatcaacccaactaactttgtatttttagcagtgatggggtttcaccatgttggtgaggctggtcttgaactcctgactcatgatttgcccgcctcggcctcccaaagtgctgggattacaggcttgagccaccacgcgcggccaagggtttcatttttattgcatcatcgacaggtttggtgtttttaaaaaattgatagtggccatttaaatgagtgtgaggggattttgtttttcattcattgtgatttttatgcatttctctacaaattagttttgtgtgtcctttcaaatgttttgatgaaaatttatttcaattattggcctatttctaaataaagttattcaactttattgttttgtttgtttgttttgagatggagtattgctctgtcgcctaggctgtaacctccacctcccggtttcaagtgattctcccacctcagtcacctgagtagctgggataacaggcgcatgccaccacacctggctaacttttgtatttttagtagagatggagttttgccatgttgatcaggctggtcttgaacacctgacctcgtgatctgcctgcctcggcctttcaaagcgctgggattacagatgtgagccaccgcacctggctattgttcggttttaaaagttgtttatattttttgaatattgactcctatcacatatgatttgtaaatattttcacccattttctaggaggcattatccccctattaaatatttatctgtatttatatgtgcagaaatggtgaagtcattatttctttataaattatccactctcaagtattcctctatatgcaaaataatacagtctataatgttgtctaggttttctgttttttaattgatttttctatgtgagttttctatgatggaaaatggggtcttgatgtctacaattattatgttgctatgtattttttgctttacttttgttaatatttgctttatatattttggagcctgatgttatatatacacatacataaagaaaggaaagaaagaaacaaagaaagaaagaaagaaagaaaaagaaagaaaaagaaggaaagaaggaaagaagaaaagaaagaaagaatagttatagatttgtggtaaatcaattcattttactaatatatactatcaatgtttgtctcacgttagcacttgacttaaaggatattatgtctaatacccaattgtagttactattttcataaaataaatttttttttcaccatgtggttttcagcctatttaactcagtgctaaaatgagtcccttgtaggtggctttttcttaagccactaaggcattttattttttctttttataatttcatttaattacttgtttattcatttatttttgagataggtctcactctcaaccaggctggtttgcagtgttgtgatcatggctcacagaagcctcaacctcccaaactcagaagattctgtcatttcagcctctcaggtagttgtgtgtagcctctcaggtagtgtgtagcatcacacccagctaggttttttgtatgtatggttgagacaaagttttgccacattgccgaggctggtctcaaacttctgagatccagtaattagcccaccttaacctccgaaagtcctgagattacatttctttctattaagtagtttaattaatttatatttaaaattatttattaaaatgaagttattagttttattgttattgttttatgtattcctcagtgggttttttaatatattgttttattgccttaaattttattttaattgtgtagtgacgtgcttcaattattttttacattttgttttgcatagtttctataaatattgtcttcataaccatcttgtgtattagtctgttttcatgctggtgataaagatataacccgagactgggcaatttacaacagaaagaggtttattggacttacagtttcatatgactggggagaccttacaatcatgctggaaggtgaaaggcatgtctcacctggttggcagacaagaaagagagcttgtggaggaaaactctgccttataaagccatcagatttcatgagacttatttactgtcgtgagatcagcacagaaaagacctgcccccatgattcaattaccttccaccactttcctcccacaacatgtgggaattaaagatgagacttgagttgggacatggccaaaccatatcatcttaaaaaatggagtttacatgaaacatcttaaaattaaaacaatatatttaaatctcatgacaacttaaattgaatataaaaattttacctctatatttttcagtttgttattaatattaaaaattattttatattgtatattaacatttatgccggtttttctgttttaaatactctacagaatagctttaagacttgtatacatcatcattatgatagtaaagagttctatatttgtatatttgcatttaatagagcgctctgttttatgtatggttttatgatgctgtccagtattttatttttaaacaaaattgactcattttagcatttttttggttatatgcagagtctccctggattactcagcgtgatctgaaactcctggtctctagtgttctgacagccttggcctcctaaaactataagattacagtcatgagcccacagtgcctgcccccatgtagcattttttcataaaactgtgctagtggtgatgaacaccctcatcctttatcttggatttttttattttcatcttctttttaaagtaaaataaatttaaatcaaatattattggttagaattttttcttttattacgtcaaaatgtggaaagttctcacccttttttatcttcaagtaacctctattatttttttctcatattcttcttccttaatgaatatattgatctagttgatggtatctaataagttttacattccatgttttaattttattttgcaattttatatttttgtatataaaatatatatatgtatttgagggtatgtcacaacacatctgttaattgtgttttgattttttagtatatattctaattgtgcatgccaatatttaactttgtacaatttaagacattgtggagcaaaatcatatatgaattagccatatgtcttttccaatagaattatctctatttgcctggaaaaatgttatccttgtttttttttataacttgtatatttgttgtgaaggtttgttgtgaatagttttttaatcctgtgtagatgagaagtcatgaaattcttgtaatttcaacatcctattaatttgtgaatatatgtgatttttgcatgggagaaacacatttggttttgaatataatttaaaactatcataactatgtatcttttaggtattattgtttatttttacttgtcaataaaacataacaaaatttaccacaaaatatttttaaatattcagtttatcgtgacattgtcatggaacatattgctaaaacatttttatcttgtaaagctaaatcttaatacatattaaacaactactaatttttccattgtctaccaaattttccagagtcttgctctgtcacccatactggagagcagtggcacgatctcagctcactgcaacgtccaccttccaggttcaagcaattttagtgcctcagcttcctgagtagctgggattacaggtgccaactgccatgcctggctaatttttgcatttttagtagacgtagttttgctatgttggccaggctggtttcaaactcctgagcttaggtgatccacctgccttggcctcccaaagtgctgaaattacaggtgtgagccaccatgcctggccccagttttttctgttttatggcacttttcaaatatcactctgttctttgtttctaaaagtgtaactccttcatatatctcatacagtctctttttgtggctgactcatttcattttgcataatgcaatcaagatttatatttatagttggcagaatatttccttctttttgaatactgagtgatattccagaattttttttcgtttttctatttcattttttagatggagtttcccccttgttgcccaggctgtagtgtaatggcatgatcttggctcaccgcaacctctgcctcccaggttcaagcgattctactgcctcatccccccaagtacctgggattacaagcatgtgtctcgacgcctcgctaattttgtattattagtagagactaggtttctccatgttggtcaggctggtcttgaactctcagtctcaggtaatcagcccgcctcaccctctcaaagtgctgggattacaggcttgagccaccacacctggcctcacaatttttatatttcaaattacatctgctgaatgatttggtgaaagaaatttgggttgctttcacctgttggcttacagtaacaatgctgcaataattatgagtatgtaaatgactccttatatgaccatatatgtgaaagtttatatgtgtgctgcattctattttatgtctacttttttacctttatactaatagcaaatcattttaattctgtagctttgtaatgtattttgaattaagaacttaaatgcctccagcatttttttcttttttttgaagattgttgggcactttatagtctcttgggattctatatacttttggggttgttgtttctatttcttcaaaaatgcaatgagaaatttggaaaacattgcattaaatatgtaaattgcattgagcacaatggacctcttcacaatttaactatttcaacttttgtgtaagagcacacttaagagtgttttgtttaatttctgtgtatttgtaaatttttcatttttgttctcatcatagtatactctcatatcattttggtcatagaaagtagttcatggaattttacctttaaaaatgttggtaagacttcctttgtggcctaagatgtggtctatcaaggaaaatgttatatgagctattgagaagggtatgtattctgatgttgttgaggaatgttctccatcactctgttcggaataattgttttatactgcctttaagtagtctattcccttattaacattcttgttttatttttgttacagaaagtgtggtattaaaatatctttctataataatactgctttctttgtgtttcttccattctgtcaatattggctttatatatttggaacactaatgtgagacacatacacacacacacactcacacacacacagagaaatttgtaataggttcccagttaatgaatcgattattttttgatgttcttctttgtttctttggagttttaatttcaagtacattttataaaatattatactttttgacttaagatggagcttgtgtatgattattttgactgtttatgctgtcctctgattaatgtttgcatggaatgtctacttccagtcttttttaaccattaaatttcttttctgagatggagttttgttctttcacccaggtgggagtgcagtggcatgatctcggctcactgcaacctttgcctcctgggttcaagtgattctcctgccttagccttctgagtagctgggactacaagcatctgccaccacgcctggctaatttttgcatttttagtagagacggggtttcaccatgttggccagggtggtctcaatctcttgaccttgtgatccacctgcctcggcctcccgaagtgctgggattactggcatgaaccacagcacccaacctcttttgtgtatttatacgaatatgtttgtggtactttggggattacatataacctctgaaaaatacaacaatatattttaatctggtaaaaaaataagttgcatacaaaaattctttttcatcttccctcaagtttcattgacattgctagttatgtctttttgtgttgtatattcattaacagatatttataattatttctatacttttttctttcaaatttcagagaataattagaaatgttttttgcaccactaggataatgctcagaaattctaattttgtttatttgtgtatgttttccagaaaattatttttgtatgattatgtggtgtttttttgaatcatgttattttcagtaaaatattttcagcaccctttatatgtaggacataagcagtaccaatatacttttttaaaacttgtttattttggaaagtttctatatttttatttggcagaacagattcactgatggtattattctcacttaatagctgctttttctcacaacttttttatgactacatcacacagttcccttatggcctgcaaaatttttgttaactcttcacagattatctcgtaagactgtgtttgtaaatggcacatcactgtttccttttaatttttattttttggagacagagcctcactctatcctcccgacatgctggagtgtactggtgcaacctcagctaactgcaacctccacctcccaggttcaagcgattctccagcctcagcctcctgagtagctaggattacaggcacacacttccacacccagctaaattttgtagttttagtagagatggggattcgccatgctggccaggctgccctttctaaaggcattatgttacagtgagaagcaggaaaagctgtgttgggtaaatttatcagacttctctttttcttctatgtggtttttcacattgtgctcatctgggacactgcacacaactcatttataaattttccacagatgtattttggtctctatatttttgttacatttgtatgtctgtgaaagaattagggcctgtggtattttgcaaagccattttatttatgtagatggtataaatttataggtaagatttttaaactatattcatgtgagtctagtaagtggagtaatttataaaaattttttttcaggtatacattctcatgttgctcaagacctttggccagaacagggtatggaagattcttttcaaaaagtaataccaagaagatatgaaaaatgtggacatcagaatttacagttaagaaaaggctcaaagtgtggatgagcttaaggtgcacaaagaaggttataatggacttaacctgtgttacacaactacccagagcaaagtatttcaatgcggtaaatgtttgaaagtcttttataaatttgtaaattcaaacagacataagacacactggaaggaaacctttcaaatgtaaaaaaatgtgtcaaatcattttgcatgctttcacacaaaacccagcataaaagcatttatactacagagaagtcctacaaatgtaaagaacgtggaaaaatctttaattggtcttcaacccttactaatcataagaaaattcatactgaagaaaaaccctacaaatgtgaagaatatagaaaagcttttagtctatcctcaaatcttactacacataagataattcatattggagagaaaccttataagtgtgaagaatgtggcaaaacgtttaacaaatccttaaccctaaccatatataagaggatgcacactgaagagaaactctacaaatgtaaagaatgtggcaaagcatatgtatggtcctcaaacctaactaaacataagaggatgcacgctggagagaaaccctacaaatgtgaagaatgtggcaaagcttttagccaatcctcaacccttactacacataagataattcgtactggagagaaacgctacaaatgtgaagaatgtggcaaagcatatgtatggtcctcaaccctaactaaacataagagaatgcacactgcagagaaaccctataaatgcgaagtatgtggcaaaacttttcatcgattctcaaatcttagtgcacataagataatccatactggagagaaaccttacaagtgtgaagaatgtggcaaagcatttatatggtcctcaacccttactgaatataagaaaattcatactagagagaaaccctacaaatgtgaagaatgtggcaaagcatttagccgatcttcaaccctaactatacataagaggatgcatactagagagaaactctacaaatgtgaagagtatggcaaagcttttagacaatcctcaacccttactgcacataagatgattcatactggagagaaaccctacaaatgtgaagaatgtggcaaagcctttaactcgtcctcaactcttactaaacataagataatccatactgaagagaaaccctacaaatgtgaaaaatgtggcaaaagctttaaccagtcttcaatccttactaaccataagataattcatactggagagaaaccttacaagtgtgaagaatgtggcaaagcttttaatcgttactcaaatcttacgaaacatacaattgttcatactggagagaaaccctaccaatgtgaagaatgtggcaaagcctttaaatggtcctcaaatctaactaaacataagataattcatactgaagagaaaccctacaaatgtgaagaatgtggcaaaacctttaaccagtcttcaattcttactaaccataagaaaattcatactgtagagaaaccctgataatatgaataatgtggcaaatcttttaacttatcttcaacttttaataaacattgaggtagtttatactggagtaaaaccctacaaatgtgaagaatgtgggaaagcctttttctcatcctcatccctaactacacataagaaaattcatactggacagcaaccctacaaatggaaaaaatttggcaaagcctttaaccagtcctcacttattactacagataagtcatattggagaaaaatcttacaagtgttaataatatggaaagcctaaaaaagtcctcaattcttaacagacataagattattcatattggagagaaactctacaaacctgaaagaaaagacaatgcttttgacaacacctcaaacttttctaaacataaaaacatgttgccaacaaattctagaaatgtgaagaatgtgacaaagcctttaaatgattgtcacacttgattatagataagataattcatgctgagaaaattgacggtgtgaacaatgtggccaagcttctaaccaatgctcacatcttattgcactgtaaagcatttatacttgagaaccaatgtacaaatattgacaaaaaagccattaatacctgctcaaatcttactcaaaatcagaattcatactaaataaaagcattaaaagtttaattactatcaaaagatctatcagaaaatatgtctataaagtgcagaagagtatttattttgaaaaagcattaccaatatgaagagggttgtaatatctttgcttgtatcacagatcgtattgtacacattttgtactagaggaaaatcttgaggcagttgttaaaattttgttcaacatcaaggagtttatactgaagaaaaccctgccaatgtaataaatttggaaaaacatttttttcaaaaactgcaaattataaaacaccaaagagtttatactaaaatgtatttttgcagatgcattaaatatgaaagatgttcagtccaaagttagttagttctatgtaactatcagggaatcattcacagtagaaatatctaggacactcaaactttagacattatactaaatcagaatgctgagtataaaaaatacagactaaagttcatataaacattatttgtatataactttaaaaaaaaattttggagagatgtaattacactcaaagtatactttttgtgaaaatatggaatttttaaaaagtgaataataatggaattaatgtcttaaattacttcatgctgtttcatcattcctggtgtattcacatgtgaaaatatgtgactaaacattgctgaataaaagatacgaaagattcttttttttaggtaggtgttatttatgaccttttctatggaagggtaaggacattataatgtaggattcatgatgaaaatttaagtagagaggctctttgtggttaacttataacattgagtgatgtatgaggtaggtgttcagagtaatctgcattattaggaaagaaaaacttttaaattttgtttaagttagtatgttatcttattaattgtacttttatggaataatattaattatacttttaaattataaattttatgtcaactttccatttaaacatttttaacagtttaaatactatcatgaattcattgaagtgttatgccactaactttagcctattacaccttactcaagggtgtaggtaaaagatggtaacaatatattatttggtaagataatggactgaaatctctagtaatcttttttgccagtggctttaaattgtcaataagttacagaatattgttcctataggtgaaacttttattcttattttcacgtttaaatttatttttcttaatttttgtggatacataatatgtgtatatgcatatgccatatatggcatattttgatacaggcatgcaatatgtaatcatattagaggaaaatagttatccattacctgtagcatttattctttgtattacaagcaattcatttcttcaaataactaactagttttagttatttttaaatgtacaattaaattgttattgactgcaggatcacttttatggtcataatgaaaattatgtagaaacataagtaaaatgtggcctctgcttgcatgcacatatggactgttagtattgatttacagagttaaatatacatctattagtctaaagataaatcttaggtgtaaataaattttggagtaaatgtatttgtgttattgtaagtttgaaactatttttagcagaaaaaagcaattttggagcaaaataaatcattttaagaaggtgtctaatttactagaaagaaattctcaaaaatgctgaaagcaaatctattctgtctgctttgtattgaatttattactgtataatccttggcttatgcttcagaatctccccatgaaaattctctgttttaagttgactattactcatgttagacccataatttttgtttgtttgtttgtttaatagtttttttttgttttttttttgagacggagtcttgctgtatagcccaggcgggagtgcaatggtgctatcttggctcactgcaaccttggcatgacattttcaagcaattcttctacctcagcctcccaagtacctgggattacaggtgcctgccaccatgcccaactaagtttcatatttttagtagagacagggttggtcaagctggtctcaaactactgacctcaggtgattcacccaccttggcctcccaaagtgctgggattacaggcatgagccactgtgcccagcctgtgtaatagtttatgaagtattcattatgtgagctagtctgtaattataagaataattttttttaaaatctcattgttccataatttaatggggtacaggtgatacttggttggatgagtaagttctttagtgatttgtgagatcctgatagacccatcagctgaccagtatacactgcaccatatatgttgtcttctatccctcctttttcccactcttccccccaagtccccaaagtctattgtatcattcttatgcctttgtgtcctcatagcttacctcccacatatcagcgaggacacacagcgttcggttttccattcctcagttacttcacttagaataatagtctctaatctcatccaggtcattgcaaatgctgttaattcattcctttttgtggttgagtagtatcccaacatatatatatatacacacatatatacacacacatatacacaccacaccttctttatctactcgttgattgatgggcattttgtttggttccacgattttgaaattgtgaattgtgctcctagaaacatgaatgtttaagtatgtttttctataatcagtatttgggtttatttttgggttctctgtttcattgttctatgtttcaaataatgacttcttttcctgtgggtagatacccagtggtgggattaaatggtagttctacttttagttctttaaggaatctctacactcttttctatagtggctgtactagtttacattcccaccagcagtgtagaagtgtttcctgattgcttcatccatgccaacatctacagtttattgatcttttgattatggccattcttgcaggaataagatggtattacattgtggttttgatttgcatttccctgatcattagtgatgttgagcttttttaaatctatgtttgttggccatttgtatatcttcttttgagagttgtctaatcaagagcccacttttttatgggaattttttttttactgagttgtttgagttcattgtagattctggatattagtcctttgtcagatgtatagattgttaagattttctcccacactgtgagttgtctgtttgctctgctgactgttccttttgccgtgaaaagctctttaatttaattaggtcttagctatttatctttgtttttactgcatttgcttttggatttttgtcatgaaatttttgcctagccaatgcctagaagggtttttccaatgttatcttccaaaatttatacagtttcaggtcttaggtttaagttcttaagtcatcttgagttgatttttgtataaggtgagagatgaggatccagttttattctcctacatgtggctagccaattattccagcaccatttgttgaaaagggtgttctttccccactttatgtttttgtttgctttgttgaagatcagttggctgcaactatttgggtttatttctgggttctctgttccattggtctatgtgcctgtttttataccagtactatgctgttttggtgactatggccttacagtatagtttgaaatcaggtagtgtggtgccttcatttttttttttttttttttttttttgcttagccttcctttgtctatgtgggctccatatgaatgttagaattgttttttccaactctgtttttctaactcaccatcttcagaatgatggtggtattttgatggggattgtgttgaatttgtagattgcttttggcagtatggtcattttcacaatattgattctactcatccatgagcatgggatgtgtttccatttgtgtcatctattatttctttcaacagtgctttgtagttttccttgtagaggtcttttgagtccttcattaggtgtgttcctaagtattttatttttgttgagttattgtaaaaggggttgagttcttgatttaattctccgtttggttgctgttggtgaacaaaagggctacttatttgtgtaggttaatcttgtatccagaaactttgctgaattattttatcagttctaggagctttctgcaggagtccttagggttttcaaggtaaatgattatatcatcagcaaacagaggcagtttgaccttttgtttactgatttggatgccctttattttctgtcttattgctttggctaggacttccaggattgtgttgaagaggagtagtgagagtgggcatccttgtcttgttcccgttctcagagggaatgctttcaacttttccccattcagtattatgttggctgtgggtttgtcatagatagcttttattatatcaagctgtgtcccttgtgtgccaactttgctgagagttttaatcataaaagatgctggattttgtcaaatgctttttctgaatctattgagatgatcttgtgattttagttttaaattctatttatgtggtgtatcacattgttttacctgtgtgtgttaaaccatccctgcatcctggtatgcaatccacttgatcacagtgaattatctttttgacatgttgttggatttaattagctaattttttgttaaggattttagcatcaatgtttatcaatgatattggtctgtagttttctttttaggttgtgtcttttcctggtttgggtattagggtgatgctggcttcataggatgaattagagagatttccttctttctctgtattagtactgattctttgaatatctggtacaattctgttgcgaacctctctggtcctggacttttttttgttggtgatttttaaattaccattttaatctccctgcttgttattggtctgttcagggtatgtaattcctcctgatttaagctaggagagttgtatttttccaggaatttaagtatctcttctaggttttctagttcttttgtaaaggtgtttatactagccttcaatgatttttttgtgtttcagtggtgtcagttataatatctcctgtttcatttctcagtgaggttatttggattttctctttttttctttcttagtcttgctaatggtctatcaattttatgtatttttcctaaggagaagctttttgtctcattcatttaccttttgtatttttttttgtttcaatttcatttagttcttttctgatcttggttatttcctttttttctgctgggtttgggtttggtttgttcttgtttctcttttctctagtttcttgaggtatgaccttagattgtctgtttctgctctttcagactttctgatgtaggcacttagggctatgaactttcctcttagcaccacctttcctgtatcccagaggttttgaaaggctgtgtcattattgtcactcagttagaaaagtttttaatttccatattgattttgtttttgccccagtgctcattcaggagcaggttactgaatttccatgtttttgcatggttttgaaagtttctttgtgtgttgatttccagttttattccactgtagtctgagagagtgcttgaaataatttcaattttcttaaatttattgaggcttgtcttatggcctatcatatgatctatcttggagaaagttccatgcgctattgagcagaatgtgtgttccatggttgttggatgaaatgttttgtgtatatctgttagtccattttttccaaggtgtagttaaattcattgtttctttgttgactttctgtcttgatgacctgtgtagtgctgtcagtggagtattgaagtcccccactattatgatgttggtgtctatctcatttcttctgtctattagtaattgttctataaattttggagctccagtgtgatgtttgtatatttaggattgcatatatgtttaggattgtgatgttttcctgttgggtcaggccatttaccgttatataatgtccttctttgtctcttttaaccacagttgctttaaagtttgttttgtctgatataagcatagctacccctgcttacatttggtgtccatctgcatgaaatgcctttttacacccctttactttatttgagtctttatgttaggtgagtctcctgaagatggcagatagttggtgagttcttatccattctgccgttctgtgtcttttaagtggagcatttaggtcatttacattcaatgttagtattgaaatatgaggtaccattgcattcatcatgatctttgttggctgcatactttggtgttttgttgttgctgttgttgttgttgttgttttggaatggagtctgctctgtcacccatggtggagtgcagtggctcgatcttggctcactgcaacatccgtcttccaggttcaagtgattctcctgcctcagcctcctgagtagctggtactacaggtgctcaccactacaccgggctaatttttgtatatttagtacagacagggtgtcaccatatcagatagggtggtctcgaactcctgaccttgtgatccacccacctcagtctctcaaagtgcttactggaattacaggtgtgagccactgcatcgggtatttttttttaacttgtatttttattttataagtcttgtttgatttatgctttaaagagtttctgggctgggcacagtgactcactcctataatgccagcactttgggaggctaaggcgggtggatcacctggggtcaggagtttgagaccaacctgatcaacatggagatacccccttctctactaaaaatacaactgtttctttccttcatatatgatgcttagtttcattggatgcaaaattcttggcacataattgttttgtttgaggaggctgaagatggggccccaatcccttctagtttgtatggtttctcctaagtagtctgctgttaatctggtaggttttcctttataggttacctggtgcttctgtctcacaactcttaagattctttcctttgtctttactttggataagctgatgacagtgtgcttaggcgaagatctctttgcaatgaattttccaggtgttctttgtgcttcttgtatttgcatgtctaggtccctagcaaggccagagaagttttccttgattattccctcaaatatatttttcaagcttttagaattgtcttcttcctcaggaacacaaattattcttaggtttggtcatttaacataattccagacttcttggaggctttgttcatattttcttattattttttatttgtctttgttgaatttggttaattcaaatatcttgtctttgaactctgaatttctttcttctacttgttactgctgagactttccagagcatttcgtatttctaaaagtctgtgcaaagttgcctgaatttttgatttttttttctttaagctatatattttgttgaatatttcttccttcacttctcatatgattttttttttattttgttgcattgggcttcacctttctcttgtctctccatcattagcttaagaactaacctcctgaattctttttttagataaatcagggatttcttcttggtttggatccattgccagtgagctagtgtgattttttttttttgtggggtgttgacaaacctccttttgtcatacaacctggtttgcttttctggttccttctcatttgggtagtccctttcagagggaaggtctagagctgaaaactgttgttcagattttttttttttatccctcagggtgttcccttgatgtagtactctcccccttttcctgtggatgtggtttcctgtgagctgaactacagtgattggttgtctctcttctggatctagccacccaatgagtcttcccagctccagactgatacttggggttgtctgcacagagtcctgtgatgtgaagtgtttatgagtctctcagccatggataccagtgcctgttctggtggaggtggctaagggtgcaatggactccatgggtgtccttagctttggtggtttaatgctttatttttgtgctggtagacctcctgccaggagatagtgctttccagaaagcatcagctgtagtactgttgaaagggactagcagtgggtgggaacccaggactcccaagattatatgtcctttttcttctgctaccatggtgtttagggaaagaccaatgggtgcggggggtgctaggcatgcctgagttcagagtctccttgggtggttgttgctgaagctgctgtggcagatgggggtgagattcccaggtcactggagttgtgtacctaggaggattatggctgtctttgctgagtcatgcagggtgtcagggaagtgggggaaagctggcagtcacaggccttactcagctcccatgcaaacgaaagggctggtctcactctcactgtgcccttcataacagacctgagtctgtttccaggtggagggcgagttgggcttgaaaatttccccaggctttctgtctcccagctgcgggaaaaaaaagggctttagttcttccatgcctgtgaagtcttcaagccggattcatgccttcccccaagttctggccataagtcttcttgccccattcaaattgttacaaagttcagctagggaagtccttctccccttggaagttttaccccctgctcctctgtcctccccttgatggatccctgtggtgctaggcaggaatgggctccttggggattcagcgagctcccagggcctctttgttgcctcctacacccctgtatttcactcagcttggctctctaacttgacgcagctccaggtagttagaaacttctcccacaaacagactttcagcttctccagtggggttgtgtgtttaggagaggaggatctccctttcccacttctgcagttgtggcactcacagtatttggggtgtctccagggtcctgcaggagcagtctgcttccttcagagagtctgtcctgatgcctttaaagacacagtctcaagatgaaatggtgatttgttcagataatctctcctgagaaggaatcagagaagagaggaagaaatggttgattgtcaggtaagtgtgtcccaggtcaaaattctgtccacattttcttctagaatgtcatgtatttagaattgcaataatttacatttctacttctgatgcttttgcctaacaagattatttgaactacatttctcttgtcttctcgtgacagtgaaaggacctcattaaaataattcacttctatatatcagaaccttatctttattctctccatccaggcttcttacatatcacaactaataccttgaatttataccctgaaatattgagagtattccctttgttgacagatcagcctgggcaggtggggatataaaacattcttattggggatggtgctgggtcctcagatatcagtgagggagaaaaccgcaccttttgggttccatcggagggctccatcagctctatgaagaacataatttttaaatgcacactttaaaaggatgaaattaatagcctggaataatttagaaagatatttaaaggaatgaattcaaagaaatttgccttctagaatgctaaaagagtttttagatacactactagaaattacaaaacatgggcaacatatgtggcttgaactttacataaaacacatttttcatgattagattcagattataatttatgttttttggccagtagtctcacagagtcatgttgcatcctcctatatgtatcagcacctgataccaatctgtcccattaattttattaacttggttaacgtgttttctgaagaatttcttcactataatgtttctttttaaaaactgtattattaataggtattttggagaggtgactaatgtgcataaacaatcacatttactctgaaagctcccctatcatgccaagtgtcaggttccagcctaatctgaggtctaacaggagtgggtgggtgagtggtgggttgctggaaaaacaatcaaggaactatgggaatttttgagatggcttttttttctctctaggcacaagcctgagcacgagccctgtgtacagggtgagcagctttactctccctctccctcctgtccacctgtctgtgtactcttttcactcaatagtggatcagagccaagtatgagcttatacaaccaggttacataataagtagaatggtgcacctgcactctaaactaactgagtcatgctgaaccagacgtttaccatggcctatttttgaccacagaacatccatttttcttacactctttttcttaatagtttctctttgtttatacattgctttggaaaatgaaggctgtcatctttgtttactggtcatatacatggggaaaaaacccaggttctatcacttactagatgttttacagagtatttttcttaagctagaatcattgacatcattggtgagtttgttagcaatacagtaactcaggtctcatcccagatctcttgaattagaatacgtattttaacaaaatctccagtttattaatgtatgcattaaaattcgagaggtaacttctaacttactgtgacttctccatatgagaactgtacacaccttactctgtataatgtatatatggcactcaaaactgtaaatgcttgtgtttttgccataaatattatgctgtgtcattcagaaaactataatacatacactggttttgtggatcttgtttcatcctctttcctcagaatgaaggaatacattagagaatctttctctattgaacaatattttattggataatgccagtctcttatgtgaaacagagccagttctcttaactctcaaacacttagagtaaaattaataattctgcctatgaccacttgctaagtatgtgtgggtctttgggtttattttaggaaatgttaactttcaaggctgtggccatagaattctctcaggaggtgtggaatgtctgaatactgctcagtgaaatttgttcagagatgcagtgttagagaactgccgaaaactggtctctcggtgtcaatacattttccccaggttttctaatacaccctaaggcttctattttctccctttgtagaatgattttggcagtttttcctctgcacaaattatttttagatcaacacttttaaggaaaacttgaaggtttactggaacagaaaagaaaatcttcaagatgttttaacaggaaacttcccctttcttgagctaatctgtattcttcactctagattaatggtcattctagaaattcagtggcattaaatattcttgcccaaatattaaaattcaatatccagcaccaattttaaattcaataatattgaatagtagagctaaggacccagaaatgtaaaatatgttctaaatattcaaaagtttctgtcagaaaacagtattttggaattaaatttctagaatctttcatattttctcctctctactgaacatggtacaaggttggtaactgtagaatctcagcaagttatgttacttttttctaacaaaacaggccttgctgtctctaaacctgatcgcatctcctgccttgagcaaataaaagacccctggaatgtgaagagacatgagacagtggtcaaatactcaggcaggtaagcatgaatgaagcagataacacagacgagaggtacaaaggtcaaaaagaattgcagaccttaaaatgtggtatgggatgctctgcttcagtggaaatgtttcctaaaaagccattttttattctgtagcttttgtataggagcatcatttgtcccataccattaaattctctatggacgttacttgctatttagtgattttcctttgaaggtaccgtgagagctaaagtcctctttatggcttataaggtgctgcatgatatgcctcctcttccattgcttcaaggggggatataagaatatctctgagtattttgaggaagtgcatgttagatcatttctgaagttttctttttccatcatatctgaagtgtgtgagagcagtggtgacattaagatttgtttcagaaatctcaggaacatcaatgacagatgttacttgctatttctgtattttttcttttctttctttcctttttgtttttgtttgtttgtttgtttgtttgtttgaggcagagttttgctcttgttgcccaggctggagtacaatggcatgatctcagctcaccaccatcttcccctcctgggttcaagtgattctcctctgggttcaagagattctcccacttcaacctctggagtagctgggattacaggcatgtgccaccatgaccagctaattttgtatttttagtaaagatggtgtttcccaatgttggtcaggctggtcttgaatttccgaacgtaagtgatcctcccgccttggcatcccaaagtgctgggatgacaggcgtgagccaccgtgcccagcctctattttttctttttgatattagtaattttaacagatttgaagtcatacctcatcactgttttcatttgcagttgcctatttgtaggtgatattaggtatcattttcatgtaataaactaattttctttgagtagatacccaatgatgaggtttctgaatcaaatcgtagttttatttttagttgagattgagcatgttttttatatgcgtgttggttatttgtatgtctttattgaaaaatgcttagtagtatttgctcatttttcaatgggatttcttattattatgatatttttgaattgtttgagttatttgtaaattctgaatattggtttcatgttggcccatagtttgcaaatatattcttttattctgtaggttgcctatttatcctgttgatttttttttttttttttactgtgcaaaaactcttttgtgtcccatttgtctattttttataataataatataataatagttttctttgttgtgtccttggctagttttggtatcagggtgatactgacctcagagtgacttagggagaatttaattatcttcaatttttgggaagagtttaaggaggattattattctttgtatatttggtagaatttggctgtgcgtttatccagtcctgagcttttctttgtcgagatactttttattactgactcaatcatgctactcattactggtttgttcaggtactctatttcttcctggctctatcttgggaggttgtatgttttcatgaatttattcattctttttaggttttcaggtttattagtgtctagatgtttataatcatttctagtgaacttttgtattactgttgtatccattgtaatgtcttctttcataactgattttgtttatttagattttcattctgtttgtggttaatctacctagcaatttacccattttgtctttttggaaaaccaactctattctgttgatcatttttattgtttttcatctctatttcatttggttctgttctgatttttgttatttttttcttctaacttggaattttgtttattattaattttctagttccttgaagagtgtgtgatgtcaggtgctcaatatgtaagctttctacttttttgatgcagtcatttaggctgtaaactgccctcttagtattatatttgctttatctcacaggttttattatattgtgtttgtctttccatcttttttcccacacatttttaatttttatcttaattttctttttgaaatgggttttaatctgtcacccaggctggagggcagtggaacaatcttggctcactgcaacctccaccttccaggatcaaaccatctttttatctcagcctcccgagtagctaggaccataggtgcgcaccattacatctagctattttttaaaattttttatagagatacagttgtggcatgttgcccaggctagtctcaaagtcctgacctcaggtgattcacctgcctcagcctcccaaagtgctgggattacagagatgagccgccactcctggctggccattttaattacttcatttacagtttttgggaacaagccccccaaaatctgtccataaactggccctgaaattggccataaacaaaatctctgcagcactgtgacatgttcatgatggccataacacccacactggaaggttgtgtgtttagcagaatgagggcaaggagcacctggcccgcccagggcagaaaaccacttaaaggcattcttaagccacaaacaatagcatgagtgatctatgccttaaggacatgctcctgctgcagttaattagcccaacctattcctttaatttggcccatcccttcatttcccagcctgaccaatgtggtgaaacctgtctctactaaaaatataaaaattagctggacgtggtggtgggtgcctgtaatctgagctactggggaggctgaggcaggagaattgcttgaaacagggagacagagactgtagtgagcctacattgcaccactgcactccagcctgggcaacagagcaagactccatctctcaaacaagtaaaataaaataagtaaatcaacatgcagtagtcagtgagcatcagccatgcaattgtgctaggtacagaagatggaaaaaatatccttgaggtaggagaaacatgttaacagataaattacagcagacagacttgatagacgagggtaaaagttattaggaacagaaggcctaattctccctagaaaaggtactatttgagatgggtctcaacgaagagtaaagagtaaatattctttgctgggggaaggggatggagacacaacaaaaagaacaacccatgcaacagcaggggcagtaaagaattattcagtgtgtcagtgatgtggaagacagagacaagagccaagactagcaatttggtttggaagcagatatgggtcttcgtaaaacaagtgaaggagtttggatttttctttttgcagacagcagggaggcaagagatgttattaggcaggcaaacaatgacagcagcttttgtttttgaggatgatgactctggcagcaagctggaagattaacagcagtagagagaaactggtggcagaaaattaagaggtgcttatgactcaatgagggccttaggtcagaagtgattaaacagccaaagtcagtgactgaagcatggttttgaggagagcctggtgactgattggacatgggggtgagagagacatgcatcaggacagccatcagtaatgttcctggcctagtaggttgtgtgcatggcaatcaccttccagaaggaatggacattactttcatttttacaagtacttgcagggtgagggacttgtagtgtgatcaggatcacaaaagattactgcttcagaaaaattgtaagtgaaaatgtagagttagagttgtcagtttataggttaaaggagagggcacaaaagcaccagaatgcacagggcactctgcaggaacagaactcactcccaagtatgggaggtgaaaggttgctgcagagaacaggtacctggcaactgactgcaatgggatgcttacagtctgtccactgatttcagaattttaaaacaactattctcaagtgttgcacatgtctctaaggtaagtgggagcccagaccactgtggaggcaactgtctgcttactgcaggcagccctttcttttctggaattcagtctcctcatcttcctgccttatctcgtgcatatttcctgcttgtgtagtagggtggaaagtggaagggcaggacaaaggtcaaatcagtggcacttatttgctaaacatatactagacagttctggtgtgaggcctggggtcccagatcatataaattatcactgtctcctttattgcatccctgtattgtccccatccatctcagccagggcagctggctaacatccactctctcaagacgacatgtgtagacagaagacctggctcagaaacaccggtctatgaaaagggcagatagttatgtaagaattttgcaaaaacttgagaaattaaaataagggagactatgaatgcaaaaacattaactatcaagctagtaagagctagttcaaagaatttttttaaaagatatactccacgtaactgaaaacatgagggagactggcagatgacagcatcagagcgaatttcctaaataactcaggtaggagccacctaccaaaacagctttacagagccaatgcatctcatttgttgaagaagctgatgagttctagagctcttatttactatggagttttcaaatacactgaataccacttaatgttttcctcaatcccaagcttcttgtaaaactttgaccttgccaaccatggcatcttagaggcaaataaaagcttacttactttatggaatttcagatttctaaatatagcacatgcaatacagggaatgcacccactgtgcttgtggatgcaataaaggccactactacacctctcaagcaggcttgcttgacttcagctctgctgacatttgtggctatcctgtgcattgtaatatgctgagcagcatttctagtgtctgtatacttaaggccagtagcacccttccccaaagcaaatcactcaaaaattcaaaattctggaaaggaaatccacagtggatacccacaaaacttcctgatctcaaaataaaccactttattccatatgtaggttttgagtttctggaacatttatttatctttacaacaatcccatgaggtagaaaggctactgaaaagatgtctatcatcatattcatcaatggcaacgtcaccagaggctaaagtttcatttgaaattcccttataccttcaaattcaatcaaatttattttgaaaaaaaaaggtctttattaaaaataacaacacacatacacagaggtaaataagcagtatacatttaaatctatgattttttttttttttgagatcaagctgactctataaagcaggtgttccatggagctagatggtagttaggaattgtggatgctgagcttaatttattgccagccactgggtacctcataaagcagctataaaatgggtcaacatacccacccaaccctaatagtgttgttctgagtataaacatggaatctttcctgaatgatttcaaagaagcagggtgaaaataacttagtccaagaaggtacatcaaaatgaataaagaacattttaaagtaattaaactaccagaaatatcacacatttatatagtcctaccccattgtctctgagaacacggaaaaaagagaaaatacaaagcaagctagggaaagacaaatacagtttttaaaagctctaattaaccccactaagaatttttttggctacctggtgtatgtcaggcactgtacaatgtagggcagtgctcctcaaccctgttggcaccagggtctggttttgtgacagacaattttttcacggatgtggcaagatggttttctattggtatgatttaagcgcattacacttactgtgcactttgtttctattattacattataatatataatgaaataattatacagctcaccataacgtagaatcagtgagagccatgggattgttttcctgcaactaaaggttcccatctaggggtgatgacagacagtgagagatccttaggcgttagattctcgtaaatagtgtacaacctacatccctcacgtgcgcagttcacaatagggtctgcactcctacgataatctaatgctgctgctgatttgtaatgcgagtgatggggagtggctgtgaatcctgatgaagcctcgctcatccactgctcacctcctgctgtgcggtttggtttataacagaccacagactggtatcagtctgtgccctgggtgttgaggactcctgatgtagggcaacaatgtttattcatttatttattgagtgtagtgctgtaatctcagctcactgcaatctctgcctcccgggttcaagtgattctcctgcctcagcctcccgagtagctgggattacaggcatgagccaagaagcacggctaattttgtatttttagtagaaatggggtttcaccatgttggtcaggctggtcttgatctcctgacctcaagtgatccactcgcctaggcctcccaaagtgctgagattacaggtgcaagccaccatgaccggctggcaactacatttattaccatccatttattactaggtcacccatgttgtacagtgcctggcacagaccaggtggccaataaacagctattgatctaatgcaggaataataaggtaaggtttattttttctccttcaacatgctgtacctttgccagatgcaaataagacctcaaaagtctgcctgaataaacttaaaataaaagaccctttcatcaaacggtcacttagatggtgtaacaagttaggtatgaatgtatcacctgtaccagctcagtgaaatgcgtgttaaccatcacataacaaactcgtgtctggcacgctaagggctttgagtctgaatttctgatgagaaataaagtggtatatagaaaaccccagagaatgatattccatatatccataagcatcagtagcacttcttaaaagtctcgcacatccagcaaaccctttaaaaatgagatatcctaatatgcaaccagtttagcagtatttttaagaatgataagggctgggcacggtggcccatgcctgcaataccagcactttgggtggccgaggtgggcggatcacctgaggtcgggagttcaagaccagcctgaccaacatggagaaaccctgtctctactaaaaatacaaaaatcagcagggcttggtggtgcatgcctgtaatcccagctactgggaaatctgagacaggagaatcactcgaacctgggaggcggaggttgcagtcagccaagatcgtgccattgcactccagcctgggcaacaagagcaaaactccgtcgcaaaaataaataaaataaaataaaataaaataaaataaaataaaataaaataaaataaaatataaaataaaataaaataaaataaaataaaataaaataagatagggcaacttcatttacctaaaatggagcacaagatcctttagaaggaactcatactcattcctgcaaaaattctgccaactcttgaaggtagcacagaattaagcatttgtgtgtgtgtgtgtttccaaagaggttttagccaagattgtggtctctaacagactccctgattaaaatagggtttagaaactatactgcctacttgaaaaagcatcaaatctagagaatgcttttcacaggtatgaaaaaaatgaaaacaaaatcacattcttctatttgcaattccctttccctcactttccacttctattaaatatacttcagtaacattgtgcataggtgcagagaccacacatatctaaaaaaggaaaaaaccctcaaatatatggggatggactggcgactctgcctttgcagaaatcattttgtttcctccagacagaagtgtctcattattttcagcattcctatctaaaaggcaaactttgtttccattgactttgaaagggctaagcttaaatctgaactcttaaacaaggacaagagttcaattttctattaatgaaaatcccagacaggtttttcagcctaccaaatcgttatacttttcttattcactcttctatctctctccacaaccaccaacattaccacccacaaaagaagaagaaaatccctccaatgttccctgaatgtgtgctgctgctagctcggaagctgtgtagagttttgtaatggagtgtgaactgctgccccggatctgggctgtatctgtgttctatctcctatccagtcaggagagaaaaaggacaaatccgctgagcagggaaaaattctttccgcctcatttataacctctcatggatgcagcgctgaagagggtcgctaggcacacggggaccctgtcaagctgcccactggccagcgcgttctgcgccgggcggggtctccacgccctgcaggtctccgccttgcctggaaaggaagctgccccgccaggcagtgagatcggttgccgttccccacccacacccttggccagggaatgggtcacatcctcgatgcgccctcggcccagaaaacgcgccgctttccgggcggggggcgtcggcgacgggaaggacctcccctgctccttagcaaacactagggtcgcagtttcctaagagacgcgagtgggaaggggaggagggagcccaagaagaggctggtgctgggggcagagaaagcaacactaggatgcgggccggtgtgggaggaggaagggaagccccggaactagctgcaaattgttcgagcgggagaagctccccgccttcttcctggactaacgacggcacccggcaccgagcccccgactgcaaggaaggtgcactccacatcgacggatccctgtaaaacaaggaaggtgcaatccacaccgacggatctctgtaaaacacgcacttagccaacggaagggcaaggaccgataggcgcccccatggccaggccctggcccccttctttcctgggcgcctaaggtggtaggtagtcagccacaccaaaaccgccagccaggaaagggccagggcgcagggctgcctgctgccccctcgaagccagtgtcctctgcccaggaagatcaaatccacagagcagggtgcgtcaggggcttccaccaaacaccctggtgagagcaccccaggaggccacctcctggccagcacccagatgctttgcgactgcaggggaaagcaggggccctagtttccaggcttccctgccagggaggggctggaaagaccttagaaggaaagtttctctttccacaggggaaggatgctgggaaagagagggcagaaggtggggagcagcgtcaggaagatgtttctggcctgcgaggcttgcaccatctgaatcagggcggttctgtaagaaataaattcaccccagtattccgggaggccaagacagagggagcgcttgcgcccagaagtttcagaccagtctaggcaacatgttgagacccggtcactgaaaaaaaaattagtcaggtgtgatgggccacacctgtagtcccagctactcgggaggctgaggtgagaggatctcttgaggacacagtgaatcataatcttgtgccactgcactccagcctaggtgacagagcaagattctttctcatagaatagatgatagatagatagatagatagatagatagatagatagattacatatatatacttggccgcctgagttaggctggattaatactatcctccaaaagctaatataaatgtacatcaggtctttctagtgcagcgctgaagaggctgccactacgtgtgctggatgctgcttggcatggctaatggctcagtaagaggaggagtaggagtggaggagtgaagaaagaggaggaggagaagagaagaaaaggaggaggaaagagcaagaactacaagagaaaaggagaagaagataggaagaagagaggaagtggagaaaaaaaaagcagaggaggacaaccggaccaggagaggagaggaaaaaagggaagctaggaggaagtagattaaaaagagagagaaggagaaggaggagaacaataagagaatgaggaaaaagaatgaggagaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccaaagcaggagagccacatcacctaggtgagagccccagagatacagcacaatgccttctgtgggtagggctcaggaagaagaggaaagttacataacctaggggctacagccagctatatgtcacaatcacccgaaggggcagggacaatgcatgagaggagagtcatatcaagtaagtggtgagcaaagcaatattaacaatcagagcagagtgtcatctcctacattctgggccatgagatatgttacaacctcccctatgggcaaagccccaggtaatagaagagatttacatcaaatagttgatgggctaagagatacttcacaatgccccctgcagaaagagagtaggagaaataaatcagattgcctgtgtgctgggccccagggataagccagtttttcatctgtggacatggcccaggcaggagagggagtcacatcactgagatgctgggcacagagatatgcaacaagcttttctataagcaaaaccctggtaagaacagaaagatacatcaaatattttatggacccagagatacgtcacgatgtttcctcttgacagagtcaaggcaagaaagtgacatcaccttggtcctgggtcccacaataggtcacaatgccttctgaaggcagggacaaggctaatgagtaacatcttaaagctgggcccagcatatatgtaacaatctcccttgtgggcagaacctaggaagaagagaagtgtcacattagctaggtgctgagctcagagatatgtcaccttccctcctgtgaacagaaaccaggcaagagatgagagtacattacctgggtgatgagtgcagagagatgtcacaatcccccctttaggctggacccaggcagaagagtcacatcacctgggtgttaaaatgagcaatatgacacaatgccccttattggcagcaccaaggtaggagagaaaatttacattacctgactgcaaatcccagcgatatgtcacagtgcctcctgtaagaggcaccaaggcttgagaatagagtcatctcacctgggtgctgggtccagcaatatatcacaattctacctgtgaaccaagccaggcaggagagtcaaatcaggtgtttggcagaggtgtatgtcacaatcagaccttcaaaaaatacagggatgaaattaccaatccctcacatgttctggttctaggtatgagagtccacatgtcttgtatgatgggtaaagtagacaagtcacaacctcaactgtgaactggatctgtgcagcagcttctcaatgttttctgggcattgtgtccccttagaaaagtcacagcctgacacgtgtgctaaattatggtttaagggtcacaaaatccatgcataacgaattcatgaatgagagtcaacattgcaacttttgactgcctctagatataagattcaaatcctcaacagtgggccatgctcatgtgagaggacaacaatctttactcttgactgtgtctgcttactactgtcacaatcttacctttcagctaggctattagtacactctctgtaccacccaaagaatttatgagatacatggtttggctctatgtcctcacccaaatctcatctacaattgtaatctccacgtgtcaaagcaggaaggtaactggatcatggggcagtttcctccatgctgttttcgtgatagtgagtgagttctcaggagatctgatggttttataaatgttggaagttccttcttcattcactttctccctgctgccacctgttgaagaaggtccctgcttcctcttctgccataaatgtaagttttctgaggcctccccagccatgtggaactgtgagttaattaaacctcttttctacataaattacctggtcttgggcagttctttatagcagtgtgaaaatgaactaatacaatatgatatgcatgtgagttgcaatctgcattaagaccttcatgctgatatgggcccatgattgtacctgtcattctaagctcaggtatgagagtcaacacctccccaattggctgtgtctaaatagaagagtactcatctgcctatgagctggatttagagatgggtcactatcccatatgtgtccagatgttcacatatgactgacacattccatctgtagactgtgtctacatatgagattcaggatctcaccagtgggttgtgtccatgtgtgaggatgactatcttaaggattggcagggtgtgtataccagaaatacaatatctcctgtgtccttggacctgtggtgacactctctgtaccactataggactttagagagtggtaaacctctgtgacttttgtacaaaaaggacacccaggatcttatctttttccttaagcttagctataagagacagtatctctctcattggcaagttgaaggtatgacagtcatcatcacaccagtgagctgggccaagatatatgtgacaatcactcctccagatcaggagtaagcaggagagtaacattacctgggtttggggccagatgtatgtcacagtcttctctaagggctcagcaatatgtcacagtgatctatgtattcaagacccagtcaaaagagactcaccactttcttgcagggtccagtgatacgtcataatcttttctgttaggagggtccaggcagaaaagaagagtcacatttcctacgtagtgtatgtggatatatgtcacaaggccccctgtgggcagggcccaggcaggagcctcttattttctaggtgtgggacccagcgttatttcacaatacaccaaatatgtggggcctagaagaaaggagtcacatcacataggtgctgagccaaatgatatgttgtaatccccctttttagcagggcccaggcagaaaaataaaatgtgtcacatcatccaagtgataaacaaaaagagtaacattacctatgtgctgggctcagcgatacatcacaatacctccttggtcagagcccaagaagtagaagagagttacctcacctaggtgctgagtccatcaatatatcacaatacctactgagtgaagggcccaagaatgaggattacatcatttcggtgaggggcccagagctatgtaccaaagctccctgtaggtagggcttaggaaaaaagaagagagtcacataacctgtcacataacctagacagatgagcccagccttatgtcaaaattacaagtggtcagagtccagacatgagaggagaatcacataacataaatgttgggtgaaggaatatgtcacaatccctactggggacagaagcagaaaaataaggagaattacaccatctaggtaatgggcccagagatatgttgcagtgacccctgtgggcaatgaccaggcagtagaatcacattgcctgtgtgtcgtgcctagtgatcatttactttacatccagtgagcatagcacaggcaaacgaggagagtcacaacacctaggtgctggaatcagagacatgtcacaatctcttctaattgtaaagcccacataagcaagaagagtcacatcaaatagttcatgaacttagagatatgccacaatgccccctgtgggcagggtccaagcaagagactcatatcatgttgttgctgagcccagtaatatgtcacaaagctttctgaggtcaggaccaaggcaaaagtgtagcatcaccttactattgagtccagagacacatcacaatctctcctgcaggcagaacctaaaaagaatagaagagtcacatcaactcaatgctgggcccagtgatgagtcacaatattccctgtgagcagcgatcaggcagaagtgagtcatatcacctggctaatgggtgcagagatgtcataatgcctcctgtaggaagggccaaggcaagagagttacatcacctgggttctggaccaagcaacatatcacaatgggccgtgtgggcagggtacaggtaggagaaccacataacttgggtgtggggcccaacgtcacaatgccttctgtgcacagtgacaaaacagaagaggagactgacattaactgaatataaggcctagtgacagtgatatgtcacaatgctgtctatgggcagtgccaaggcagtggaatagagtcccatgatgaaggtgctgggtttagcaatatgtcaaaattccatctgtgggttgggccaaggcagaagtgttaaatcactcagttgctggacagaggcatatgtcacacagtctcacatgcagaaagatacagggataaagttaaagttcttgcacatgacccaattctaagtatgggagtcaacatctcctctatgttgggtctaaatacatgagtcacaatcttaatggtggactaggtctgtgcgtgggaacctcgctttcttctgtgcactatgcctccttagtagagtcacagcctcacaggtgtgctgaatcttggacggagagtcaccagcccacctgtggactggatccacatataagagtcactttttcaagtttcgactgcctccaaatgtgacattcagaacctcaaaagttggctgtgttcatgtggcagtatgatgtgcataccagtgtcaaaatctcacctgtgctgtgccttgtcaggaaacactttgtagcacctgagggctttatgcatgagagcctcaatatgctttgagacctcccttctggtatggacccatggttataatttttaccctaaccgcttgtctcagagtcaacttctcttcaattggctcagtccaaacagaagtgaactaggtttggaaatgagtcaccatcccaactgtagcaaatgagagaaacaattccagctgtggactgtgtcaacctgtgtgattcaggacctcacctgtgggctctgtccacgtgtaagggtgaaaatcctaatggatggtagggtgagaatatgagaaacacaatctcatttgaatgctgggttccgtggtgacattttgttccacactagggctttatacaatgtgtgagaaagtggtaattttctataaccttcatacaaagaggagacatgggattttacccgtgtctctaacctcagctaaaacagatagtatattttctgttggctggtgtgtggtattagagtcatcattgcaactgttagctggaccaagatatatgtccctacctgtgggtagggagcaaacaggagagtcacatcgcctatgttctggtccaggaatatgtcacaatcttccctgacagaagggaccaggcagaggaataatatcacctgggtacttagccaggaatatgttacaatcacaatcccctcctgaaagctggatgcaggatgtagactgcagaaccacatcaccttggtaatgggcccagcgatgtgtcaaaatgctttctgtgggcaagactcaattaggagagacttatcatctgtttgctgaggccagcaacatgtcacaatcttccctgtaggcagggtgcaggcagaagaagagagccacattgcttaggtgataaatgcagaaatatgtcaccaggtccactgtggacaggccccagccaggagcgttccatttctaggtattgggcccagcgatatgtcacaatacccaaaacatgtggggaccaggcaaaaaaaaaaaaagagagagagagagagagactcatatcacctagatgatggatcaagtgatatgtcacaatcttcttatttggcaggtcccaggcaacaaaaatgtgtcatatctcctaggtgatgaacaaacagtatcatataatacccctgtcttcagggaccgtagagtagagttgcatcacgtacttgttgggtgcagccatatattacaacacacaatgtatgccgggcccaggcaggagaggagagtaacatcccttaggccctgtgtccagggatacatcacaatgcctccttcagcagagcccaagaagtagagaagggtcacattacttaggtgccaggtacaacaatttgccacaatacttcctgagagaaaggcttaggcagaggtgtcacatcaccttggtgagggaacaagaaatatgtaacaatgtccctggtaaatacagctagaaaaaaagataagaatcacataacataaggtcagtgcccacttatctgtcacaatcacaccagtaggcagggctcaggcaagagtagagagtaatataatgtaggtgctacagcaagaaatatgtcacaattttcactgtggacaagtcccagaaagaaaatgagaatcacatcacctaggtcatgggcccagagatatgtcacagtggcccttgtggacaataatcaggcagaagaatgacattgcatttgtgctgggcctagtgataattcattattccttctgggagcctggcacaggcaaaagaggagagtcaccaacacctagctatttggcccagagatatgtcacaatctcttctatgggcaatgtccaggtaaaacagcagagtcacatcaaataattgatgcagccagagatatgtcataatgccttctgttggcagggcccatgcaagagagtcacagtgtcacaaaacacaatgtattcagggctcaggcaagagatgatagtcacatcatttaggtcttggatccattgaaacattacaattttgtattgagcaaaggctaagcagtctagaagagtcacatcacctaggctttacgtccagcaataccttgcaataacccctgagaggagagcccaggtaaaaggataactttatttaggtgagagtcctagaaatacgtcacaattatctgtgtgggtaaagatcaaaatgggaggcagttccaagatggccgaatgggaacagctgcagtctacagctcccagtgtgagtgacgcagaagatgggtgatttctccatttccaactgaggtaccaggttcatctcactggggcttgtcagacagtggaggcaggacagtgggtgcagcccaccgagtgtgagctgaagcagggcaaggcatcacctcacctgggaagcacaaggggtcagggaattccctttcctagcaaagggaaggggtgacagacggcacctggaaaatcgggtcactcccaccctaatactgcacttttccaacagtcttagcaaatggcacaccaggagaatatatcccgtgcctggttcagagggtcccacgcccacagagcctcactcattgctagcacagcagtctgagatcaaacaacaaggccacagtgaggctaggggaggggcgcccgccattgctgaggcttgagtatgtaaacaagtggccaggaagctcaaactgggtggagcccactgctgctcaaagaggcctgcctgcctccgtagactccacctctgggggcagggcatagccaaacaaaaggcagcagaaacctctgcagacttaaatgcccctgtctgacagctttgaagagagtactggttctcccagcacagagtttgagatctgagaacggacagacttcctcctcaagtgggtccctgacccctgagtagcctaactgggaagcacccccccatagtggcaaactgatacctcacatggtcgggtacccctctgagatgaagcttccagaggaaggatcaggcaggaacttttgctgttcaacaatattcgcagttctgcagcctctgctgctgatacccaggaaaacagggtctggagtggacctccagcaaactccaacagacctgcagctgagggtcctaactgttagaaggaaaactaacaaacagaaaggacatccacaccaaaaccccatctgtaagtcaccatcatgaaagaccaaaggtagataaaaccacaaagatggggaaaaaacagaacagaaaagttgaaaattctaaaaatcagagcacctctccccctccaaaggaatgcagctccagcaacagaacaaagctggacagagaatgactttgatgagttgagagaagaaggcttcagatgatcaaacttctccgagctaaaggaggaagttcgaacccaatgcaaagaagctaaaaaccttgaaaaaagattagatgaatggctaactagaataactagtgcagagaagtccttaaatgacctgatggagctgaaaaccatggcacaagaactacgtgatgaatgcacaagcttcagtagctgattcgatcaactggaagaaggtatcagtgattgaagatcaaatgaatgaaatgaagtgagaagagaagttcagagaaaaaagagtgaaaagaaatgaacaaacctccaagaaatatgggactatatgaaaagaccaaatctacacctgattggtgtacctgaaagtgatggggagaatggaaccaagttggaaaacactctgcagggtattatccaggagaacttccccaatctagcaaggcaggccaacattcaaattcaggaaatacagagaatgccacaaagatactcctcgagaagagcaactccaagacacatatttgtcagattcctcaaagttaaaatgaaggaaaaaatgttaagggcagccagagagaaaggtcgggttacccacaaagggaaacccatcagactaacagcggatctctcagcagatactctagaagccagaagagagaggggaccaatattcaacattcttaaagaaatgaattttcaacccagaatttcgtatccagccaaactaagcttcataagtgaaggagaaataaaatcctttacagacaagcaaatgctgagagattttgtcaccaccaggcctgcgctacaagagctgctgaaggaagcactagacatggaaaggaacaaccggtaccagccactgtaaaaacatgacaaattgtaaagaccattgatgctaggaagaaactgcctcaactaacgagcaacataaccagctaacatcataatgacaggatcaaattcccacacaacaatattaaccttaaacgtaaatgggctaaatgctccaattaaaagacacagactggcaaattggataaagagacaagacccatcagtgtgctgtattcaggaaacccatctcatgtgcagagacacacataggctcaaaataaagggatggaggaagatctaccaagcaaatgggaaacaaaaaaaggcaagggtcacaattctagtctctgataaaatagactgtaaaccaacaaagatcaaaagagacaaagaaggccattacataatggtaaagggatcaattcagcaagaagagctaactatcttaaatatatatgcacccaatacaggagcacccagattcataaagcaagtgcttagagatctacaaagagacttagactcccacacaataataatgggagactttaacaccccactgtcaacattagacagatcaatgaggcagtaagttaacaaggatatccagtaattgaactcagctctgcaccaagcagacctaatggacatcctcaggactctccaccccaaatcaacagaatatacattcttctcagcaccacatcacacttattccaaaattgaccacatatttggaagtaaagcactcctcagcaaatgcaaaagaacagaaattataacaaactgtctctcagaccacagtgcaatcaaactagaactcaggattaagaaactcactcaaaactgctcaactacatggaaactgaacaacctgctcctgaatgactactgggtacacagtgaaatgaaggcagaaataaagatgttctttgaaaccaatgagaacaaagacacaacataccagaatctctgggacacatttaaagcagtttgtagagggaaatttatagcactaaatgcccacaagagaaagcagggacgatctaaaattgacaccctaacatcacaattaaaagaactaaagaagcaagagcaaacacgttcaaaacctagcagaaggcaagaaataactaagataagggaagaaccaaaggagatagagacacaaaaaacccttcaaaaaatcagtgaatccaggagctggttttttgaaaagatcaacaaaattgatagacagctagcaaaactaataaagaagaaaagagagaagaatcaaatagatgcaataaaaaatgataaagggaataacaccactgatcccagagaaatacaaactaccatcagagaatactataaatgcctctatgcaaataaactagaaaatttagaagaaatggataaattcctggacacatactctctcccaagactaaaccaggaagaagttgaatccctgaatagaccaataacaggctctgaaattgaggcaataattaatcgcctaccaaccaaaaaaagtccaggaccagacggattcacagccgaattctaccagaggtacaaggcggagctggtaccattccttctgaaactattccaatcaatagagaaagaaggaatcctccctaactcattttatgaggccagcatcatcctgacaccaaagcctggtagagacacaacaaaaaaagagaattttagaccaatatcccaggtgaacatcaatgcaaaaatcctcaataaaatactggcaaacccaatccagcagcacatcaaaaagcttatccaccatgatcaagtgggcttcatccctgggatgtaaggctggttcaacatacacaaatcaataaacgtaatccatcatataaacagaaccaaagacaaaaaccacatgattatctcaatagatgcagaaaaggcctttgacaaaattcaacaccccttcaagataaaaactctcaataaattaggtattgatggaacgtatctcaaaataataagagctgtttatgactaacccacagccaatatcatactgaatggacaaaaactggaagcattccctttgaaaactggcacaagacaagtataccctctctcaccactactattcaacatagtgttggaagttctggccagggcaatcaggtaagagaaacaaataaagatattcaaataggaagagaggaagtcaaattctctctgtttgcagatgacatgattttctatttagaaaaccccattgtctctgcccaaaatctctgtaagctgataaacaacttcagcaaagtttcaggatacaaaatcaatatgcaaaaatcacaagcatttctatataccaataacagacaaactgacagccaaatcatgagtgaactcccattcacaattgttacaaagataataaaatacctaggaatacaacttacaaggcatgtgaaggacctcttcaaggagaactacaaaccactgctcaaggaaattagagaggacataaataaatgcaaaaatattccatgcttatggatagggagagtcaatatcttgaaaactgccatactgcccaaagtaatttatagattcaacgctatccctatcaagctaccactgactttcttcacagaattgtaaacagctactttaaacttcatatggaaccaaaaaagatcccacatagccaagacactcctgggcaagaagaacaaagctggaggcatcatgctatctgacttcaaaccatactacaagtctacagtaaccaaaacagcatggtactggtaccaaaacagatatatagaccaatggaacagaacagaggcctcagaaataatgccacacatttacaatcatctggtctttgacaaacctgacaaaagcaagcaatgaggaaaagattccctatttaataaatggtgttgggaaaactggctagccatatgcagaaaactgaaactggaccccttccttatatcttatacaaaaatcaactcaagatggatcaaagacttaaacataaaacctaggaccataaaaatcctagaagaaaacctgggcaataccattcaggacataggcatgggcaaaaactccatgtttaatacaccaaaagcaatggcaacaaaagccaaaattgacaaatgagatctaattaaactaaagagcttcagcacagcaaaagaaactatcatcagggtgaaaaggccacccacagaaagggagaaaatttttgccatctatctatctgacaaagggctaatatccagaatctacaaagaacttaaacaaatttataagaaaaaaaaaaccatcaaaaagtgggcaaaggatatgaacagacacttctcaaaagaagacatttatgcagccaacagacgtatgaaaaaatgcccatcatcactggtcattagagaaatgcaaatgaaaaccacaatgagataccatctcatgccagttagaatggtgatcattaaaaagtcaggaaacaacagatgctggagaggatgtggagaaatagggatgcttttacactgttggtgggagtgtaaattagttcaaccattgtggaagacagtgtggcaattccccaaggatctagaactagaaataccatttgacccaggaatcccattactgggtatataaccaaaggattataaatcatcctactatagagacacatgcacacatatatatactgcagcactattcagaatagcaaagactcagaaacaacccaaatgtccatcaataatagactaggtaaagaaaatgtggcacatatacaccatgaaatactatgcagccataaaaaaggatgagttcatttcttttgcagagacgtggatgaagctggaaaccatcattctcagcaaactatcacaagaatagaaaatcaaacagctcatgttctcactcataagtgggagttgaacaatgagaatacatggacataatgagaagaacatcacacactggggcctgtcaggctgtcgggggctagggaagggataacatcaggagatatacctaatgtaagtgactggttgctaggtgcagtgagccagcatggcacatatatacctatgtaacaaaactgcacgttctgcacacgtacccaagaacttaaagtataattaaaaaaattatatattgaaacaaacaagagcctgaatactcaagacaatcctaagcaaaaataacaaagctgaagatatcatgctacccaacttcaaactatgctacggggctatagtaaccaaaaaggcatggtactggtacaagaagagacacacagaccaataaaacagaatagagaacccagaaataagaccacatggctacaactatctgatttttggcaaaactgacaaaaacaagcaatgggaaaaggacaccccattgaataaatggtgctgggataactggctagccataggcagaaaattgaaacggactctcttcctccatcatcttcagcaaactaacataagatcagaaaaccaaacaccacgtgtcctcacttgtaagtgggagttgaacaatgataacacatggacacagggaggggaacaacatacactagggctagtcggaggatgggaggtgaggagagggagagcataaggacaaaaagctaatgcatgcatggcttaaaacctagataatgggttgataggtgcagcaaaccaccatggcatatgtatacctatgtaacaaacctgcacattctgcacttgtatcctgtaacttaaagtaaaatttaaaaaaagaaactgaactccttccttacagcatatacaataatcaactcaagatggtttaaagactaaaatgtaaaaccccaaactataaaaactttggaagataacctaggcaatacaattcaggacatacacatgggcaaatgttttatgatgaagatgccaaaagcaattaaaacaaaggaaatattgatgaatgggatctaagtaaactaaagagcttctgcacagcaaaaaaaaaaaaaaggaaagaaaaaaagaaaagaaaagaaaaaacaaaaactatcagcatagtaagcagaccacgtacagaatgggagaaaatttttgcaaactatgcatctgacaaagatttaatttccagcatctgtaagaacttaaatttacaagaaaaaagtaaacaaccccattaaaaagtgagcaaaagacaaaaagagacacttctcaaaagaagacatacatgcagctaaaaaagcatatgaaaaaacctcaacatcactgatcattagagaaatgcaaatccaaaccacaatgagatattgttttataccagtcaaaatggctattattaaaaagtcaaaaaataacatatgctggtaaaactttggagaaaaaggaacgtttttaccctgttggtgggagtgtaaatgagttcaaccattgtggaagacagtgtgatgattcctcaaagacctaaagacagaaataaaattcaacccagcaatttcatcactgagtatatacccaaatgaatatgtcattctattataaagtcattctattataaagacacatgcacacacacattcattgcagacctattcacaatagcaaatacattaaatcaacccacgtgttcatcaatgatagactggatgcagaaaatgtagtacatatacaccacagaatactatgcagccattaaaaaaaaaaaccaagatcatgtcctttttagacatggaagaagttggaggccattatctttagcaaactaatgcaggaaaaggaaaccaaataccacattttctcacttacatgtgggagctagatgatgagaacacacagaaggaacaacatgcactggggcatatcatgaggtggagagtgggaggagggagagaagcagaaaaaataactaatggatagtaggcttaatacctgggtgataaaacaatgtatacaaccaatctttatgacacatatttacctatgtaacaaagctgcacatcctgcacatgtacccctgaacttaaaagttagaaaaaaagttgtagcaaaaagatagattatttttgactgccttggtgcacagtccagagtcagcatggactgtccagctctaagattcttatttatcagaaagaaagcattctgtcttttgtctgcactactattatattgggtatccttctacttgtaggcaaatgtaatcctaaccaaagtgctagctttgacatggaatccctggtaatcttcggtaagacatgtctctttcttaagacattttcttatctgcatagtggtggaggcaggagtggggagatttaattctgaagttctagtgcttctatatggcccacctccataattccttgtacagtaatagcatctcagattctttttgtaggactactccaccacaaagggcttatcagtccgtgtgttaagtgtggatgtcaccactttctagatgcagaggacaggggacatattgggtatgctccagtgggagctgctgggggataaaggtgggtcccacatgcacacattgtctgtgggccttgaaggatcctgtgtgcatgactttttggacagaaggtccagctgcccagtgcagaacccatctatttctgcccaagtgaggaagatctgggcacaccctcatcacagccctgctacacccatcctagttggtagggaacttgcaccatgtgcaggctgagctgtggtttaagcactttgacatctaacatctcactggataactgggaaattgaagtctggagagaagcagagaatggcccagagaacataaagttggcagagtccagaggataaaagagcattctgacctcataggccaaggttcatccttataatggggtttgctttaggaatgagagtccctgagatcctgagaatttctgccaattttctcatatgcagcaaactcatgtctgcatcattaaacctgcacagttttgcatgcacgtgtgcacacacagacacacacacacacacagacttctcaggttaaaggaagagttaacactgatggagtgacgagaagaaagaagacagaggatggcggcagctttgccatggggtaggggcacccagtctcctggtaacatgtccaggacctataactgatgacttgggaacttcaaggttcccatggatctgcctgggctgtggccatccccaggaaagctttcagaggacaaaaacttggcttctgcattcactgctctctgtaattaaaaccgggaggaatccccctacacccagtatggaggggaatacagtagtgaaaacctcaaacttttttctctgtaaattgaagtaattgacctgagtggcctctaaatttcaaaggcttaaaaaggtgagttgaccttgctgtctatcagttacccactctactctcagatccttagaaatttctctattatcctctggaggtttttcagagcaaaaattggcctggcggtttgtgggactgagcactcagcttagtatagaacatggcagagcatcctatcactgatctgaaggccatccctgtcatagctttggggttcttttttggaagtggaaccagagtcattttccaggctgggatgatggagtcttgtgagttaactggatacctcagaacagcggaggcaaacaagaaagcatgggaggcttctgagatctcttacattgtcctggagcctgtaggcctcactaacttgccctcttgtttcttagtttatttttttgtttgttaaattgttttaaatttggattttaaaattttgtttagtctgctgaaggtttgtcaatttttaacttttcaaaaaagccaaattttttcattgatttctgctctaatctttatgatttttttcttctaataactgtgggtttggtttgttcttgcttttctagttcttttttttttttttttttttttttgaggcggagtctcgctctgtcgcccaggctggagtgcagtggcgggatctcggctcactgcaagctccgcctcctgggttcatgccattctcctgcctcagcctcccaagtagctgggactacaggcgcccgccactacgcccggctaattttttgtatttttagtagagacggggtttcaccgttttagccgggatggtctcgatctcctgacctcgtgattcgcccgcctcggcctcccaaagtgctgggattacaggcgtgagccaccgcgcccggcctctagttctttaagatacattattaggttgtttatttgaaaatgttcccatttttgggatgtagtcacttatacctataaacattcctgttagtactgcttttgtgtatcccatagattttgatacacagtgcttttattatcatttgtttcaagaacatttttaattttcttcttaatttcttcatggacccaataatcattcagaagcatattgtttatttttgtgtatttgtatagtttttataattcctcttcttattaatttataattttattccattgtggacaaataagatgtttgatattatttctagtttttgaatgttttaggacttttttgtgacctaacatatagtctatccttgaaaataatccatgtgctaaagaaaagaatgcattctgcaaccattagataaaatgtcctgtaaatatttactaggtacatttggtctatagtgcaacagattaagtccaatgtttctttgttgataatgtgtctggaatatctgtaacatctattcaatgctgaaagtgggtttttggagtctccacctattattgtattagagtctatctctctcaggctctaataatatttgctttatatatttcagtgctcaagagttggttgtatttatatttaaaattgttataccctcttgttaaatttacccctttatgattacatagtaacctctctgtctttttttttttttttttttttttttgagatggagtcttgctcttgaagtgcagtggtataatctcagctcactgcaacctccacctcccaggttcaagcaagtctcctgcctcagcctcccaagcagctcggactacaggtgcatgccaccacgaccaaataatttttgtagctttagtagagatgggatttcaccatattggccaggttggtctcgaactcctgacctcgtgacccacacactttggcctcccaaagtgctgggattacaggtgtgagccaccgcacccagccctctttgtctttccttataaattttgtctaaaaatctatttttctgatgtaagtatagctactactgcatttttttaattgacattgaatatctttttccatttctaaaatttttagtctatgtatgtctttatagatgaggtgaatttcttacaggcaaaggatcaatatgtcttgtttttatatacattcatccactctgtcttgattggcgagtttagtccatttacattcaatgttattattgataagcaaaaccttacttctgccattttatttgttttatggttgctttggggtcttttttatctttctttgctttttgtcttccttttagtgaaggaggtcttctcttttatctttctttgctttttgtcttccttttattgaaggtagttttctctggtgatgtgacttagttttgtgctttttattttttgtgtattcttgtatgttttttggtttgaggttaccatgaagcttgcaaatgctatcttgtaatctattattttaatctaataacaacttaacactgtttgaataaacaaagaagcaaaaagaataataaaaactgtatgctttaaatctcttccctcagtttttgttgtttctatttatatgtaattttactgtctatgtcttgaaaagttgttgcagttgttatttttgattggtttattgtttagtctttctaccttgcataaaagtagttcacacaccacagttacggtgttataatattatttaattttctgtgtacttactatcaccagcaactgtatttaactatatggtttaaataattcctccatcagcaagtgttagccgagtttggtttgctttttctttccgttataacaggaaagcactgaattcaatgcctcacaattgctgaactctccctttctgcaccatgccaccattgttgggggatgtgggaaaaatagtgtaaaagattcaagactgttattcctacccgttcagtgcctctttcagcaatatgaagttaaaaccaggtaccatgagtgctcacctgacttttggttcttacgaaggtgctttttaaatgtaggtcattgttaaattggtgtccttgcaggggggatggttggcgaagccttccattctaccatcttgatgtacctatgagccatctatgacattttaacttaattagtttaaagctacataaccatataagctttccattgtctaaattattagaggcccaattttaagataaatttttggcctctacatttctttattataacatttagtaaatagaaaattatcaaaaaactattcaaaacatttagtctgtaactgtcattgctaccatacaataaattctatgagggcagggactcagtctgtgattcacaggttctctgatatgtgactgctctttgtgggaatttaacctctgcataaaataatgaatacatgtctgcacatttaaaaaataattccacataaaatgtagatctatctgattatcttaggaaactgtatattccttccacagcatgaagaggttatactgtttatcctggggtcatggcttaggagaacaatgggcctgactatagaaaaaaacaagcggtaatcagtttagagttgttcataagccaacaatttgaattatacaaaataaccatatatactgaaaagatgtaggagagagtgtaaaatgatacaaaggtgctcctttaggacaaagatgctttgggtgactctggactcatgtgagaatttaggagtggtgttggacctatgaatatgttggacccaccacttgtgttgaacagaataaaggtcatggagctgttggcccaggttataatttccaaacacaaaacactaaaaaatgataaaaacatgacatgtcataaatgtggaattctgttattaactactccagaacagtgtttaaaataatctttgtgttctttatggtgttccacttaccagtaacatacacaggaaaaaatgacatttacaagcctattcagaattcagcacataatttggatattagagattcaaatatatttggaagcatgtagtttaagctacgttcacctgaggttttgggggctgatggtgatgacctgggagatactcaagaggcagatggtgccaatgcacatgctgtggccactctgtgaatacagaaaacaactttctatctaatattactgaaaaaatatttcaactccaaatcagtcattgtctaagggacctttttggagagtaccaaggagttggccataggtgcttgagagtcaaatctgtgtatcacaatgtgcatctggtaattaaagaaaatctgatgtcaaggaagaaaaaaaatccaactatttaactatggtctgagataagatcattcctactgctatattactggagacaatctgatattttcaagtaactgataatttcatttccatgtgaggagatctttcatggacagatgaggtctgttttatggagaaaatagaaacattctactgtgtacttcccattgtatccaactcagaaatattttattgaaacttttatttcacaatacttttgttctaaagagaaaaacatatatattcccactatactataacactactctagaatactataacaggttttacatgtatttttatcatacatctacaatgtgctttattgttccctttttacaggtaaggagatattaaacaaaagaaggctgaatgacatttctaaagtcacctcattgtaaaaagaaagtttcaggtgtagacaatgtgcttatccactatgtttctcaatcttacagacacagatacactttaatatgtcacaaatttgttatttttaattttgcatatttgtcagttataaaatatatttgtactttaaaagagttttgattgtagcgatctcatttaaatctaaccaaattaaatctaaccatttattacagggaaaattgtatttttagtgaatgaaaacatcaaataaagttatttcaatgttagaatcattaaatatattaaaacaaatccattttggagaggaaaactggaggcacagatacttatttacttaaataattgaaatagttgaatattaagcctggcaagggtttagaattttttttttctttgagacggagtctccctctgttgcccaagctagaatgcagtggcacgatcttggctcaccacaacctccgcctcttaggttcaagtgattctcctgcctcagcctcccaagtagctgggactacaggcacatgccaccatgcccggctaatttttgcatttttagtagagatgggctttcactatgttggccaggctgcggctttagaatatttttaaaccaagaagaaatgtcacaaactattcaattctgaaaacaattgaaatccatgcttttttttttctaatgtgaaaacattaaggtcatcaagttacctttccttgaatcctccttccctgatttaatgaagcaaatagtcttatcataattgacaaagaccagatgttttctgtcgccatccaattatgatctttcttaagtatataatatgccctagcaggtaaaataacacaacaaaaaacctacatttaatatttttgaaaagaataagataattcaatcagctacattctatgcactttatatgcatgaaggtattggagaaatatatctactaatcttggagtcattcctgactcttgtagagaaaataagagttagcggattaatagtcaaaatgtattgaagaacttttcataaaacatattccatatctttatacatcacaaagcaacaatgaggaccactgagaattacattatattaaattatgatcagttatggaatggcttatgttcttgatattatattctttccacaatttcagcctatgagttagtaattatttcacaccttatgcatggttttggcagtggtcagtttctggaacagaagagttactttttcagacaaggcacaacctacaacaaatttaatttaaagatggaattggcttatatttgtaattgtagagttttatggattctactttgaggctcaaacagcactaattcacttgggttagcttcaaatgcattatgaagtcaaacttagccagttttttggtatcaatatttgttgtctaagattccccaggtcttcctggatattaatgcaccattacatgtgcattttgtttaattttggttcagagaaagcagatggtacctccagatgtggcccctaaacaatccctgcagctcaactctactgaacccacagagcccactccgtgtcctcaatctaggtctggagtgaagctttgcccaagacaatctatacagagccttttcacaagtgccatttcatgaaatgacagttaaataaagatgggaggagactgaggtaaggtcctgggtgagtgcaagccaatgtgtcaggtaggagactgcagaatcaaaggttagtcagtgctaaacacagcactgcattaagaagataatcaaccaagaatgactatcacctgggttgatattgccattcttcatgtctctttcttttctctctttctccagacttctttcttagataagatcagtcctgagaagtcacttcacaatgtataatatgacatttagaacttcaaatatgccttttttttttggtgccacaatccagtaattaggaagaaactcacatgttgaaaaaaggttctatgctgaccagtagaagaaaaaaaaaattcacactgaaaactcttatatgaagtctgggcattgtggctcagcactttgggaggcagaagagggtgaatcacctgagctcactttgggaggcagaagagggtgaatcacctggggaacatggtgagacaccgtctctacaaaaatataaaaattagctgggcacggtggcattcgcctgtagttccagctacttgggaggctgaggcaggataattgcttgagccccagaggcagaggttgcagtgtgccaagattgcactattgtactcctgcctgggtgacagagtgagactttgtcttaaaaaaaaaaaattacatggagacaaacaaatgatctatttctactcttttccccaaattactatctaatgttagtgaagcccacacattaggtaacagccaggggtatgtggctggactcatcctccctttcaaatcacaaaaccctcagtttctgctagtccctgctgagcatagggtcaccaggggagaatgaacacagcttttcatttcttgtggtcctgcatttcccagccttccttccatttctgagccctaacccggaaactattcttttatgctccatcctgcatgctgaagttgaccttttggtttatttttttgtcacactcgagcctgagtgtgacaaacagggagagaaagagagagagagaaaaaatgagagtaaggggagaaggtcttaattgtaatattaattatcttttacctttgttcactcatttatttattggtctttcatactgtttgctattttttgttattgttatatattcactgttggtgtttaaatttattttgagacagatgttggtcgcaagtgttggacttagccaacagcttgcattgtctaaagtcgaccaggtggctcttgccggcggtagtaccacacaggtccagcagagggatgcaatggtgattcactgtggcctccatctccccggtcttgcccaggtggtctacccatcttggccttccgagtagtacgtgggagtactcgcattttcttcttctgtttgttctctaaccccactttcagattgtttccatagtacttagagtgatttgttgttgtttttcttctttgttcttttctctattttccttagctccttcctggacattgaaattgaagttttagattttattttttgtcacactccagcctcggtgtgacaaatggaaaaaagagagagagagatagaaaaaagagagaggaaaggagaagatctcaattgtgatattaattaccttataccattgttcactcccactttattggtctgtaatattggttgttattctttgttattgttaaatatttactgttgggtttttttgtttatttattttgagactgatatcggcctcgagcctcggacttagcttccagcttaccatctttaaggctgaccagatgactctcgctttgccatatctaaggtcgactggatggctgtcgctggaggtagtaccattcaggtccagcagagggatgcgattgtgaatctctgcgtccttgatctccctggttccacccaggtgatcttcccatctcagcctaccagtacctgggactactcggaccttcttcctctgtttttttcctaaacacacttccagtttgtttccacaatacttaagagtgacttgttgttgtttatcttctttgttcttttttctttctattctcctatgctccttcctgtacgctgaagctgaccttttggtttgttttttttggtcacactccagactgggtgtgacaaagagacagagagtgtgtgtgtgtgtgtgtgtgtgtgtgtgaaaataaatgttaattttgacactaattaccttttacctttgttcactcccatttatttatttattggtctttaattttttttgttgttatgtatttactgtaggtttttaaatttattttgagacagatgtcagtcgcaagcgttggacttagcctccagctttccatgtctaaggttgaccagatggctctcgccttgccatgtctaagatcgtccatatgattttcaccagtggcagtaccgttcaggtccagcaggaggatacgatggtgattcactctggccttcacttccccggtcttgcccaggtggtcaacccatctcggccccttgaatacctgggactactcggaccttcttcctctgttttttctaaccccattttcagtttctttccacagtacatagagtgatttgctgttgtttttcttctttgttcttttctctcagtattttcctacactccttcctgcacactgaggttgacttttagatttttttatcacactgtagcctgggtgtgacatacagggagaaagagaaaagagatcttaattgtgatattaattaccttttattattgttcacttccacttatttattggtcaataatattgtatgttactatttctttattgttaaatatttactgttgttttttgtgtatttattttttgacagatctcagccacaagcattggacttagctgccagcttgccatgtctaaggtcaactaggtatctcttgccttgctatgtataaggtcgagcagatggctctcgctggtgacagtacagtttatgtgcagcagagggatgcgatcgtgattcactgtgacctcaatgttcccagtctcacctgggtgatctatccatcttggcctcccgtgtacctgaaacaaccttcttcctctgttttttatctaaccctactgatagtttgtttccaaagtacttacagtgacctgctgttgtttttcttctttgctcttttctgtgttttcctatgctccttcctcctcagtgaagttgaccttttaaatatttttttatcacactctagcctgggtgtgacaaaggggagagacacacacacagaggagagagagagaaagatcttaattgtgatattaattacctttgttaactctcatttatttattggtgtttaatattgttatcatttctttgttattgttaaatatttactttttttgtttatttattttgagagacattggcagtgagcattggatttagctgccagcttgccatgtctaaggttgaccagatggttctcaccctgacatgtattaggtcaaccagatggctcttcccttaccatgtcgaagattcaccacatggctctcactggtagcagtactgttcagttccagcagaaggatgtgatcgtgattcactgcagcctcaatctccctggtcacacctgcgtgttcttctcatctcagcctcccaagtacccgggactactcagaacttctttttctgtttttgtttgtttgtttgtttttttctcaacccactttcagtttatttccacagtacttatagtgacttgctattgtttttcttctttgttcttttctctattttcctacacttcttcctgtaagctgaagttaacctattttcttttctttctttctttttttttttttgtcacactccagcctgggtgtcacaaatggagagaaagagagaggagaaaatcttcattgtgatatttattgtactctacctttttcactcctccttatttattttctttaatattgtttgttattatttctttgttattgttaaatatttactgttgggttttttgtttatttattttgagacagctgttggctgtaagcattggacttagccaccagattgctatgtctatggtcgaccagatggctcttgccttgccatgtctaaggtcctccagatggctcacgttttgctgtctaaggttaaccatatggctcttgtcagcagcagtcccattcagctccagcagagggatgcaatcctgattcactgcagccttgatctttccagtcttatccaggtagtcacacaacaaaacgtcaacctcggcatgcaggaaggagtgtaggaaaatactgggagaaaagaacaaagaagaaaaacaacagcaaatcactctatgtactgtggaaagaaactgaaagtgaggttagaaaaaaacaggggaagaaggttcgagtagccccaggtattcaagaggcagagatgggtagaccacctgggcaagaccagggaggtcaagggccacagtgaatcatgatcgtatcttcctgctggacctgaacggtactgccactggcaagagtcatatggatgaccttagacatggcaaggccagagccatctggtcgaccttggacatgaaaagctggcggctaagtccaatgcttgcaaccgacatctgtctcaaaatatatttaaaaacctacagtaaatatataacgataacaaaaaataataaaccatattaaagaccaataaataaataaatgggagtgaacaaaggtaaaaggtaattagtaccacaattaagatttattttctctctctcacacacacacactctctctctctgtctctttgtcacacccagtctagagtgtgaccaaaaaaaaaaaaaaaaaacaaagattagcttcagcatacaggaaggagcataggagaatagagagacaaaagaacaaagaagataaacaacaacaagtcactctaagtattgtggaaacaaactggaagtgtgtttaggaaaaaaaaaaaaaaaacagaggaagaaggtccgagtagtcccaggtactcggtaggctgagatgggaagatcacctgggtgggaccagagagatgaggccacagtgaattacgatggcatccctctgctggacttgaatggtactacctccagcaagagccatccagtcaaccttagacatggcatagcgagagtcatctggtcagccttaaagatggtaagctggaagctaagtccaagccttgaggctgatatcagtctcaaaataaattaaaaaacccaacagtaaatatttaacaataataaagaaagaataacaaacaatattacagactaaccccactttcaatttgttccacagtacttagagtgacttgctgttgtttttcttgtttgttcttttctttattttcctatggtctttcatgcacattgcagttgaatttttaggttatttttcatttgtcacacttcagcctggatgtgacaaaaggagagagacagagagagaagatcttaattgtgatattaattaccttttttttcgctcccacttatttacttttggtccttaatattgtttgttatttctttgttattgttaatttttttttactgttggtatttttgtttattaattttgagaccgatgccacccatgacccttggacttagctgccagcttgccatgtctaagtttcactagatggctctcacctgtggcagtaccattcaggtccagcagagggatgcaactgtgatccactgcagccttcatctccccagtctcacccgggtggtcttcccatcttggcctccttgagtacctgggactactgagaccttcttcctattttttttctaaccccactttcagtttttttccagagtacttagaatgacttgctgtccttttgcttttttttttcttttctctctctcttttcctacgtagctttctacacgcttaagtttaccttttagggtgggaggagccaagatggccgaataggaagagctccggtctacagctcccagcgtgagcgacgcagaagacgggtgatttctgcatttccatctgaggtaccaggttcatctcactagggagtgccagacagtgggcacaggacagtgggtgcagcgcaccatgcgtgagccaaagcagggcgaggcattgcctcactcaggaagcacaaggggtcagggagttccctttcctggtcaaggaaaagggtgacagacggcacctggaaaatcgagtcactcccaccctaatactgcacttttccaatgggcttaggaaacggcgcaccaggagattatatcccgcacctggctcggagggtcctacgcccatggaggctcgctgattgctagcacagcagtctgagatcaaactgcaaggtggcagcgaggctggggaaggggcacccaccattgcccaggctcgcttaggtaaacaaagcagctgggaagctcgaactaggtggagcccaccacatctcaaggaggtctgcctgcctctgtaggcttcacctctgggggcagggcacagacaaaccaaaagacagcagtaacctctgcagacttaaatatccctgtctgacagctttgaagagagcagtggttctcccagcacacagctggagatctgagaatgggcagactgcctcctcaagtgggtccctgacccctgacccccgagcagcctaactgggaggcaccccccactaggggcagactgacacatcacacggccgggtactcctctgagacaaaacttccagaggaatgatcagacagcagcattcgcggttcacaaaaatccacagttctgcagacaccgctgctgatacccaggcaaacagggtctggagtggacctctagcaaactccaacagacctgcagctgagggtcctgtctgttaaaaggaaaactaacaaacagaaaggacatccacaccaaaaacccatctgtacatcaccatcatcaaagaccaaaagtagataaaccacaaagatggggaaaaaacagagcagaaaaactggaaactctaaaaagcagagcacctctcctcctccaaaggaagcagttcctcaccagcaatggaacaaagctggacagagaatgactttgacaagttgagagaagaaggcttcagacaatcaaaccactccgagctacaggaggaaattcaaaccaaaggcaaagaagttgaaaactttgaaaaaaatttagacgaatgtataactagaataaccaatacagagaagtgcttaaaggagctgatggagctgaaagccaaggctcgagaactacgtgaagaatgcagaagcctcaggaaccgatgcattcaactggaagaaagggtatcagtgatggaagatgaaatgaatgaaatgaagcaagaagggaagtttagagaaagaagaataaaaagaaatgaacaaagcctccaagaaacatgggactatgtgaaaagaccaaatctgcatctgattggtgtacctaaaagtgatggggagaatggaaccaagttggaagacaccctgcaggatattatccaggagaacttccccaatctagcaaggcaggccaacattcagattcaggaaatacagaggatgccacaaagatactccttgagaagagcaactctaagacacataactgtcagattcaccaaagttgaaatgaaggaaaaaatgttaagggcagccagagagagaggtcgggttacccacaaagggaagcccaccagactaacagcggatctctcagcagaaactctacaacgcagaagagagtgggggccaatattcaacattcttaaagaaaagaattttcaacccagaatttcatatccagccaaactaagcttcacaagtgaaggagaaataaaacactttacagacaagcaaatgctgagagattttgtcaccaccaggcctgccctaaaagagctcctgaaggaagcactaaacatggaaaggaacaaccagtaccagccactgcaaaatcatgccaaaatgtaaagaccatcaagactaggaagaaactacatcaactaacaagcaaaataaacagctaacatcataatgacaggatcaaattcacacataacaatattaactttaaatgtaaatggactaagtgctccaattaaaagacacagactggcaaattggataaagagtcaagactcattagtgtgctgcatacaggagacccatctcacgtgcagagacacacatagactcaaaataaaaggatggaggaagatctaccaagcaaatggaaaacaaaaaaaggcaggggttgcaatcctagtctctgataagacagactttaaaccaacaaagatcaaaagagacaaagaaggccattacataatggtaaagggatcaattcaacaagaagagtgaactatcctaaatatatatgcacccaatacaggagcacccagattcataaagcaagtcctgagtgacctacaaagagacttagactcccacacattaataatgggagactttaacaccccactgtcaacattagacagatcaatgagacagaaagttaacaaggatacccaggaattgaactcagctctgcaccaagcagacctaatagacatcctcaggactctccaccccaaatcaatagaatatacatttttttcagcaccacactacacctattccaaaattgaccacatagttggaagtaaagctctcctcagcaaatgtaaaagaacagaaattaaaacaaactgtctctcagaccacagtgcaatcaaactagaactcaggattaagaaactcactcaaaaccactcaagtacatggaaactgaacaacctgctcctgaatgactactgggtacataacgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatccaaaattgacaccctaacatcacaattaaaacaactaaagaagcaagagcaaacacattcaaaagctagcagaaggcaagaaataactaaaatcagagcagaactgaaggaaatagagacacagaaaacccttcaaaaaattaatgaatccaggagctggatttttgaaaggatcaacaaaattgatagacctctagcaagactaataaagaaaaaaagagagaagaatcaaatagacgcaataaaaaatgataaaggggatatcaccaccgatcccacagaaatacaaactaccatcagagaatactacaaacacctctacgcaaataaactagaaaatctagaagaaatggataaattcctcgacacatacactctcccaagactaaaccaggaagaagctgaatctctgaatagaccaataacaggatctcaaattgtggcaataatcaatagcttaccaaccaaaaagagtccaggaccagatggattcacagctgaattctaccacagacacaaggaggaactggtaccattccttctgaaactattccaatcaatagaaaaagagggaatcctccctaactcattttatgaggccagcatcatcctgataccaaagccgggcagagacacaactaaaaaagagaattttagaccaatatccttgatgaacactgatgcaaaaatcctcaataaaatactggcaaacccaatccagcagcacatcaaaaagcttatccaccatgatcaagtgggcttcatccctgggatgcaaggctggttcaatatatgcaaatcaataaatgtaatccagcacataaacagaaccaaagacaaaaaccacatgattatctcaatagatgcagaaaaggcctttgacaaaattcaacaacccttcatgctaaaaactctcaataaattaggtattgatgggacatatctcaaaataataacagctatctatgacaaacccacagccaaaatcatactgaatgggcaaaaactggaagcattccctttgaaaactggcacaagacagggataccctctctcaccactactattcaacatagtgttggaagttctggccagggcaattaggcaggagaaggaaataaagggtattcaattaggaaaagaggaagtcaaattgtccctgtttgcagatgacatgattctatatctagaaaaccccattgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacttaggaatccaacttacaagggacgtgaaggacctcttcaaggagaactacaaaccactgctcaatgaaataaaagaggatacaaagaaatggaagaacattccatgctcatgggtaggaagaatcaatattgtgaaaatggccatgctgcccaaggtaatttatagattcaatgccatccccatcaagctaccaatgactttcttcacagaattggaaaaaaccactttaaagttcatatggaaccaaaaaagagaccacatcaccaagtcaatcctaagccaaaagaacaaagctggaggcatcacactacctgacttcaaactatactacaaggctacagtaaccaaaacagcatggtattggtaccaaaacagagatatagatcaatggaacagaacagagccctcagaaataatgccgcttatctacaactatctgatctttgacaaacctgagaaaaacaagcaatggggaaaggattccctatttagtaaatggtgctgggaaaactggctagccatatgtagaaagctgaaactggatcccttccttacaccttatacaaaaattaattcaagatggattaaagacttaaacgttagacctaaaaccataaaagccctagaagaaaacctaggcattaccattcaggacataggcatgggcaaggacttcatgtctaaaacaccgaaagtaatggcaacaaaagccaaaattgacaaatgggatctaattaaactaaagagcttctgtacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaccccatcaaaaagtgggcaaaggatatgaacagacacttctcaaaagaagacatttatgcagccaaaagacacatgaaaaaatgctcatcatcactggcaatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaattaccatttgacccagccatcccattactgggtatatacccaaaggattataaatcatgctgctataaagacacatgcatacatatatttattgcagcactattcacaatagctaagacttggaaccaacccaaatgtccaacaatgatagactggattaagaaaatgtggcacatatacaccatggaatactatgcagccataaaaaatgatgaattcatgtcctttgtagggacatggatgaaattggaaatcattattctcagtaaactatcacaaggacaaaaaaccaaacaccgcatgttctcactcatagatgggaattgaataatgagaacacatggacacaggaaggggaacatcacactctgggcactgttgtggggtggcaggagggggaaaggatagcattaggagatacacctaatgctaaatgacgagttaatgggtgcagcacaccagcatggcacatgtatacatatgtaactaacctgcacattgtgcacaggtaccctaaaacttaaagtataataataataaaaattttttaaaaagtttaccttttagattttttggtcacactccagctgggtgtgacaaatgaagagagagagagagaaaaagagtgaagaagatcttaattgtaatattaattactttttacctttgttcacttccacttatttatttactggtgtttaatgtttgttgttattatttctttgatattgttaaatatttactgttggtttgtttatatattttgtgatggacattgaccatgagcgttgggcttagctgccagcttgccatgtctgaagtcgaccagatggcctcgctggtggccataccgtttcaggtccagcagagggatgtgattatgatccaccgtggcctcgatcttggtctcacaagggtagtcttcccatctcagcctctcaagtacctgggactactaggacctacttcctctgttttggttctaaccccactttcagtttcttccacagtacttagagtgacttgctgttgtgttaaatctttgttcttctcactctatttttctatgttcctttctgcatgctgaagttgacctcttagatttttttttgacacactgcagcatgagtgtgacaatcagagagagagaaaaataaagaagatcttaattgtgatattaattaccttttaccctttttcactctcatttatttattggtctttaaaattatttgttattatttcttttttttttttagacggagtctcactctgtcacccaggctggagggcagtggctcgatcttggctcactgcaagctccgcctcccaggttcatgccattctcctgccttagcctcccaagtagctgggactacaggtgcccgccaccatgcccagctaattttttgtatttttagtagagacggggtttcaccatgttagccaggatggtctgaatctcctgacctcgtgatccgcccgtctcggcctcccaaagtgctgggattacaggcatgagccaccacgcccagcctattatttcttagttattgttaaatatctactattgggtttttttgtatatttattttgtaacagatgttggctgcgagcgttggattagttgccagcttgccatgtctaaggtcaaacagatggctctcgctggtgataaggttgaccagatggctctcactggcagtagtattgttcaggcccagcagagggatgccatcatgattcaatgcagcaacgatcttcccgatgtcacccggaggacttcccatctcagcctcccatttaccttggactactcaggccatcttccttcttttttttttctactcccactttcattttgtttccacggtatttagagggggttgctgtggtctttcttctttgttctttgctccatttcttttttcttttttgttaccctccttcctgaacgctgacgtggatgtttaaatttgatttttggtaggtcttctcactgtcacaccctggctggagtgtaggtgctggatcagcagtgagccgttaccatgcccctgccctccagcatgtgtgtgagagtgtgacacatggagatcgatggagagagggacagaaagacagagacacaaacagacagtggcagagagacagaaacagagagagacagggaggcagacaacaattagttgttatattaattacattttacctttgttcactcccacttatttatttattggtcttatcattgtttgttatttctttgttattgttaaatatttatgtgccaggcgaggtggttcacacctgtaatcccagcactttgggaggccgaggcgggcaaaccagctgaggtcgggagtttcagactagcttgaccaacacgaagaaacatcaactctactaaaactacaaaattagccaggcgtggtggcgcatgcctgtaatcccagctactccggaggctgaggcaggacaatcacttgaacctgggaggcagaggttgcggtgagccaagatcacgccactgtactccagcctgggcaacaagagcgaaactccagctcaaaaaaaaaaattattgtttgtttatttgtttatacattttagacagatgtcagccacgagtgttggacttggccgccagcttgccatgtttaaggttgaccatttggctcttgctggcagcggtaccattgaggtccagaagagagatgtgatgatgattcactgcagcctggatctccccagtctcacccgggtggtcttcccatcttggcctcccgagtacctgggactactcagacattgttcctctgttttatttctaaccccactttcagtttgcttccacagtacttagagagagttgctatagttgttcttctttgttctttgctctcattctctctctctctcttattttttttttacgctctttcctgtatgctgaagttgatgttttatatatacacatatatttttttagccaggtcttctcagtctgtcacaccctggctggagtgcaggtacatgatcagcagtgagctgtgaccacacacgttcactccagcctgggtttgacagtgtgacacacggagatcagggaagagagattcagaaagacagagagacagagacccagactaaaacagaaagacagagagaggcagagaaatagagacagagagagatacagttaattgtgattttaattaccttttatttttgttcactcccacttatttatttattggtaatattattgtccattatcatttctttcttattatttactgtcggttatttattaattttgaggcagatgttggctgcgagcattggacttggctgccagcttgccatttctaaggtctaccagatagctctcaccagtagtagtgttcaggtaaggcagagggatgcaattgtgattcactgcgatattaatctccctggtctttcacaggtggtcgtcccatccatcttggcctccagagtacctgaaaatacttggactttcctcctctgttcttttttttttccagctccacttttagttttcttccgcagtacttacagtgagttgctgtggtttttttttttttcctttcttctttgctctttctctctcttttattttcttatgctcctttctgcatgctgaaattgacgtgatatatatatatatatatatatatatatatatatatataaaattattatttttagctaggtcttcctactgtatcacattctggctggagtgcaggtgagtgatcagcaatgagctgtgaccacacacgtgcactccagcctgggtgtgaaagtgtgacacatggagattgaggaagagagagacagagaaagagagacaacaattaattgtgacattaattaccttttatctgtgttccctctcacttatttgtcttgttattatttgttattacttattattgttaaatatttactgttagttgttagtttatttatgttaagacagacttcagccatgagcattggacttggccaccagcttgccatgtctaaggtagaccagaaagcggtcaccagtggcagtactcttcaggtccaggagaaggatgcgattgtgattccctgcagcctcgatctcctcagtcttgcccaggtggtctttccattcggcctcccgagtacgtgaaactactcaagcttcttcctctgtttttttttctagccccacttttagttggcttcaacagcacttagagggagttgctgtggtttttcttctgtgttctttgctctctctctctttttaaaatcttttatgctccttcctggatgctaaagttgatgagatccacccacctcagcctcccaaagtgctgggattacaggcatgaggcaccgcgcctggctttaattttgtatttttagtagagacaggggtttctccatgttggtcagactggtctcgaactcctgacctcaggtgatccactcgcctccgcctcccaaagaaaaactggtctaagatctagctattttcttaaattttaggtttgattagctcacttttggcatgagtgactcattttgttttgttttggtctgtttgggaagagtgcacatgctcagtccagatgatggccataaataattttgtttaaaaaattcaccccaggccgggctcagtggctcaggtctgtaatctcagcactttgggaggctgaggctggcggatcaaaaggtcaggagatccagaccatcctggccaatatggtgaaaccccgtctctagtaaaaatacaaaaattagccgggcgtggtggtacacacctgtagtcccagctactcgggaggctgaggcagaagaatcacttgaacccgtgaggcagagtttgcattgagccgagattgcaccactgcactccagcctgggcaacagaacaagattccatctcaaaaaaaaaaaaaaattaccctatttgtaagctctcacataggtcacggtgtgaccaaaactcagggccttagtgccactctgtttccattatctttttttctttcttttttttttttttaagatgaaatctcgctttgttgtccaggctggagtgcagtggcactatctcagttcactgctacctccacctcctgggttcaagcaattctcccacctcagccttccgagtagctgggactacaggcccatgccaccacggctggctaattttttgtatttttagtacagacagggtttcaccgtgttacccaggatggtctccatctcctgacctcatgatccacccacctcggcctcccaaagtgctgggattacaggcctgagccaccacaacaggccaatttttgtatttttagtagagatggggtttcactatgttgcccaggcttgtctcaaactcctgacctcatgatccacccacttcagtctcccaaagtgctgaggttacaggcaccgcacctgtcctattttgggtttttgtacttatcatgtcattcataggttatggtgtcttcgtagtcacatgtgtctttgagtttctgccattctggtttaaaagagatcatttgacattttggagatgaccgcatgcaaacatttataacttttgagagaatacggtgaagtagggagacactactatttcaactatcaggagaatgataccaagagtttgaagcatgctttttagccagggtccccacgaaacaccaactaaaattaaataggccgaatagttagctagataagtggtctactcatttcaaccaagcacactgttcattaatccgctgcaactgcatctccgtggatgcagagtaggctcagggagcctacactacgtatttctccatgtgcaactacaagtgttagcaacttcataggtacttctctgttcatccaataagtaattaaaagaaataatattattgctgggcgcagtggctcacgcttgtaatcccagcattttgggaggctgagacaggtggatcacgaggtcaggagatcgagaccgtcctggctaacatggtgaaaccccatctctagtaaaaatgctaaaaattagccaggcatggtggtgggcgcctgtagtcccagctactcgggaggctgaggcaggagaatggcgtgaacctgggaggcggagcttgcagtgagccgagatcgagccactgcactccagcctgggcgacagagcgagagtccatctcaaaaaaaaaaaaaaaagaaagaatgaaataatattatttagcacaactttagtaagtaaatttaaaatatattgtgtaatcatagcctttacagtataatcttctatagagccctattggggggatacatttctaaccattgcctcatttactttataccatggaaagaaagacctaacaaatcatggccattcagaagagtaagggcatcctggaaatgctccttaacttattgtgaaaaagttgtccttaacttatgaagtaggttaagagcagtggaccaatattctgtttctgatattgtgagggaacaaatatcccataaaaatttctcacacaggctggcccttcatcttttacctatcaaggtgtaagttttttcatatataatgttggctgcaaaattctctacatttaagtataccccataagtgcacacaagagaccccttctttatttctattgtttgtagagccataaaaaactgtgaaataagtgtgtcatgatagcagagaagtatgatcatgttctgagtgtgtctcaccatgaaacaagcaaaaaaaaaatactgctgttattttgagatagtgagttagcattttgtgcaaatatgtactatgtaattttttattgatatgtaacatgcatagagaaatacatgaagaaattcttcattcaagtaaagctcagtgaattgttatgaagaaatatacttgtgtaatcagataataaaactaggccgggcacagtggcttatgtctgtagttcagtacattgggaagccaatgcgggtggattgcttgagctcgggagttcaagaccagcctacccaacatggcaaggctctgtctctactttaaaaaaataccaaaaaaaaaaaaaaaagaaccaggcaggctggtgcatgccggtggtcccagctactggggaggctgaggcaggaggatcacttaagactgaaagtttgaagctgcagtgacccatcattcagccactgcactccagcttgggttacagagtgagacctgtatgtgtaaacacacacacacacacacgtgcacatggtgggggatatgaaaaagagaaagtgtggctcctgcaattcagtgagacctggttctccatcttgggaactgcccatccacactgaaaccacaacctagcacatgccaattcttacgctaaacctgctaagataccactgtttacccttaagaaaaaaactgaagtatttcacctaaaagaagggaaaaagaaaagaaggatttcacatccaaagcctttgtttcctttataaaacaacagccccttgtcatttgagttgtccagaggtgtctgacaacactaacacacttatggaatcagccaggaaaagtgagcctctcaggtgacaaagaggcacaatggtaactaaagacaatccattctcatctctacatgatgcccccctctcatgaagtggtgttaaccatgtgaaccatattcaccagaggaaagtatgttcagggcaacacaatcatgaggttgcaaatcaaaccaggggtgggaagcacataggaggtttccatggccaagacactggtggctatccttgggtgtcatttaaaaatttcaggtgaaaaatccttttcttccagttggctcaggaaaactaacagacattacaattggaattcgttttactttttagaatttctaagacataaagcatgcttcaaacactccaaaagacattcagctatacctgaggctgaggacctgcctccttctccacgttagggccctgacagcaggcaaagagaaggagcacaggggccgggtgtggtggctcacagctgtaatctcagcattttgggaagctgaggcaggcggatcacctgaagtcaggagtttgagatgaggctggtcaacatggcgaaaacccttctctactaaaaatacaaaaattagccatgtgtggtggtgtgcacctgtaatcccagctactcaggaggctgaggcaggagaatcatttgaaccgaggaggtagaagttgcagtgagtcaaaatcgtgccattgcactccagcctgggcaacaagaatgaaactgccatctgaaaaacaaaacaaaacaaacaaacaacaacaacaacaacaaaagagagaaggagcacaggcaggtggggacagagagcagcccaggcctatagggatccccaacaacccccagagccaccctacagtgtctgtaggagggactgtgtggcaaaaatcaggtagggagctgggcttcatggagaggttaccaccacttctgtatctttaacttttcccaaggatttatgattccactctggttctccccaggtccccaacccatcctaccctcactcccacactgtgtgtttatgtgggtctggttaaaatgaggagaataatacttccagattgtagccttcaaggtattcccatctggggtatggggagtagggaggcaagtcagagtctgtggtggtgcttacttctgggtctgagggcaggaaggccagggctgggcacatggatatctggggaaacaccactgttgattccttctccccacccggagctacaaccaggccagggcaatcacaattaataaaaccactgcagctcacatcctacacgaaactaaagtgtaccccaacacccagtcctaccacagatcgagaacttcccatcccagaacacaggaagccctccgtctttttgacctaaagcctggactttaagccaggttgggcttgggggtagtggcagcaaaagcagcagccacaaggtcaaacataccaatgacctgagaaatctcatctgcacatcattcactcagaacagacctggggttgtgaacaaattaagaaaaaggccagatctatacactcatgggcatggacaccttccacacttgctggggagaatgagaggcacctgtttcccagctgcaagctgatgtccacatacacccattcatgtgtcttcatttaggtctctgcattgtatattcattgaaccaatacaaacacatcttcagtggtgggaggaggggggacatcatttagtgcaacaccactccccatttgttatagggggcactcaggaggtatctggtcagctcctaattccctaggacaaaggtggcgccccatttccagcactcacatccagcagcgccatctcagattttttttttttaaacatgaacagcatgaggaagcaggcatggtacgacaggctcagggccacagacagctggctgctggagaagcagcacaggcagtcacatctgtgggtggggccatgacaagacaaggccaccatagttcctacccctgacagccctagcccagatagcattcaaatcttccttgatgggcttcatggctgtcactcaccggctctttagcaccgccttgtgttggttactcagggcctgggagaggtagtggggatcgtagatccagggtgggaagcacctcacacccagagttcacctggccacaggccagcaagcaagcccaagcagcacagttctagacactgagcctcggcacctccagctgcactttctatttatatatcaggtttttaaattccataaataaagagacacaaaaacagccactttgattgaggagaaagtgggagcctaaagcagctgaccctcaaacatctccaccaagccccaggccaggccaggccatctgaacactccaaggccacatgatagttacagaggatgacagttcccacaggtacttgtcaagcactgtgctagcttctcaatcacagtctcagaatgcctccttgccaataccctgtgaggggaggctctgcctcactagagcacaggagtttcctaagctcttcccaggaaatggttagcaaagtgtcgagctaggagaaagcccagtcagaacaagtgactccccagggtcttcctagactccatctgctcctccacatgccgcccggaggtgatatgggcagcctcctaaccccctccatcccactctctcctcaatcaaagtggctgattttgtgtttgcttgtttctttatgggattttaaaaacctgatattttatttagagtagtttcaggcttgtatgtgtgtatttgtatagactttattagaaggaagagggcttaatataataacattttttttcttttttttgttattgatcattcttgggtgtttctcacagagggggatttggcagggtcataggacaatagtggagggaaggtcagcagataaacaagtgagcaaaggtctctggatttcctaggcagaggaccctggggccttccacagtgtttgtgtccctgggtacttgagattagggaatggtgatgactcttaacgagcatgctgccttcaagcatctgtttaacaaagcgcatcttgcaccgcccttaatccatttaaccctgagtggacacagcacatgtttcagagagcaccaggttgggggtaaggtcaacagcatcccaaggcagaagaatttttcttagtacagaacaaaatggagtctcctatgtgtacttctttctacacagacacagcaacaatctgatttctctatcttttccccacatttcccccttttctcccttttctattcaacacaactgccgtcgtcatcatggcccgttctcaatgagctgttgggtacacctccccagatggggtggcggccgggcagaggggctcctcacttcccagaaggggtggccgggcagaggcgccccccacctcctggacggggcggcggccgggcagaggagccccccacctccctcccggacggggcggctggccgggcaggggctggcccccacctccctccgggtcggggcggctggccgggcgggggctggcccccacctccctccgggacggggcggctggccgggcgggggctgccccccacctcctggacggggcagctgccgggcggagacgatcctcacttcccagatggggcggctgccgggcggaggggctcctcacttctcagacggggtggctgccaggcagaggggctcctcacttctcagacggggcggccgggcagaaacgctcctcacctcccagacggggtcgcggccgggcagaggcgctcctcacatcccagacggggcggcggggcagaggcgctccccatatctcagacgatcggcgcccgggaagagacgctcctcacttcctagatgggatggcgccgggaagaggtgctcctcacttcccagactgggtagccgggcagaggggctcctcacatcccagacgatgggcagccaggcagagacgctcctcacttcccagacggggtggcggccgggcagaggctgcaatctcggcattttgggaggccaaggcaggcggctgggaggtggaggttgtagccagccgagatcacgccactgcactccagcctgggcaacattgagcactgagtgaacgagactccgtctacaatcccggcacctcgggaggccgaggctggcggatcactcctgattaggagctggagaccagcccggccaacacagtgaaactccgtctccaccaaaaaaatacgaaaaccagtcaggtgtggcagcgcgcacctgcaatcgcaggcagtcggcaggctgaggcaggagaatcaggcagggaggttgcagtgagcagagatggcggcagtacagtccagcttcggctcggcatcagagggagaccgtggaaagagagggagagggagaccgtggggagagggatgggggggagggggagggggagagggagagggagagggagaataacatttttaaaatgtctcagtggggaatagacttccatgtcagaaaccatgatgttggcctatttctgctgcctttgagcaaagtataaatagtgtgagaactggcatgtgctgggttgtggtttcagtgtgggagagcagttcctcaagatggaaaaacaaatctcactgagccgtaagagccatgctcatcttttaccacattcccaaccagggtctttcacttttcttctgtgcttgaatttctttcaacatacatattattttgattatatacatagggtacatatatatgtgtgtatatatatatgtatgtgtctctgtgtgtgtgtgtgtgtgtgtatacactctgtcacccaggctggagtgtagtagctgaatgatgggtcactggtcactgcagcctcaacctccagtgatggttccacctcagcctttcaagtagctgggactacaggcatgcaacaccacatgaggccaatttttaacgtttttgttgagactgaatctcactacattgcccagactggtcttgaactcctaggtttaagcaatcattccaccatggtcttccaaagtgtttggattacaggtgttagccatcaaactctgccaaaaatattttttaaggaactgttacaaccaagttattagctatggttgtgccactgtactccagcctaggtaccagagtgagaccttgtctccaaaaacaaaacaaaacaaaaaaacttacgaccaaattaaaattctaaggttgtgtcatatgtgtccccttcctgccctgtaagctatcactgttaaatataatggtattggccgggcacggtggcaaatggctgtaatcccaacactttgggaggccgaggtgggcggatcacctgaggtcaggagttcaagaccagcctgaccaacacggagaaaccctatctctactaaaaatacaaaattagccgggcgtggtggcgcattcttataatcccagctactcgggaggctgggaggattgaggcaggacaatcgcttgaacccaggaggtgggggttgaggtgagctgagatcatgccattgcactccagcctgggtaacaaaagtgaaacactgtctcaaaaaaaaaaaaaaaaatatatatatatatatatatatatatatatatatatatatatatacacatacatatacatataaaatgggtattgagaaaactgttatatattattaagaaattcctggctgggcgcggtggctcatgcctgtattcccagtactttgggaggccgaggcaggtggatcacctgaggtcaggagtttaagaccagcctggccaatatgatgaaaccctgacagacccagggcatggtggtgggagcctgtaatcccagctactcgggaggttgaggcaggagaatcgcttgaacccaggagaagaaggttgcagtgagccaagatcacacgattgcactcccttctgggcaacaaaagcaaacctccatctcaaaaaagaaaaaattcctatatattctctaaatgagaataagttattctgatgtgacccaatatttcctcactcttacctccatggtctaacccagcaaatcaaatcaggacacccacaaaggacagttggccattttcaaatagaaataaaatagaaaataaaataccccattagtgacagtaatccagtgattttaaaaaagagaagtcagattgagatgcagtgcagtcagggcacaattaccctggaatacacacttcacacagaatgattgagaagtctttctaaaataaacaaatttgggtaacataatttttgcttaaccattctcagccaccgctttcccccacccctgccccattcctaatggccatcccacgatgtggtcaacagcgtggtatagcatgatgagagaggtactcagggatgggatgagggtctttcctgcattatcaaaatcattaaaaagttgttaaaatatgttcaaatgggccgggcatggtggctcacgcctgtaatcccagcactttgggaggctggggtgggaggatcacctgaggtcaggagttcgagaccagcctgcccaacttggcgaaaccccgtctgtactaaaaatacaaaaagtagctgggtgtggtggcatgcgcctgtaatcccagctactcgggaggctgacgcaggagaatcacttgaacctgggaggcagaggttgcagtgaaacaagatcacaccattgcactcaagcctgggcaataagagcaaaactcagtctcaaacaaacaaaaataatccaaatgttcttttcttacccttaagtagcaaataagatgcattatacaagcagacccaggtaagggaaagagcaagttcatttcaagtctcagcttacttcttaattggctgtaattccctatggttgacactccctgctttagcctgttttcctgggggtggagggagtggtactgggcgagtgctggtgctttatcgaatcagtggcacagttggagaggagggcgtggcatccggcatttggcggggcttttgtctctcgctgcagccagagcttgggatcgctttctgctattcaacgtcctccacctctgcccccctctccccccagccggtgacaggctgttgccctgtgatctgcaggtcctgggacgtgcacagacagctaagatgccaggacattccagaaggtgggaaagggtgagtgtgaggggttgagcatcccgagaggggagagctggctgagaaaccgacgggactggcctcctcaccgctcctgggttgccgacctgagtccctgctggcgcagctccgtcccaggtccctctggccgcaagatggtggctgggcccgcagcaatgacccgcgcgtcccgcccagtccctgcggcgccctatctggagctccctgggcagctctgcacgcagccccgagtgtttcccagattgttcagggatgccaggcgggtcatcagggcagaatcccgactcgtgtgtgcgtaggaggagctgtggccggtggggctcccagtctcttttgttaaacattttgttggtttgtttgagacaaagtcttgctctgtcgccgaggctggagtgcaatggcgtgatcactgcaacctccgcctcccaggttcaagcgattctcgtgcctaagccccccgaaaagctgggattaaagacctgcaccaccacgcctggctgatttttgtatttctagtagagaagtggtttcgccatggtggaagctggtctggaacccctggactcaagtgatccccccaccgccgcggcctcccaaagtgctaagattacaagcatgagccaccgcgcccagcttcttctcttgcaaagtaaagggagtcaacgttaaaacgttaacgagtttatctgagcagtgattagtgaaatggaaagcacccagccataatatgtgggccacctgaaaggcaaaaagggaagggttttgaaaagggcgtgtgagaaggcaaaccaaattcaagaattggttacagttatgtagtcaccttatttgtatgattcgggtggaaatttcctggttatgtaatcagaggttaattgcaggttaagcctgaattttgtttctgcctaaaataatttataagaagtgaatccgagataggttttacattttttacttatgaacacagggcactagagccccttcagtctaatttcctgctttttaaataacactccacaggaggactggttttcctctgtgacttcctaatgtatggcaagcaggacttctaatccactacccttttaccctagcttaactcaggcttgtagtaaaattataaatttccacctttgttcctacattctcaaaagtggaaatgagaacaacttcctctctccaatttacaacactatcaactatttgtcctttattttacatttcaaacacagtgtttttgttattaatcatgttcttacacagcagtggatggcaggttttaaaataattgttgtctgtatacaattttttttttttctttttttttttggagatggagtttcactcttgttgcccaggctggagtgcagtgcaatccccgcctcccagattcaagcgattctcatgcctcagcctcccaagtagctgggattacaggctcccaccaccatgcccggctaatttttgtatttttaggagagacggggtttcctcatgttggccaggctgctcttgaattcttgacctcaggtgatccacccgcctcaacctccgaagtctgtaaacattttacgtgagaaaataatcctctggaactccactgttaaaaagaaaaaaaatctctgtgactgtccttttatcttccctggtgcatacaccttgttagtaggtctttcggttgaagttttgctttggagaaattccagggccctttgtggcagccctccggtcttttcttgttcatgattttcagaaccgtcagggataacccaagatgcccacagtggccatatctcttggagtgtctaatgaatatcatcccctgggtcatctcttagaggacagcctgaggaggaagagtgtagcctctcagaagagcagctggatggcttaggcctgtggaaatttcctcgcataccatttgtcttagaaagctaaccttttagaaaattaaaattattttttcacaaaggaacgtgtatacactgttgatgggagtgtaaattagttcaaccattatggaagacagtgtggcaactccttgaagacctagagacaaaataccatttgacctagcaatccattattgggtatttacccaaagcaatgtgaatcattctattataaagacacatgcatgcatatgtgcattgcagcacaattcacaatagcaaaggcatggaatcaacctaaatgcctattaatgatagactggataaagaaagtgtagtacatatacaccatggagtactgtgcacccattaaaaaaaaatgagatcatgtcctttgcaggaacgtggatagagccataagacattattcttagcaaacagaggaatagaaaactaaatactagctggatgtggtggctcacagctgtaattccagcactttgggaggccaaggcaggtggatcatctgaggtcaggagtttgataccagcctgagcaacatggtgaaacctcatctctactaaaaatacaaaaaattagccaggcgtggtggcagatgcctgtaatcccagctactcaggaggatgaggcaggagaatctcttgaacccgggaggcagaggttgcagtgagctgagatagtgccactgcactccagcctgggtgacaagagcgaaactccatctcaaaaaaaaaaaaaaaagcaaaacaaactactacatattctcacttataagtgagagtcaaatgatgggaacacatgggcccatagaggggaagaacacatactggggcctattggaggagggagaggatcaggaaaaatacctaatgggtactaggccttaatacttgggtgatgaaataatctgcacaacaaacccccgtgacacacgtttacctatgtaaaaaacttgaacatatacccttgaacttaaaagttaaaaaaaaaaagaatttggtagcttttccaataattccctgacagcattttgattttatgtgtatatgacacctattaagtatcagacatttggattacacagatgaacagggttcaacatacctgccccataggagtttatagttcattagcatggataggtgtgtaaatgattaatttattctggagagaataacccttgtacataaaaagacttataaagtattgaggagctaaatggtaatagtgatcaattctgccagtgacatagcactgggaaaatcaaggagggctttatagaggatgtgacatttgagtgggtgtcagggtttactagaactttttgtgttaatgctgctagtgcagagtatgctttttttttgagacagtctttctctgttgcccaggctaaagtgcagtggtgcagtctcggctcactgcaacctctgcctcccagcgattctctcacctcagcctccctccgcctttaagcgattctctcacctcagcctcccaagtagctggaattacaggcatgagccaccacacctggccgcagagtaaaaaattatttccagcttggccaacatggtgaaaccccatctctactaaaaatacaaaaacattagtcaggcattgtggcatgtgcctcttcctgagttttttaccttggaaagattttttcacattactatttcagttttttaataactgtaacttatattttatcagaagagtttaaaagatgtttaaaaagtcagactatgaaaggtatatttcagaaaaatctactcatatattttatgtattaaagattcttatttacctttatcttctccagagtgagtgtagtaagtttctcatgtctgcttttcctggttgcatgattttaaatagaaccccagggctttgctttgggaatgctaccagagaaaagaaataggaaaaatctttttttcattatggctatacaaagtgaatatatttccacaagcaaatgtgatagattaattggtgcattgtatatatttctcaaaccatcagctcctcttttttgtggtgtctagaatttgtaacagtggataatctctgttctgtattctgttgtctagatgtccaagtttaatgctaaattttatgagatggaacttgacatcttctagaaatgttcacatatgattgtttattaaattatctatcatggaaatagttaaatgagatgtttatcatctgaaaaggacagatgcttttttttttttttgagatggaatcttgctctgttgcccaggctggagtgcattggcacaatctcggctcagtacaacctttgcctcctgaattcaagcgattctcctgcctcagcctccctagtagctgggattacagttgccagctgccacactcatctaatttttgtatttttagtagagatgggtttcaccatgttggccaggctggtctcgaactcctgacttcaggtgatcctcctgcctcggccttccaaagtgctgggattacaagtgtgagccaccatgcccagccttacttaagctttttatattgtagttgaaaatttaagtcttacaatttccttacactattctataaacagtgtgttggagtgattttgcacttttttgaaacattggtcatttttttaattattattatttatttatttttgagactgagtctcactctgttacccaggctggagtgcagtggcacgatcttggctcactgcaacctgcgcctcccaggtttaagggaatctcgtgcctcagccttctgaatagctgggattacaggcgcatgccaccatgcccggctaatttttgtgtttttagtagagatagggtttcaccatgtttgccaggctggtctcgaactcctgacctcaagtgatccacctgcctcagccttccaaagtgctgcaattacaggcgtgagccatcatgtctggccatacattggtcattttcttatttcaaactaagtgaataatcctgactgggaagtagaagcctgaactcagtgactgcaagctaaggatagttttgcctgcaaagggagatcattgaaaaagcagctcttctgcctgaggagcctcccctgcagatgtcctggcctgctcacaatagccatggacagagcctttatacttagagaagccacagagccttgaaaaccttgaaatccacaggcagatgcagttgggattggcacaaaggtggggttgggaggctctttctgggaatggagttgttattgttctgaggttgtttctagattttgtaaaatatgatgaatctagatttaggtaagaagttatttatttatttatttttattttattttatatttttttgagccagggtctcattctgttactcacgctgtagtacagtggcatgatctcggctcactgcaacctcagtctctcagattcaagccattctcctgccacagcctccctagtagttgggactacaagcaggcacatcaacgcccacctaatttttgtatttctagtcagaaggttttgcaaagcctcctgggagaatagctgaaggcagctgctttataaccctgaggcagagggcaaggagtaggtacaacagagtataggggaatttatcttaaacaggcttgtttacttttattgaccaggaactgacctttgatcatcagtgcgagtgatgttccctgaacttttttggttttatttttccttccttcctacctttctttcttctctccttcctcctttcattctgctttgtgttcccagggctggtgtcaaaattctgtgctcaagcaattctcccatttcagcttcccaaagtgttgagattacaggtttgagccaccatgctctgtcctcttttattttcttcttgtttttccttttcattcttccttttcctctcttcctccctccctccctcccttccttcttccccatcatctttttttttttttttttccgagatggagtctcactctgtcacccagggagtgatgggaagctcgcagacttagacgccagagggacgttttcaggggcgagctccacacatggcctgcagggtggacacgttggcttctcggtctggccgccgggtgaccagatgtgggtggcgagctgtggccagtagttgtggctgctggcctctcgtttgggtggaccagggattcaaagcttaggaaggaaggtcggcagacttagaggctggctgcggaggtgggccaccttgggggaaataaggttccaacagggacagcttcaggccgcgagtgccacatgtggcctgtagggtagacacagtgggcttctgcttctgccaccaccaccagctggcttctctttctggctgccaggtgtacaggatgtgggccacgagcgtaggacttggttgccagctggaaatgtttacggtggaccagatggctctcaccgggacagtacagcttcggtccagcagaggagttcaatgatggctcactgcactctttaccttcctaggctcatccagttgatcctcttattttggcctcccaaataggtggggctctcaggatctttctgtttctttttcttttcctttttttttttttttttttttttagcaccactttgagtttgttttcacagtacattgagttctgttgtttttttctttttttctctttgtctctcttgctccttcccgtacactgaagttgctgttgttttagatttctttcacccaggctaaagtgcaggtgcatgatcacagctcactgcagcctcgacctccctgggctcaggtgatcctcccgtctcagacaccccacttcccagtagctgggactaaaggcatgcgccaccacactggcactttattttgtatattttactttttatttttgtagagatagggtcccatcatgttttccaggctgatctcaaactcctgcagccagacgatgtgctggcctagacctctcaaattactgagcttacaggcgtgagccaccatgactggttctatctatatctatctatctgtctatctgtgtgtctctctgtctaccaatcaatcatctatgtttttttttttttttttcagtagagatgtgttcttgctatgtttttcaggcgctggtcatatatatatatatttttttttaactgtaattattattttttaatataggtgttgtctcaccatgtggcccccaggatagtctcaaaatcctgggctccagatattctcccgccttggcctcccaaactgctgggattacaggcatgagccactgtgcctggtctggtcatttttttttttttttttttttttttttgagatggagtttcactctcattgcccaggctagagcgcaatggcacaatctcggctcaccacaatctccgcttcctggattcaagcaaatctcctgcctcagcctcccgagtagctgggattataggcatgtgccagcacactggctaattttgtatttttagcagagacggggtttttccatgttggtcaggctggtctaaactcccgacctctggtgatccgcccgcctcggcctcccaaagtgctgggattacaggcgggagccactgtgcccggcctggtcatatttttgatgtgttgattcttcccagtccagatgtataatctcatccctgaacatttttgatagtgtaattatgacatatgactttacccgacaccagagtgagttgatgctcctgcccagcttacagaagggattgtgacatatcactggacccagcaccaaagtgatgtaactgttctactgctttggcacttcccacagtgggcattgtgacatatcactgggtcttgtacccagatggtgtgaatcttctctccagcctggctctttcacagggggcattgtgtcatattgctgggccccacacataggttatgtgagtctcctgcctgtgccctacccatgtaggccattgtgacatattgctgggtccaacacccaggtgatgtaactctactgcctcggtcctgcctacagcggacattgtgatataaccctgcacccatcacacaggtaatgtgactctcttctcctgcctggcccctgctcacagaagggattgtgacatatcactgggctcagcacctagctaatgtgacttttctcctcttcctgtgttttgcctgcaggggatattgtgaaatgtcactaggcctaatactaaggtgacattactcttttgtcatggcactgccctcagaaggtatggtgatatattgctgggcccagaacaaatgtgatatgagtctcctgcctggaccctgcttacaaggtgtattgtaacatatctggggccctttgactattttatttattttatgttatttattttaattttatttttgagacagagtctcactctgtcacccaggctggagtgcagtggtgtgatctcaactcacttcaacctttgcctcctgggttcaagtgattctcctgcctcagcctcctgaatagctgaggttacaggtgtgcaccaccacgcctggctaatttttgtatttttagtagagacgaggtatcaccatgttggccagactggtctcaaacccctgacctcagccgatctgcccgactcagcctcccaatgtgctgggattataggggtgagccatttcgcttggccctttttgactattttatgtgactctactctcttacctggacattgcccaaaaagagattgtgacatatctttgggcccagcaccaaggtgatttgactctccttttctgcgtgggccttgcccatagtagagagagtgacttattgctgagtttagcatacaggtgatagattcttctgctggctcccaaaagtcactgtaagatatatctgggccaattgctgagattgtgtgactcttctcctgggacctgtccacagtggggattgtggcatattgcttggccaagtacctacatgatatgactcttttcttaggtctgggccctgcccactgaagtaattttgacacatagctgggcccagctcaaaggttatgtgacttcacacttcttcctgagccctacccatgagggccatggtgtcttatctctgagaccgcttattaggtgatgtgactctttattttttttgagatggagcctggctctgttgcccataatttagaagatgtgactcttttgcgccagaatgggtactgtgacatattgctgaacccgttacataggtgatgtgactctcttgcatgggccctcctcctaagggggtagcgtgacacattactgagcccagtacataggtgatgcgactcttttctatggctttgcccaagcagggatttgtgatgtgttgctggactcaccacctatgtgttatgactctcctcttctgcctaagccctgaatgcattgtgtgttgtgacatatgcctggattcagcacttaggtgatacaactttatgacatgggaactgcccacggaagtattatgacatgtctcctttccatcacctaggttatgtgacccttttatttttcttatttctggcatattttggatatagtgatgtatcattgagttcaacagacatgagatgggaggcttctgcctgagcccagcacataagtggccttgtgacatatctttgtacccattatctttgagatttaaccccccttttctgcctgcaccctcaccactggaaagattgtgatgaatcactgttctcaggaatcaggtgatctgtttttccttcctggtccttgcccacagatcattgtaacatatcactgggcctagcatccaggtgatgtgactgctgactgtattctgctttcaggaggagactgtaacgtatccctaattgagcacccaggtggtgtgacacttctgccctgtccctgccctcagaggagattctgacatatcactgccccaaaatgcaggtgctgtgagtctactagtcagtcccttttcattggtgggattgtgatgcatatcttgttcaaacttaaaggtgcaataatgattttcaaacttcgaaaaaaccaatagcagatacactatctctcatagccagggtcaggaaaatgagtaatgtcttgggtctcctctttgtatgaaggtcataaagaacactctgtcacatactgtgtaaagttgtcaagaggtacagagaatgtcctaacagaactcagcacacagaggaggttgtgacactcatatgcatagcctgccaacagtaaagactgtcatccttccacataaacacagctcactgttgaggttctgaagctcttatgcagatgcagtcaaaagttggaaaattgaatctcattatgtgaattcgatccatagagatgttagtgtctctgacaccaagattcagcacacctgtgagtcggtgacttcactaaaatgacacaatttgcaggagggattgaggttctcatatgcaaattcagactatcattgagattgtcactcaggtacttacacccaagatacagagggaattatgtctcagctagaactaaaaaatgtgtgaaattgttaatctcatacctcaaccttaattcagctgtgtttgtgacatacacctttttttagcacctgagtaatttgactctcctgcctggacccagcgtacagatgggattgtgcttcattgctggacccagcatttaggtaatgtgagtctattcttatttcacagagggcattttcacagagggcaagggaggattgtggcatatcactagacccagcaactaggtgttgcaattctcctgtttttcctcggcctcacatatttttggtattgtaaatattactaggcccactacctatgagattgcatgctcctgcctgggctgtgcccacagtgaccttgtgacatatatctgcatccatgacctaaaagatgtgacacttcttgcctgcaacctgccctgcacaggaaagattgcgacttctccctggaagcagacaccaggtgatgtggctctcctgcctctgtcttgcccccagggagcattgtgacataatgctgagctcagcacttaggtgttgtgactgttgcctatgctgtgctttcaggagagaactgtaacatatccctggatgagcacccaggtgatgtgatattcctgcttggttctttccctcagggaagattgtgagatacccttggctgaaatcccaggtgatgtgactctcctgctaactctctacctacaggttaaatggaggcatgtactgtagtcagcttataagtgtaatgatgactctcatacctctagtcagctattagaagaaatactgtctctcatagctcgacttagaaaaatgagtcacattcttggtcttctctttttatgaaggtcatacagaattgccaccctccaacatatcatataatgccctcgagtgttacaaagagtgttatcccaaggcacacagcacaaaggtgagattgtttcttatatgcacacctcaccaaccattaggattatcacccttacacatgaaaagagcccattgctgaggtcttgaatctcaaatgcaaacactgtccagagttggaattgtgactgtcatatatgagcctccggccacagttgagatggtgacacacttctaaactcagaacatagcagatgaggactctactatataaaccctaccaactggagagatgttggctctaatacctggacttagagccacaagtatggtcatgggtgcttacaaacatgactttagagtaaattgtgactcttatttatactggataaagcctttgagtagtatagagagtgtactagctgggcgccatggctcatgcctgttatcccagcactttgggaggctgaggcaggtagatcatgagtcaggagtttgagacaagcctggccaacatggtgaaaacctgcctctactaaaattgcaaaaaatcagctgagcatggatgtggccgcctactgggcctttcctgcaggccctggctgatggatagaattagtactcagacacaggtatgcagtgtaacagcagctagataatggcctgcctctagtggccagagagctgccccaagaagctggagctgcttgctttctttcagtgcaggcacaatgccaaaaacctggagcaaacacaacctgcaggtaattaacatttattgttctcctttcagggatcgtcactcccgtggatgatcaaaggtcagttcctggtcaatataagtaaacaagcctgtttaagataaattcccctacactccactgtacctactcctggccctctgcctcagggttataaagcagctgccttcagctattctcccctgggtctttgcagaaccttccgaactttcagaaggtttgcgtcctttccctatagtttttcttaccattctgactgatccctcacaggcgcctgtaatttcagctactccgggggctgaggcaggagaatcgcttgaactcgggaagcagaagttgcagtgagccaaggtcgcaccactgcactccagcccaggcgacattgtgagactccatctcaaaaaaaaagaaaaaaagtgtactaacaagacccagcacacagaggagacttttaccattgtatgaacacccatcaaacagtacacatcatcattgtgagttctgaatctcacacatagaggaagtcaaaggtggaaaacttgactctcatatttggatccagtccacaggtgagttggtgacattcagagcaagaatcagcacgcctatgaggctgtgacttcactaattagactaagtccacagcaggagtatgggctgttaggtacaaattttgtctactgttgagattgtaactcctgttcttagacacaacatataggaagggttaacctcctatacctaaaaccggaacatgtgtgggattgttaatttgatccctgcaccttctcacaggtttacttggaacatatttctctgcccagcacctgagtgatctgactgtcttgcctacagatggaatagtgacatatagctgaacccagaactgactctctttttctgcattggtgctgctcacagggggcattgtgacatatcgctgggccttgcacttaggtgatgtgagtctcctttgccttggcactgcccacagaatgcattgtcacatatctctgggccccacaccaggttttttgactttcctacctgtcacctgaccacataagcaattgtgacatattgctgggacatacaccctggtaatgcaactctactacccacaaggagcattgtgacatatattttcacacctcacccacatgatgtgactttcttctcctgcctggtccctgctcacagggggagttgcgacatatcatgtggctcagtaccaaacaagtgtgattcttcttccatcataggttctgctagcaaggaagactgagacatattgtggggctctacgccaatgtgacattactgttctgccttggcctgtacctgaaaaggcattgtgacatattgctgggcccagcaacaaggtggcatgagtcttccgtatggaccctgacaacagagcattgtgacatatctttaagagcatcaactatttgatgtgactctccttttctaccaaggctttcctcatatgagagattgtgacacatcttctggcacagaaatcaagtgatgtgtttctcctgcctgagctttgctcatagggagcattgtgacatatctctggtctcagcacccaggtaatgtgactctactctctgtgccctgatttcaggagaaaatttatatgcctaagcacccagtttttaactcttctgccttgtgcctgttctcagagaagattgtgacatatacctggcctattacacagatgatataagtctcctgctctctccctatccacaggggagattgtgacatatatctttgttcagatcattggtgcaatgttgactctcatatctgaaatcagccaataggagacatactatctctcatatgtgggcttaggaaaatgggtaagattctggctctcccctttgtaggaaggttaaagaaaattacagtctctcccatattgtataaagccctccagtgctccagaaagtgtcataacagggtccagaaaacgagattgttttatatttgcacagtttgccaattgttaagattgtcaccctcatccatggacagagcctactggtgaggtcttaaattttacatgtggatgcagtgcagagttaaaattgtgactgtcatatgtgaacatcaggcaacatgaggtggtgactcattagcctagcttataggcaggtgtcaactctcatatctggacccagccattacagagatgttgactctctcatctgagcatagagccacaggtatgatcatgggcccataccagcacaaatgtttcctagtcacaaaagattgtgactctcatgcataccttataaatcctcggttggtacagagagtattctagctagactcagtgtacagctgaggttttgacattcctgtatacccagtcgacagtaaagattatcatcttttcacaagaacggtccactggaaattctgaatctcatatgcagagacagttgcaagttgtaaaatttactcataagtgaatccagtccaaaggtaagttggtgactttcagaccaagattgaacacacctgtttgtctgattccactaaggtgacacagccagtaagagggattgagtctctcattcagtgattcagctcattctaaaaattgtgactatgtacttagacccaacatacaggaggtgttgactctcataccaagaattagggtacgtacaggattgttaatctcatctctggtctttccttcaggtgtgattttgacgcacacttctgcccagcacctgagtaatgtgattcttcagaattggcccggcccacaaataggattgtgccacactgctggacccagtgcctaagtgatgtaactctattcttctgccttggtgctactcgaaaaagacattgtaacatatctcagagccttacacccaggtaatgtgagtctcctcttctgccttgctgctgcacacagaagcggaatatgtacaggattgttaatctcatcttggatcttcctgcacttgtgattgtgacacatgcctctgtgtagaacctgagtgagtttactctcctgcctggatttaacccatagatggaatcgtgacatatcactgtaccagaaactaggtgatgtgactctattttcttgcctctgtgtttttatatggggcatcgtgacatatcactgggccttgcacccaagtgatgggagttttctctcctgctttggtgccgtccacaatgaaaattgtgaaatattgctgccctccccactaggttatgttactctcctgcctctgctttgcccacatgggtcactgtgacatattgctgggtctaaaacccaggtaatgtcactctcttgtttgggttctgcctgcaggagtcattgtcacatatctctatgctcatcacccaggtaatatgattcccttttactgcttagttccttctcacaaaacaacttgtgacatattgctaggcccaatacacctagctggtgtaactcttcttttcttttctttccttttttttttttttttttgagatggagtctcactctgttgcccaggctggagtgcagcggcatgatttcagctcactacagcctctgcctcctaggttgaagcgattgtcctgacttggcctcccaagtagctgggattaaaggcatgtgccaccacgcccggctaatttttgtatttatagtagagacagggtttcgccatgttggctaggctggtttcgaacttctaacctcaggtgatcctcctgcctcggcctcccaaagtactggaattacaggcatgagccactgcacctggcctgattcttctcttctttctaggtttcaactgcagcagagattgtaacaaaccactgggcccagccgcataatgatgttactcttttgccttgggcctgccctcagaaggcactgtcacatattcatgggcccaacgccaaggtgatatgtgtctccagcctggaccctgcccacagggggcattgtgacatatctcttggcccatcagatgtttgattgttatcccctcccctcttctaccctgtgtttgcctataaaagacacagtcatatgttcctgggcccagcacctaggtgttgtcttactggaatgtgtccacatggggattgtgatatgtcacgtggcccagtacttaacttgatgtgactctcctctcatgcctaggccttgtagagaatccccttccccttttgttttcctttttttctttgcagatccaggagataatcaactaagagccaggcacccgtttaggtctaataaacattttacaaactgctctctcttttaattcacctatctgagagattcctctgtacaataaaacttggtctccacaatcctttaccttaacctaaaccttccctttcattgatcccaggtcttcagattccaccacttgtcaaccacaaaatatttaaatttacctggaagccgcccgctttgagttgtcccgcctttctgaaccaaaccaatatattcctgcaaaaccggccatgattaaaacatcaaaaaataatacatgttggcgtggctgtggtgaaaaaagaatactttttcactgctggtgggtatgtaaactagtacaaccactatgaaaaacagtatggagattcattaaataaaagtaaagctaccatttgattaagcaattctactactgcgtatctacatgaagaaaaagaaattatatgtgtaagacacttgcacacacatgtttatagcagcacaatttgcaattgcaaaaatatggaagcagcctaatgcccatcagctaatgagtggaaaaagaaaatgtggcatatatataccaatgcatactactcagccctaacgaggaataaaataatagcatttgcagcaatctcgatttagttggagaccattattctaagtaactcagcaataaaaaaccaagcattgtatgttctcacttgtaagtgggaactaagctatgagaatgcgaaggcataagaattatgtaatggactctgggtactcagcagaaagggcgggagagaggggtgagggataaaagactacatattgggtacagtgcacactgcttgggagatgggtgcacctaaatcttagaaatgattacaaaagaacttatccatgtgaccaaacatcacctgtaccttaaaaactttggaagtaataataattacaaacaaaaacaaaaaaacacaaaaccccgtaagtttaactttctatgttttggctgttttgttttgttttgtttagaaaaggtctctgtcacccagaatagagtgaagtggctcaatgagggctcactgcagcctcgacttctgggctcatgcaattttcctccctcagcctcctgaatagctggtactaaatgtgcaggctaccatgctcagttaatttttaaattttttttagacatgtgtttttgccatgttgcccaggctggtctcaaattcctgggcttaaacagtcttcattacttgctcccccaaagtgctgggattataagcatgagccaacatgcctgactataatttttttattttattttactttttattttttgagacggagtctcactctgtcagcaggctggagtgcagtggtgcgatctcggcccactgcaacctctgcttactgggttcaagtgattctcctgcctcagcctcctgagtagctgagactacaggagcgcgccaccatgcctgtctaatttttgtattttttagcagagacagggtttcaccatatttgccaggctggtcttgaattcctgacctcatgatccacccacctcagtctcccaaagtgctgggattacaggcgtgagccactgcacccagcccagaatctttaatatgttataaaaaagctaactatatttagattcgtttacagaaaattaaaaaaaaaatcttttattaaatgttagaagcaaatttttgatgccgcaaaggaaatagtacttgaatgtaaattttctcagcaagacaatatttacttttatagaagggtgcatcttgcgaatggagcaatggcaagagcacacctgaacaagggagggaaaggagttcttagccctgatgcaggtagcccctactgctgtgtcattcccctattggctagggttggactgcacagtctaagctaattcccattggctattttaaagagaggaggagtacaagccagagtggtggggtgagcagtttgggtgggaactactgttatggaacaggtgaccaaggtgactcaggtcagagcaggtgaccaggggtgactcaggatggagcaggtgaccaggggtacagatgtaaactactgattagaactggcgggaaggttgtttactaaaactggagacaaaaacaacaaagaagttaaactttaaaatggagaatgaagaacagggagctgaatatactgacatactgattctttgaagagcaatttagaactcactgtatttaacattaaaatatataaatgttttttatctacaaatattaatataaaacagttcaaaattacttcctagggatttcactaaaaattagtttgttaagggttaatgtaattaataaaagaccactagatgtaaaaaaactaattcttcaaagagaatgtttaaggccaggtgttgtggctcacgccttgtaatcccaacactttaggaggccgagataggcagatcattttgagcttaggagatcgagaccagcctgagcaacatggcaaattccagtcactacttcaaataaggaaataaaccgggcatgatcgcgcacgcctgtaatcccagctactccagaagctgaggctggagaatcgcttgaatctgggaggtggaggttgcagtgagctgaaatcatgccactgcacttcagcctgggtgacagaacaagcttctctcttggaaattaaaagaaaatagagagagtataaacaaaagcaaaatatgcttttgatgaagaaagttagaaacatttgtctgctttgaaattacttaaaggttccttcaaattgaaaaagtaaaaataatgtagattaaaatgaaatataaaaagttaaacaatggaccggcatcatggcttacccatgtaatcccactactttgggaggctaaggcaggtggatcacctgaggccaggagttcgagaccagcctggccaacatggtgaaaccgcatctctactaaaaatacaaaaaattagtcaggtgtggtggtgcacctgtcatcccagctactccagaggctgagggaggagaatcccttggacctgaaaggcagaggttgcagtgagccgagatcgtgccgctggacttcagcctgggccacagagcaagactcagtctcaaaaaaaaaaaattaaaaaattataagagatcataaaatatgtataaaaatctagagaggtcaaaaaaattttaatgtatttttatttttattttttgctggggtgcagtggcatgatctcaactcactacaacctccgcctcccgggttcaggcgattctcctgcctcagcctccggagtagctgggattacagacgtgtgccaccatgctcagctaatttttatattttatttttcatttttttgaaatggaatttcactcttattgttcagtctggaatgtattggcgcgatctaggcttactgcaaccttggcctcccgggttctagcaattctcctgcctcagcctcccgagtagttgggattacaggcacgcaccaccatgctcaataattttgtatttttagtagagatggggtttcaccatgttagccagactggtctcggactcctgacctcaggagatccacctgcctcggcctcccaaagtgttgggattacaggtgtgagccacggcgcccggctgagagacttacaatgttttatcaaattagctttattattgataatacacaataaagtaaaagttgattttctctggaacaaaaattttatgtattattaatatacatcaaatatttttgttcacattttgaatacattgaaagagagcaaagaagagagaggattttcccatgctctgaggtgggcctggctgagctgaggaagccctgcctgaaaaggctgcagcctacgctgtcactctttcttcattcagcccagtgtctgatcacatcttctgtcactcagggcctgagaaggcggggccttaaacgttatctaatcagggacgctgggctgggaactgtccaatcaggcacaaagctggagcggacagggcggcttccgggatgtggctgggcctttgtctctcgctgccgccggagtttccaggtctcgacttcactgctctgtgtcctctgctccaggaggcccagcctgtgtggccctgtgacctgcaggtattggagagccacagctaagatgccaggaacccctggaagcctagaaatggtgagactgccaggtgcgacgtcccgagagagggaacggggctcgttgaaaccggtgggatgcggctgtggcgagcctcaggccttccttcagtcagctccacaatccgtgcccgggttctccttgcccagctcggcctcagtccccttcagcgataagatggcggctgcgttgacaggcgggctccgggcgtcctgtctcttccctgcccagtgactgtgtcctggcctggagccctctctgggcagctctgctcccgcagcgccgcgtctctcccagattgtgcagggatcacgggagggtcgtcaggggagaatcctgactggaggtgctggctcatgaataggaagcactttagtccgtggggttcccagggcctctttttttctattaaaaatttatgggcgtcaccgcgaaaagattaaataatttaatcaaagagtgattcaaacattgtagagcacccagctatggtttgtaatttgtggtctatgaaaggccttgaaggagatatttttataaggttcatgataaagaaaaccaaattcagtaatttgctaggtacagttatgtaggttttgttttgttttgttttttgaaaaggagttttgctctctcgcgcgggctggagtgcagtggcgtgatctcggctcaccgcaacctctgccttccgggttcaagcgattctcctgcctcagccctagtagctgggattacaggcgcctgccaccacaccaggccaatttttttatttttcggagagacggggtttcaccttgttggccaggctggtctggaactcctgaccttaggtgatccacccaccttggcctccgaaagtgctggaattacaggcgtgaaccaccgcacctggcctagtttcttaatttttacaatctaggtggaaatatccttcttatgtaatcagagcttaattggcagtttatagttgcttaagcctaaattttgcttctgccaatgtagtaatttaccaaaaaatgctcttgagtttagatttttatttttagaagtagaaatccgaggactagagccacctcaatctaattgcctgccacttaatttttctcacactcaaaaggggacgatttttccctgaattttttacatgtgtctcaagcagggcctcaagtccacccctcatcccctgttcctccagcctaactctggcttgcagtaaaatactaaatttccagtttcgtctgacattcccaaatgccaatttcccctccctaattcactttatcaactatttgtcctgtagtgtacattttgataccgattttaatcatttttatttttaatttttgagacagagccttgctctgtcacccaggctggagtgcagtgacgcactaggctcactacaacctccgcctactgggctcaaatgattctcctctctcagtctcccaagtagctggacttacaggtgcccacgaccacgtctggctaatttttgtatttttagtacagacagggtttcactatgttggccaggctggtctcgaactcctggcctcagctggtctgcccacttcggcctcccaaagagctgggattacagacgtgagccaccgcatctggccaattaattttttttttgacaaagcatttgatggcacatttaaaaagatttgttttttttggtaaatactccctgtgagaagaaagcaaagaataatctcctgacactgtatggtaaaatatctctgtgcgtttttttcgtctattttccctagacgcagctatcttaccagaatgtttttgggtcaggttttccttttggaaactgtatagggtgatgtgtcttcagtcacccttcagttttttcttggacctagatttcagtactgtatggggataaaccaagatacccaccatggctatgtgtgctagagtgtctagtgaatatcagcttctgggtcatattctctcataggacaacctgaggtattgagtttagcttctcaagtgtggacgtggatgccctgaggctgagaggcatttcctggtgcacttttttttaaagttaattccttgagacattaatattgccttcacccaattcagctttcatttcttggagacacattgctggccagccaatcagatactagtattgaggagaaaacaaataatttctgcctcctggattcctttagggggcagaaaaatagtgcaagaaaaatagtaaaaaaatttctagaaaaaaaatacccagcactccaaaagacaaaaaacaaaaaaaaacccaaaaaaccaaaaaactgaccccagttagatggcgtaagaacttgcagagtataatgtgcctgaggcactcactggggcatagttcagagtctcctgagagggggttattgagcacttaagtgagcaggatgggatgggacaatctctcaagtaattgaatggcctgacttgacacatgaggaagacatatctgtatcttgaaaagctttgttcacttattttgacctaagggtttttttttgtcttatttatttatttgtttatttatgagtcgaaatcttgctctgtcgcccaggctggtgtgcaatggtgtgatctcagctcactgcaacctctgcctcctggattcaaacattcaaggaattctcctgtctcagctccccagtagctgggattacagacgtgcaccaccactcccagctaatttttgtatttttagtagagatggggtttcaccatgtggcccaggatgctctcaaattcctgccctcatgatttttccaccttagcttcccaaagtgctgggattacagatgtgagctgtcgtgcctggttctatatcctggtattttgatttttgagtttaatgctaaattttatgtgatgaaacttgatacctcctagaagtgttcccatgtgactatttttttttctttttttttttttttttgagatggagtttcactcttgtcacccaggctggagtgcagtagtgcaatctcaactcactgcaacctctgccttttgggttcaggtgattctcctgcctcagcctcccaaatagctgggattacaggcgcttgccacaacgcccggctaatttgtgtatttttagtagaggcggggtttcaccatgttggccaggctggtctcgaactcctgacctcaggtgatccacccacctcagcctcccaacgtgctggaattacaggcatgagccactgtgcccggcagactaattgtttgctacgtgatttttgatacaaataataacataatatatttattgtctgaaaggaataaatacttttgcttttcttactgaggtataagatgtaaacaccttaaacttttcttcccttatatgaacactgtgtttgcataattttgctgaattattctaccacctagttatagtttcaaaagccaagttaataactctgacatagaaattaaagcttaaacccagtgactccaagctaagccttttgcaggcttgagcctgcaaaaggaggtttttaaagacccacttagttccttctggggagcctcccctgcagatgtcccagcttgctcacctcagctatggaagaagcccctatactgagacaatctacagagccctggaaagctggcaacccacacgcagatgcagttaagattaatataaaagggtattgggagggtcttactgaagatgaagttattgttttgaggcagtttctagactttttaaaataaaagttagatgtatgtaaaaacttgaatttcaaaggagtattgcaacaggaggaagtagcgactataagatttttaaagattgcaaagatgaggcagacagtggctttttttcctagggaaaagcaaacaagattagtaaggaggtaggaggggaatgtttaaacagagggtaataaaatcagattttgagaatgttttaccctgaagtcagcatgttcttaggataaacataaaatggggttgtatggtggctcagactgagggtagctcaaagttcaggagcctgtgggaagaaaataaacttaagttcagttagattaagaagtattttatgtttaccactgaagacaaagtcagctgatttttaatgaggaagaggagaaaatgcacaaagcgtttttctggctgtgtgataggtaagaaaagagagcaaaaaaatagatactgtcaaggtttcagagaaaagggaatacttatacattgctgttaacagtgtacattaattcaaccattgtaaaaagcagtgtggcaatttctcacagaactaaaaacaattaccatttcaccaagcaaccccatcactgggtatatacccaaagaaatacaaattattctctcataaagacacatgcacaagggtgttcactgcagcactattcacaatagcaaagacatggaatcaacttgaatgcctatcaatggtagactgaataaagaaaatatggtatgatcaggcacaatggctcatgcctgtaatcccagcactttgagaggccaaggcaggtggattgcctgagctcaggagtttgagaccagcctgagcaatatgggaaaatcccatctataaaaatgcatctctaaaaaaaaatacaataagaaaaattaggcatggtggcacacgcctgtggtcagagctacttggacagctgaggaacaagagtattgcttggcccaccacgatggctcatgcctgtaatcccagaactttgggaggccaaggtgggtggatcccttgaggtcaggagttcaagaccagcctggccaacatggtgaaaccccgtctctactaaaaatacaaaaattagtcgggcgtggtggtggtgggcatcataatgaaaagggtttttccgcccccccaccataaagtgttcttggagaacacaaaagatagagaattttattaatcacagctgtttatcatctatgtgcttcatctttttccacctttattcttggtcttatacatttttttcacatgactttgttggggttgtacctttttcttttctgagacggagttttactctaattgcccaggctggagtgtaatggcacaatctcggctcaccacaacctccgtctcccgggttcaagcaattctcctgcctccacctcccaagtagctgagattacaggcatgtgctaccatgcctggctaattttgcatttttactagagacagagtttctccatgttggtcaggctggtcttgaactcctgatctcaggtgattcgcctgtctcagcctcccgaagtggtggaattacagaagtgagctggcgcgcctgtcccgggttgtatcttttatgtgaaaatggtaaatatgactacagtgttccgctgagttctgtgagtagctctaacaaattagtaaatttcagtaacattatgggagtccccagtttctaaacagtatctcagaagcacagatgggcttatagagtttgtgactggcatctgcagtgaggacaatgttgtgggactgagccctgaatcaaggtctgtgctgactctgggtggtgtcagaattgaagttttagataataagttggtgttggagaattgcttggtgtttagcaaactctacagatttggtgccagaagaaagataccacagactcctggattagaataaacctctgggtgtccaggaatgagaggctgtgcactctacacaggctgtcacactgtcccttgttctgtgattccagctccccttccagggtgacagaggacctaaaacttagaggaaaggagctctgatggcagatccccttttgccacagccaccaccacaagattttcacccactcactaacatacccactagacattaatgtgtccacacctctcccaggacagggaaccacactcaggaattttactacagcatttttgatcctagtgtttttttttttttttttgccaaaaacttacagaagtatctccaagtcttctggcatattcccacctccagacactgaatctgcagcagcaggctgttttgtccaccagcctggggttctggaccacctgtttataaactcatctgcctgcatggacccagaaataaatcagagtacagccccacctgggccactatctgtagcacaaaccagtctttctacctggagtgtactcttccctacccagggagtttttttttttaaacttctatttttggtttaggggtacacatgcaggtttgttatacagctaaaattgtgtcatggtggttttgtgtatagattattttgtaactaaggtactaagtatagcaccaaagaggtattttttctgaccctgtttctcctgccaccctccaccctcaactaggcgtcagtgtctgttgttcccctctgtgttcatgtttttattatttagctcttacttataaataacatgcatttggttttccatttacgcattcgttttctttctttctttttttttaaaagatggtttcactcttgtcaccaggctggagtgcaatggcgtgatctttggtcactgcaacctccacctcctgggttcaagcaattctccatccccagcctcccaagtagcttgggattacaggtgcccaccaccatgcctggctaatttttgtattttttagtagagatggcgtttcaccataatggccaggctggtctccaactcctgacctcaggtgatttgcctgccttggcctcccaaagtgctgggattacaggcgtgagccactgcatttggcctccgcattggttttccaagaataatggtctccagcttcatgttgctataaagggcataatcttgtttttttctgtaccagttccatgttactttgtttactgtagctctgtagtataatttgaaaacaggtaatgtaatgccttcagttttgttgttttgcttatgtttactttggctattcagcctctgttgtggttttatatgaattttacaatttggttttatatgaattatacaaaaacaatgtttttggttattgttttctgtttgttttttatgaccacacggtattccatgatgtttatgtatcatatttttttattatatattttattttattttagagacagggtctcactctgttgcccaggctgaagtacggtggcataatcttggctcactgcaacctccgcctctcgggttccagcaattctcctgcctcagcctcctgagtagctgtgattacaggtgtgcgccaccacgccctgctaatttttgtagttttagtagagacggggtttcaccatgttgaccaggctggtctggaactcctgaccttaagtgatctgcccacctctgcctcccaaagtgctgggattacaggcatgagccactgtgcctggccttttttttttttttttttttttgagacagtctcactcttgttgtctagaatgaagtgcaatagtgccatctcagctcactgcaacctctgcctcccgggtttaagcaattatcctgtctcagcctcctgagtagctgggagtacagatgcccaccaccaccatgcccgactaatttttgtatttttagaagagatggggttttaccatgttggccaggctagtcttgaactcctgacctcaggtgatccacccaccttggcctcccaaagttctgggattacaggcatgagccatcgtggtgggccaagcaatactcttgttcctcagccttccaagtagctggggccacaggtgtgtgccaccatgcctaactaatttttcttattgtattttttttagagatgcatttttatagatgggattttcccatattgctcaggctggtctcaaactcctgagctcaggcagtccacctgccttggcctctcaaagtgctgggattacaggcatgagccattgtgcctgatcataccatattttctttattcagtctaccattgataggcattcaagttgattccatgtctttgctattgtgaatagtgctgcagtgaaacacccttgtgcatgtgtctttatgagagaataatttgtatttctttgggtatatacccagtgatgaggttgcttggtgaaatggtaattctgtttttagttctgtgaggaattgccacaccgctttttacaatggttgaattaatgtacactgttaacagcaatgtataagtattcccttttctctgaaaccttgacagtatctattttttgacattttaatagctgttctcactggtgtggatggtatctcatggtttttcttggcatttctctaatgattattgatgagcattttattgcatgcttgttagccaaatgtttgtcttctttcgaaaagcatctttttcatgtttcttgtctactttttaatgaggtattttttccttgtaaacttgtttaagttccttatggattctggatattagacgtttgtcagaagcatagtttgcaaatattttctattattccgtaggttgtctgtttactgtgttgatagtttccttttctttgaaggagatttttagtttaattaggtccaatttgtcaatttttacttttgttgtaattgcttttggtattttcatcatgaaatctctgccagtttctgtgtctagaatggtatttctttggttatcttccagggttttttatcattttaaaattaacatttcagtctttaattaatcttgagttgatttttgtgtatggtgtaataaaggggtccagttttagtcttctccatagtgctagctggttattccacaaccatttattaaatagggaattctttccacatttctattgttacttttggtgaagatcagatggttgtaggtgtgtggcattatttctgggctccctattctgttacattcatctatgagtttgtttctgtaccagttccatgttgctttgtttactgtagctttgcagtataatttgaaaacaggtaatgtaatgccttcagctttgttgttttgcttatgtttactttggctattcagactcttttttggttttatatgaattttacaacagtttttttttcattctgttaaaaatattttggtcatttgatatcgaacagcattaaatctgtaaattttggaggacagtatgatcacttttaggatattgattttttctatttatgagcataaagttgttttccatttgtgccatttctgacttctttaagcattgttttgtaattcttatagagatctttcaccttcctggttagctgtattcttagatattttattatttttgcagcaattgtgaatgggattatgtttatgatcacatttggcttggatgttgttgattcacagggatgctactaatttttgtccatttattttgtatcctaaaattatttttttccaaaggcatgtaaaaatatatttttactttaaaaataacttagttacagtagtactttgcctgtatcttaccaacatgtagctgacagttaaaattttgtaatatagatataatatatagggatatataagaactacaagaaaatctccaaaacccgtaaaattcaaatgtgaaaacagaaaagttttaacactggagaattctctacggtgagcccaagcaatatatagaaaagagtctagaaaaaaggctgaggtgttaaatatgtttttacttcctcttgctcagaaaatattggagtgctgtaaagttctgtaaatttctaatgtgacgcgtccagccctttgtagctagtgccaatcctggccaagctagatttcttgtgtgtctgcaaacaatatctgagccaaacatcaccaatgcctgctgaaaatggattctgactgacagatttcctcgttttgccaagacaggattttttttttctaaattgtttttgcaaacaagctataacaggtaaaaaataaaaatgctttataagaatattattttagaaaacccatcacaaaactgcaaatacagcttcagaagcccttctgttcaactgcagttagtttagtttgtttttgtaccttctaccccaaaggaaataagttcgcatcctgttacttatttttttccgtgacattcagcccctcatccaaaagtgagggcccaatatcaagctgcagggggaggagggaacctgtaagatcagagagggactcctctgacttagtctttcccttgatgagcttgcatgacgcaggatggtgaaacatgtcttcggctggccattcggggtactgttcggacaggttggaggagtggctgtccctgccctgtctggactgagatgcggaaccgctggagccccatgaggtgtctccctggtggactgtcccgttctccaacagactgcttttctcctgacctttttcctccatgacgggctcgcagctaagccttggcaactttgctggccgaaaggactcctgtttggaattaaagttcaccggtgacaataagagcaacatgagagcttgggaccctccagtgatcgtgagggagatggtatttttgaccactgaggagggtgtttctgtgaacacagagtctgaggtgctgttggcccggaagaacttactatgcccggggagctgacccaggtgtgctttctcctagtttccaggtaaaagctcattgttcccttgaagaaaggaaatatctccaaagacgtcatgcttggccctctttgccgatttggatggtatggcaaaagcctccaagagggggactgatgatatcgggagacagaatgtctcagtttaaatttctttcctttcttgttattggctgctttcaggtaaattggggccttggctggcattttggaatttgagaatgtctgttttgcaagcggaagaaagggcaacttttttcacagatggtatatgtttctgaagaatctttttcgttaggaactgtcaaatttttctcaagtggcttcagaagtggctctagctgtgcgcggttccggcgtggtgggcggtgacctgcagggaagcgaggccacctgagtgcactgccctggccaggctgcagctccccaggtcccttgcagcccgggattggttgggcgcggagggctgtatcctgaaattatactgaagttatttgtaagtttaaagagctattctgccaagtctctacggttttcctgatgtggaaacctgttgtctgcaaacagggatagtttgacctcctctgttcctgtttaaacgcctttaattttaattttaatttttttttagatggagttttgctttgtcgcccaggctggagggtagtggcacgatctcgctaactgcaacctctgcctcctaggttcaagcgattatcctgtctcagcctcgtgagtagctgaaattacaggcacgtgacaccacgcttggctaatttttgtatttttagtagagacagggtttcaccatgttggtcaggctagtctcgaactcctgacctcgtgatccacccaccttggcctcccagagtgctgggattacaggtgtgagccactgcatccagccaaatgccttttatttttatcttttgcctgattgctctgaccaggacttccaattttatgttgaatagtagtgttaagagaaggcatcttttgccttttgccagttttcaaggaggaatatttcaagctttttttttttctttttgagatagtctccctttgtctctcatgctggagtgcaggggcacaatcttggccaactgcagcctctgccttctgggttcaagcgattctccttcctcggcctcttgagtagctgggattacaggcacccgccaccacacctggctaatttttgcatttttagtagagatggggttttgctatgtcagccaggttgatctcaaactcctgacctcaggcgatccacctgccttggcctgccaaattgctgaaattacaggactgaaccactgtacccatccgcttccaggttttgtttattcagtatattggggctgagggtttgtcatagataacttattttaaagcatgtaccttcaatgcctaggttgttgaggatttttaacatgaaagatgttaaaatttaccaaaagctttttctgcatctactgaggtaatcttgtggtttctgtctttagtagttctttttatgtgatgaatcacatttattaatttgtgtatgttgaaccaaccttgcattcccaaaataaattctacttgctcatagtgggttagcttttggatatgctgctggattttgtcatgattttgttgaagatttttgtatcagtgttcaaagatactggcctgaattttattggtttgttttatctctgccaggttttggtatcagaataatgctgttcttatataatgagttggagagaagttactttttcttaatttcttaaaatagttttagtagaaataataccagcacttttttgtacgtctggtccacctgtgaatgtctggtccttggctttatttggttggtaggctatttattacagttcagtttttgagcttcttgttcatctgtttagggctttgatttcttttttgttcattcttggaaggatgtattccttaatactttttttcattttttctagattttcttgtttgtgtgcacagaggtgttcataatagacttcaagatgtttttgtggggtcagtggtaatatctctgtgtgtttggtttgtataattttgagatttttgaatttcctgaggatttttttatttctgattgtgtggtcagtatgtgccacgtggcgatgagaagaatgtatgttatgttatttttagatgaagagttctgtagatacctattaggaatatttggtcaagtgttgagtttaggttctcatattttgttaattttcttcttcaattatctgtctattagtgcctgtgggatgttgtaatctcccactattattgtgtctgaatctaaatctcttcataggtctctgagaacatgctttattcatctgaacctatgaattttatgtaacacctttctctcttctgttttttcttccataaacattctttcatgtgcacacagtgtgcaaaatttagatgtccaggagttcaagaacatgtttagagacctggctgttgtaaaagaaaatataaattagaaataagaggcttaattagtctacataaaagtaagaaaatatcttactaaaatctcttttcttataacatttagattacgtatatattttatctccctttttttgaaatatatataaatcaaataacagctgaataaaccttttgtcatttttttttttttttttttgtctcaggattgtctttatctgggacccgagattaattgcttcgtttttgctttggcaaaagattgttcttacaatttttagtcttttaaagttgacacagatttgttcagtcttgctcattctaaaagcacacaaaagttgagcataaaaataggattaaatttagcaataaagaattataaagactaaaagatactgagtaagttgtttgacagaaacctgattatccatgatgattatttgcaggctaaagtatttatactacaaaagaaaaaagagttcagtttatggctgggcgcggtggctcatgctggtaatcccagcactttgggaggccaagtcgggcggatcacctgaggttgggagttatagaccagcctgaccaacatggagtaatcttgtctctactaaaaatacaaaattagctgagcatggtggcgcacgcctgtaatccagctactcgggagattgaggcaggagaatcacttgaatccaggaggtggaggttgaggtgagccgagatcatgccgttgcactccagcctgggcaatgagagcaaaactcagtctcaaaaaaaaaaaaaaaagagaaagaaaaaaagagttcagtttataaactgaaaagtggagtgtgttgtcatacctttgtttctatttattcagtacaattagcatagtaatgtataatgtttgtagacaacctgcattcatatacattcaatagtattttctgcaagagtatgaatataaagccacaatatttactttgaatgaattccttaaatagttgttttaatattgtgattcatagttttgaaatgtagtttttcaactgaattatagttgcagaaaattttttaaaatcctacatacattatgagtagtatattaaaattattcataattacatatttatatctaatatccaaagaaaatgtattaccaaattgttacagtagagattagtctgatatacttattaatttaaccaatagggatagttataggtaagtataattttagtggctttcatttcagaaattggaatgctgctattacaggacaaataaaggcaggtgatttggccaccccaaaactgtatagctgtttagttagttatgttgcaggctcacatatattccattatattaacacaggttttaatttttttaatcaaaaagtgctggtggtagttgtcagatatatttctatatagattccacatttaatgggcagcagattagagagcagcagagatagaaaaaaatcttctaaaattctgctgataatgtgccctttcttcataacactcatgtttctcatgctgtgagtagctatgcactttggatatttagagagaaattatttttagaggaatattttctggctgacttgatcaatcttatatgtaatctcagttttttcttaagacgcttttaacttgtttttttctctcaatataatctttctcggaatgagagctgtttttctttctaatgctttgtgtatctgttttagaaaccctattagtatcccataatgtctgtgaaagacatgggctgtcacagtgagaactcttagagctatctctatctggatgcatgctggaaacccagcagtatattttccatgtcaccattataaatagaaactgtggcttagataatgctcgcattcccattattgtgaaggtgcgattctacccgggaggcctgcaagctctccttctgcagctcaagcttcactcttttttttttttttttttttttttttttttgagacggattttccccccattgcccaggccagagtgcaatggtgcaatctcgcaatctcggctcactgcaacctccgccttctgggctcaagggattctccttcctcagcctcctgagtgcttggattacaggtgcccaccaccatgcccagcaaattttttatttttatttttagtggagatggggcttcactatgttgaccaggctgctcttgaactcttgacctcatgatctgcccacctcaacctcctgaagtgctgggattacaggcatgagccaccgcacccggccagacttcactctttgatgtgacactaaagtgctgctgtggcaattgtcgttcatctaagatgtgagctgccagctgtgagccgtgtgctgtgggctgtaccacagtggcagatggtaggaaacaaaagaggacactggccaccagaagaggggaagcaggagtgcactagtcaagtcctcagggagtagagagccagtgctttaaaatgcaagtagccaaaaagatagcaccctattcaaccacttttgtagaagagtgaaagtctaccttaagcaggcacctggcttcaagttgcaaaactaccttctgccatgaagatgtgaaaagcttattttgtcattgaatataaccaattagcatacatggatgacctccccaatgaccaggtgaatttaggatgaactacctatgacatggcgctgtaaattcttctacttgtgaactaattacggtaaccgtctttatttcttttcaatctcttaagcagatggattgtaatgcatgtgacattcagacttaattgtgtaatgagacagttttctttctgttctattactgtggtttctctggtgctgaagagaattaataaaaattatatttcccaaacactgtgtagaattaccagacataatataaacacataaggtgccaaccaagctctactctagaggggactttccctctcaggcttccagtcaactcacagttacgctgtaaaatgtgtgctgtcacctaaatatgcaggcagaattgtgtctctgcctatttggtagtttcattttctatttagaatcagcctgagtctctcttgctggcttattattggaccatcagcccagggtcactggaaatgctctcacagtcacctaggtatctttgagacatttgagaatctccagaacagaattgtgtcaggctgactagagtggttaattttgcttctaacttagtgtaaaagaaatgagtcatcctgtgtttgctcctcccctcatacaagagatgtctttggttggtacccaggtgagagtttctctagttccctggtacttgagtgaaaaatgatgaggaggtctggagactcaaacaaataaactaattgcttccaattcatatagtcattagaaaaatagatgaagcagtcatggtccctaccatgcaagaacttttagtctagactagcaactggataagtggtttaattatgcatcaaaaggttgggtacaataaatagatgtgtgcaaaaatatgggctttatttgggccgttttctttatatttttgtgacttgtgatgtctacacctgaacatatattaataaacaaaaaagttattatttgtattttttatgccctgctaagaatacttatttatcatctaaaaaattattctagaaaaccttaagggatttgtttaaattgcttattagtatgtgatataaaattgaaagggcagtggggctaaaaaagattaaaattacacaaactctgagatttaagtttctgttttcgtttttgttttttagctaagtttaaaaaaagaaacggaactaaaaatactccccagtggcataaagaacagaattttacatcaactctacaccctgcttcagccctgtttagattcaccctttttgaaggccttatttaagtcttgccctaccctggagttttgcctcgcagaactaactagtagagatcagagttttgggtaatgaatcctgttgccttttagagttggtgctcacacttttctgaaacccaatagcagataaatggaaaaataacatgtattatagggtcttaatttaataattttatattaaaaccagtgtttacagagacattccatttagcaacttgttttctgttcctgcagatacagtagttgattcacaagtcacaaaatagtaaatataaacataataattcatctaaattacattacactctatctgtatccctctcatctgtctatatttagattttattctatgcatttttttaaaaaaatgagtgacaaaaacagaagaagaaataaaaatgctggatccttattctaaatccttgggattattcaacacttagtatcaactcacagggtgttattagaattaaatcaaataatgaattatcacagtgctctgtaacatcctgttgattacatagtacctgcttaataaacattgcattagtacatgtgcacatgttgttttccaaatgcagacttactcagaaattgctgttttctgttttctttgtgaactttaaagagccagcaagtagtatactttaagatagagaatggttgtcttcatttgtatcagaagtatttgtgttgtgacaggagtgctgagtgtaagggactctgtgctgtgcctcatttttctaacaaatgctaataatgagaccagagagagtgacatcagcactgacaggggacttgtttagaacacccatttatggaccatttccaaacctgcggaatcacattacatagagtggggccaagtttaccaagtgatttataagctaattaaagcttgagtggcaatgcttaggtaagtggttataagctcaggattctaattagaagcacatggccaattcacagaactctcttgtgcccttttcacagtttctgtttaatgttctgaagatagcatctatttgttttaattaagtgtctcctgtgactctaaggtgccagaatcaagtatgagaagtttaagatacattcatgagagttaagttccacctttgcactaaagggtggtccaggaacctgttctatttggatttggtaaggacaggacagtgtggccaatatttgtattactgtagcagaaattgctgatgtccgtagcaggggagggcacctgaggacaaaaaaaaaagagaaacttatatttttatctctgtggagcagctcattgttctgaatcttttctgttattcaggacagaaatgggtagagtttttgtgtcttgggccttctgcctttgggtgtggtggtaataggtaaacatgtgctcaaattattaaaggcaaattctcaaaatgcagacataattagtccagaaaaactcatctgagaaagaatttgagaggaggaggagaaagagaaaaaatggctttttttcagctaaacatgtctcagatcaagagctgtgtccactctgcctcgtggaatgccacgcgtttagtacttgcaaatttttacttctgtacctgtattttttctccctaatgagtttgtcttaactacttttaaaaatgcttatgataggccaggcgtggtggctcacgtctgtaatcccagcactttgggaggccgaggcgggcagatcacctgaggttggcagtttgagaccagtgtgaccaacatggagaaaccctgtctctacgaaaaatacaaaattagctgggtgtggtgatgcatgcctgtaatcacagctactcggcaggctgaggcaggagaattgcttgaacccgggaggcagagcttgtggtgagccgagatcgtgccattccactccagtctgggcaacaacaagagcaaaactccgtctcaaaaaaaaagagaaaaaaaaaaaagcttatgatagtcaaggatctctgaaaatatttcttttctatctaccagagccttctctgcatgatggcttcttatatgccatgcagaattctcaccatgaatttgtgatctgcaatattaaaaatgttctctttgtggctgttgaacatggaaaggtgtggataatctatttctatggagaaaacctgggattcttagtgaagatggagaacatataatgttgaggttctgtttttttattatctctgtgcattacaggattaagaaagtgctcatttaaacaggatggcatttattacccagaaagtttggaaaaaattatcaggatatagctgcttattagggtgttaaagaaagtacttaaaatcactattaaaaattgtagaacacggaagatacctgtaccttgaactttccatgcaactgatattttcttatggttaaattgagactgtaatttactttagtgggggcaatatggtgcatcagcatactatagaaacttgtcctagtgcaattggtattaataactcacttgcttaataagctctcttacagattttttcactacagagttatttttctcttcatcattaagtatctttatgcaggtgatgtgcataaaacatcacatttaatctggcagctgcccttttttttttaggttttctttgcattgatctttttttggtaaatgaaagctctcatctttgtttacaggccagaaaaactgaaaaaaacacaggctgttccacttactggatgtttgacagaatagtcttttggggtcaaaacattggcattactagtgaactttttagaaattcagtaattcagactttatttcagatctcctgaaaaaataatctgcattaacaagatgtctagtttatcatacacattaaaatttgagtggtactggccaggcatggtggctcatgcctgtaatcccagcactttgggaggccgaggcgggaggatcacgaggtcaggagatcgagaccatcctggctaacacagtgaaaccctgtctctactaaaaatacaaaaaattagccgggcgtggtggtgggcacctgtagtccctgctactcgggaggctgaggcaggagaatcacggaacccgggaggcggagcttgcagtgagctgagattgcgccactgcgctccagcctgggcaacagagtgagactctgtctcaaaaaaaaaaaaaatttttgagtggtaccttctaactcaacgtgtctattgtgtctgaaatatataacaactatgcctttttcacctgaaaaaaatacacaagtcattctgtattatgtaaatataacactcaaaaatgtacttgttaatatttatgccctcaattttacactttatcatctagacaagtatcatatatacactgatattgtgggtattatgccactctcttttctcagagttagagaatacattacaaaacgtttgtgtgttgacaattattttattggataatttcagccactcttataagtcagaaccagttctagtcactttctgattttaccttgagtcaaatgaaaaattctgcccatagccactttgtaaatatgtgtgtttgtgtgtgtttttcagggactgttgacatttagggatgtggccatagaattctctccggaggagtggcaatgtctggacactgcacagcagaatttatataggaatgtgatgttagagaactacagaaacctggccttcctgggtaaggaaaactttaatactaagtttctaatataaactaatggttttacttcttttctttttttttttttttttttttgagacagagtcttgctctgttgcccagactggagtgcagtggcgagatcttggctcattgcaagctctgcctcccaggttcacaccattctcctgactcagcctccggagtaactgggactacaggcgcccaccaccatgcccggctaatttttttttttttttttttttttggtatttttagtagagacggggtttcactgtgttagacaggatggtctcgatctcctgacctcatgatctgcccgccttggcctcccagagtgctgggattacaggcttcatttctgttttgtagaatgttttctggaaatttatgctttcagatttctgttttcaagaaaatcctggggatttgtttgtttagaaaagaatttcctcaagatgtttcatcttgacctgaactttccacattcctgagctgatctgtgtccttcactttagattagtggtaatttcagaagttttgtggcataaaatactgttactcacaccttaaaatctaattgccatcaccagtttttgatacagtagtaccaagcagtaaaattaagaacctataaaattaaaatatcttctaaatatttaaacatttctgttacaaattagtatattgggacaatttattagaatattctattatatgctctttactgagcacattactaagttggcaggtggagaatatgagcaagactcatgttagttatttttaataaaacaggtattgctctctctaagccagacctgattacttatctggagcaaggaaaagagccctggaatatgaagcaacatgagatggtggatgaacccacaggtaggtgagagtgaatacaacagacgacaaggatgagaggcccaaagtcaagaagaaagcaggtctttaaagtgatctgagaagctgtgttccaaaggaaatagtttctgggaagcctgaatgttttttttaaattatgctatcacttctgttaatgcttataaaatctctaagaattctactttcccttcaatgatctttcttcaagtttacagtgacagccagagtactgttcatggcatagaaaagagtgcattttgctaattttacattttgctaattttttgcattttacattttgctaattaactgagtgtattcattagtttaaacaggttttaaagtactgtttatttatatatatatatatatatatatatatatatatatatataagattacatgatctacaaaaagcaacattttacttactggtcttcaatttcaatgactttaaatttttcttttgactgttttgtcttccacatactttgagtgctatgttaaaatagaagcattgacaataagaaacaatagttttgcatcggtgactgtaaagaaggagcaaacacttgttcaagtatttatagactggtttcagaaagtaaaaatctatttttattgggtcctcagagtgatagaatgtcatctgggtttgtagtgaagaagggttgtagcttggtcttaagtctgctgggtttgcacaagggtccacctttagttgtgttgttaaaaggggcttggatagttataattctcatttaatttttggacagagtgaatatccttcaggactttgctctgcagggcagacccaagggcaggtttctgcagtcaggtctgcatatggtgggctttatatgaggatgtggatgagcatggctttcatctagtacaagagaggattttcccaggttactttgggtttctacataggcagaaccggccatgaactgtggctcagagagctggaactgaatcatggacctgcttcagggaccacagtaaaggccaaagtctgcaggcctgctgcatggctataaatgggtgtcttcctccaggcctctggaagggcagaacctccccaagtctgtagctgggaagagtttgggatggttacagagtacagttcaaaattctcagtggaaccaagttaagtggaatattttcttgtctgtagccaaaaacagtagtcctgtagtttgctgcctgaatgaggcttgccttctaaaaaggattaccttcaatcttgggcttcagcagagtttcataactcccatcctggatctcagagctctcttaaaggcacttatttttgagatggggtcttgcaacataacccaggcaggtcttaatattttgaccggaagcagttctccaactttaatgtgccatgtagctgtcattacaggtgtgaaccatgatgcctggttctctcacaaacgcatttttgtcaggaatggctgccaaattttcttgctgtcaggagataagcaaatagggcatctttttttttttatcttattaatgtcactctccatataaatttttatttttattttctacttcaaatttgtctgtagttttggattcagacatttaggacaatatactagaatgtacatgttgtgtgtgagttaggtaattagtatacaggcaggcaaataggaattacagaattttcagccacttttgtcagcctgtaactaaataataacataatgtattcctcaaatatttgttttatacatgaagctctaaccatattttgctaaatatatacataatttagcaatttaaggctatagttggttctaaacttgaattacagtaattttattttgtgtaaaaatagcacatatttaaaacataaaaattgacactagtttcttttaaatgcttatctattaagtttctcattagcatctcctatttatgattgtactacattttctctgggattttattgccatacaatagataccagtaatttaaagtgcctgccttccatgactgcacagttagtcaaacattgccgttttctagacaaattatttgttaacgtacattaatgttgccaactagattttatgagtaaacatttctttcattattttcttgcagttctacattagtgtgttttttagtgtaagttccttaatatgagtttattgttttttggttttacttatgtattataattttagacaatttgcaattctgtttgtatactttaagtcagtgtgggatttaattaaaagataaatgagccatatgtctatcacaatcagattatatatatgtgtttttatgtctacaaatatgaccccagttttggttatagcttatcttgtatatattctttcttatctcatttttttttcttttttgtttttgagatggagttttgctcttgttgctgaggctggagtgcaatgcatgatcttggctcactgcaacctccacctcccagattcaagcgattctcttgcctcagcctctaatgtacctgggatatcaggcatgtaccaccatgcccggctaattttgtatttttcttttagtagagacagggtttctctcatgttggttaggctggtcttgagctcctgacctcaggtgatctgcctgccgtggcctcccaaagtgctgggattacaggtgtcagccaccttgcccagcctcttagttcactttcaatgttggttttgtcttgtctaagtgagtagcctttgaaatagcattattttcaccatgtgtttaatgatgaatatgtatttcctttgtgtgaaaaaaagtttttgtgatttgaaggtaattttcaagaaaatttataattctttattttttctgtcttttttcctaaaataattgttgtaaaaacacataacatataatttaccttcttaaatctatttcaatgtacatgtcagggccaggcatggtggtggctcacttctgtaagaccaggattttgagaggccaggacaggaggattgcttgagcccaaaagtttgagaccagcctgggcaaaatatggagacaccctctctacaaacatttttatgtaagaaatatccaggcatgatggtgtgtacctgtggtcccagctacttgagagattgaggggcaggattatttgagcctgggagtgtaaggctgcagtgagccataatgtgccactctactcaagcttgtgtgacagattgagaccctgtctcaaaaaactaaacaaaactgtatatttcaagcctgttaatattaacattgttatgcaaaagacttctagaaattttacatcttgcaaaattaaaatgaaatgcccattaaataacatttgaccattttatgctctctctagcccttgacaaacacccttccactttctgtttttatgagtgtgactattttatatatcttagtgaaatcataacatttatcgtttcgttactagtttatttcagttgacataatctcaaagtgtatctttaaatgtgacaagttttttgtgtttttttttaaggttgaataatactccgttgtatcaaatatgtcttcagggtcttatgatgcatattttagatatagattcataaatggaattgctgtatttgataataattttatttaaagtaaatttataacattataaaataatgggtgcatcctgctttccaccaacaatcaatataagttttttttgtttgtttgtttgttttttgcttttttttttttttaattgatcattcttgggtgtttctcggagagggggatttggcagggtcataggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcacagggttgggggtaaggtcatagatcaacagcatcccaaggcagaagaatttttcttagtacagaacaaaatggagtctcctgtgtgtacttctttctacacagacacagcaacaatctgatttctctatcttttccccacatttcccccttttctattcgacaaaactgccatcgtcatcatggccccttctcaatgagctgttggttacacctcccagacggggtggtggccgggcagaggggctcctcacttcccagaaggggcggccgggcagaggcgccctccacctcccggacggggcagcggccgggcggaggcgcaccccacctccctcccggacggggcggctggccgggtgggggctgccccccacctccctcccgggcgttgtttttttttttctgagacaaattcttgctctgtcgcccagggtggagtgcaatggcacgatcctatcacactccaacctctgcctcctgggttcaagcgattctcctgcctcagcctcctgactagctgggattacaggcacacgtcaccacacctgggtaatttttgtatttttagtagagacagggtttcaccacgtttagcaggctggtcttgaactcctgaccttgtgatctgcctgccacggcctcccaaagtgctgggattaaaggtgtgaaccactgtgcccagccaagggtttcattttgattgcattatcaagagatttggtgcttttaaaaaatggatagtgaccatttaagtgggtgtgaggggattttgtttctcattgtgattttaatgcatttctctacaaattagtaattttgtgtgtcctttcaaatgtttttttatttgtgtttttttatgaaaatttattttaattatttatttctaaataaagttatttaactttattgttccgttttaaaagttgtttatattttttggatattcacacttatcacatgtaatttgtaaatattttcatccattttataggaggcattatttctctattaaatgtttacttaagtatgcagaaattttgaagtgtagtgtagttaaattattctggtttttttctttgttgctcatgcatttaatgttgtatctaagaatttggcaccaagactaatgtcatgtgtttcatatatatatatagagagagagagagagagagagagagagagagagagagatggagtttcgctctgtcacccaggctggagtgtaatggtgtgatcttggctcactgcaacccccacctcccgggttcaagcaattcttctgcctcagcctcctgagtagctgagactacaggcacgtgccgccccgcctggctaatttttgtatttttagtagagacaggttttcaccatcttgttcaggctggtctggtcttgaactcctcaccttgtgatccacctatctcagcctcccaaagtgctgggattacaggcatgagccacagtgccctgcctcccctctatgtgtttaagagattaaaaatttatgcggctgggcctcgtcgcccagcgctttgggaggctgaggtgggtggatcacgaggtcaagatttcgagaccagcctggccaacatggtgaaaccctgtctctactaaaaatacataaattagccagacgctgtgcccggtgcctgtaatcccagctactcgggtggctgaggcagggtaatcgcttgaacccgggaggcagaggttgcagtgagccgagactgcgccactgcactccagcctgggtaacagtgagactccatctcaaaaaacaacaataacaaaacagcaacaacaacaaagttaccttcttatgtctaattaaaagattttcacatatggtttaaggaaataatctttattttatcagaatggatattcagtttctaacagaattttttgaaaaggttatcttccattgtgtgctcatgtcaattttgtgggagattatttggccatatacagaagggttcatttctggcctctctactctgttctttcatctgtttatctgtgtgagtacctcattgtttttgttattgttgcttttagtacgtttcaaaatcagaagttataatgcctttgttttttttccatgggtgtttggctatagttcgtaacaaaattttaacatctcaaacagtatttctttaaaaaactactgttgggatttttataaagattctattgaatttgtgtaccactgttggttgtattgacatctttgaaaaattaatttttttattcttgtgcaaaaatatgttgaagagttttttattttcatgtatttttggatttttcagttttaatctccagtttaattgagttttggtcagaaaacacaaagtggataatattgatattcttaaatttatttgttgtttttttgtgtttgttgtttttgtttgaagacaggatcttactctgtcacccaggctggagtgtattggcataatcttgactcactgcagcctcaacctactgggctcaagttatctttccacctaagtctctcaagtagttgggactacaaacaaagtaccatgtctgaataattatttgattattttgtagggatagggtctcactatgttgcccaggctggcctgaaacttttagctgtaagtgatcctcacaccttggtctctctatgtgttgggattataggcatgagctacaccacccacctggcattcttaaatttaataaaacttagtatgtgtcgtaacagaatacaccaggtgcaaataaaaatattgcgtattcccttgcttttgactgaaaagttttgtacatgtctgttaaacctagttggtctataatatggtattgatgttgatgttactcaaaccttatgctgcaatgtaattcttgatgttagatgtcggacctggtaggaggtgtttgggtcatggggcagagtccttatgaatagtttggcaccatcctcttggtaatcaaaatgtgtgcactttattaattcaaatgaaagctggtttgttagaagaacctggctccttcacctcgtacttgctctgtctgttatcttgtggtgtgtacagttaatcttcgccttcaaccgtgattgtaagcttgctgacactctcaccagaagcagatgctggcacagactttttatacagtctgctgaattgtgagccaaataaacttggttttttaataaattatccattctcaggtattcctctatatgcagaatgataaatcagtgtataatgttgtctaggttttctgttttcttattcatttttatatgaatcttctatttatcgaaaatgggattttggtgtctacaattaccatttttattctgttttaaatattctatagaagatctttaaggattttaagcatcatcattatgatagtaaagacttctggtcagccccccgccaggccagccgccccgtctgggagggaggtatgggggtcagccccccgcccggccagccgccccatctgggagggaggtgggggggtcagcccccgccgggccagccaccccatccgggaggtgaggggcgcctctgcccggctgcccctactgggaagcgaggagcccctctgcccggccaccaccccgtctgggaggtgtacccaacggctcattgagaacgggccatgatgacagtggtggttttgtggaatagaggagggggaaaggtggggaaaagattgagaaattggatggttgctgtgtctgtgtagaaagaagtagacatgggagacttttcactttgttctgtactaagaaaaattcttctgccttgggatgctgttgatctatgaccttacccccaaccctgtgctctctgaaacatgtgctgtgtccactcagggttaaatggattaagggcggtgcaagatgtgctttgttaaacagatgcttgaaggcagcatgctcgttaagagtcatcactactccctaatctcaagtacccagggacacaaacactgcggaaggccgcagggtcctctgcctaggaaaaccagagacctttgttcacttgtttatctgctgaccttcccttcactattgtcctatgaccctgccaaatccctctctgcgagaaacacccaagaatgatcaattaaaaaaaaaaaaaagacttctatatttgtctgtgtatttacatttaatagagagctttattttatatatggttttatgatactgtccagtatttttttaaaacaaaactgactcattttactgactcatttcagcatttcttattgttatttacagagtctcacattactcaggctgatctgaaactcctggtttctagtgttctgacaggcttgcctcctaaaactgtaggattacaggcatcagcccacggtgcctggacaccatgtagcatttttttttttttgtagaactgtgctagtggtgatgaacacgctcactttttattttggaaattttttattttcatcttctttttaaagtgaaataaatttaaatcaagtattcttagttagaattttttttcttttattacatcaaaatttgggaatttctcacctttttttattttcaagtaatctctgtattattttttcccatattcttcttctaagattttttaatgaatatgttaatctagttgatggtgcctaataaagtttacattccatgttttaatttggttttgcaattgtatatttttgtgttatatattttagggtatgccactacacatctgttaattgtgctttgatattttagtataatgtgcatgtcaatatttaactttatgcaatttaagacagtctggagcaacatcaaatatgattgagccatatgtctttttccaatagaattatctctatgtttgtttgcctgtataaatattatcgttgtattttttataacttgtatatttgttgtgtgggtttgttgtgagtgattttctaattctgtgtagctgagtagtcataaaattcttataatttcaacatcctatttatttctgaatctatatttttttatgggagaaacacttttaaatgtgaatataatttaaaactatcataactctgtacttttagttattattatttttacttgtcaaaaaaaaacaaaatttaccagaaaataaatatttaatttagtcatattaatcatcttgaaattttcatgcaacatattgctaaaatgtttttaccttgcaagctaaatcttaatacatattaaacaactaccattttttttttcttgagatggaattttgctcttgttgcccaggctggagtgcaatggcgcgatctcggctcaccacaaccactgcctccgggttcaagtgattctcctgcctcagtctttgagtagctgggattacaggcatgtgccaccacgcacagctaattttgtatttttagtagagaggggttttctccatgttggtcaggctgatctcgaactcctgacctcataatctgcctcagcctcccaagtagctgggattacaggcatgtgtcaccacacctggctaatttttgtagttttagtagagacggggtttcaccatgttggccaggctggccttgaactcctgaccttaggtgatctgtcctccttggcctcccaaagtgcctaaaatacaggtgtgagccaccatgcctggcctggcctggcacatcacttttattttgcagcttcaaagattttttttttgtctgtgacttttgaaattgtgcttatatatgtgtttgttataaatatctttctgtgatcctagtttgttgagcttctttatttttacatcattttttcttacttttaggatctatcagtttttatatttttacctccacaatttctgcttttttgaaatcttaaatatttttgttctcatcctcatttttccgattttccatagttgtctctgttcctattttaatcagtgagtattattcattaccaattcataaaattaatgtatacatctcttttatggtttctttcagaaaattttataatattttggtggcatcatattgccctattttgtatacattataatctttgattgagatttggacatttaaaaaagctaactgtcaaagtctttataatgtagttttgtcctggcatagtttgaaaacaactgtcttgtctaatgattatgggaatttctcaaatatgttcttaggatatgtgttgtctgaaattttgtgtttatgtcttaattaagagtgtttacttatgttactttgtaggagtcagtaatcacttgctatgcctgtttcctttctgtggtactgcagtctctctgctgctgtaacatttttctttggtctcagcagactcaaactttcattccaaattatgccacggtttctttcaacacttatgtcatgagagagggaaatcagtgtcaggaaaagcccctaaaagctgtaaataaaaatgaatgggctactattttacctttcttttaaaacataaaccaggagttggcaatttacttctaaaggcactctgttataatgggaagcaggaaaagctgtgtcaagtaaatttaacagacttttcttttttttctgtgtggttttttgcattgtgctcccctgagacactgcacacacttaactcattcataaattttccatagatgtaatttgatctgtatgtttttgttacatatatatgtctatgaaagaattagggcctgtgcagggtaatggcgtgaacccaggaggcagggcttgctgtgagccaagattgcaccactgcactccagcctgggtgacagagcgagactccgtctcaaaaacaaacaaacaaaaaaacaaaaatagaattagggcctgtggtattttgcagtgccatattgtttatgtagtttgtataattttgtaggtaagatttttaaactatattcatgtgagtctaggtgagtggagtaatttattatttttagtttttttttttcaggtatatgtcctcattttcctcaagacttttggccagagcagagcatggaagattcttttcaaaaagtattactgagaaaatatgaaaaatgtggacatgagaatttacagttaagaaaaggttgtaaaagtgtggatgagtgtaaggtgcacaaagaaggttataataaacttaaccagtgtctcacaactgcccagagcaaagtatttcaatgtgggaaatatttgaaagtcttctataaatttttaaattcaaacagacatacgataagacatactggaaagaaatgcttcaaatgtaaaaaatgtgtcaagtcattttgcatccgtttacacaaaacccaacataaatgcgtttatattacagagaagtcctgtaaatgtaaagaatgtgaaaaaacctttcattggtcctcaacccttactaatcataaggaaattcatactgaagataaaccctacaaatgtgaagaatgtggcaaagcttttaagcagctctcaacccttactacacataaaataatttgtgctaaagagaaaatctacaagtgtgaagaatgtggcaaagcatttctatggtcctcaaccctaactagacataagaggatacacactggagagaaaccctacaaatgtgaagaatgtggcaaagcttttagccattcttcaacccttgctaaacataagagaattcatactggagagaaaccctacaaatgtgaagaatgtggcaaagcttttagccgttcttcaacccttgctaaacataagagaattcatactggagagaaaccctacaaatgtaaagaatgtggcaaagcttttagcaattcctcaacccttgctaatcataagataactcatactgaagagaaaccctacaaatgtaaagaatgtgacaaaacttttaagcgactctcaacccttactaaacataaaataatacatgctggagagaaactctacaaatgtgaagaatgtggcaaagcttttaatcgatcttcaaatcttactatacataagtttattcatactggagagaaaccttacaagtgtgaagaatgtggcaaagcatttaactggtcctcaagccttactaaacataaaagaattcatactagagagaaacccttcaaatgtaaagaatgtggcaaagcatttatatggtcttcaaccctaactagacataagaggatacacactggagagaagccctacaaatgtgaagaatgtggcaaagcttttagccgttcctcaacccttactaagcataagacaattcatactggagagaaaccctacaaatgtaaagaatgtggcaaagcttttaagcactcctcagcccttgctaaacataaaataatacatgctggagagaaactctacaaatgtgaggaatgtggcaaagcttttaatcaatcttcaaatcttacgacacataagataattcatactaaagagaaaccttccaagagtgaagaatgtgacaaagcatttatctggtcctcaacccttactgaacataagagaattcataccagagagaaaacctacaaatgtgaagaatgtggcaaagcatttagccagccttcacaccttactacacataagaggatgcacactggagagaaaccctacaaatgtgaagaatgtggcaaagcttttagccaatcctcaacccttactacacataagataattcatactggagagaaaccctacaaatgtgaagaatgtggcaaagcttttaggaaatcttcaactcttactgaacataagataattcatactggagagaaaccctacaaatgtgaagaatgtggcaaagcatttagccaatcctcaaccctaactagacatacgaggatgcacactggagagaaaccatacaaatgtgaagaatgtggcaaagcttttaatcgatcctcaaagcttactacacataagataattcatactggagagaaaccttacaagtgtgaagaatgtggcaaagcatttatatcatcctcaaccctaaatggacataagagaattcatactagagagaaaccctacaaatgtgaagaatgtggcaaagcatttagccaatcttcaaccctaactagacataagaggttgcacaccggagagaaaccctacaaatgtggagaatgtggcaaagcctttaaagagtcctcagctcttactaaacataagataattcacactggagagaaaccctacaaatgtgaaaaatgtggcaaagcctttaaccagtcttcaatccttactaaccataagaaaattcatactatcacacctgtaatcccacactttgggaggccgaggcgggcggatcacgaggtcaggagatggagaccatcctggctaacacagtgaaaccccttctctactaaaaaatacaaaaaattagccgggcgtggtggcgggcgcctgtagtcccagctatgcgagaggctgaggcaggagaatggcgtgaacccgggaggcggagcttgcagtgagccgagatcacgccactgcactcaagcctgggcgacagagcgagactccgtctcaaaaaaaaaaaaagaaaattcatactagagagaaaccctacaaatataaagaatgtggcaaatcttttaaccggtcttcaacctttactaaacataaggtaattcatactggagtaaaactctacaaatgtgaagaatgtggcaaatcctttttctggtcctcagccctaaccagacataagaaaattcatactggacagcaaccctacaaacaggaaaaatttggcaaagcctttaaccagttttcacaccttactacagataagataactcatattggagagaaatcttacaagtgtgaataatgtggtaaagtctataaaaagtcctgaattcttaacagacataatattattcatactggagagaaactttacaaacctgaaagatgtgccaacgcttttgacaagtcaaacttttctaaacatcaagaaaatcatgctgctgagaaatcctagaaatgtgaagaatgtgacaaagcctctaaatgattgtcacacttgatcgtaggtaagataattcatactggagaaaactaccagtgtgaacaatgtggccaagctttgaaccaatgctcacaccttaatgcataggaaagcatttatgcttgagaaaaagtgaacaaatatagacaaaaagccattaatacctgctcacatcgtactcaaaatcagagcgttcatactaaataagaagtgtaattactgtcaaacgactgatcagaaaatatgtctttaaagtacagaagagtattttgaaaaagcattacaaatatgaagaggcattatttatgaccttttctatggaaaggtaaggacattaaaaatgtaagatgcatgatgaaaatttaagtagagaggatctttatggttaacttataatatcgagtgatgcatgaggtagatgttcagattaatattctgcattattatgaaagaaaaacattcttaattttagttaaagtttagtatgatttattgtatttttatgaaatatatgtagcatatttttaaattataaattgcatgtgaacttttcaactaaacagttttaacatgttaaatactatcatgaattcaatgaagtgttattatgccagtaactttaacctattccaccttactcaagggtgtaggtaaaagatggtaaaaatacactatttggtaagataatggactgacatctctagtgattttttttgccagtgagttttaattgccattaagttaaagaatattgttcccataggctaaatttttatttttattttctcatttaaatgtatttgacttaatttttgtggatacctaatatgtgtacatattatgccatatgtggcatattttgatacggacacacaatatataacaatcgcattagactaaatgcggtctccattacctctagcatttattctttgtattacaaataattcaattctacagttttagttatttttaaatgtacaattaaattgttgttgactacaggattatttttatggtcataataaaacttatatacaaacataagtaaaatccatatatttctgagtcccgaataaatcttttttaattttttcatatatttttcttcgaacatgtggcctctgcctgcaagcacatatggactgttagtattgatttacatagagttaaatatacacatctgttagtctaagatgaatcttaggtgtaaataaattatggagtgtgtttaagtttgaaactatttttagcagaaaaaagcaatattggaacaaaatcattttaaggaggtgtctaatttactacaaaacaaaaattctcaaaaatgctgaaagcaaatttatactctgctttgtattgaatttcttgctgtacaatcttttggcttatggttcagagtctccccatgcaaattctgttttaacttgactggtactcatgctagacccataattttttgttgttgttgtttaataggttttttgtttgcttaattgtttgttgttgttgttgttgttgtt

SEQ ID NO: 15947 - DNA, 149543 bp, Human
ggaataatgcttgaaacatagtatgtgataaatgttagctaaggtcatggtggagtgctgtaggagtgtagaaagggaaataattagtcaaggctgagttggtgggaagactgtggaggagtagggatttattggggggcaatgcaaggatgggtaggagaagaatgaaggaaaaggaattttaggttggggaaagcattgtaactagtcttagatcagtaaagccataacatctatgtgatttacttactaaacaaaactattcctgttagggagtagtgggacatagcaaaggaggataaataactgatatttattataatgaaagaagttctgagatggggcaccagagcattttggttgtgatttttatcctggccctgtgactcagggcaagttgtctgatgtcttaggaccccacctttcctcatctaaaatcaaatggactaaatttgtaaaatccttacagctctgaattccttagataattcctacatggaaatgatttctctgaccccactgtctgtaggatggtggtggtttttgcgcagcgtgaagccaactggtctatgtggggcaaacttgtggttatggcctctttagccccctgctgtgagtgagcaagctgaccggccctcatacagacactacacactgtcttgcaacacttagcaatcaccactgctccagagatctggaatctcagcaggtggatttgtggaaggagctcttgggtatctcattcccaacttatttagagttaactctactactgttctcttgaggagcctcaaggtttagttgccttgaagtggaccttgagggctaagcaaaaggggaaagaacaatctttagtcttaaaaaaaaaattcctggattgttcttatggtgttcacaaaactaaagagaaaaaagcagtaccatgagcacccaatgaactgccagcaaagccctaagcctttcacagtaaacttacctgctcaggtcattttgtgcttgaaactgaatactgctgcttttgaaaccagggattgattcctccattttactgcatgtgtttaaataatccaggactcttataaacataaatggaaaatgagcttttcaaataccatgcttagaaatcattggctctcataagacattacttcagttttctttttagaagggaatttttgtttgcaactgttctcacgtctccgtccttcctggtttgagcccctctcaggagtcgcacgcaggcccttctgctgctgctctgcctgcagtgctgcagtgctgttgcatcagaggaagttctctaggattccactcccatttgctttttctagttgctaagcaggtggcacttagaacagtatctgccctctgagcttgatggttgaagaagatacttttggacttttatgctggatggattttacacaacttgatgattgaaaaataacttgaaatggaagaactaaagcagatggaagcgattttatctatattttgtgtctccaaagtttgaagggtttattttgttttcagaaactgaaatttgagaagaatgacaatttatcctcatcttgcccttgaaaggaagagtttttctttggggagtggagctttaggaaaggaaggtgacttgaactgtaaggacttcacagctaatatatgcccctgggtaatgttacatagtccttatttgtttagaatagaagttccttgagggagtagaatatatcctttttgtcatatgtggttcctaatagtgagttgcatctgagtgaatataataaataactagcaattcaggagactcctgatctttgatctcccttggcagatcagtccatgccacagatttcctgaaaagaaaaataagcatgtcatggaagaaactatgtgttttttttgcaaaggttgtgaattaaggttgagagtgagatggtttagtctggcctctttttagagcagtgattgattaatgctgtctgtgttgctgtttcttccagagctgacctgtcctggacgcagcataactaacgaagctgctgcaggatgagaagatggcagcgcggctgcttgcaccaccaggccctgatagtttcaagcctttcacccctgagtcactggcaaacattgagaggcgcattgctgagagcaagctcaagaaaccaccaaaggccgatggcagtcatcgggaggacgatgaggacagcaagcccaagccaaacagcgacctggaagcagggaagagtttgcctttcatctacggggacatcccccaaggcctggttgcagttcccctggaggactttgacccatactatttgacgcagaaagtgagttggaggaggaggagcagctgcagatacctgtttcctaacaggcttagggagatgggggagaaagaactgtgtctctttgccaaagtttggataagtagttaaccttttgtttcagttctggcttgtggggattatttttcattttaattgctactaagggtcatttgtggtcttggcactcatcaactctattaataagacttctgattttggctccaggccagatcagaaaaaggggatgtaaatgaaatgggactatttaaaagagtctttaaaagatgggatagtaaaagatagtacagcctccctctctcaaacacacattcaaaattctatctttaatataaagatgttgttactattgtgacatcagtagagtagtgtggtggagatggtgtatttgctctcttgtctagctccctttgtgacattagagcatagctgctggggacaggaataaaactgagtaaagcaaacagccaatgaggacagacccaggtcattggccctgttacacagttgtctggattgattcttccagcactgattcttgcagtagagtcaattctgttattcatgcaagtagggagctcaagtgaaagaactactaatcttcatttggccaagagtttcaaacttcctgaacaaatatttgactaaatcttcagctactttctcatgattatcttctgaaacaaggcaccaagtagagaaacaaagcctcctgggtgatccaccagctaaataattgaatcttgaggactggcatcagacaccgttttagggaacccctcatttgacagattttttttttttttttttttttttgagatggagtcttgctctgtcgcccaggctggagtgcagtggcgtgatctcagctcactgcaacctccgcctcctggtttcaagcaattctcctgcctcactctcctgcgtagctgggactacaggctcagagcagctacgtaatagaaaaaagtggaaccattagtctgttctttcactgggaaatctagaaagtttaatgaacaaaatgatatgatgtaaagaacggtagattggaagtaagaaatcctgattctaccataatttaccatgtttattatttactttttttttttttgagacagagtctcgcactgttgcccagacaggagtgcagtggtgcggtctcagctcactgcgacctctgcttcctgggttcaagcgattctgctgcctcagcctcctgagtagctgggactacaggcgcccaccaccacactcagctaatttttgtatttttagtagagatgggatttcaccatgttggccaagctggtctcaaactcctgacctcaagtgattcacccgcctcagccttccaaaatgctgggattacaggtgtgagccatcgcacctggccttattatttacatttttattttttagtaaatgtattgtccaagctaccacagataatttatggggaaataaatgaagaaaaaaaccttctcaaaactagtttgtaattttcggcaagacacttcatctctctggacctaaactattttttccaactcaaatgcaaattaatttctcattttctttttgttttatagtttttattttttatttttcctttaacttgtattttaagttcaggggtacatgtgcaggatgtgcaggtttgttacataggtaaatgtgggccatggtgatttgctgcacagatcatcccatcacctaggtattaagcccggcatctattaactattcttcctgatgctctccctccccccattccctacctctgacaggccccgatgtgtgttgatccctcccatgtgtccatgtgttctcatgattcagctcccacttataagtaagaatgtgtggtgtttggttttctgttcctgtgttagtttgctgaggataatggcttccagcaccatccatgtccctgcaaaggacatgatctcgtttctaatttctcattttcttaaacctgacaggagatatgaaaaaatatatagagctaatagttgttagagcccaattttcctttgcatactctttttccctggttcctgctctatagacagcctctttccattcccaatgcctcagatttcagtggcctggcttgagagtggggacttaccaaagagagtgggtctctggacctgatgggtgtcattcattggataggccaaattgttcttgatggtgctccattagaagactgattcttcatggtagaaattctgacttcagccttcggcttcatcacaagggtaaattgttcctggaaaggataactttaataattttttttggtaatcttgaaaaaatatataccaccatacagaaaagctcataaagtataaatacatagcataatgattacaaactaacagcatgtcaagaaagaacattgctagcactttagatatgttcattgtacttttaaatgaaggatattttacttgattaaaaataatattcttgctcaagttaacttgcaaatctttaccagcagtgctgatacttctataggggtggaaaaagtccacctccattctcctagggtgccagctgggtcttagaattaaattgacataacatagattaacaggagaaaagcataatacatgctttatgtagcacaggaaccctcatgaagaaatgaagaccgtaggctgggcgcaatggttcacgcctgtaatcccagcactttgggaggccgaggtgggtggatcacaaggtcaggagtttgagaccagcctgaccaacatggtgaaaccccatctctattaaaaatacaaaaattagctgggtatggtggcacgggcctgtaatcccagctactcaggaggctgagtcaggagaatcacttgaacccgggaggtggaggttgcagtcagccaagattgtgctactgcactccagcctgggtgacagagtgagagtctgtctcaaaaaagaaaaaaagaaagaaatgaagacctaaagaagcagagtcagttatttatatactggattggacaaaaaagtagtaaattgtgaagaagcaactaaattatgtgggcaggcttaaaagataagacttatttaacaaggtcagtacagtattctcttggtctcaccttctcgcccttgaagataagcatgttgcctttccttcaggttcagggagtgtcttccacacaggaatttcatcttccactcttaagaaacaacaagaagatcagagtgatttttttgcacccgctgttatacaaatgtctttaacttagtcaatatgccagaatagcgtatcttaaccccttcacttcttgctaactaggccttgtactaaattagcaagatctcttctacaaggaagcacactgggaattaacccacaaatcaaaaagtcataagggtagaaatgactttaagaggacattcctttctgtttgttcttcaagggctgccttaaataattcttcgcaaaatagaatctcttttctttgctaaatgataccagtggaatcctttatcttttcctcataggtctcattttctaactgatgaattgtctttgtgactctcacaaaaacttgtttcttatttccttccctctttctcctagtgggtaagagagaactcgttttctattagtgaagttctggttttagctcggatttcacactcccaagggacacagggccctaaaagttgtgcaccacgttttcgagatactgttatttattccagctggtactggtttggctatcataagtatctgaggtccttgttgggtttcacactgactttttcagctggtccctgcaaacaatctgaatcatcctctctttgaattgcctcagacttctcagggctactttacattttctttgtctcttggtacttcgttctaatacctcctttctttggctttcttgtttttcagctgtttgctacaaataattgtttaaggaacatttaaatttttaaattcagtttttaaaataggtaatatatttaagtggttaaaaattcaaaggtacttggtaaataagtttcctttttacacctgtctctcatctgtctatttcctatctccctgcacaggcaaccactgatagtagtatcttccagagtttctttatgtgtatgcaagcaaaaacaaatatgtgttttatggaacttgaactccattaaaagcctttgttcttgtttttttcctgttgttttcttaaacctattgaagtcttaattttgttttttgtttttacttactattatttttttttttggagacagagtctaactccaagttggagtgcagtgatgcaatcataggtcactgcagcctcaacctcctgggcaacctccatctctgtctcccaagtagctaggatcatacgcatgcgccaccacatctggctaatttttgtatttctcccacttttaaaagtttttcttgtttagtgaaaaattaaggactttttctctgttgcacaaagtgcctgtcttcactaaaaaaatgctctccaatgcttaataatttgttgaatacaaaatggccatatatactcctaatgactatcttaagtaggcagccaggaaatctgtaggttaagctgaaacaaggccttcagaattgactcctatccctttttaatttcttagaactgacagttgatatatgtgtcttttttgtttaatgggtataccgtgttacaatcatataaacaaaaatttaaattacaagattgatcaatgtgtttttaaatagggcacactcctattgcattaaaaaaattatatatggccgggcgtggtggttcacgcctgtaatcccagcactttgggaggctgagtcaggcagatcacttgaggtcgggagtttgagaccagcctgaccaacatggagaaaccctgtctctactaaaaatacaaaattagccaggtgtggtggtgcatgcctatagtcccagctactcaggaggctgaggcaggagaatcgcttgaacccgggaggtggaggttgtggtgagccgagatcacgccatcgcactccagcctgggcaacaagagtgaaactccatctcaaaaaaaaaaaaaaaattatatatagcttcctaaagttcagtttaccttcaacttttcaggtgtacctttttctgcaaagagatatctgcttattagaataatagaaaattataatttggtagccttagacatcatctagttcatcctcctcattttataaattttatgaggtgaagtactttgtcaaaagcccacaccactgttggtggtataaccaggactagagctcatgcctcctgaccctccatttattacaacatatttctagttccccacttttctaattttttattaattgattctcagcctcaattggctcagttctgctgaagctgggcagggaaatagaagaaaaataagctccattttcatttattccttaaaaatccctgtggtttttaggacaggtcctaaaaagtgcagtggtaagagcagtgcttctgggggaaaggattcatgttagccccctgtattgtatcttctcaagtcaaggagctctgaggtgtgctattccagggacttgggcttattatcaataccgccagttattcaactggacatgtgatcttgaggcaatttgtttaacctttctaccacttgttactttttaaaggaagagtatttcctatctgccatagtccatccctaacctatggtaggatagtatacaatcatgtgtcacttaacgatggggatacgttctgagaaatgagttattaggccatttcatccttgtttgaatgtcacagagtgtacttacacaaatctagacgatgtagcctactgcacccctaggctatatggtatagcctattgctcccaggctacacacctgtacagcatgttaccatattgaatgctgtagacatttgtaacaccatggtatttctgtatctaaacatagctaaacatagaaaaggtaatgcattgtgctatagctacaactttatgacagatacaaggtcactgggcaataagaatttttcagcctcataatcatcttatggaactaccatcccaaatattgttgaccaaaacattgttatgtggtgtctgactatagtggaaagagtgcctaactgggaatataaaaccttgttttagttccggctttgcttcatgtttgtacttggccaaatcactttaatttccttacctacaatatttgcaaaatagagttagacccatatctgtatctttctaattgtatttcacacttttgcctgtcacatattgtattttagctgtggcgaactacttcctgtttccttagtgtggaagatccctccacccacccaccttcttctggtctccctctcttcctgttggaatgtactctgtcttttagttttaccttttgatattctacccacacaggcccagcccagaggcctctttttccttgtagcctaacttaattatcttacacttggagaactgattactccttttaaatttttaaaacacattaggatcttcagtcctacattggataagaagttggtttcaggtttaactcaggttagatgtggagggtacctgtgttcccaataatgtttgcaattttctccttatttcactaatattagtgccatcagcttaagtgatacatacacacgcagccctatatgagctcctggcagaaaatccttgccaaaactgtgctgacacactttcaacaggtgtgcagcacagagaccattacggaaggatttatgttcattaggtgtgatttgaagtattgctaataagttgtatttcctgcttttgcacaataagcctaaatgctgctttctgttttaaataaaaactacatattttaaaactttggtttattttgttgttaaaaattttttcccaacaatataaggaaacaaaatgatgtttcagttattttatttaccaaatcaaattgagataaatgctttgagacactgggaggtgggcccttctcaaggggatgggtcattgatgggcacgtatggtcttgtcccctctctaagtatggctacctagaggagaaggaatttaattaagcattcctaaatcagatttctcttttgtagccttggcaatagaccaaaagttgggaaatcttatttctgatcccatccctgtgtaattccaggtgatcttgggcatgctatttaaccatttaaggtctcaattcctccaatctagaaaattaagattatgctaacagctaacatgtcacttattacaggttgcagtatagaccatttctgtaagaaaaatccaggtcatctaatttgattggaatgtggggaagtgactgaggaacagtggaagatgaggctggggagggtgagctggagcaaatcctggagggcttagaatgttagactcagaggtgtggtgtttgtttgagaagcagtagagaactactgaaggttctggaatgggagtaaggatacgtgatgatagctgtgcttagagaggtgaatgggacgacaatatgtaagctgggccagaaggaaagagaactgaaacaggcagatcagctatgaaataatgaaggtctgagttacagtggtgggagtggaaattaaggggattggatgaattcaatatgatttatgatagattatggagggttaaggaaggaatcgagcatgcaattattcatttgacaatttgataaattgttactgagtgttttctatatgccggggctctgttccgtgcccttgggaacaaaacagacaagccatatacattgttggaacttagtttttttgttagggaaacacataacaaacaaatacggaaataaaattattactgataatgatacgtgcattaatgaagataacatgttccagctactttagaggcttatggtgctctaatttggtacagagactaaacttggagaatccagaagaatcaaagattatatggtctctcaaatattcagtatcttaaataggacttcagcaagtactaaattataatctttaaaagagccaattttgagagcatttgcccctcttggatttttacacagacagaaataaaatatacttgagcatcagtgtgagctattggggtgcttacaaagaaacccagcattttctccaggtttaactcgggttagatatggagggtacctgtgttcccaataatgtttgcaattttctccagtcctaagttctcatgcaggtactaagctgtgattccatagttctgagccacatagggtatagacatagacagcttttacctgaattctaggatgtgtgttattagccagtcacctcagccataaaattccactgattggtaattttaggaattagtttctgttggtttctccagggtgtgatttgtgcaatcttatcataacaaaaatttacctgtggaatgggactgtttaataatggccatttaaatgttaaagaatgtttcaagattatgataatatcgatcatctctgacaataattaaacatattttaagtgctttcttagttaaggagagaaaactgtgttattattttacagagggatgcttctcttttgaattgtttccaaattgacaaatgagttgtaaatgtttctttacatataacactatttgacacaacttaagatcaggattgtcccatcatatgacaatttctgctaactctgattttaccagaagaatttttgatacaagctctgaagatgcatttctattccagacactgttgagcctgcaaagtttggcctatggaaccaagttggaataaaagattctgctgatttcagagaatagggtgccccatctactgttcaagaccaatccctcacccctgtctttgaccctgtgcctttctacctcctctggaatttcactcctttggttaccctttctcttttctgtattttccgtctttcctctcatataggttcctttcccatagtctgtaaacacactcaaagcctctcccatcctaatgaatcctcacttgacctcctgtccccaggtagtctaattgcttcccatgccactgaaaattgtaaagaggagggtttactcaccacatacacatatctacccactcctccatccttgaagcctgactgcatcctcacccctttcatgatattataagatcttcccaataacatctcaaatggccaagtctaagattttttttaagttcttaactcactaaacctctctgcagtgtttgacaccatttattattccctgactcttatatctctttacttccttggcctaattttctttttatctcaaatgtttccttctctttcatgttctcaacctttccctaaaatgtttatattcccccagattcagttcttggcccatgttcctctcagttggcacattctccctggatgatctcatccagcctcagttcgaggactcctgactctagcctagcctagaatgttccttaaatattcaacaccttgccagtcatctgtttctggattttcccacaggttactcagtatattcagaattgaactcattttcttcccctcaaacctgcttatcttcttttatctactttcctagttgatggcaccagcaaaattctagatatcatttttgactccccaattttcttcagtccctgaggattgccagtactagggatatctcagtataatgatgcacgctttcacaagtatgaaacagttgtggctccagaaacattaacttgcttcctcaagttccctcaactaatatgtggtagagtcaggtttctgttccagggatctgtgaatttcaccttcatggtctttcttccatgccctgctgtctatatagagcatattgcaggatgatttttttggttttgtttcctatcatttttagagaattttctatcattttgcattgcctcaatatgaagttagtatagtcagccctccatacccatgggttccacatttaagaatttggggaaattatttggggaaaaaagcacatctgtactgaacatgtacagacatttttttcttgtaattattcccaaacaatatagtataactatttataaagcatttacattgtattaagtattataagtaatctagagatgatttaaaatttactgatgtgcataggttatgtgcaaatacaatatcatcttatgtcagggattgagcatctgtggattttggtatccctgggagtcctggagccaattccccgtggatactgaggaacaactgtatgttgttgtgtttagttcatttgttttataccataccttcagcatggtatctgagacatagaaaaggagagaagacttttcaaactaaaattagtgaatttttatgggtagatgagctaaggggtagaaaagtgaccgtatagcttcaactgggcacccagaagaaagttggatatagttaaaggttaggtgattttagctatagtatttctttatgaaagaagagattcatacattcaacaaacatgtatgaactgtctaccttgtgccagataggcatcacattatgtactgtgcttgctaagctgagaaaatcatagtagatggaagataaacccctccccttcacggatctcagggtccagtgagagatactggtatgtaaacctcaataacaatattctgtgttaactgctctaatagaagtaagtacaagtgttatagggacacacaggagggaaggacaattctattgaagagagttgaatggggctgtcttcatagaggatgtgatctttgacctggacctttaaatattaaagtatggttaaaaaaaaattcacctgtcagagaagagatgagagagtagttcaggtgtgaggaacagtgcatataaaggccgagagacatgacacaggtttaattgtttaaaatagtgagtgtagctgtaactgaagcatagagtgtggtttggtaagacaggagataaagcctagaggcaggttggagccaatgagtgcatcctaaggggttttgttttctctcacttccagagttcccaggttggaaataacctttgggacccgttttgagctagtgcagccttgctctggattcttgctctaacttgtgcacaagtgtccttcctgcaggcttgtgccaagtatgtggatccaaattaacagaaatattagccccttcttgtcatcttcttttttttttgagagagagagtcttgttctgtcacccaggctggagtgcagtggcacagtctcggctcactgcaacctccgcctcccgggttcaaatgattctcctgcctcagcctccctagtagctgggattacaggtgcacgccaccacgcctggctaatttttttgtatttttagtagagacggggttttgccatgttgaccaggctggtcttgagctcctgacctcaggtaatccacccgcctcggcctcccaaaatgatgggaatacaggcgtgagccactgcacctggccagccccttcttgtcttctaatggccactccgtgtttggagccaaagagctgaaggaatggcagtactgtgtgatagcagtggcagcatcataaccacatttaacgagtgcctgttctgtaccagccactgtgttaaggactccttgtgacccttcatttaatctttataacaacctgataaaattggaatagtgattgatggcacccactttatcaataagaaaactgagccttagcaaccttaacataagttgcctaagatcatgacagctaatgagtgacagagctgggtattgaatccaggtctttctggcctcaaagcctgtaaaccactctgctttgctgctttctaagagagaggagagtgagaatagattctagaatatgaattcagtaaatagaggggttaatatgctttacataataagcctgcattttgctcttgcttagagcaactgtagtctgtgcactttaagaggttaaagtagaaggtgatcaaagtcaaatttatatcgaaggacaacaaggaagaatggccatggaggagggtcagacctgccctgccctgggaagcagcattgtgctggctcagcattgaagcaggtgcacagtgctgctgctctgcccggtatggcttcctgtgaccagaacgtgagcaggaagggtggcagctactccaaatgtaggttggagagcatggggttacaaggtcaaagcaaatgaagaagtgtatgcagaagcacctggaaaactgtaaagccacaggcagatgtggtgctagcattatcttcatcaaactgaacttggagaaaagaccataaacagcacatgtagggggttccgttttgcaacagttaaagttattaagtagaggagattcgttcattgatctgagggttggaccagatgacctggtgcagtaaaaagagtttagaactagaagccgggagatctagtccctggcaactcccccgccccgctcctgctcactagtgctgtgaccttagtttgggcagagcattctgtgcttggtttcttgtttgtgaaacgaatagttagatttgagtaatagttttgaagctttttaaaattgtagtatgccttgataattaagagtataggctttgtagttagattgcctcagttcaatgctaaatttcaccacataatagctgtgttgtcttgggcaagttacttaacctcctgcctcaattttatcatctgtaaaatagtacctacctcatagagtagttgtgagacaattattatattaagtatcttagtagggtgcctgcctgccacatagtaaatgcttaataaatattgaattttattatttcttcaaatagactcataggtaaaattatcggttactaagaaggaatttttaaaatacgggatttagtggtctcttttgctccattctcagtatcgtgtaatagaggcgtggaaaatgatggttctaaataatcacacagctcaaatagaagtacacgcctagggaagaattttgctggtgtctttatgtcctgctttggtttagtatttctaaggggagctggatagtaccaggacacgggtactctggaaatgcattccagttatgcctttgctggagactttcctgggacacactggggctatataatataacctatattgtaattttacttgaggaattcactaggcagattagcataaatcaggattcttttcaacatggcatagtcatttttacataacaggtcatttgtttctgaacagcttcctagcctgatatagaatctgtttagattctgcattatattttccgttattaaaccagggaaattttgaaaagacacttatttgttgcttgctatattggctgtatgcatactcagaaatgaatgccaaattgctgttgattaatgaacaactggccagttgcctagttcagaaagaggtgcataggcctgggggaataaagtacatatattttgtttaggcaggcaagaatttaaggccagagaagttggctaaaaatgagaggaccagttagttctagaaatcaaaacagttaagatctagggacagtcataagtcattgccagtaatagttatagtcagatagactcaaaggttcccagctgccctcttgttgattagctaaacctctgagcccctaggtgttcattatagccagaagctcatcagatgcctgcagattacctttgccctagttgagatgttgacctctcaggatggggagaattggttgagtgaagagctgctctcctgggccatgtgtttcacagcaaaccagggaatggataataaatatttctcgaagaagctttctcttctatgatattctccacccctgcattgagtactcttctatataaagtcttttcatatatatgcatcctttattgttttgttttattttattttattttattttattttattttattttattttattttattttaccaagacagggtcctgctctgtttcccaggctggagagcagagctcactgcagtttcaacctcctaggctcaaacgatcttcccacctcagcttcctaagtaagctgggtctacaggcacatgccaccattcccagcaaattttttttattttttttgtagagatggagttttgccatgttgcccaggctgatctcgaactcctgggctcaagcgatcttcccttcttggcctccaagagtgctgggattacaggattacagatgtgagcccatcctgtttttttttaatttacactttttgtgtggctaaaaaaattatttcagtcttgggatggggtggagacatgctaataaactagctgtactgcagtcctgtgatgactgtgtgtgttcattgttttgcatttgcagtatgctaggatttgtttggtatgcatatggacgtgctctacctggccttgcacggtgttccttcccctaatagtgggccccaaagagaagatatcttaccctgagttaacaatggcaatgcttctacattgtgtgctccaagccccacattgctaattagaaatgaaaagcctgtgcttttcagaaggctcattttatgccacatgacacatttattaatactccatgccataactcgttaagaactgttctgccgctcttaatggaccttgtgctgaaacacattcagtggctgttgttgtaaactgatatttccccttgggcagtaaccgcaatccaatttcaatttcccttttaactcatttacttcacaaagatctaatttgagacagattaggtaaaatattattggacttcatgggcaccaagtgattgttgtttaagaagtattgtaaaaacccaaagcttgctgtcctttccactatatctaggctttgaaggatctggcgttagagcgtagtgttgaacgagagaggacaaatgtccttttctggattcccaccagaagtttaacgatgattacaaacgtttaatcagccatatgaaacatatatacatatatctctctcaaagtcaacccatcaccagtcattcctttccattctcccatattcactgttctcctgagaacaggggataaaagtaggggagatagtgcagggaaaagcattgtgtgacgcagttctgccttggggctgctctatgctcccccctgctgacataagtatggtactatcaagcactgttgaccctggacttgacagacttcaacataaggaagcagaataactaactcaagagagttctacaaggataaaatgtgagagaataaataataataggctttctcctcaaatttatggtttgctgctttgttgcacttaatcctggatgctctgtgaattttctaaatcgtagaattacagatatcagtgctggaaaggacctgagtatgcccatcaggcagccctctctcttattttatagacgaagaaaatgagatctagagacatgcagtggcccagccaggccatacagttaggcagaggcagggaagaaggagaacacaaatgttttagcacatgacctgagagatgatctagtggttccccaaatctggtgagcacagattcctggattctgcacacttatttaatagaacacctggagaagggatttatgactgtgttttttaaaaagctactcagcctaggctgggcatggtggctcacgcctgtaatcccagcactttgggaggctgaggcaggtggatcacgaggtcaggagatcgagaccatcctggctaacacggtgaaaccccgtctctactaaaaatacaaaaattagctgggcatggtggcgggcgcctgtagtcccagctactcgggaggctgaggcaggagaatggcatgaacccaggaggtggaggttgcagtgagccgagatcacaccgctgcactccagcctaggcagcagagcgaggctccgtctccaaaaaaaataaaaaaataaaaaaaaaaaataaagctactcaccccaggtgcagtggctcacagctataatcataatcccagcactttgggaggtcaaggcaggaggattgcatgaggccaggagttcgagaccagcctggacaacatagcaagaccctgtctctacaaaaaataaaaataaaagataagacaaaatagaaagctagtcagatgattcttatgcagtcagtctggacttagtcaggaactaatattagtgtatcccctggggcagatcagttttgccatctgtttttgtatggcccacaagctaagagtagtttacattcttaaatggttggatgtgtgaaaatgatacgaaatttaaatttctgtgtccataaagttttactgaaacacagccactcttcttgggttgcatgttgtctatggctacttttacaccacagttacaggggtaagttgttttaacagacactgtatggcctacaaagcctgcagtattgactgcctgcgccctttcagaaaaagcttgctggtgccgggtatattacttatctctttctcgtgtaactactgcaagccccagtattaaaagggaaattcctaagctttgagtacttgtgtttgtccaaagactatcttgcctttttttttttttttttttgaggcggagtctcgctctgttgcccaggctggagtgcagtggtgcaatcttggctcactgcaagctttgcctcctgggttcaagcgattctcctgcctcagcctccagagtagctgggactacaggcacatgccaccatgtcgggctaatttttgtatttttagtagagatggggttttaccatattggtcaggctggtcttgaaccgctgacctcgtgatccactcacctcgacctcccaaagtgctggacttataggtggactatcttgcttttcaaaaaagatccattgtgaaaaactgcatgcaaattatctgtaaatctaattatttcaataataaaacatgttttattgtaatacaatttcctactaaagtatgggagatttaccttcatttcaggagtttagtgtgctagatgtttatttttgttaatagaaaaactgtttttatacttgatgaagatataagatgtaaatatttagaaaggggtgatggtaaatgagttttattttaagtgcaacactcagtacccaaattaattaggaaatttctatttcacacatcaaatgtccttagtaaagccttctgcttacaaaatcatagtttttgaattcactaaagatgcttagtttcccccagaatcatcagtctcccacttgacagctcatgactgatcctaattcagaatcctacctcctagtttttcttcaaccaaggtgtaacagtttccatttcctaatggcttccttttgtttttcttcttctccttttccctcacctaaaacaacataagcatttgttcatgaaccaatcaacagacatttatgaagcacctgctgtatgccaagcactgcaggcactgattcagtgataggaaataccctccatgctacctctagacctatatttccatcacgaccaaaccaagagacaagaaaaatggaaagtatagagtacattactttaaaaaatcctgccaggcgcggtgactcacgcctttaatcccagccctttgggaggctgaggcaggcggatcatccgaagtcaggagttcaagaccagcctggccaacatggtgaaaccctgtctctactaaaaatacaaaaaaattagccgggcgtggtggcaggtgcctgtaatctcaagtactggggaggctgaagcaggaaaattgcttgaacccgggaggcggaggttgcagtgagccgagattgcgccattgcactccaacctgggcaacaaaagcaaaactctgtctcaaaataataataataataataaataaaaaataaaaatcctgttgcctgtctcctaaggagaggttttgtaggtgatattgtaaaggcctggcccggtggtttttaggtcttggggcatgggccagtgcttctttcattgttgcttagctgccctatctaccccggggactcaaatttctcattcaccagagaatttgtctcccacaccaacttcattctttgccacgttgccactgaactgcctcccaatctggcacagtggaagctgttgagaggctcgaagctcggcataacatgctgctctttgctgcgtgacctttgataggtggtgttcctctcctgagcttttgttaagtgtatagaggataataattcctccttcacccatacttcatgggaacctcatgaagttgaatgaggaggttatttaaaaggctattttcatagagggagttgctgtagaaacacagagaggtacaagtacttcagagaaggggtttgggggaagccctgggctgtttgtttctttgagaagccaagatatggaagagctatagctcagccctcgatatgtttcagatgaaccctaggtctcctacttctctttgcttttaggattaggctttttctgcagcatatcccaccagaaccagtatgctccattacaggaagaatttcactgcagtacaatgtcaaacactagggatggtgtagtgggcgtttgtagaatgaatctagctcaatacttttccattgggaagagaatgacgtgactctggtagattaggaaaggaaagaatagaagataagaaaagaactttaaaaaacatcactaatactgtgcattgggagtacataggctgatcattattttggaactgtggagggaagcataagattggttcctgccctcaaagaaccaaaagcctaattgtaggggatggaggttaaaaaaaaaaaggtgggggcttttcataaatgacctgtatcaggttaagaaggacctctattactagtttgttgagtacttttattatgaaaggtgttgaattttgtcaaatgcttttttctgcatctattaagatgatcatgtggtttttctcctttattaatatgttgcattacattggttgattttcaaatgctaaactatctttgcattcctgggataaatcccacttggtcatggtgtgcaaccctttttatatgctactggatttggtttgctggcatttttgttgaggctgtctgtgtctatattcataagggatgttagtatagagttttcttatgatgtctttggttttgtatcaaggtaatactggcctttagaatgagtttagaaatgttctcttctattttgtgggagagtttgtttaattctttaaacatttggtagaattcatcagcaaaaccgtctggtcctgggctcttctttgtggaggttcattttttaatgcaaggtacagaagagtatttatggaacaatcccatgtgagagagagactttttaaggacatagatgtatgcttttatttacatagaaaatttctagaaggatatacaaaaaaactggcatcgaaggttatcattaggtaatgagatggaacttggtcttatgttccttttttcttttaaaaaaattatgatcatgcattgctccaaaatttaaaaataaaaaactacttaaaatgactagcatttatttggccatttgctctttcactcacacagtgagatgttaggactgtgtatctgccactggcctgtctccttaggaacttgcagtctagtaggcccttgcatctctcagcttcacagtctgctctccctcttccctattttattctccatcaacactgaattactggtcaattccctaaaaaaaacctgcagctacatgctactatgctttcatatatgtgatttttgttcccttacctttccatcccttctcactaaatctgcccaattaatttttcttaattcttgtttgtcctttaaagccccttccaaatattagttaccttcctttgtgaacttcccagctcactctcttttttatttcccagccaaggggaaaaaaatctctccctcctgctgcctctcatacattatgcatatttttgttattgaactttgtacttaccctgcatcataattactagctcacatatgtgtcttccctaaaagtacagttttattcagtgttgtgtcctggtaattagcacaatgcttggcacagaatagatgctcaaaaatattttaattcaattgaattcagaacacagggcattctgggtagaatgagccacataaacaaaggccaacgttatgaattatgagaacctgttccgaggacatgagctagtttggctagatgggaacattcatactgggaaatatgatttaattattttggcaaggctgatattgggggctcttgaaagccatataaagcagattgaatattggtaagtaaatattgattgaatgaagaacatttctcacttccttccagtctttgctgaaatctctcttctcaataggcttatcctgaccacctctttaaaactgttgcctctttattcacccatcccctgactccagcattcttgatcttcctctccctgttcttcctccttttcccatagcacttgtcatcttctgtgtagcacagcctatatgatttactcattcattacagtttttatttattgtctgtctttcccactagaatttaaactcttcgggccaagactatcttgttcactgaccattcccaagcacctagaacactgtctgacacatagtaggtgtccagtcaatatttgttgagtgaatgaatcctaaattaatgaacttcagtatcgtgtacagagctggcatagaagcttaggtatgattcaaatggcctgtttctgaaagaaacaagtttattctgtaaaactgccaagattgcatcagctatttgtattataatctgggcagggcagagggagggaggtggggcaaacattgtgttaagtttgcttgtttaaaaaccaagttgggaagtaaaaagtattaaagacttttgagtttatgtattccttacctagaaatcattgtttcatgtggtgactcatacccatgctttaataatttctctctctttctttctccacagacctttgtagtattaaacagagggaaaactctcttcagatttagtgccacgcctgccttgtacattttaagtccttttaacctgataagaagaatagctattaaaattttgatacattcatatccttttcggcaaatgtggagtgagtgcggcaattgcatggttgcttgtttacctttccaatatttgacaactggattatatgttaagttttttactgatagtgtagttaactagcccatcagtcagaggtttaagagtgaactcctgccacatcccaagctaagcttcagcaaattattattttttttcttaggatgatattgtgggaatctgaaattttgtttggtatcattgtatggacaaattaaaataacctttgttgaagtcttaactttatttagtactcagacttcagtgatttctttctgtggccaactattcagcttaatatattaaaagccattattagaggtttttgaaagtccttcttgagttacaaatagttggatgaatgctttagaaatcagctttgaatttttaaaaaattttttgagcagtgagcttagaaagtgagatagttctcagatgaaataacctccttgttacagaggtttagatgcagattgtaggataaataggaattttttctggtatttttactcaccttaaatagaaaaatgccaatttattcaagtggcctgagttacaccttattaacatatgagagtgcatgtggcaaatgaaaaattatttgatggatttagtgatgttgcatggtggcttgaaacttccatggctggtcgatatttaacagcatgtagtcccatgcttcgaagattactgtatcctccaagtaggatgaggaagccagcagtggcaacttggtgaattggtttagaagcttttgccacattttattaactcttgagaatttagcaacatggttgtgaaatctgtagtttagaagcaacacacttctgaaacctgaaagtttataaggaaataaataattcacagtggacttcttcctttctgttggatcagaagatggagtgttttttctcttctggttccaaaaagcatgaagacaaatccagctgtaatgaagaaaaaaaaatccagctgtaagaaatattttctctttttaaaactccactggtagaataaagatagtgaatgccattaacaagagagagtgaattagtggcaagtgggatatggctcccaggctctaattggctctaattgtctaatatgacaattagagtttgagtaacttgtgctgacctaaaatagtttaatttttctcagagataagaacagaaaggcctgagaaaaattctggatggaaatgaaatggcagtatggtttgctatccataaacattcctggacactttcagaatggattttgctctattacctagtcttcagaagtgtggtggtgcagatgtccttgaaatctttacctaacacgccgcagctggtttcccacattggacatattcaacacatatgggctgtattggctgatgccttgcccccacagacaattcagccctttagaaggactagggaaggctgggtatgatggctcaggcctgtaatcctagcactttagaaggctgaggatgtaggatcacttgagcccagggcttcaagaccagcctggatgacatagagagaccttgtctcttaaaaaagaacaacaactatggaaaaaaagtgaaccattgcatgtagattttcaaataactagctatataagataattaacttaccaataaatgaatacctagtcatatagatttaattgattttcttatctgacaactttggttgagaaagtgcaaaggtattatactaagtgcaaaaaacatttagaggcttagtctgtagttgagctgaaaagtggttaggggaacatgtttcatccaaagggagtagaacagtgacggcccttttgaaagaaggagaatagctgtccttccccatccatccacagttcacagtggcatgctgtgtttatggtggtgaccacagttttcattgtcaccttgcatttttctcttctgtgcttcatctcctttcaggttattgatttagatctgatacccaatggaaatgtgtttgttttttgagaaaacaaaaggcaggccagattttaatattgccccttgactcttctctacagtatttagcatgatcattatgtgcactattttgaccaactgtgtattcatgacttttagtaaccctcctgactggtcgaagaatgtggagtaagtaactcatttatgtgtgtgcttgtttgttttaaatatttttagtcactaaatcttgctttgccacagtttacccatcaaggagaaaaaaaattagttattgcctctctttatttcacagagaaggctgaaagtacatgtggaatttaggaaatagccctccctaaaagtcaactctagaaattactgcccttcactccaccctttcctgtgccaggcagtgccgttgccctgcagccccatcaccatcttgtatcctcagttcctggtgatactgttttctccaattttaggtttccctgttttttgacttctctaaggttaaaaacagctctggggggcctccttaccttcttcaaaatgatcatgtactagatagctgcaaagttaacttccttggaatacagttcaggacccagtacaacattccaaaggtcttagtttgtgcatttcagtaagtttcattcaaagcatttctttctcctcctcacttccttcctgctgcattggctgtgccctttctgttttgtctctcttagttgaagcaacacttcaggcaagtgctaacttaaaaggttcatttaaagtttctgtccagaaattacctcaagctattcatttctttgacaggtacacgttcacagggatttatacatttgaatcactagtgaaaatcattgcaagaggtttctgcatagatggctttacctttttacgggacccatggaactggttagatttcagtgtcatcatgatggcgtaagttctccccttactttattggtgttctgggtgtgattctgtgtgtggagttgtactcctgggtctgtttgtaggtgtgcatttgtggacacagctgtatgaggaattaatggataaccatgtaaggccctgtgggcttatgtctatgattcttgcttgtgagggcctcttgtggttcaggcgatgataatgtgattatgtgggagaaggcaagcagaggctttacagctgggagagaaaggaggaggtgatttcccattggcactctctcgtattttattcctccttgtaacgatcacggtttgcacacctatcattacaaggcctctgtgaagacttgaaattttttagttgtaaactttcagctgaaaattagtttcctgggtatgtcttaccgtatgtaatttaataaggctggccaggagttgcagacttcagagcacattttagagtcaaaacatgagccaaggtacccacactggcacttcctgaagagttactaaccagaatttcgaactattgctcaagatcagtgtaactccacattggtatgttactgctcttgctcatttgtgttgttttagcaataaaaatgtatctttgggaaacttagctgatgatagaagagttatagcaggctttaatatttttatttccaggttgggaaagcgttttgtggtttgagagtgtagtgggggtggtgtataggttttgcatgtatgcatgatgtgtaagaaagagtgcatttaaatatgtattgatctgagcatctggtggaaagatgtatttcaactgtaaaatgtgaataaatgatatgcatcgaatacttgaaactgaaactgactttctgttatataaaggcaatgtcttactttctagcattatgaatacacattagtgttcatttaaaatttttaagtgtccttgctaggcacagagcttgtaattaaaatgagcacttaacacaatatttgctctgatcccatgatttggattttcctgagccctgcttttgtatgtcacaggccaaaacttcgtttatagacatgactacaatcatatgattacaactcctgattaagtcatatatacagacatttagtcaattttgccattgtcaactagggagttactttaatgtagatttgtttttgtggggctcctgctgcagaaatttgtctccctctcttaagaaattgttcgcaaaacctgggaacataagtctttgatacctcctggccttcctttttactaaaaaatgtgaatgggctgacagtaaagccattctgattgggatcagcacattactatgctgattaaaggagtaaatcccaaaaacctcctttctaatatacttttgaattcttcttgtccaattaaaaacaaatgttccttaaatgtttgtattttgaagcttttctttttcaaggaaaaaaaatgaaaccatagcttgtatataagaccctttcttccccccattctcaaaccctcgcccagtggtaccattacaagttaactttggtttgattctgcaggtatataacagagtttgtaaacctaggcaatgtttcagctctacgcactttcagggtactgagggctttgaaaactatttcggtaatcccaggtaagatggtccggggttggtgttaggtgttgggatagggccctgacgtgacgtattgtactttttgttttgttgtggttttgttttttcctttggtgtttgtgtttgtgtctgtgtttgtcacttgtgtctgtgtgtgacctcccttactacagatatgtgacagagtttgtggacctgggcaatgtctcagcgctgagaacattcagggttctccgagctttgaaaactatctctgtaattccaggtgagaaaatttgtacataagactgactttgccacatctcctctttctcctccattcgttttgtccaccattctaaagcagcatcagtacagttgataatggccttgcattctgcatgtttttcctgggagacattctctggaatggccgttgggtcctcaggcagttttctctgagtgcttgccaggcatgcagcccccattccatccatgctattgaaaaagcacgtgcttaagaatcacttggatctcaccatatttgaaaaaattgtcacagagctagctgtctctttgtatataaatcatttgcttcctggctccatggaattacagtaattttgacatttgccatcatttcattgcttgtgatttctaggcttcctatcgcatggtttgctgatgggacgttattcaaagaattatacatttactattactatattaatgaaattttttaatcacagaagagatctacccagttaactaatccagtatcagagacaaatttaagagacttggagttagtgaactgcacttaaataatcactgtctatcatgttctactgctgtctgtctcactagaataagaaccagtagacatctactgtacatattcagggttcattctcagacataaatcccaatgaaagcttatgcaggcactgttaaaaaaaaatcaaaggtaagataagatacaactaaaggtatgggcaacaaaaagtatagaagtttgagggggaaaaacagaatcagtaggtgagttgagagttagttgattgacaacctctttaaaatttgtgcctttttctttttggttctggttgagctagcccagtggttcttaaccttttgaaggttttggatccctttgagaatcagatgaaagttcacagaccccccccgaagcccatccatggaccccaggttaagattccttaatttaatttaaatcattgctactgggtaatacttatctttctaaagaccagtcttgaaatcttaaaggaaagatattttagttagtattgtgagcctaagatatactggcagtaacttggcagaggtgaagactgtgttgttgctctttggactttagttgtggtcatgggttttcaaggaagactccgtagagaccaggctttccacagcagtttcgtagaaataggaatgtggagaaagaacagaggcatcctattcttatcctattcctattacgtggctcttccccttgtggctgactcagaaatatctctctttttaaaatttatttttattttctagagacagggtctcactctgttgcccaggctggagtggtacgatgatggctcactgcagccttgacttccagggcccaagtgatccttccttctcagccttccaagtagctgagaccacaggtgcatgccatcacacccagctcatttttaaaaaaaaatttttttgtagagacagggtctccctatgtgttgcccaggctggctgccaactcctgggctcaagcaatcttcctgcatcagcctcccaaagtgctgggattacaggcgtgaaccactgcatctggcccagaaatatttctttttcccctttttaacattatctcaatagcagatagagagggaagcacaaagatagaatcctggagagggcagactggaatgtggtttactgagaacctcaaagaaggtaaattcatcttcaccacttacaaatttgggccatggagttggccagtaaatcagtgccctaccaaagatgaattcctatatttttagcgatggtagctgactccctatcaaccaaaggctgggtgtcagttggagtatatacttcttggcaaaaaactacaaccttaacttaccaagatttagttcctagccattttaaatctgcttaacagaaagctcagctcattctccagacagcctcagatagctcattgatggtggcctaatctttaggcaagccctgtcttattttttgaggtatctggaatgccacatctttactttcctttttcctatggtgtctctcctcctctggccccttttaaatatgatcttgtgttttctgctcacttccctcagcgtactctgcaaggcatctgtctctttatgttcctgtgatctcaaaacttctctcccagaattaaattggaaagctgtattctattcactaactagggcagcagatgctgtctctagtctagctcatagcttctgtctctgtctctgctatatggttaacttttgaccatggcatttctgcaagataactcttgattggtgtcacgttatttattctttgtatatatccttaatatgtcatgttatttatcctttatatatatatatatatctggaatatatgcagtatctaacacagtggtgcctggcccatagtagtgctccataaatgattgtagtagcagcacttatgattataaagaaacctaagccaatagaaagggtttgtatcaagatttagacatcagcttcacagtttgaaatagagtcccagattcctatttctagaagcacccccaattgagctggctttgggaggctaactggggtggaaaataacattaagggatagtaaagcgaataatagatcactgtcagtaaatggtatatttggttcttgaattaaaagtgtggctctcagtctcaatctttttgctcccgattctatgttttagagttagcaagagaaatccagtaatgaagtttccctcatgggaagttttctctcatcccatgggaaattctgaaattgctgattatgctttctcccatagagggctgttgtgctattcctacctgcctgctatgcagtctccttccaaggcgggagcaccagtgtatgagtcagtggatctgggccatctcttgcttggaagtatgtcattttgattcttgtgtggtagagctggcccatgattcccccttagtaaaaaccattgttctgtataccaagttttctcgtggatcacttcagtggaattgttgttctctttgtcttctcctcttcccagtttggttatagactactgccaagggtgccaaaaatagaatgtaagtgagagcaaccactgacctggagcctgcaaggtctcacaaagctccctgtgtatcaacttcctttatgagagcttttcctttcctagagcactcacccacccccaacctgggctgatactgtccttcctctttgtgtctttggtagatattctgagtatgtcagggccgccaggactcctgaagattggacagtaaggtgcatcagttagctctgcccttttctgtaagaaatgctttgctttacagctttcttgtagctcagaaaagaccaaacccaccttctgaccctttttactttacttgacttggatacatactatttatgctttccgttttgctccagaggcagcaacttggagaacagtgtacacaaggtctgtgctaaaagggtcggttatagaggagaccctttctaaattttctttagtctggaatttgtcaggttcaccttgacattgaaatattctgcctaaaagtttatatgtcttaaaactttgttttcactttgtatttgtctgagtcccgcataaagtgaacttctaagtgactctgtcagaagttttgtcctctgcatgctttgatcatgtgccacagggctgacatgcccaaagaaagggtgggaatctcgaaagagtttctcaggttcttcttagcagcatttaatagtataagtactaatagaactggttgagagaaactcacttgtcagtttcttttcatttctgtcatttaaatggctcccccaaagcactgcttatctgctgctcattagcacttatttaatttcattccaccttctttagaattgtactttcttgattatttttctcttggcaattttatttctcagctttcatttctgttactttcactcctaaccagtgggatcagacaggaagcagggaaaatgataggcctttctttttcccatcccagtattcacaaagaaagcattttctttaaacgtatactttgtgaatgtggcaatttctgctgcataatgatgggagatataaacggttttaagactatatcctgactcattgtctcttttaaactattctggttattctcttgcctttgtatttctccttttcccacattgcttcttaggaaagataaagtttaacagtggtcctaagtgaaaaaacactaaatgctcacaggatcccactgacccatctttgagagctagtttagttttggtcacactttgtgatgtgaatcaggtctcgagtaaataaatctagagtcccccaatctctttcaaattactgttgctctaaagaatcttcaagagctatcactgtaggctgggtgcagtggtacacacctatagtcccagctaatcaggaggctgaggcagaggatcacttgagcccaggagttcgaggctgcgttgagctgtgaccacacctgtgagtagccactgcattccaacctgggcagcatagtgcgatcttgtctcttaatgaataaataaataaatattatcatgaggattgcagttgcagcaggaaaagtcaacacagcacactactttacccctatgctttgtctgaacccaagcctaactctgggaacagggcagttgttctttccctgggttgagaactgcttgttattgctactgaggcctgtttcaatattaactttgtaggggaattagctcacattgcttcaaaccacttagatttctcaacctgagctacaaactagggaatatgaattagctttatttgtttattttatttatacatatatattttttgagacggagtttcgctgttgtcacgcaggctggagtgcaacggcctgatctcagctcactgcaaccgccacctcctgggttcaagcgattctcctgcctcagcctcctgagtagctaggattacaagcatgcgccacaacgcccagctaatttttgtatttttagtagagatggggtttcaccatgttggccaggctggtcttgaactcctgacctcaggtgatccacccaccttggcctcccaaagtgctgagattacaagtgtgagccaccgtgcctggcaaattaactttatttataatctggccatccagtggtggaagactttgaccccaatatgcttgactgatttttctggacatagcacataggcaggcattgttcatttgttcacaggattcctgggcattgtgaaacgtgacaggagattcagaagtacctttggacatagagtagaattcttcacctgcttcttaaaattccttaaatatccagctttccctcttgtcactgaccgttctctacattgaatccagctgtcttttcttggcctgtggtaaatgtattaactgtttctactcagacacgtaccaaagcgagctaatgttagccttttccaagagttctcactgtccaatttgcccccacgtggcttctgttgcacactctgttgtgtaggagtcttttgaagaagcattctgctgttttggataattggttttcagtcagtatcttgcttgttctggaatgtgatgttgtgagccaatagaataaaaagacagtgtctctgtatagccagaatgatggcattctacattctggcttgtgtcaggtcaggaattctactaacaactttttgcctttattgacaggtgttgatggtacgagggagcgctttcaggcagtcacagctggcaagactgtagagcttgagcttaggaaatgaattgatggcatcatctccataaattggcattgatgtctgcaaatatggccatttgcaatttatcctaatgcaaggaagaagagtcttggctgagaccaatgtatagttcagtgactgtttattatttaatattgctgtgtgatcatgtgccttcctttacctgaaaacatgaagccgcatcacctttcttcttctttttcctttgccttctcattttctcttggtgatctggatgggaatcttggagagtaaaccttttagattgctgtagttagtgttatttagtgattatccttgcttaattaagatttatctgaccctctgtgaagtataagcagctgaataccatttccaattaagtttctactttaaacatcttaaaagctaactcaccaatgagatgatctaagccccagacttcaaagctgaggcttgaaaaagtgtctttttagcttccttgactcatgtttacacatttctttagcaataacatctggtttatggagaagagatgttaaaccagctgattgtgagcatttgggtccatctccaggaaagtgaattccatgcaggcttggcatatcagattagtgggggtcatctctggttgcaagtagcaggacacaggaataattcagggaacccaagggctggaatgcacttgtgcttctgggaagccagtagaaaccagaatgcagagccagaaagccacaggtacaaggaagtactttgtctccatctctcttctctccacgtgtccatttctctctctcagcatactaactgcctttactgctcagtcacatcttaatataatgacagaatatggctaccacttagcttccaaatttatttattaccattctcaccacatgaaaatattactcaactgtctcttatcctgttccaaattcctgtaggaaaggatctggatttaggtcagatgtccacccagacatctgcaactactgagagaaggtgaccttgtacagacatggctgctgagagctcattcttaaggaacaggggatagttggagctcatggcctagaatttccacttatgtggacctggaactgtcaaagagctcccagcccaggaaaatcagattctactcatgctaaaattgtatgcttttcaaattatttacttacaaactcagtggtttggctattttgtagtattatactcttgttactaatacaaaagacagcttacagctcatttctcaattcagtaaaatagcaatggtaaagtcctttaacagtcatctggtgtttggaaaggtgattgtctgaatcgtctggagagatggctgtataggcttcataaaaaagtccaggaaaaagaaactgtacaaccatttttagtgacccattcaagtattattttttaaatcagtctatgactttgaaaacagtaaacttgcgtaattttagaagcctaggattgaattattgattcaatataggcccactccaacccagtcaaaatataatgaggacttctctgttccttagcaactaaatgaaaataaattccattacactggaacaatttttatttcttgatggctgccttctactttattccaccagtaccttcttacctagctgtgtgattatgatacgatttcccagggccttaggtttaaaagatagcttgaaatttcaattacttaatctcaatcaaataaacatctctgccttattttgaaagacttttggagaagattcttcagcttctccactactgcccactgctgtgtagtggtgtgtttatccatgttctgtagatgagaaaatgagactatgagaagtaaccttaaatttgatttgaaacacaataggtcaggccgggtgcagtggctcacacctgtaatcccagcactttgggaggccaaggtgggcggacgacctgaggtcaggggttcgagaccagcctggccaatatagtgaaaccccatctctgctaaaaaaaaaaaatacaaaatttagccagggcatggtggcgggcacctgtaatcccagttactctagaggctgaggcaggagaatcgcttgaacccagaagacggaggttgcagtgagccaagatcgtgccattgcactccagcctggacgacagagcgagaatccgactcaaaaaaaaaaaaaaaaagaaaaagaaacacaataggtcataagtagtgattgagccagggccagaataccagctttctgattccctgtctgatgctctttctgcacagccctgtgaggagaaaaataatcagattataaatgctttgtttcctggagcccaagcaagcgcttcataatccctttgtggccacagtctccatggaaggctcactctaagaaagcacaggactctgcatcctttatctctacagtctacctcttggttcttttttctttaattcctcttagatcccttttaagatatttgtgtaagaggagagaactttctcattcatttactctcccaataaaaatgtattaagtggctgcctttgtgccaggtcttgtgctaggcagagcatccatttctattattggactcagaaaattctattgggctcgactttgaaaagtctaggtgattacttgcaaaatacagcaaaagaagaatcatgtccataccacccattagatcaccattatatgaggttagccctgagcagtgccattttcccaatcatgtccctttgaggagggtaccatatgtaaaatagtgataacaagtgttgagtgccagctatgtgccaggaactttactaggtattttatataaattatctatttaaacctaacaacaacccaatgaggttggtattgtaaatccatttttatagatgagtagactgaggttcagacaataatggtcaacatttgactcatttgctatgtactaaatgctttgtgaagttttttttgtttttgtttttttgttgttgttgttttgtttttgagacggagtctcgctctgttgaccaggctggagtgcagtggcgcaatcttggctcactggaacctccacccccgcaccgggttcaagtggttctcccaccttagcctcccacagtagctgggattacaggcgtatgccaccacacctggctaatttttgtatttttagtagagatggggtttcaccgtgttggccaggctggtcttgaactcccgacctcaggtgatccacctttcttggcctcccaaagtgctgggattacaggggtgacctactgcgcccagctgctttgtcaggtgttttatatgaaccacacttaatcctcacagcagccctatgatactcaactataattttccctactttaaagatgaaaaaacagattctaagaggttagaaggcgtattgcgtaggtcagacaagtaagcggcataacttagttaagattagtgattatctacccaggcacacccttcaaagccaggattaggattcccttgaatttcagttcagtggtcttgccttcagaagtgagcagggatgagattcttcctgaggcctgtgtgtcaaggcttagcgcctgcctcttgctcatcctggtgcattggctaccaagagtgctcagtgctttgttggccgtatcctatggatagcctgatatctgggcacgtaaagactcatttggacccaaaaagcatgaacctacaaccatatttttctgtctcttctgtcactgatctctccatgtgcaattaagaaatacaccttcagtctacatttgagccagtgtcttacatttaaactttaaattaaaatgtttttaatgtttttgtttttaatttaggacagaaaaaagatcattgtagaaagcaggcaatgtatgtgatacagaagaagtatatttttaaatggaaaaagacaaagtataaatactggattaataataaccttttcaataccttggcatttccagaatccttgggaaaatattattgtaccttctcatttattattggcttttaaacttcccagtggttttctttctaacctggaggcctcctcaattcctgatttttccatttgtttctttgacaaatatttactaaatacctactgtgggctaggcactatagatacagctgtgaacaaggtagatgtaaaaaatcaattataaccatgacaaatgctacagaagaaagtataagatgctactgaaacactagtaacaatggagaggaagaagagttgcaaagtcagagaaggctttctggaagaattgacgtttaaactgggccttgaaggatgagtaggatttaggcacagaggacaagataatatagcagggagcattccaggcagagggaacagcaggtatgaaggccctatggcaagtaagagctgggctcatatggggaaccaaaaagtagtcagagatgggaaagtgttcccaggaagaaaggagccacatgttggcagaagaatctttcttttgctttttaagatgtattcacttaaaaatggatacttctggaatattgataattttgctgacctattattattctcatggcataaatataaagtggccatatttcaagagtggtgctgtggggaggagtagcagccagtggctaagagggaggcttggggaggtggggagggctttgaggtgcctctgattccggggattctgtctcctcaggcctgaagacaattgtgggtgccctgattcagtctgtgaagaaactgtcagatgtgatgatcctgacagtgttctgcctgagtgtttttgccttgatcggactgcagctgttcatggggaaccttcgaaacaagtgtgttgtgtggcccataaacttcaacgagagctatcttgaaaatggcaccaaaggctttgattgggaagagtatatcaacaataaaagtaggtggcctcttctctgcaagaggaataggaaaagtctattcctagttcacatggtcagaagctaccacagggcttaaaaaagtagttggaggccgggcgcggtggctcactcctataatcctagcactttgggaggctgaggcaggtggatcacctgagattgggagtttgagaccagcctgaccaacatggagaaaccctctctctactaaaaatacaaaattagccaggcgtggtggcacatgcctgtaatcccagctactcgggaggctgaggcaggagaattgcttgaacccgggaggcggaggttgcggtgagccaagatcacgccattgtactccagcctgggtgggcaacaagaacaaaactccatctcaaaaaaaaaaacaaaaaaaaaaagaggtagttggagctggaaaggaatggcagtgctactagaactagccttgtaaaattattcctttcctcgacgtaggattgtgttcagaagctctcaaacatcagccctctctctccctttttcgcatgtacccctaaacttttgctttgaaattcaggcttagaagcttgataaaaattatttttttccctagctgagttacttgggatatttacacatttagtccagaatgtatctatggaactcaaattttcttaatactactaagactattgcagtcgatctagtctagggaatcaggtgatctttaaggcactattcaatcctattacagttgagtagttttaatcattttatttgaggaaccaaaggaaaatttgatgtagtgatacttctttagactcatgaaaaaagttagagatgtcactattagtcattcctgagaaaataaagtcagtttagtaaccataagaaagtgttgcaaaggagatttcggggacatatgctggaaaggaaaacatgccttgtaatttaaagtaggacctagtatctagtgaccaatgagctctaaaatatctttgataaagacacgttgtaaggatagaagaatagagtggtataaaggggtgtacaactcagaaaacttacttttaggtccctttgattcaagtaccagaatctggcatatagatttgaagtatgaatggaagttgggtgtctgtgaaaactatattgcatcaagaactttgggatagcacttttaatttgtaaatatatataagaaaatcattaataggaaagaattcttatcagctgtcacagctgttggaaaagatttatgagctaaagtcaataactttctgctggggctagttaggaacagtgtaaccttattctctcattcacttaaatctgcctgttcatttcctgcctcttcaaacttttctagcaaatttctacacagttcctggcatgctggaacctttactctgtgggaacagttctgatgctgggtaagtagctcacctagttttattctctttccttaaaataatgtacctgttattagtagggtcaaaataggcaatatgtttacttttctttgtgctcaagtagtagaccttacaattgcatctgacctatcggttggcatagattttctttgtttcacatttgtctatctaaagttgacatttcactagtaagtgcctgtgcttgtagtctcaagccaaaatgaaagaatccaaggatgaaatcaataacaccagatagcttacctgcctcttggggactcctctcatcctatagtacaatagagagcaaagataccatcttagtgatggttatggatccaaggatgacccaaaatatgcttgacctgacagcatagaagaggaaaaagagtagcaacgtagtatttgagtcctgatcctgatacttcctgctctaagacctttggcaagccatttaacttacctgagccttggtttttttcatccataaaatggatttatttaataagccatgctctctcttgctcacagggttactgtaaggatccacttacattacatgaaagtgctttgtaaacagagggctttataaatgtagggtggtagtgtcattttgcagagtatattggtcctctaagaactggtgttttaacatgaccacaatgtctagaaatccatttaatttctgtattagactactagagattacattgaaagaaatatgagatgaatctaaaagcaggagaaatggtgtaactgaggtaactgaaatccccccttgacttaggttgtcacagtgagtgtaaagaaaacaaatgattaagaggaacttctggccaggcgcggtggctcacgcttgtaatcccagcactttgggaggctggggcaggcagatcccgaggtcaggagttcgagaccagccaggccaacacagtgaaaccccgtctctactaaaaatacaaaaattagccagacgtggtggcaggtgcctgtaatcccagctactcgggaggctgaggcaggagaatcgcttgaacccagaaggcagaggttgcagtgacccgagatcatgccatggcactctagcctgggcaacagagctagactctgtatcaaaaaaaaaaaaaaaaaaaaagaggaacttctagccgtttgtcatttgggataatagctgagttaaatttgattgaattgcacattgatatgaatctagaacagtacttctcacactttggcatgcataagaatcacctggcatacctcttaaaaatgcagattcatagatcccatatccagaacttttaattcctagtttgggtaaggatgcaggaatctgcatttttaaagaccatgccaggtgattctgaccctaggctgtccccagaagttggttagctgcttatttccttcttctttttcttctaatttgttggcctggctctatcaatggttatttattatctccaaggtcatggagtaaatagaattatgttatttattatctccaaggtcatggctgggtggaattatgttgaaaagtcctgaacttccctttctttctttaggcaatgcccagagggataccagtgtatgaaagcaggaaggaaccccaactatggttacacaagttttgacacttttagctgggccttcttggcattatttcgccttatgacccaggactattgggaaaacttgtatcaattggtgagtaatacctcttttcctttggccatagagtttgcatgagcttatatggggttggggaccttctgtgtgagagacatttagtgaagacattatacaagatctaactgttgtgtttcccacagtcagctggtttttgatattaagtgaattctctcagttctcatccctgtttctcgaatgctcagtcatgtatagctgtagactcttacagccttgacggcctcttgtctggcctgagaatctgctatctctatctacttcctattgttcatcctctgcagcatatctccttttggatatttggggttagggtttgttttttttgttttgttttgttttgttttgtttttgaggtaggtactacaggcatgtaccaccacacctggctataatatttctactttttggaaagttgggatttcactctgttgcccaggctggtcttgcaacttctggcctcaagtgatcctcccactgtggcctcccaaagtgctggaattacaggcgtgagccaccattagggcttctgtttaagaaaaattaaacacctctttgtgcaaggcactatatagatggaatttccataaggaccttggagtatatcaacatttttgagatttgtaacacatttggatttgttcaagcaggttgtacagataaaaataaggtcagtaacattctgttgggctacactggtgactctggacaagtcatttaactttgctggttgtaatgaagttagtgtaagtgattgctaagtgtcttacagcttagaaattttatgacagtccattgttttctctttgtgtcatttggtgataccagttactttgaaaatgaaaaacacgtcccctcaggcatgaaggaccctctttaagggaagtttctagttcaaatatctgagttaattcttacctttctgttgcacagcctagagttccctcaggttgaatgtttctcatgaaatatttgtgattgatgctgtttctttttttttttcttttttgagacagagtctcgctctgtcgcccaggctggagtgcagaggcgcaatctctgttcactgcagcctccaaacaattctcctgcctcagcctcccgagtagctgggattacaggcatgacgcacgcacctggctaatttttgtatttttaatagagacggggtttcaccatgttggttggccaggctcgtcttgaactcttgacctcaggtgatccacctgtcttgcctcccaaagtgctgggattacaggcatgagccaccgtgcctggcccattttgtggttaacagaataaagatgaaaactgtgtaatagtgggttgcatgtacataacctaaaacctagtttccttctgcctttttttaacctcccccactatcctttatgtcatattgtcatatccttttaaaactcatcctattgcaaaagaataaggaagggtgtcactcaagatggggatttcctggccggacacagtggctcatgcctgtaatcccagcgctttgggaggccgaggcaggtggatcacttgaggccaggagttcaagaccaacctggcaaacctggtgaaaccacatctctactaaaaatacaaaaattagctgggcatggtggcacatgcctgtaatcccagctactcgggaggctgaggtgggagaattgctttaacctgggaggtggaggttgcagtgagctgagatgatggcactgcactccagcctgggtgacagagcaagactccacctacaaaaaaaaaaaaaaaaaatgggtccgggcgtggtggctcacgcctgtaatcccagcactttgggaggccgaggcgggtggatcatgaggtcaggagctcaagaccagcctggccaacatagtgaaaccccgtctctactaaaaatacaaaaaaattagctgggcatggtggtgggcacctgtaatcccagctactcgggaggctgaggcaggagaatcgcttgaacctgggaggcagaggttgcagtgagccaagatcgtgccatcacactccagcctaggtgatagtgtgacacttcatctcaaaaaaaaaataaataaaataaaaagatgggatttccttcaacttggacctgatttcagagacataatttgtctgttaatgctgtttgaggatctgtagataaataaactgcagtcttgtattcttttctttatacttgtcttagcccaaaatcaaactttttttatgaaagaagtgtatggggaatatttagaaatgagaggggatttttttgtcacaatggttgggagataactactgccatttaatatgagttgaggataagtgaaaccattcaaccattgggagtaccaagtgcccacaataggaaggagtactgcacaaggaaacagtcctgtacaaaatgcaaatagtgcccttacagaggaacttggcccattagctgttttcagcctggttcatttggtacaagtgactcagaaaatggcctttgtctttgcagactttacgagcagccgggaaaacatacatgatcttcttcgtcttggtcatctttgtgggttctttctatctggtgaacttgatcttggctgtggtggccatggcttatgaagaacagaatcaggcaacactggaggaggcagaacaaaaagaggctgaatttaaagcaatgttggagcaacttaagaagcaacaggaagaggcacaggttggtgatgaattctttgcaatagaccttcctgccagatcatggtgactaagaccccatctgattttcactgcagttgatcttttctaggcatattttcaaatagaggccattggtctgatgaaaataacccaagtaacaactgcagatggttgctccaattattccatttgtcttaacagccaaattgtttgttcatatcatcttttgttgaattgctcaactgttcagtgtgcaaccgccatgatgactgggaagaaaaaagtgaccagggcagtttatatagtgtttcacataagcatattctttttcttgggagaaatgttaagattcctgtggtcataaaaagtattatttctaattaaaaagaagatacaggcaaaatattaaagtaaaacttgaaagacatttgtgatctcatcaccttaacacttaactttctcatccttatctaaatgtacatgtatttatacatttttaggacccataatatataatgttacttagcattcatttccagacttgctcagaagggatcctctggtaccaaggcagcagtcaagttcttgtctgaaatgctcaagagaataactcccaaagttctcaccactgggttctgctctgttcacttagggctgtgtgccagaatacacagaaaccctctaacagtctaggtttcctgcctccttttttcctcctttcccttcagtagggaaatgttctgtactaactggttggctttgggtggctccagttaattgccctggtctggcttccctgctgtggcttctttcctaggctgctgcgatggccacttcagcaggaactgtctcagaagatgccatagaggaagaaggtgaagaaggagggggctcccctcggagctcttctgaaatctctaaactcagctcaaagagtgcaaaggaaagacgtaacaggagaaagaagaggaagcaaaaggaactctctgaaggagaggagaaaggggatcccgagaaggtgtttaagtcagagtcagaagatggcatgagaaggaaggcctttcggctgccagacaacagaatagggaggaaattttccatcatgaatcaggtaaactcttcttttttctatacctttttcaaaaatgtattttttattaaggtaaaatgtgtatatatatattataccatctttaccattttaagtgtaccgttcagtgttaagcacaattatattcttctttttcctctttcatcccctctatcccctcttcttcctggcctctagtaaccaccagtctactctctaccttcaagagatccacttttttagctcccacgtatgagtgagaacatgctacatttgtctttctgtgcttggcttatttcagtgaacataataacctctggttccatctatgttgctgcaaatgataggatttcattctttttatggctgaatagtattccataatgtaaatatactgcattttctttatccatttatttgttgatgggcacttaggttgatttcatattttgtctattgtaaatagtactacaataaacatgggagtgcaaatatctatttaatatattgactgactttcttttagttatataccccataatgaaattgctggtgtattattcagggttctctaaaggtatagaactaataggatatatttatatatctattagtatataaatatataaaggggagtttattaagtattaacttacacaatcacaaggtcccacagtaggctgtttgcaaacttcaggagcaaggagagtgagtctgagtcccaaaactgaagaacttggagttggatgttcgagggcaggaagcatccagcatgggggaaagatgtaggctgggaggctaggccagtctcgcctttttacgtttttctgcccgctttattttcactgacagccgattaaatggtgcccaccacattaagggtgggtctgcctttcccatcccactgacttgactgttaatctcctttggcaacacacctcacaaacacacccaggatcaatattttgcatccttcagtccaaccaagttgacatgcagtattaactatcacattggattatatggtaattctatttttagttttttgaggagcctccatactcttctccaaactcattgtactaacgtgcattcccacaacaggtaaactctttgcattggctcaataagcctaaaaacatctggtttttctaatcccacttgatttttattttcccctttggccctatattttccaggcccatccctgcatcctcatttctacctcactatgctccatattgttctcctctgggaggaagtgttaccagcacatttggaacattctccattctaatcctgccctcccttctctgatgtaaaagccaaccctagactatgtgatcacctttggcagacttgcttggcagtaaagtatatgtcacaccagcaatcttcatgttctaaaacatcagggagagcttttctcctctaagcatcagaatttagctcaaacatctctgtttaagaattgcatttaattataggggataataataataggagtcatgaaacaggacatcttatttgagcatggcaagttctactgattaattattctggatatgtagtatcacactgataagttagcctatggtagattgaaagcctccagtttttcccaactttgataaataaggaaactaagcaaaaaagagaagagaagacttagggtaattgttgagcattctgttactatagatgtcatcacataaataggtatttttgaatttcagagaacaccaccaaaatctaattcttaggccatttaatttcccattttaaagaaatgctggaaagttggtaggtatagaatagattatagttactgtttatggcagtatatccagtgtcttttcttttttcccagagatgattcattttcccacttgcatctctcactttccggttcagtcttttgccagtcttattcatttcaggggatgagcaaaatccctcatgtccatccctttctttccattccttaaccttatcttagttttggctttacaattgtattattttgttctactgcgtttgtccactgcagttttgttttctgtagtctttctccttctcctttgtattttatatactgtcaacagattacgtcctaaaatgtagttctcatcattcatgtagtaggcatttatggagtacctactacatatcaaggattgtactaggtcctagggcttaaaaggtgattaaaacatcatccctaccctagagagcttacagtacagtgagacagctgaatacactaaaaaattatgtagtagcatgtgttattccataattgagatatgctgggggtgttagaaaagcacagatctatcccaacatggagattcagtaaagattttctgggaaaggtaaatttctgaactgaagcttaaaggatagacaggaattaggtagtgtatgtgtgtgttggtgagggaacaataagaaaaaagggatggtctaggtttagaagggaagcatattccagtttagacatccaaagtttgaattatttgttggataaccaagtacagatttttttagacaaggataggcaaatgatagctcagggaagaggtcctgagctgagaggtggtgattgaaaccatgagacttgtggagattactcaaagagaatgtgtcagttggaagaatagtgagccaaaggcatgaccattgctgttcactggcatagagatggagttcaggaaagaaaacggataaacagtgttagagaagctgagagggccaagagttcagtgaagtcaggagagtagcgatgttggagaaggcagggccatgatcaatggattgaaatttaacagagatgcttagtgagctcagaattgaaagtgtccatcggatttggcaatataaagtcattgaggactttaaagacatgttttagtccagagtaaggaaggatgccatgttgagtggggagtggagacaatgagtatagacttctcatcccagcttctttaaagagtgtgggtggaaataagcatgtttatactttgtggaagaaaaaaaaacagaaaagggagacgtgttagaaaatgaaatagaatagatagaagtagagcacaatcttggaagataccgaaatagatgtggtttttaacagaaaagggacccttgttccctgaaaccttaagaaaacagggaaggatgaggtggataaatttgtagaaaaggagtaggaagttgaggaagataacccctgacagtttagtgttttgataatgttgggaattaaaaatcaaggagtttgagatcagcctgggcaacatagtgagacctctgtctctacaaaaaatgaattaattttttgataatgtagggaattaaacatcttattgaagggaatgagaggttgtgtttggaggtttaaagaaaatattgacagtttagaatagtttttaagaagaatgggagagggaattcccctaatcagattcattctatttactaattaagtcccaactccttaccctggaattcatagcattccccatccccttagtacggttacaacctatgtgttcattctccagtctctgtgccccatcaagcaccctatacctgaaccagaatgagctactagatatttctcatatatgatgtttgttttctaccctctgtggtttgctcaagaaacaccctctctaaaatgtcctgttggccagcacagtggctcacacctgtaatcccagcactttgggaggccaaggtgaaagaatcatttgaggccaggagttcaagaccaccctgggcaacatagagagacccctgtctctaccaaaaaattggccaggcgtggtggcccatgcctgtagtcccagctactccggagtctgaggcgggaagatggcttgagcatgggaggttgaagctgcagtgagctgtgatcttaccactacactcctgcttgggcaacagaacaagaccctgtctccaaaaaaacaagaacaaaaacaaaccaaaaaattaaaattaaataaaatgccctatttttctgtctttgaatttctgcatcatagttattctcaatatcttcctttcaagaaaccttccctgactctcctgttttctagttggaaatcttcattttatctttctgttatgttttatatgtacctctttatttgttgctttttactctacatatagaaagtactctacatatactctgtgtgcatatttatttatgctcatatcctcttctctctaaataaagtgttaaagtcaaggtctgcttcttagcacatggctagatattgttagacaaatgaatgcaagacttagaaatttgatttaaccctttctgagagacttctttatagcctgaagccatctctatctcaccttcacctctcctttcttctagttcagcctcttttggggaaagtatgatagtagctttgttgtaattttacccttgtcttgagagactcactgagctatgaataccttagcgctgttaacgctttgctattgaatggtctctgattattctataggctttagtacaaaggtacactgattgctccttaactcaaaaaataaaaccaggtttttgagatgccctgctgtgcatgaaaatattcacttagtctaatctctccattcaaaaaaaatagtaaattcctagaggccaaggctgactgccaagagtagcttaagatgctacaagggatagtagtattctttgtcccaggactttcctgcagtttctctggaagagtgactgaggaaatcgaggcctagaaagaatcacttataactataactagttatagaaggttatataactagtaagtgttcaagccaagatttgaacccaggttcatccaactccagagcctgtgctcctaaccaccccttctttattcctgcacacgtacatgatcatctcttctgttagtttaacaatgaatgtggcttcagttttctcacaacatagttcagttatgtgtcagtttcttttatttccatagcttctgagttctttttttttttttttagaaattttgagatttttttcatttgaaggtaatcgtaatgctattaaattcacaaatgctaatttaaatattcaatcctatttatctaaaacacacattgcaaacacacaaattatctattctctccacgtcagtacccattcatatagtggtttggaaatggggagaatagattccccttaaactgcaagtcagcaggtgtttctttacagttaactttagcaaaattcatacaaaatagtaattaacaatgatctttacttgttaactcacaaggaaacaccttcaaaactgcattttgttaaagtttctgtactaaaatgtagaaaaactgaactacataaatattgaaaagttaaaaattccttaatttttaattcctggtaccactaccacaatttacagggcaatatacctgatgtaatgaaaagaaaaagaaaaagacaaggctacaacagataaaaaacctcaggaatgtacatctaattgacactacattgcattaatcaatagctgcacttcctgcaaactgtggctatggtagtcctgaacaagaagggtttcctgtttaagctgcagtaacttttctgactatggatcatccttccttctgtggcagatttttacagttcctctaatgcatttgggacgactgtctcaaagtaacctgcagctttcctgacagctcctcgcgctctctcctgctgagaactgtagcccttttctgctgtttttagaaccttctgctactatatccaccacttccaccactagatgcataaccaccaccatagggactgcccgagcttcttccaccaaaacttccccctttcatgggtccataatttgattgctgttgtccactataatttctaaaatcattatagttcccaccaccaccatagttaccaccgccaaaatttcctccttcattgtaaccatcatatcctccaccaccgctaccatatccaccacaccaccttggtttccatatcctggtccaccaccaccatagccccctctactactataaccaggaccaccagcatagttgccaccgtcacttccaaatccattatatccaccatcacctcctccataactacctctgctgccaccacctccaccaccatagcctcctcttccaccaaagtttccaccacggccaaaattacctccaccacctccaaagcttcctccgcaacccataaaattgccagatccacctccacgacctctccgtgatccagcggactgcatctcttgtttagaaagggcctttttcacttcacaattatgcccattaatagtgtggtatttctgaacaacaattttatcaactgtatcatgatcatcaaaagttacaaaagcagatcctctcttttttccactctgcctctcttgcataacttctatggtttcaatcttgccatacttttcaaagtagtctctcaaattatattcctttgtatcttctgtaataccaccaacaaaaattttcttcactgttagatgggcaccaggcttcacagaatcctctctagaaacagctctctttggttccactacatgcccatcaaccttgtgtggtcaagcacacattgctgcatccacctcttcaacacaagaataagtcacaaaaccaaagcccctggaccattttgtttgggggtctctcattaccacacaatctgtgagtgtgccccatttctcaaaatgtcctcttaaactatcatctgtagtttcaaagttcagactaccaataaacagttttctcaactgctctggttcctttgggtcatggccctcttcctgccggtggcaatgtcgacggctggagtcggactgggggcgaccaggcggcggttttacctccattttgagcctgagttcttcttgagacatctcctgctcactcatctccgacctatttctctatatttttaaggctcagggcagtttataaatattaagttgagcctattttttcaaagtattttaattgctctattgcagcagttttcaaactttctggtcttaggacccctttatcttcttaaaaaattttgaggacctaaaaacctttctaaaatgtgcttttaatttctcatattagaaattataattaagaaaattaaaaaatatttactaattttaaaaatatagtaatgataaacccattacatgattaacacaaattatatatttttaagaaaaatgaactgttttccaaaaccaaaaaaaagggtttttttttttgtattacatttctgcaaatctctttaatctgtaatgtaatagaaaacagttgaaatatcatactggcttatgcatgcattcagtttgttgcagtatgattttctttggttaaggtatttgaagaaaatcaagtttcatacagatatgtagtggaaaagggaggaatattttaataaccttttcagataactgtgaatgttcctccttgatgctgttccaaaacttaacagtgacaattatttaaacagttagttgtgatgtggaaactataacagtaactttgtactctgttatagtaaaatcccttgctccattttgtgccatagatctttaacctgtgaatgatttctagcatcatgcattgatcatttgagaaattttcatttcctgagtttatgcaaatcttccaaatacacacaagattttaaaactatatttattattaccaccaatctcatcataaaactatttaaatattatgaagctgtcaggctcacagtgtcactgtgtgcttatgagaagatgagtgataaaagcacatatcatctcagtattattaggaaagaattttgacctcatgagccttccttaaaaggtctcagggacctccgggggtctccagaccacactttaagaaccagtgttatactagaaagaaaaagtgaaatatggcatggaaatagaacatgtaaaatcactccttcatcacattccaaacatcccagtcatgtaagcctcatcttgacagacaatttacgtgtatcccctgagatccctagagataatttttctgtggaatgcaaaagttacactctcaaatccagaacatcccagagccattctcccgagcaaacatctaaacctaagttggaattcatagtttaactgtgactgcctgaaaaggactaaaagctcctggttggttgacaggaggattttgaaaagagggagtaaggcctactcatctcataaactacacaggatcccaggatttaatagagccatggatcctgagtcatcactgaaaacctctagtctaggaaaattgagattgaggaaggtttggggtttcagccctcaggatgtagctccttagggaatgccctaaatcaggattggatcctgggtacaaggagaaatggagcaagtcacctttacccctttcacatttgtccattgcagactactcttttgcaaagagtgaaacaaggaattagaaaataatagaacagtttttcctcatattatgtattatcttaggatcctgatttttaagtgttcataggttcactgaattggtcataaccttcatcactgtcttatcatccttatcactatccttaaggttaagaatagtctgatgtattagatctcatgtagtatatgatatttcctcctggcctccaagtttcaagagggcagggaccatgtcatatgtctcgttcaccactgtatccacaccacttagcacacaataggtatttggttaaataaaattaaattttggccaggcacagtggctcacgcctgtaatcctggcactttgggaggctgaggtgggcagatcacttgaggctgaggcaggagaatagcttgaacctgggaggcggaagtttcagcaagccaagattgcaccactgcacttcagcctgggtgacagagcgagtctctgtctcaaaaaaaaaaaaaaaaaaaaaaattatataaaattaaattttattgtaaaatgcataaaacctctttcctaatgtgaaggcctaatgtaccaggtagtatcagcacccagcattgacctaaggcaaaattatgaattcagtgtagtttagcttgctgtgagaagtgaagcagtgaccccgtgcaggtgtggaacaaccctaaaatgggtggctaagctgcagtacctaatctaagtgcatgttaattaagttaaacattgtagttactatgtgcaaagcactctgggagatataaggatgaatcagtcaatgtgcccttaaggagtttgtagttggttaaaaatgagaggtagaacatgtatataaagaactgttgtaaaaagtagagcgtaggctggatacagtgactcacgcctataatctcagcactttgggaggccaaggcgggaggattgctttagcccaggaatttgagaccagcctgggcaacatggcgaaaccctgtatctacaaaaaaatataaaaattagccaggcgtggtatggcacatactgtgtggtgtggcacacacctgtagttccagctacttgggaggctgaggtgagaggatcacttgagcccaggaggttgaggctgcagtgagtgattgcactattgcactccagcccaggcaacagagtgagaccctgtcttgaagaaaacaataaaaaataaagtagagcataaatattctgaaagggggtttggtgctatggaaagattaaggaagttagtagaggaagaagcagaagggctggatcatggagaactgagaggatttccccagctgaaaatggagcgtgcactggaaacagaggaaataaagacctgcggtagggtggctgcatggtagggtgtatgagaaaacagtgaaagatgaagtagaataagtaaattagagtcaaagctgggagggtcttgaatgccatttttatgacggtgtgatagtgttaaaggtgattgtggcatttagcaaaggggccatgagtacctgagtcctgtgttttcctggccatatttctccgcagtgacgccctcaagagagatatatgtgcccaaggcaccggttattaacacctgggcttgtacgctgaacctcagtgttctatgttacgcttgccttcaaacttgtttttcatgtacagatcaaccagtccaaagcccacattcccaactacctcctttatctaactcactcactaagccaatatttcccttccctaaatcaccccatagccagataccagacaagtagttaccacctctgtaggccagagccttccaaaattattcaaactccccaatcctaaacttgctcagacttacctatcctgcctcatcccttccttcctgaggaaaccacaggctcaggctaaactttccccctcactccttctgcttcctgaccaacacttatatttccccgtatggccctccatggcatggcaagcccactcctcttgggaacggaagtaacgaactcttctttcaaaggcagttgcctctgtgtctgtcaccttaccgtgatctgattaaaacaaaatcccaagtacatcttaagacaccatcttctggccagccacattgtttagagcagtgtttctcaagttacctgtggtaaaggactcatttctatttttcccaattcttcatgaactgatactattgtaaaatacagtaacaatcaatttctagaaaaatcatcacattcttagatgttatgactgtgtctaattgttacaaaagtttctaaatgcccctctcagtttccttacttgtctcattgcagaccaataacaagtcatgtactagctgcctgtgaatcacaccgagcagagctggttcaggggaattaatcagtgattcaaagggggtgcccaaacatacatgtaagaagaatagtaagcttaccaatccagcaacatggaagaaggacgtgcaagggcttcctctgttatgtgctcctttaccacacagcgtatgtgtccttttaacacacagtgacaacatctactcataaatgaggctcagtcaacattctggaatctaaccaatgtagctccttctctctggtacaaggatgaggcagaagaacaaaataagtcagggtcatcctgttttctagagacctatatatagcatatggcatgtatctaacaatgacatttatatataattatctatgattagtgcttttcttgatgtggtccccagtgatcaaattcatttattgtcttagaagttcgtgggttgcttaaagccaaagcaggaaaagcctacataacacgtgaaagatacaggtgagagcatggaataatatgcaactagaattatccaaagaaaatataccaatctggggacaggggctttgtacattacaagaagagacaggatctaaagtatagaaccagaaacggaattgtagccaacaaaaagataagggcagaaatgttaaagaggagccccatagcccttccagtgttaacatcaaaagtattaacaggctgagcgcagtgcctcactcctgtaatcccaggactttgggagaccaaggcaggaggatcacttgaacccaggagttcaagatcagcctgggcaacatacagaccccatctctattaaaaaaaatttttttttaattagccaggcatggtggcacatgcctgtagtcctagctacttggaaggctgaggcaggaggatgccttgagcccaggggtttgaggcatatttctgttttacatatttctgttatgagtgaaacagaattataactggggatgttgagatgttttaatttcaggagattgttgcccttgcaatacatactaatacatttattaacagtgaaaaatgggatcatgctttttcaaatgaaaataaatctaatttagccaattgctctgacattgaggactgactgctcattagatcatgtgattgaacattttcagaaatgagctaaatctgtgactttaaggtagattttgatgaaaatatatttaaatcatgtgataagataaaatcatattaaaaataaatgttggcaatgatggaaagacattaataatattttgatcatttcaaccatctattgggttaaacgagcttcctttaagtacaagagtaactcatgtgagaataacccacataattattagtaaataatacagctttttgatgtcctcagaaatcaagaaagggaatgtgtgtaggtaacaaatcttttggcaaattgagttttcagttctttgctttcaataaaattggaaaaagacttaattgccagccgatagattattacaataaattttgctgatagtttgctatatatttttggtatataacttggaaggagtccaaagaattgagtgacattactataacaaagttcttccattccaagataatatttatgtgaataaggttttagcacataaaattgattattagaaaggtggggaggattgatgttgagccatgtctcattctaataataagtaatactaccaacaaatatttaaacaccaattgaaaagaaaatctcatccatcttattaagaaatgcattttaatacaattttctttcttaagtctattacctgtaaaatgtgtaatatatttctatagcttgatcaattgtattcataagaatattaataaaaactcaatccaggagaattatttaaatgtcttaaagactcatgctcatagaaaatttttaatagtaagtacagtttatttataattttttgtataatttgttggaatcatagccaacaaaaagataagggcagaaatgttaaagaggagccccatggcccttccagtgttaacatcaaaagtgttaacaggctgggcgtggtgcctccctcctgtaatcccagcactttgggaggccaaggcaggaggatcacttgaacccaggagttcgagatcagcctgggcaacatagagaagtaaattcaggggtgagcagtaaaatacattaaaacataaaagtgtacattcaaataaaattccctagggaatatggaaaggaagcatgaaattgaaggagaagaataaataagaaaaaatttatgctaaagaattcttggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacctggcaggcggagcttgcagtgagccgagatcgcgccactgcactccagcctgggcgacagagcgagactccgtctcaaaaaaaaaaaaaaaaaaaaagaattctttaagtaaatttctttaccacaaactttacggtaaacaagagttttatttaaaaacgtcaatgccggatattatataacttacagctgtttgagaattatatactttacaactatgtaaacttttgatgaaaaaaatatgtttaaaatggggtggatggaatactatgcagccataaaaaggatgagttcacgtcctttgtagggacatggatgaggctggaaaccatcattctgagcaaactatcacaaggacagaaaaccaaatactgcatattctcactgataggtggaaattgaacaatgagaacacttggacacaggttggggaacaacacatactggggcctgacatagggttgggggaggggggagggagagcattaggagaaataactaatgtaaatgatgagttaatgggtgcagcacaccaacatggcacatgtatacatatgtaacaaacctgcacattatgcacatgtaccctagaacttaaagtataataataataaaagaaaaggaaaagtaaataaatacataaataaaatggggtgggagggggcatatataattttcaactgaactaaaaggcttgaaggccactgttggagtagtagttgaccaggacatgtacttggagagaatggcaaatgatacaggcacgttttaaattctgtctttttggccaggagcggtggcttatgcctgtaatcccagcactttgggaggccgaggcgggtggatcacctgaggtcaggagtttgagaccagcctggccaacatggcgaaaccctgtctgtactaaaaatacaaaaattagccagggcgtggtggtggatgcctgtaatcccagctactcaggaggctgaggcaggagaagctcttgaacccaggagctggaggttgcagtgagccaagatagcgccaccacactccagcctgggccacaagagcgaaactccatctcaaaaaaaaaaaaattatatatatatatatatatatatatatatatatatatataatatttatttattgttatatatatgataataaataaattctttttgcccagtgtggcgtagtctaactgaagttaaagacacctcctctgagcccatggtaaaaagaaatacacagccatgtgctttaccctggataagttgtgtataatgtgagataaaagcatcttagggatgcgtgcaagaacagtgggtagacgttttgaatccgtaactggtcaagcacaggtgagtaacaatgggtgatgaactgtagcagtcaacatgcagaagtgctttctggaaacacttgtgttctgatcacaggagtgcgagggtggggccggctgggaacctaaccactttgctcagtataaaggtccacactcccgtctcatttccccgtccctctctctttccctgtctgcccctgcagtcactgctcagcatcccaggctcgcccttcctctcccgccacaacagcaagagcagcatcttcagtttcaggggacctgggcggttccgagacccgggctccgagaatgagttcgcggatgacgagcacagcacggtggaggagagcgagggccgccgggactccctcttcatccccatccgggcccgcgagcgccggagcagctacagcggctacagcggctacagccagggcagccgctcctcgcgcatcttccccagcctgcggcgcagcgtgaagcgcaacagcacggtggactgcaacggcgtggtgtccctcatcggcggccccggctcccacatcggcgggcgtctcctgccagaggtgaaaattgataaggcagctaccgatgacagtgtaaggaagaacacaaatagatcgaggctaggcatggcagtctcccccgctccttcccctcctctttccctgctctgcccatcccacttggtctgtctggaccccactcctgttaacaccccagccatttctgtgttcttcctggcctatttctatttctctcttcagttttccccctattactcaccctgtcttctcctttcctttattctttgctccattttccccatcttccctccttgtttctgacattccttctcccctatcaactccttcctttattttaccgttttctttctctccatctttatctttgctagtctgtgtgcttgtgtttccctcctcccacctgctttgactgaatgcctctggccccggagcctgcccggatggaatgagaatgccatggagccaccaccaatgaccaagtctgaaccggtttggaactaccattgcttctcttcccccacgtcttctaccctcctagggaaacagcttggaatttagagatcttatcctttaaatttcaaaaaagtaattgagttttgaataatgttctaagtctcctctgcaagaatgagatgtgctttttctaaagaggaatgctcatgtgatgtcagggtgggaggtgtgtgccagcagagccaggcaaggagaagttaaagaggccaataggaaactggacccagacttttaaaagggattgaaattgaaataaatcaaaggaggaaaaagtgggaggttggggcaagaacacattgtatatgggggaggaaggaaaggggaagcaaaagatgaattttaaatgtaatcaaatgtcaggctctggaggagttgcatataatagcttcacaaaatcagttatctagaggtttggataatggtgcccctctttgggaagagccatctcctaacatttctttaaattctaagctgtttgtatcttttttattttaaaattcttataaccttagtgatcctaatccttcatacctctaatttctaactttcctcagtccctcttcagctggtataaactccttgagatagcatgttagtctatttctttctaacacttcagtttcttctaacacagcatgaagatagccaatcctttaattagcatgatgcatgtatggaggaaaactggacaatcatggataaagtttattgaatgtatagataaaatatcaaaaggcaatttgtatgtgtttgggattgtctagtctcgcccttcccttttatttaaaagcaaaatacagccgggcacagtggctcgcacctgtaatcccagcactttgggaggccaaggaaagaggatcacatgaaaccaggagttggagaccagcttggcaacacagtgagaccctgtttgtacaaaaaataaaaataagaaacattagccaggcatggtggcatgtgcctctatagtcccagctacttgggatgctgaggcagggggatcacatgagcccaagagtttaaggctacaatgagctatgatcactacatttcagcctgagtgacagagtgagactctatcaaaaataaaataaagcaaaaatactctcccccttatgtttgtatagctttttataagctacaaattactcttacatgcattatttaatttgtcctaaataaaaattctgggctgggagtggtggctcacgcctgtaatcccagcaccttgggaggccaaggcaggtggattgcttgaggccaggagttcgagacaagcctggccaacatggtttgaaacccatctctactacaaatacaaaagattagccggatgtgggaggctgaggcaggagaatcgcttgaacctgggacagggaggttgcagtgagccaagattgcgccactgcactccagcctgggcaacagagcgagactccatcttaaaaaaaaaaaatctgtaagggtgactaagtgaagattaatatttctgtttttgagatggggagaaggttcagagaatttgtgttcctttgggtcttacagctcatcactgatagagccagaatctcagacccctcagagaccctaatcttccgtgtgccagttaattttaatttgttctctgcctagacacttggccgttgctcttctcaagacctacttatttaagatcagcaacagtaagaacaataataatcctctggtttctctttagattgtataaatctttcactttttacaacaataataaacagtgggccgggcacggtggctcatgcctataatcccagcactttaggaggctgaggtgggcagatcacctgaggtctggagtttgagaccaggctggccaacatggcaaaacctccatctctactaaaaatacaaaaattagccaggcatggtggtatgcgcctataatctcggctacttgggaagccaaggcacgagaatcacttgaacctgggaggcggaggctgtaatgagccaagattgcgccattgcactccagcctaggcaagaagagcaacactcttgtctcaaaaaagaaaaaacaaaacaaaacaaaacaaaaacagtggctccagatagttggccaaaataaatgttatagatacttatctttacatttaatttttatttgactttcactaattctgcgaatagggataaattttgggctccacagttagataattatgttctccgaaaaaacaagagataatatcaatggcaaatgaaggatggatcaacatgggcagtagagttggggcaattcaaatgtttagaaccaaattgaattttgatatactggcagtttttaaaaatatttaagccaaataatgcagcttgccttttctctgaataaaaaggtattagagaaggtattcagaaagaaggagcttaaacttcagctgaagagagatgatcaggtttaggggttttgtttttgtttttttagcaccttctgttacactgtgtgggagaaaaaaattgagagtcagttaagcagatggctgtggaatgtaaggctttctgtactgctttacactgtggtctataaaggtctgcatttgggttttgggggatctacatacccagcaccctataaacacttaggaggttctctgtagtgacctcaagtgaggatggtgacagacttgagaattcccaaagtcaggaggtcacagtggcaggaagatgaggtaggcaagaccatatcattcccaagggcctcataactaggaaaaactatttttatttatgtatttatttatgttattagaagccataaagaaactgttatggctagttgttaacggtgtgggaaaatgtctaagttacattaataggcccaaaggaagaaaacagcaaaacaagatgcatatagtttgtgtggtatgataccaaattatataaagacaaactacatagagaaagaagatgaccagccaatagttaacaatagttgcctttgagagaagaaattatggacttttttcttccttatacttttctgttctttctggttttctgtagtgagcataatgattatagccatcatatattgagttcttattatactatgctgagcattttatatacattatctcattttattcttataatcactctattcagtaggtggttttatcctattagcagatgagactcagagcgctgtagtgacttgggaattggaccttaaaccatggtctttctgataccaaaaggaacttcctgacagcttaaatattagctcctttagaaagtgggaaaaacagtcacttatcttagaaggacacagtatattaagacttttatattattcaggattataaatttaattatgaatattaagagattctaattgcttaatatctcttaaattaactagaagcccaagacagatgaaaattaatacctcttggggctaggatgtagtgattgttactagcaaacattttggatgcatccacagccaaggattaacctgagcaattagaatgcatccagttgtgtatactcacgcttcacagagtggcataggagccactgatagtgcacgcactggtctcacacaatattcctgcttaggctatgccaaatctatattttttccttcaggcttaaattaagaaataggctgtaagaaaaaaagacattcagacatcacttcattagtctcatcaaaaattattttatatcttcattagttattcagttgtgattgagtgttgagattttttgatcattttggaatttcacctttgctttttgctgaagcagaagataaagggactttttcctgcgtctccatctctgagctgggaaagtaggtgagaatcatttctcttcactcattgccactagcaatccagaaatcacatgcaattgagaaatcatgttgaggcagcttgcaaatgtataagcattatctcatttaatgcttacagcctggaccttatgaaacagatactgctattggctgcatctgactgaagaggaagccaaggcttagaggaataaagtaacttgtccaagatggcacagtaagcagtagagttaggattgaatccaagcaatctaactcctaagcttttaccattaaccattacaatatactaactctgaagcccaagttctgtatttgtgcatatgatcctgggaaattctctaagccattttcttctctgtaaaaagagataaaaggacctctgttatagggctattgtgaagataaactataacatatatatgttattcatatataatatgcttcatatataaagtgtgaagcatattatgtggcccattcttgctgttcagaaagccaattttcattccttttcttacacatttttggccctgatagctctgagaagtaaacagtaccgaattgcttgacttggagaaggtggggctccttctaaaaatcctttgtttgagaaagagaaattattgtacaattattttaaagcaaaacactatgcaaatttgagaaaggcttgggaaggggattatggctaggctctaaggatacttataaaatgccataagttttaattccaagaaaggtgactggctaataaacgtccagttatgtatttccatgtgaaaacaatttagagtcaataagaagtcaaacttccttgggcagatctctagaaatgtgggcagaatctgccatctgcagctattgtaggatatctctttgaaaaggactgctgtaatttaggaggttggaagtcagtggctaaatgcccaaataaacagcatttgggttaagagaaatggaacaaacttgtacggggtttaacttccaaagaacttacttaaggttttcagttgcttcctcagttactgagggtttttcctccaaggcttcttacaggttgaattaaaaaaaaaatacaaggctcctaactttaaaatgttaattctcctccccactcaccaacaacacaacacaaaacaaaaaaactatacacctccatttgcaaaaaaaaaacaaaaaacactgaaaagatagagaaggggagggaaagggtatgtgatctttcctctggcccttggatctcaacatagttggaagaagccctcttcccactgccaggtgatgagaattgtgcagctgagcctgtaacaaaggtacatctcacggaagcccaagcagaattctaggtggaagctgactatgagaagctgacagtgaagctgctttacctgggagagaggctcctccagattttcttcccttcagttgtctgatttaacataaatagtagctcatgcctgtaatcccagcactttgggaggctgaggcgggcagatcgtttgaggtcaggagtttgagaccaacctgaccaacatggtaaaaccctgtctctactaaaatacaaaaattaaccaggcatggttaatctcagctactcgagaggctgaggcaggagaatcacttgaacctaggaggcagaggttgtagtgagtgaagattgcaccactgtactccagtgtgggtgacagggcgagactctttctcaaaaaaaagaagaaaaagaatagccaagaacctagccttgaaatcccagctttcaaaacctcacttagggaagagggcctgctcacccgtgttggtgtaccctaagtttaacagattagattttcctggtagtacagatatattgttctctagacaccatcttagccccctctcagcacttttagtgatgtccttcatagacaattttagtttgtgtcatgttagttaacactggtgaatatatgtttgccctctctctcttcatgaatcagcctattttgatgaatactatgagacatctacaaatggacaatgactagaccatgtaaaaaaatagaacgttgacccatgacctgcccaagaaaccatcccccttatctacaataaacagtccaagaagccagcctgttataagtcaaacttgcaggaagccaggttgctgtctctgatgacaatccaggaagctaagtaataatttctgtaacaatagtcccctaatgagagccaggcatggtggcccttacctgtaatcccaacgctttgggaggctgaggcaggaaaattgcttgaacccaggagtttgagactagcctgggcaacatagtgagacctcatctcttcaaaaaaattaaaaaattagctgggtgtggtgtcacgcacctttagtcccagctacttgggaggctaagatgggaggatcacttgagcctgggaggtcaaggctgcagtgagcagtgatcactgtactccagcctgggcaacagaggaagaccctgtttcccaaaaaaaaaaaaaattcccaaatggccaggacttgattcataactgacagctttccttaatttttgttcccattttcaacttagattcaaccagagacagccaaacatgcaccccccaacccatcacacgagatgtcccactttttattaccttgactacagcttccccatgccaacagcctccattcaagccacatttcaagccttcccttttctcacctgtaaatctttgccactcctctgcctgcctttgagtttctgccaaaacacaaatggcagttatggtggcggacttcctcagtatagcaaggtctaaatagcgtttgcttttctcatttggttgatctttatttccacaatacagataatattttatacatattttatactccatatttttgcattccatatttcttctcaaaggaattctgcataatcaaattctggtaggacattgggtaagccgcacccaagagttaaccaaagttgtgggtaaaaaggaggtggagaaggagttatctgagcaattgaggatcattccctaaacccatcattaccataagactctcctaaaaagtactctcctacccgtttctaatcagttccttccacttcaggcaaccacttctgactcgtatcactatagatagatttgttttcttttgtatgtgtagactcatacaatatgtatttgtatttgactgctttcaatcaacaagatatttttgagacatattcatgttttatataccagtagttcattccttgttattgctgagtggtatttcattgtataaacatatcccaatttgtttattcattctcctgtcgatagatgttccggttgcttccagtttgcaactagtgtgaataagcttgctatgagcattcttataaaactcttttagaacataaacgttttcatttatattgggtagatacatcaaagtgaaattcctgggtcatatggtaaatgtatgtctaatttataagaagttgccaaacagttcctcagaatagttacaccatttttttatcccaccaacaatgtattagggttacacttgctccacatcctagccaaacttgctgttgttagtctttgattttagcattttaatgcatataaaatgttgttttattgtgccattaatttgcatttcctgatgactaattatcttttcctatgttttttggtttctcatacatcttctttaatgaattgtttattcatatcttttgccccttttttgactttttattattgatttgttttttatgttccagatacaagtcaaatataaaaatgtttaatgttaatgaagttcagtatatcaatttttttcttttatgatatggctttttgcatcctgttcaaggatgcctacccccaagaacatgaagatattttacttctataagttttatggttctgagttttacattcaggtctccaatttatctcaaattaatttttgtgtgtgaaatgagatacaagtcaacctggatagatatccagtctgttagcaccatttgttcaagagactttcctttctccattgaagtgacttggcaccttggacaaaaatcaattgatgtatatgtgtgggtctatttctggactctgttctgttcccttgatctgtttgtctatgcttatgccaatatacatttgtcttgagtattgtaactttaattcttgaaatgtggtagtataagccctaagaacaaaaaataatatttttaagattattaaatagcatctctagagattattttcctattctagagcctttgcatgtccttagaaaattttatttaatttcagatttttgtgggtacatagtaagtatatatatttatgaggtacatgagatactttgatacaggcatgcaatgcttaatgatcacatcatgaaaaatgggatatccatcccctcaagcatttcttctttgtattacaaacaatccagttatattcttttagttattttcaaatgtagaattaaattattttcactacagtcaccctgttgtactatcaaatactagctcttattcttactttctaacaattttttttgtacccattaactacctccatctccccgctacccttccccactacccttcccagcctttggtaaccatccttctactttctatcctcaggagttcaattgcattgatttttagatcccacagataagtgagaacatgtgatgtttgtcttcctgtgcctggcttatttcacttaatataatgactttcagttctatccatgttgttgtaaatgacaggatctcagtctttttttatgtctgaatagtactctgttgtgtctaagtaccacattttctttctccattcatctattgatggacacttaggttgcttccaaatcttggctgttatgaacagtgctgcaacaaacttgggagtgcacatagtgcagatagtgcagttatctctttgatatactgatttcttttttctttttcttcttctttttttttttgagacaatctcactctgtcgcccaggctggagtgcaatggcacaatctcggctcactgcactgttaacctctgccacctgggtcctatgttcaagcgattctcctgccttggcctcccaaggagctggaattacaggcatgtgccaccacgcccggctaatttttgtatttttagtagagacggggttttaccatattggccaggctggtttcaaacccctgacctcatgtgatccacctgcctcagcctcccaaagtgctgggattacaggcatgagccaccacgcccgactggatatattgatttcttttcttttgggcatatacccagtagtgggattccggatcgtaaggtagctctatttttagttttttgaggaacttccaaactgttctccatagtggttgtactaatttacattcccaccaagagtgtacaagaattcccttttctccacatcctctccagcatttattattgcctatcttttggttaaaagccattttaactggcatgagattatatctcattgtagttttgatttgcatttctctgatgatcgtaatgttaggcaccttttcatatacttgtttgccatttatatgtcttctttggagaaatgtctattcaaatcttttgccagtttttaaattggattattctgttttttcctatagagttcttggagctccttatatattctggttactaatctcttgtcagatggatagttttcagatattttctcctattctttgggttgtctgttcactttgttgattgtttccttgctgtgcagaagctttttaacttgatgtgatcccatctgtccatttttgctttggttggctgtgcttgtggggtattattcaagaaatttttacccagaccagtgtcctggagagtttcctcaatgttgtcttatagtagtttcatggtttgaggtcttagacttacctctttaatccattttgatttcatttttgtacatggtgaaagacaggggactagtttcattcttctgcatatggatatccagttttcccagaaccatttattgatgagactgtcttttccccagtgtttattcttggcgcttttgctgacaatgagttcactgtaggtgtgtggatttatttctgggttctctattctgttccattggtctgtgtgtctgtttttatgccagtaccatgctgttctggttactatagctccgttgtataatttaaaatcaagtaatgtgattcctccagttttgttcttgttgctcaggattgctttggctgttctgggtcttttgtgattttatataaattttaggattttttttctgtttctgtgaagaacaccattggtattttgatagggattacattgaatctgtagcttgctttgactaatatgaacattttaacaatattgaacaatccacgaacatggaatatctttccagttttttgcatcctcttcaatttctttcgtcagtgttttatagttttcttgtagagatgttttatttcttttattaattactaggtatttaattttatttgtggctcttataaatgggattactttttttatttctttttcagattgtccacctttggcatatagaaatgcttctggtttttgtatgttgattttatgtcctgcaactttactgaatttatcagttctaagagttttctggtggagtctttggatttttctcagtataaaatcatatcacctgtaaacaaggataatttgacttcttcctttccgatttgtatgccctttatttctttttcttgtccaattgctctaagtaggacttccagtactatgttgagtaacagtggtgaaagtgagtatccttgttgtgttccagatcttagagaaaagctttcagtttttccctatccagtataatattagctgagagtctgtcatatatggcttttattatattgaagtatggtccttcaatacctagttttttgagggtttttaaccacgaagggtgttgaattttataaaatgctttttcaacgtcaattgaaatgatcatatggtttttgttgtttattctgttgatatgatgtatcacactgattgatttgcatatgttgaacctttcatgcatcccagagataaatccaacttggtaatgatgaatgatctttttaatgtgttgttgaacttggtttgctagtattttgttggggtttttttggaaatatatttttgcatcaatattcatcagagatattagcctgttgttttctttttttgatatttccatgtctggttttagtatcagagtaatactggcctcatagaatgagtttggaagtttctctcctcctttatttttcagaataatttaaataggattgacattggttcttctttaaatgttggttaaaactcagcagtgaagccatcaggtcctgagtttttctttactaaatggctttttattacagctttgatcttgttacttgttaattggtctgttcaggttttggatttcttcatggttcagttttggtaggttgaatgtgtctaggaatttattcactttctctagattttccaatttattggcatgtagttgctcatagtaaccactaatgctactttgaatttctgtggtatcagttgtaatgtttcccttttcatttctgattttatttatttgggtcttctccctttttttcttcattagtctggctaaaggtttgtcaattttgtttatctttccaaaagataaacaacctcttgtttcattgatcttttgtattttcttcattccacattcatttatttctgctctgatctttattatttcttttcttctactaatttggggttttgtttgcccttttctagtcaagatgcaccattaggttattaatttgaagtttttcttcttttttgatgtcagtgctgctgagaccagctcggttggggagaccctaacccagtggcgctagaggaattaaagacacacacacacagaaatatagaagtgtgaagtgggaaatcaggggtctcacagccttcagagctgagagccccaaacagagatttacccacatatttattagtagcaaaccagtcattagcattgcttctatagatattgaattaactaaaagtatcccttatgggaaaagaagggaagggccaaattaaaggaataggttgggctagttaactgcagcaggaacatgcccttaagacacagatcgctcatgctattgtttgtggcttaagaatgcctttaagcggttttccaccctgggcgggccaggtgttccttgccgtcattcctgtaaacccacaaccttccagcttgggtgtgagggccatcatgaacatgttacagtgctgcagagattttgtttatggccagttttggggccagtttatggccagattttggggggcttgctcccaacgtgtctcccttctttgatttgcaaagagataaaagcaagggcggctttgtcacagtgagctacttcttgcaggagtcagaatctgcatctgcagactatacaaagaaaaacaacgtagattaaaagcacagtcatcattgaaatcacagagcttccaagtgtttttatccattttaatggattactagctgctaatttgtctgcagcgcctttaagcactccagttcctggcattaaggtcaggtgtgcctgggatgctttaaatatttgttctttaattttgcaatatccaaaggcaagtttgtagagtgtctttgtagatggtttttattttttcctaaattttgatcttattaagagctattaatagtttccacaaatccttatgtttagctcccacaacgagccctatcatttgaggttgaggtgccactataccaccatggttccagataataggaacttttgccgtactttttggtatttctaccatgtgatcagtttgttcagatcatctgaacatagtctggccatggcacgcagactgagaggtgcaattcaagcttaacattcccttaggggaccaattaataatgattccataggaatcgttgtgcagcacctctgcctgttttgcaaagcaatcttcctaaacaagtacgttcattttttctaactgggtccaatcctgtttacaaataggtttttgagggtggtatgcctcaattataggagcagatttattatggtaaataccgagatcagaaagcatgtgtaactgtgtcatagagtgattgcatccaggcattattaccggcccttattgaaggaatactcacgacagtggtgataaccactatcatagctaccattaaattattcattgtgactggttgtcccgctttcctcaggttttcttcctccatctctgacagcttcttgatctgtccccaggtgggtggctgtggttgacgggtgttgctcgtaactgttggggtcctcctcagcatcggtctcgacatggctgcaaccggggggtcctcgggatcctcctggagtctcttcctcggcatctggctcctgataaggtttcaggtgtcttgatggtatccaaatcggctgttgattttggcctggagaaatacaagcataacctctaccccaagttattattttacctatttcgcacctttttgttattggctctgtccaccaaatcagttgttctgtttctgtctttgcagctggtttctgtagatgctgttcagctgctgatagcatctggcctttgggcaggctcaaaaaatttaaagttaataatgctaggttcagttgcatttgtgggggttcagtattctctgtctctccctttctgcttttgcaactgctgttttagggagagagattcattctttccactatggcttgtccttgagaattgtatgggataccagtaatgtgtttaatattccacatagagaaaaatgtagctagagcttggctagtatagcctggggcattctctgttttaatagaagcccatcaccacaaaacactgcaaaaggtgacatttaacacgggcagaagactcttctgattggcatgcagcccagacaaagtgagaaaaggtgtccacacatacatgtacataagctagtctcccaaacgagggaacatgtgtggcatccatttgccaaatagagttaggttacagtcctcgagggttaactcctcctgtaaaagatgaggaatgtaccatttggcaagttgggcatcactggataatagctttagcttcattccaggtaatgctatatctgcatttgagaccagaggcattgacatgggttgaattgtcaaagtgtccagcattagatattgcaatagcaactaggccatcagccatttaattcccttcagtcaaaggtcctggaagaggtgtatgagctctaatgtcagtgatgtaaaaagggtgcattctactcctaactgctatttgcagttgggtaaataaagtcatcggttgttcatctgtatgaaatcgtaactgagaattttcaattaaccgtgtggagtgaaccacatatgaagaatcagaaatcacattaataggcatttcaaaagcagtcaatacctcaattacagctacaagctccgcttttagagctgaagtatagggcgtctgaaaaactttaccttttgattcaaaataagaagctttaccattacgagacccatctgtaaaaacattctcaacaccttcaattggtttaaatttagttattttagggagaatccaattagttaatttcaaaaaactgaaacagcttcgttttaggaaaatgattatcgagaatactcacaaagtcagctaaacgggtttgccaagtaagactatttataaaagcttgctgtatttgtgccttcgtgagagggacaataatttttccaggatcatatccatgtaatttaacaatccgagttttcccaatccctatcattgtagcaatttgatctaaataaggagttagagtccgtgaattagtatgtggaagaaaaagccactctactaagtcctgttcttggacaataacaccagtaggtgaatgctgagttgaaaaaattagcaaatctagggtcttctctggatctattctatttatttgagctttatggacttgcttctcaatcagttgtaactctgcctctgcctcctttgttaattgccaagggctagtgagactaggatttcctctaaggatagaaaacagattactcatggcataggtaggaatgcctagagcaggtcgtatccaattaatatcccctagtaatttttgaaagtcatttaatgtttttagttgatccctacgtatggttactttttgtggcacaatggtagtgtcatttactcaggtccccaagtaggagtagggagtagtagtctgaattttgttaggagctataattaaaccagcacgagaaattgaattttgtaagtgatcatataacacttagcaggctgcaggttgtttactgcaggaattgtaaatgcaaaccattcacagtgttgctcagctaaagggatagtaaagaaacagtcttttaaatctatgactgttaaaggaattgatggcttttaagtcagttaacattctccatttacctgattttttcttaattacgaaaactggagaattccaaggggaaaatgttggcgctatgtgcccattttctgattgttcagcaagcaatttctctaaagcctccaatttttctttacttagcggccattgttctatccaaattggcttgtctgttaaccattttaaaggtataggttctggaggcttaacaatggccgccatcaaaaatgatttcctaatctttggtgggaactttgtttttccactttaagcggttctttcaaaccatgcaaatttttttctagtcccataccagggacataccccatttcatgaatcatatgttgactttgagggctatataattgttctggaattagaacttgtgctccccattgttgtaataaatctcttccccataaatttataggtacagaagttataattggttgaatagtcccaggtcatccatcgggcccctcacaatgcaaaatataactactttgatatacttcagtggctttaccaactccaactatgttcaattgagcggattgaattggccacgtggacagccagtgctatagagaaatgattgaaatgtccgttcctgtatctcccaaacctttacatttccttccctgaatagttatttcacaggtaggacgtttatcagtaatttgatttacccaataagctgctttgccttgtttatttgtgcttccaaatcctcctgttcgtttaatttcactttttcccattcccacatatggcacaatcaggagctgtgctatgcgctctcctggctctgctttccagggaacagaagtagatataacaatttgaatttccccattgtaatctaaatcaatgactcctgtatgtatttgtacgccttttaaacttaaactaggccttcctagaagtaatcctattgtccctgctggcaagggtccacagactcctgttgggaccttttgcgggggttccccaggcagaaggctcacagcttttgtgcagcataaatctactgcagctctaccggctgtggtgggggacagacattgtacaggggtgagggaatggcctgagctggaaatgccctggtttagaatggggcccgggacaggcccctcatggtgtttcccaaaatcaggttcccatctttatcaaacttagagtgacactgactagtccagtgttttcctttttttatatgttggacctatttcagactcaacagttttcctttttcctctatctggcggcctgactcgctgattttttctacattcttttttagtatgaatagcttttttaaattctttgagtaatttaaaaggaaaaggctcaaatgtagctgtaatatttccctgttgatctggggggtttgttctaacagggaaccgccaaacctctaaatcaccctctcgtatagcttgctgaattcctgcctgaatagaactaagagccgtcactcgaggtgccgctcgaagagtcactggggcaactacttttcgcccaatgtcctccggaaaagaaagatccggggggtcattttcttcaaaataataaggagggggtgcagaagggtagggatgaacctctccttcctttgccactttagctttagctggcaaataaacctgctctgtaacctcttctgttacttcactattctcttgttcctcctcattatcagtgtgaaaaagttctaaggtgaaacgaaccagaccccatccctgtcccattgttaccctgaggcatccgaactccccttcttactcaccatggggactgctttaagagtactcgggtgtcctccagctagttttctgttccaagcatcgcttcagcaaccctttgacctggatttgagcccccacgaatggacgccacttgcgcgagaccagctcggtcagggagaccctaacccagtggcgctagaggaattaaagacacacacacacagaaatatagaagtgtgaagtgggaaatcaggggtctcacagccttcggagctgggagccccaaacagagatttacccacgtatttattaacagcaaaccagtcattagcattgtttctatagatattaaattaactaaaagtatcccttttgggaaactaagggaagggccgaattaaaggagtaggttgggctggttaactgcagcaggagcatgttcttaaggcacagatcgctcatgctattgtttgtggcttaagaatgcctttaagtggttttccaccctgggcgggccaggtgttccttgccctcattcccgtaaacccacaaccttccagcttgggcgttagggccattatgaacatgttacagtgctgcagagattttgtttatggccagttttggggccagtttatggccagattttggggggcttgctcccaacaaggtgctgatagctttaaacttccctcttactagtgcttgcactgtatcccataggttttgttatgttgtgtttctgctatttgtttcaagaaacttttcagtttccttcttaatttcttcattgactttgacccactggtcattcaggagcgtatttaatctccatgtgtttgtatcatttccaaaattcctcttattgatttctggttttattcaaagatgcttgatattgtggtaaaaaatgctggatatttcaaattttttgagtattttaagacttatttgtgacctaacatatggtctgtccttgagaataatccatgtgctaagggcaataatgtgtattctgtagcctttggatgaaatgttctgtaaatatctcttaggtccatttgttctattaggtcatccttagtgtaggttaagtccagtgtttctttgttgattttctgtctgggagatctgtccagtgctgaaagtggggtgttgaagtctctaactgttattgtattgaggtctctttctctttgagacaaggtcttgctctgttatccaggttggagtggagtggtgcgatctcagcccgctgcagcctcaaccttacaggctcaagtgatcctcctgcctcagccctctgattagctgggactacaggcatgcaccaccatgcctggctaatttttgtatttttttgtagagacagagttttgccatgtttcccaggctggtctcaaactcctgggctccagaaacccacccacctggacctcccaaagtgctgggattatgggcatgagctattgtgcctagcctgaggtctatctctttagctataataatatttgctttacatatttgggtgttccagtgttgggtacatgtatatttataattgctatatccttttgctagactgacccctttatcattatgtaatagcgatctctgtctcttcttataatttttgtcttaaaatctattttttctaatgtaagtatagctactacttctgctcttttttggtttccattggcatggaatatctttttccatccatttattctcagtctgtgtatctttataggtgaagtgtgtttcttgtaggcagcagatcattgggtcttattttttcatgcatttagccactctatgtctttttattggagagtttagtttatttacattcagtgttattactgataagttgggacttactcctgccattttgtcatttgttttctggttgttttgcggtcttcttttacttcttcccttccttccttgtcttccccttagtgaaggttattttctctggtggtatgacttaatttcttgctttttattttttgtgtatccgttgtgtgtttttcaattcgaggctaccatgaggcttgcaaatattattaatgtctcataatccattattttattttatttttatttatttattttttgagacagagtttcactcttgttgcccaggctggaacacaatggtgtgatctcggctcactgcaacctccacctcctaagtgattctccagcctcagccccccaagtagctgggattacaagcatgtgccaccacgcccggctaattttgtatttttagtagagatgggctttctccatgttggtcagactggtctcaaacttctgacctcaggtgatccgcccacctcgacctcctagagtgctgggattacaggcgtgagccactgcacctggcataacccattattttaaactgatgacaacttaacactgattgcataaacaaacatgcaaaaagaaaactaataaaaactgtacactttaacttcatccctctgctttttaactttttgttgtttctctttatgtcttattgtactatgtcttgaaaagttgttgtagttattatttatattggcttatcataacactgtaattatggtatgtgggagtttacatgccacaattacagtgttacaatattctgtgtttttctgtatgcctactattaccagtgagttttgtatcttcagatgatttcttcttgccgttaacatcctctcttctttcagatggaagaactccttttagcagttcctgtaggacaggtctggtgttgatgaaatctctcagcttttgcttgtctgggaaggtctttatttctccttcatgcttgaaggatatttttgccggatatagtgttctagggtaaaagtttctttccctcagcactttaaatatatcattaccactttctcctagcctgtaaggtttttcactgaaaggccagctgctagatttattggagctccattgtatgttttttttttttcttttctcttgctgcttttaggatcctttctttatccttgacctttgggagttttgttattagatgccttgaggtagtcttcttttggttaaatctgcttggtgttctataatcttcttgtacttgaatgttgatatctttctctaggtttggcaagttttctgttattattcctttgaataaactttctatccgtatctctttctctatgtcctttttaaggccaataactctaagattttcccttttgaggctatttgctagatcttgcaggtgtgcttcgttttgttgttgttgttgttcttttttcttttgtctcctctgagtattttcaaatagcctgtcttcaagctcattaattctttcttctgtctgatcaattctcttattaagagactctaatgcattgtttagtattcagttgcattttccaactgtagagtttctgcttgattgtttataattatttcagtctctttgttaaatttatctgatagaatgctgaattccttctctgtgttatcttgaatttccttgagtttcatcaatatagttcttttgaattccctgtctgaaaggtcacatatctctgtttctccaggattggtccctggtaccttatttagttcttttggtgaggccatgttttcctgcatgatcttgatgcttgtagatgtttgttggtgtttgggcattgacaagctaggtattttttatagtcttcgcaatctgggcttgtttgtgcctgtccttcttcagaaggctttctaggtattcgaaggaatttgagccccgagtccaataatgctgtggtttttgcagattcatagaaataccaccttggtggtcttggataataaagatctggaagaattctctggattacgagacaaagatttgttctttttcctcactttctcccaaacaaatggagtctctttttctgtgctgagccaccttgaactggagtgtgttgatgtaagcacccctctggccattactgctgagactgctgggtcagacttgaagccagcacagcacagggtctcgcccaaggcccgctgtaaccactacatggctgccacctgtgttcactcagggccctagggctctatagtcagcaggtggtgaagccagccaggtttgtatcctccccttcagggcagcaagttcccccaggtcccaggtgggtacagacatgttgtccggaagccagggattggagcaaaaagccttagagatttcttagcactttgggagtccaaggtgggtggatcacctgaggccaggagtttgataccagcctggccaacatggtgaaacccatcaagaggacagggaccatgttgtatgtgttgttcgccactgtatccacaccacttagcaaacaataagtatttgtttaaataaaattaaattttagctgggcatggtggctcacatctgtaatcccagcgttttggaaggctgaggtgggaggatcacttgaggccaggagttccagaccagcctggataacatggcgaaaccttgtctttactaaaaaatacaaaaattagccgggtgtgcttgtgtatgcctgtaatcccagctattcaggaggctgaggtgggaaaattgcttgaacctcagaggcagaggttgcggtaagccgagatcatgccactgcattccagcccgagcgacagagcagactctcaaaaagcaaaaacaaaaaaccttagagatttgcctgatgttctattctgcagctatgctggcactcaaaccacaatacaaagtccttcctgctcttctctcctttttccacaggcaggaagcctcttcctgtggccaccaccacaagtcattcttacatacacagatgttagtgtagtaatgcagcaaggaattcccagggaaatcggttttttttttcctgtatttcttctgtagctttgccaaacaaacaaaacaaacaagaccccaaggtcactgatccaaatctgaatcagtgaaacggtctgatgaaacactttttttttttttttttgagatgaggtctctatgttgcccaggatggtctctaactcctgggctcatgtaatcctgccgcctccaccacctgagtagctgggactacaggctaatgaaacactttgataagataaatcgtaatctgctaggaactttcttctgttcagtccttaaaatctgaagatgtttagaacagatgggctttttgatgtagctctccagaggtaattattttctttttaaaacagctaggatcattctcttactgatcagacatatgcttctccagcctcatacaatctcccctgtcctctgagggctgctgattgtctctgtcctcttaccttcaccatcttagaaggtagagccaagtctacatgggtgatatggtacagtgaacaacatggttactaaagagctggattagttttaagccaccccattaagcctgaactgatgtggaatagtcacaagaacgtaagtcagggacatgaagaaaccctttgctgtaatctaccataccagttattgtccagggtggagcatgtaatcatattttttataacaatctgattatactttctgccattttttattgggaatttgaacattgcaggttaactcataaaactgtgaaagggcaagataaacataggatacaatatatttaattaagatagcaaaacctttctgtactttcttacaatggcttgtaggagatctggagcagatcttcaacttgctaatattcagttaggcccagatttggtatttggaagaggcagtttattagaataatggtgctcctactcaaggaagaaacagcatctataatacttagtgtgatcagggacttgactttaatgaaatttcaaatagaagtaaatttgacttacttcgtcatgtggaccaattctagccaaatattgtggatttgagattaggaccagaaaactcagggtctacttcggatgacagtaccccaggaggatctggtctttctactctatgcttggaatgaaccaggtgagatgtttgggtcccagccagattcttggggtcattgtagattcacacagacttaaatgacttcatcttatcacccacagaaataaggatgaaccatagccaattcatttcattctacttcttgaagtgaataggactgtaggatcaaagttaaagactgtaatgaagatcacacactggactgtgtatcaagtaaggcccagatttacctttatagacttaactcactctatttgcttttctttttttttttttaaaggctacaactgaggtggaaattaagaagaaaggccctggatctcttttagtttccatggaccaattagcctcctacgggcggaaggacagaatcaacagtataatgagtgttgttacaaatacactagtagaaggtatgtgccctataatgtcagtccaaccgctgagatataaatatgtaatgtgcatggtaaatataatccctgtcccttggtctgagttttgcaaagactgtctctgagctttaggaatggaacgtattcctatatagaaactagaatcacaaattctcttcctaaatttacatgcagagaatcaaatatatgggcttcagatatgctgccagcattgtacacaggtacgtaagagataggaaaggacctgcatgagtgacctagaggagctcaagacccctgtcattgtcatcatgaggagtcagtggggtgctgtaaggcataaaggaatgtagactgaagaactgcaaagatacaaaatcatagaatttccctcatggtctctaccccaaaacataccttcctttttcctttttaactacttacagcccttttggttttcccttaaggaagaatgtactgtgcgttttgattgcacctagttctgtctctcttcaaacacccccacatatccataaataaatttgatgtgtgactaggtaagttgaaacccttcttactttgagtgctccatgccacagggaaagagcaaccgctgttgaatcatagcacgtctgcagtaatgttgctgtcagtgcctgagttctctgtgttaggtgggttctctgtgacacaacctggcgtgctgaggaatacctgaagattttccattaggccacagtccccctagcaagaatcagctcctctccagttatggtctgtagtccaggatctgcatgctttctttagaggtaaattcagtgacagatttcctctcccaagattctgatggattctgcacctatcttcttcattggatttatgttgatttagctgagttgtctcattgtagatctagactattcttgaggcctcaaattgctattcttcagaatgcagatgcctggaataaccaaagtccctgagacaggaaaactcaaaatggtcccagtatccttgagacaagttatttttttagtcatttaaacccagtgccacttctactctgtgtgtatgtgtgtgtgtgtgtgtgtgtgtgtgtgtgtgtgtgtgtgtgttggggagggggttgcagtggagggagagtccctagaaaagaattctctaagggtgcttacttccccacatatgtgcaaagaatgagactataactagactgaccttgagaatatctcaagtaaaaaaatgaattaactgctttcatctgccttaacaacctctgtttattcctgttttctttaattaccatcggggttattgtctgatagaacatcttcaagctttgtagcttatactttgagattgtgggcaaataactgcaggtcctaagaattccaagctaagaaatcctagcctaagaactttggctaattttattattcacatagagaccaagacaggatttctctgggtatctgtggcagttgagaaagaaaaactaacaacctccaacaggtgcattttattattggtagagacatcagaacagcagaactatcaatacagtgcaacagttatttatttattactgcattggcttagcacaggtcccagcaaaagtagatgctcaaacaatctttgtcaagcaggcattggctgtgcttagaatggtaggagtgctggtgctgcagggctcctttcggaggccttagagctttcatccctttactgagttggatacaaaccattgggacgttttaaaattctcttttctgcctcttctccctgttctttctctttctgtcctgctgtgcttattctccaccctttacccaccatcacacacattaaaaaaaaaaaatagatgtaagggtagctcaggagacagagacagatgtagttgtgttcctgaataggaaaatattattccagttttttgtcctctttcctaagccctgattttcacatagttatacctgtcctgccatttcctgctcaggcattccgcctaacctctccccttgtatttgacccttttgttgaagctgatgggacagaactgctataagcaaagagcaatgaatggctgaccggaatcacgtaagagggaatgaaacatccatgtctgtttaaccattggtccctctgtatttaatgcttgctacagcattaaaagccagcattgaacgaattgtagttcttgctctcagactttcagttaggaaactttgacattattttaatccaaagattaaaataattattatttaaaacccaagaggcaggctacgacttacctaatagtttagaaaccacagtggagaattctagaatcctgtcaataattagaaaaccctgcctgctctgccccaccccattcctattgcaaacatgcttaccaggatccagcacatttagtagagttcaccactagcagagctataagctttggggatatttcagaggactgggcgtggggtgtaggtagagtagtatagtctcactcttcaaagcagtaaagctgtgggagaaggggagatcgtggtgaagtaagaaagaggaagtagtgatgtacttgacattattgatttttaatatcaaggaagtacttgacattattgattctcaggtaaaacaattccaaaaactcccctagaggtaactggccatagctattgctgccactatttatgtattcttttatttaactgaccagcatcaagtgtcagtatagttacttggctgatatcagcctttcctgtgtggcagtaaccttagtgagggtgggggctcttcatcagtgtatccttggtgcctagcacattgcagatgcttaaaagttgttgaactgagttgagggaagctcctgccttcagaaacctcatggtctaccaaagccactatcttggtgaaattgtgaggtcctttctgaaaacaattcccagtacccctgaggttaagacccaaagtaacctctctgaaaatgtccaaaagcaaagtaagagaaaccccacaaacctttggacatctcacccctagatgttaacccattcccccaagccaaatactgggccattccaggcatgtggaaccagtaacagtttgcaaagtcataagtcacttgataagccttcttattccccaaatgatcttttctagctcctgaagctccacattgtcttactttttgtaggcgtgaaagtttatcctgaggatcttcccttctcagtaaatgtggctaagagatgtctggtatccctagaggaattttcttggtgccctgtagggcaggaaaacccctttttgctgtgtggcaagactcaagacctagttcattttaaaacattacaattgtgtcaactgtcataaatgtgagcagtcgcagcttcaacctccacgtgccaatgagcaacagtcgtttggagaagggaggagataaaaaagggaacggaactaaatttccaaatatgtactgtaagaatttatggaaataagagaaccttgtcattttcttttttgggggagaaaactatatttaccttaggaagggagggagttctctgaggaagaagccacagcagattttcctcacagacttcctttcccacgcagcctcccacgtggcgcttacaggggtccttaaatctgaaaaaccaaggcaaccattttcttagcaaccagggaaccaatcagaaactcagccaaaaccaccttgtctaaaataaagcatcgccatccagctggttggaaaagggaacgtaggctaatttaaggcagccatcttggttttggtgaaatgttagggaattttttttttccttaaatgatttgatagtgtcagcagaattgaacagagagagagtagctgttacagccaaccctgtagaatcaatacctcacattctgacaggttttcaaagttcacctcttaaaaagcatcctcttagctcagggtccttggaattttgtaatcctggcagttgtatttcatgcttaatttgaggagagctttgttatgtagggcttcatacctagattgttgtaactgccagttgagtgtctgtctttgatatctgataattcttttgaatctttgctttggaaatgacctttgagatcgtctagtccagtgatttttcagtctgtgtgtatcagagtcctgggattctaggggagtgcctcaggagaggaagaaatctatccaagtgggctcctgcttcatctagggaaattcctggtgtatttcatgtattgggggtcatgtgagatcttgtctgacaataacactttctgtttctaaaagagacggagaagataagacaaaggagagaaagaaaaaggaaagaagatgatgacccagggagggaaggaggaagaagctgtagaaagaaagagaaaagcaaaggatgagagcaggaaagggcaaaggggcaagaaagaaggagacaggaggagacagaacaaggaaggaaaggtgaaaaggggagaggagtgtgacttgtatttctaactcaaccatgagctgtaaacttgttaagggtggagacagtaacttgtacttctttgagaacatagcagatgtgttttacatggtggcttggtcgatgatgctggtcctgctaatgaagataataataatagcaaacacttccatggcactttctatctgccagggtattctggggcactttgtatatattttagctctttaattctcacagcaaatcaaagtaacttgttcacggtcccacagttagcaagtgtctgagctagtatttgaactcaaatatgtctggcttgagtccatacttttgatggcttctctgacaataattgaataatatagtgtataatagaatacctaccatttattgaggatttaccctgtgccagatactatagtgactgctttacaccagcatctaatttaatcaaactcattcagtcctgtaacctgtaaagtaaatgccttgttttacagctgaggcagctgagcagagaaatcagctaccttgcctgggatcacacaacttgtaagcattcaagccagttgaggccagggagtcagacctgagaggccaagctcttgacctctgtgctcgactcccataactgatgggttgagtttcatttataactagatcattattaacagggaggcaacttgtgtggatcatgcttcctctctaccttagagagaaggaaaacacttaggaatgtcagcgctcaaaacaaccttgattccatattaataacagtgataatgactgagagtgagtagtgtgtccccctggttttcttgctgtgattgaggggccatctttgttcttacttactgtagaactggaagagtctcagagaaagtgcccgccatgctggtataaatttgccaacactttcctcatctgggagtgccacccctactggataaaactgaaagagattgtgaacttgatagttatggacccttttgtggatttagccatcaccatctgcatcgtcctgaatacactgtttatggcaatggagcaccatcctatgacaccacaatttgaacatgtcttggctgtaggaaatctggtaagatggaacactgtctcccgatattaggattggaatgtgttttgcctgtaggatatctttttctggtactgaaagctggagtttctttgaaaagaaagtaatagttaattggaagacaaatgcttccacatatgccaggacaccagctgcttttctgctcactgttgtgatccctttcctctttctgcagaactttgaagacgtcatttaggagctattggcagaaaaccaatgttggcgacagaatgggaggcctggtacagtgggttggtttcagcagcctgagccaagtacttctggtttttttcctcattctgtttctcacattgattcctgcattgctccagcaaatcagttcccctttcaccttaagtaacatctaccacaaaataggggagctcttatagtacactacatgtaactatggatttgcctgctctgtcaggccttaattacctaaatggggactatttatgggaaagttttcactcaaggctggtttccccctccaatccaacttctaggccattaaagtatgtagttttaaaaaaaatagattacaaagtgtgtattctgaaattaagtagttgtgatttgaggattatgtgctttgtttactacaaaaatcaggagttaattgaattttgatagatagtaaagaattagtgagaaagaatcccctaggtcacctgggccccctaattccttaggtgttaaccacaggcatgtccaaatctggctattaccgtttattaatgatttgagcatgatttctgcccagtttctcttatgtgtgctctctcactctctctctccctctctcacacacacacacacaccacacaccacacagttttgaccttaagtcctattactatactattagagcactacaatatcattttcatttctcattctcaaaacacatggcaaagagatcctttgtagcccattgtgttccctggtatacatccaagatgattctgtgatctttccagtctccatgtctgtggttggtgacatgctccaggctctctgcaatgatgtaaacccttgtgtgcagtccagtggaatgcccggagtcttgaaatgggacactcccacagactgtccaagaagtctgctgactggctctgaaaggtgcctgtcagtgggcacatgctgtgactggctgacacagtaccttggccatcaagcagaattttaaccctgtcaacaatatcatttagatataagcttgattttagtagccaagagttaagtaacaagaaatatgtcttgataatttttattgttgatgttggtggttctgttttccctgtagagttttgtttttctcaaaatctttacttttccttactttttacagaaccagtctttgattttcaagggattttgagaggctttttcacctatccccactagaactccagtcagaccaggctagcaaataatgttatttttcctttcatgaaaatttagagatttaggatgacatctaaattagaattgtaagtatgcagaagactttgctcagaaccatcagtaaaaaaagaggaaataagagaaggtcaacagctaatattcaggaactccatgagacaagccaacccagaaccaagttctagaataagaaagctcttaggtggcaagggttttcaaacggcaagtaaatgtacaattagcagtggggagggagcttagtatatagtccagcatactttgtactagatgtgagggtaaaaggaaagaaatcaagaatggtgcctcgatgtgggggtttaataactgagggaaaagtggaatgactgcaaaggaactggcttgacgtataaaatcaagagttctgttttggacatattaagtgtctattcactgagtggagatgccaaataaggaagttgggtacgtgctggacctcatgagtgttttctggacaataccagaaactcaaagatatactttgttgccaatcaacacgagcgctgagattggcagaaagaacacagaattggaagtcagaagatttgggttttcattcctattagatatcgtataaccttaaataagtcattgatttctgtccagaaatgtttcacatctgtaaagttaagataataccatgccatcactggttgggaagataaaatgagaacctatatggaagtctttgggatagctaaaagtatcttataaatcttaggaactgtgttagtataattcaataggagaattttcaaagatttggagaattgggtagaggctttgactgaacctgagaataagaggatggaaaaaaaatgagactgacttgtgaaataaagtatgaccttgtcctgtggttggaatgtgaggcttttcctatagccctaattgtgagttaagttgtctttgtctgtagacatacagaaagatgtttttaaagaaagatgagaacagtcttctgcaaattgaagatccctgcctcttctaccctccccaaaagagaaaataatagtaggaagaaccttagagataattcaatccaatccacatgttttatagaggaaattgaagcccagggaagctgtgtgacttatacagcctctatgttatgtagtagataaatgtaatgattcttttcctgccttttttgcaactaactgaatacaatagtaagtttatgaggtgactttttaaacattctgaatcttacaggaaagtttcaagtacagtacaaaaaacttctttttttttttttttacaataaaagccttatcacatagccttatcacccccaaatgcttatagtgtgtattttttatacacaagtacgttctcctacataaccatagtataactgtcaaaaccaggaaattaacattgatacattacaatgttgtgaagtaaagtatgaccttgtcctgtggttggaatgtgaggcttttcctatagccctgattgtgagttaagttaagggtctaattctcaggccctattcaagttttgccagtgatcccagtggtatcctctgtaacaaaaggatgcagttttaggattaccccattacatgtagctatcatatctctctaattttcttcagcctggaggagttcctcagtctttccttgactttcatgtcttgacattttgaagactacaggtcatttgttatgtagaattccctcaatgtgggcttgtctgatgcttccttatgattagatgcaggttctgcattttggtaggaatatcagataagtgagactatcttcttcatgttgtatctaccagttggcatgtagcttccatttgtcccactactggtgacgttcatttaatcacttgattaaggaggtgtctgccaggcttttcatctgtgaagttacgctttttccatttacagtaagtccccacttaacatcctctataggttctagatttttggaaactgtgactttaagctaaatgatatactgtataacaaaaccagttttaccataggccagttgatataaacaagagttaagttcctatggcatatagtacatcatgtggcttaaagttgctgttttcaagaacctattgaggacattaagtgaggacttactgtatacttaataggtatttgtgaggaagaccgtttgaaacgatttaaatttcctgttcattcagattttgatttcttcctttatttatatcagtatggattaatggttttctattttatctgagttacaatccatttgatgtttagacttcctctgatgtggccagtggaaattccttcaagctggcttctgatccctttcacatgtcttcttcacttcctggctttctggtaccacaaggtattccaggatactttcgtgtttttccagccccagggctggaatcagccatttctcaagaagccctgagtcttttagtggaaaaatggcatttagaagtagagatctaggctgagtatcagctgaggcaggaggatcgcttaaagtttgagaccagccttagcaacacaatgagaccccatctctaaaacaaaatagaaaagaaaaaaaaaaggaagaggtggagatctgagatctaggtatgcatattgctatgggagcagcatgcagcccctcttaggacatgatgagctatttatattgagctagccgtggatattgcaaaccatgagttgatcctgtcacttccaattctaatccaacacttcaagattctttctagttttctccctttctgtatttgtaactcctgcaacaataagaaacctcgttgccactatctttggtatacttatttgatcaaaaagccactgttaccttttatagcatgggtaccctcctcaccctgtataggctctgggtgccccccaccccttcagcacccgagccgtgtcctccatgtggacacctgctcacactcctcagcttggaacccacaccagtccaactcacacatggtttgccccaccctgcttagaccccgatgcctcacagtagaccttcgcctgcatggacatccttctcaccccacaccagactctcccctgacatagaagctctgtttatcctgcacagactcttaacacccctcaccaggccacccctcgtcaccctgctcatgctgccatctgtctgtgtgaacactcctggaagttctcacctggcccattgactttatcccaaactaggcgacatcctcctcaccctgatgagctctcacaccctcactgtccacctccctgtttggacactttcctcaccccactcgggatctgacaccccacatcaggccttcccctacatgagtccctcatcagctcacctggctctggcaccccttgtgagtcttcccctgcagggagtccctcctcagcccactccgggatcttctcctggagatgctatctttaccttacttaagctctgactctctctgctaagtcccccaccccctcaagtgtggacgtcctcccaccacacttgggcctcaacacctatgtggggtagccacgcctcataccacttccaactgcccatcctagactgttgcccaaagcggatgcctctccttggcccacaggctcagacagcccatgccagcctgctgccctgcatggacctcctcgctcccctccatgtctgactctccttgctgggccgtgcccttcctggggttccagcactgggcagcagcctccctctaccggcatgcccacctacagccttcaggactgagtggttcaggaggaaggggatggaaagaagagctagggtttaatctgacatataagtttaagttctcagattctaagcaaaagcaaaaaagcagaaagttattttcctccttcaccaaacataaatgaatgttatcatttcttaattataggttacctagattttcagctaaaaagaattcttttcagattttttctttcatctgtgcttctatagccccatatggatacttctttttaaatacttgtcacatgatttttagttattgttctgtcccctcctggttgggtaaccaaccaccttaatttgcagaggcctgaggaagcccttgcagttttaaaactgggacagtccttgtcaacaggtacgagttgatcaccctaactggagatgcaggatgcaggactttcggtgtgaaaagtggcaaaccaggatgagttacttacattctggcgactgagttcgtaaggaaccattatttttcatggtcacatttttttttttcatgtctccattgcagtacacatagaacttttaatcaaattgaacttgattaactttgggcgaggatctactgcagaacaggagctgacaagcccttttctgagcacaaagagaggagcatgccagacgctcgtcactttcaaataaggctgaattttttctgcaaatgcaatgagggctgaaggaggtgtgtgacttctccccagaccccatagtgacgccaaagtgaaatataccccaatcttaggactatataggccttacttgttgacctggcattacaagttatcaggcatatgaccacaggctagtccaaactagactaggcatggctcatgcctgtcatcccagctctttgggaggccgaggtgagaggattacttgagcctagaatttcaaagctgcagtgagctatgatcatgccactacattccagcctgggtgacagagcaagaccctatctcaaaaaacaaaacacaacaaaacccaaactagaaagatatgatgactgtgaattcagagtattttatagagaatagagaaccattgttttatagaatattctgaggagatcaggactcctttatactcttaaataaaagtgctatgtctattgatatttatcatgtttgaaattaaaactgagaaaatttctaaacattcattttgtaattaaagaattacaataatatagctaggtgagtcccagttacttgggaggctgaggcaggagcatggcttgaggccaggaatttgatgccgaagtgctccaggaacacggctgtgaatagccattgctttctagcctggctagaacatagcgagaccccatctctacaaaaataaaaaaattaaccagacatgcagctcatccctataatcccagctactcaggatgctgagatgggaggatcacttgagctcaagaattcaagactatcctggacaacatagcaagaccctatctgtaaaataaatatcacaataatacacctatcacacatgaacataaataacatattggtgtggggaaactatattttttaagaaaaactggaagaatggcattgttcgacattttgcaaatctctttaatgtctggtttgtttgtttgtttgtttgttttgttttttgaggcagagtctcactctgtcgcccaggctggagtgcagtggcacaatctcggctcactgcaacctccgtctcccaggttcaagcaattcttctgcctcagcctccagaatagctgggattataggtgcccgccaccatgcctggctaatttttgtatttttagtagagatggagtttcaccatgttggccaggctggtcttgaactcctgacctcaagtgatccacccacctgggcattccaaagtgctgggattataggcgtgagccaccgtggctggcctcatgtctggtttaatagaaggtagttagattctctttttctgtttctacattcagtctgttgtgatatgttattttagctaaagtataggaagaaaagcttgcctcacacagatatgtacagtagtcctctcttatccaagggggatacattccaaggcccccagtggatgcctgaaacctcagatagtaccaagccatacacacacacatacacacacatatacacatacatgtatgtatgtatgtgtgtgtgtgtgtgtgtatatatatatatacgtgtgtgtatatgtacagccacgtaccacataacaacattttggtcaatgacagactgcatgtctgacagtgataccataagattataatggaacatatataaaaacttgttatatgccatttgatattggccttgcaggtcaagtaagagaaatgattgatgttaagtaaaggtgctgggacatttggttttccatattaaaaaatatatatatataaatgaaaatatatatataaggcctaggtttgtgtaagtacactctttaatgtttacacaatgactaaattgccaacaacacattatccctatcattaagcaatgcatgaccatactgggttttgtgaatctgataaccaagatggctgctaagtggctaaagggcaagtagtttatacagcatggatacactggacaaagggatgattcacatcctgggaggatagagcaggacagctcaagagttcatcatgctactcagaacagtatgcaatttaaaacttatgaattgtttttctagaattttttatttaatatttttggactgtagttgatggtagctaactgcaactgcagaaagcaaaaccacagatggggggtacttctgaagttggaaaagagcggaccatgtgcttcctgagagggccttagggactctaaggatcctcaactaccctttgagaactgctgcataagaacataaattctaaagtgaatatttgatgacattcaggagaacaacactgtctaagtaatgttaccacaacagagtaccatagactgggtaatttataacagacagaaatttatttggctgacatttctagagactgaaaagtacaagggcatggtgccagtacctggtgaagacctttgtgctacatcatcccatggtagaaggccaaagggcagaagaagctaacagtgagagagcaagagagggccaaacttgcttttatcacaaagcccactattgagataaccagcccactcctgcaataacatcagtccactcatgatggcagagtcctcacatgacctaatcacctcttatcagaccttgctgcccaacagtgttgcattggggattaagttttaatacatgaactttgggggacacattcaaaccatagcagacacttatatataattgctgatacactgcatgtaattcttccctttctcctctttgagaagcatatcacagtgcaaacaagagcatcataggataaccttaaatctgctcttctcaatttttaaaaaagcaattccttcacacagctaatagttataggtgtattttgacacacacccaactgatggcaacataccatgtgttgaagcaacatggtggctgacctctgtcacagacaatttctaatgcctggggccattcatcctggtgataggcaacaccacataactatgtcattgttgatttcccttaggaaccagagttcccacagtatagatattccatggtcaatcagccagtgcttcttcatgagcacttcctgtgtgtttaccaggaaccagtgggataacaaatcaagtctctacttagtgtgtgttaggcaggctagcatttctatgtggagaaacctccgatgggtttacactaagggtgaaatgtatgtcaggatttgatgagctgtctgtactttccctgaactcactcagagggatgttccatctatagatgcttaacttgtattatgaactttgattttacttaactggatctctttgtggaatttttttttcaattttagaatattgcatcttcaatctagaaacatgaggaactacagaaaagcatatgaacaccgaaaacctataggccacttatccattttgatgtattttagtcatcattctgtttttttattgctgtttattaattcagtatatttccaaacagcatctataatctaagtattttttactatttttaattttgttctcagactatatcttcagttttccttaaactgtttcatgtggaaacttggtaaacaggtagttacaagtactaatatattatgacagttttaaatctattgtaaaaataagtcctctcctctaaaaacataatattcaataagagtctgttgttatatggttagcctagaatgaaggtattggttttgtcaaaaccggcattcatgggatttgactttcatcctgcatatcacctcctaatgcctgcaggatatggaagtcatcgggaagtgcaggcactctgtcagcagaaaaatgggagatgggtaacatagggaagatgtcatttttacacacaataagctacaaatctaaaacatttattatgtcattgattatcctattgaaaaaaattaaaaggaagcaccgaagtctccaacaataggaaaattctttgaggatgtatttacccaatagaattttattcactatttatttatttatttatttattattatttatttattattatttatttatttgatagggcttgctgtgtcgcctgtgctggagtgcagtggcatgatccactgccctccaggttggctcactgcaacctctgcctcccgggctcaagtgattctctcacctcagcctcctggtccctggtaccataggcgcccaccaccacgcccaactaatttttgtattttttgtagagatgggttttcaccatgttgtccaggctggtctcaaactcctggactcaagtgatctgcctgcctcgaccaccagaagttttgggattacaggagtgagccatcatccccagccgccagtagaattttatacaggcagtaagagtgagagttgggagaaccgtgtagcaacatggatagacttaatgataagtgaaaaatcagacccaagatattatgtattctatgattttccaactctgtcaaaatacctgtgtatttgaaaaaaaaaacagaaagaaaatacatgaaaatgatagttgtatgcaaggtggtgagattatagatattatttcctatattttgcacattttggcaatattgtatgcttttacaccttgtggcaaatgtctgggtttggtaagatataatgtcaaattagcattaatactttatttttctaatcataacgcgagtgatttttttaagcaaacatcacaagtattatatacattcaaaatgactgctgaccctttgaaaggagttgcctggtgtagtattgccattgcttagcatattttctcaactgcactcttgaagagtttaaattgagtggttctggcaacaaagatgggaactttggggctggggacttcattcaagaggagaataagattttcctgcatcaggtggggtgctcatgagacatccaggtattgatatcttcagatgcagaatttaactaaggttaactcttgaggtttcttggacatgttgttttcaaaaataatgataaaggcattctctttctactatttctttttcttaccccctgcatccccctatttaggttttcactggaattttcacagcggaaatgttcctgaagctcatagccatggatccctactattatttccaagaaggttggaacatttttgacggatttattgtctccctcagtttaatggaactgagtctagcagacgtggaggggctttcagtgctgcgatctttccgattggtattccatatttctccaatttcttttaacatttcctatcttgcagctactagaaagagttctgcataaattaatttgatgatttaaaaaatatattagctgtattttactcccaattccagttatttggcttagctactaaaatactaaaaactttcctaaaatacctgatatggaagttagttgttaaaaatcaataagcaaacagaaatcaattttaagaagctctttagaaaatgctgcttaatctaagagatgtctaagatgataagtgaaaaataagacccaagacaatagatgaagaaaatgaactcccccaaggcccagtgtgaggtctaatttgggtttgctagtgaatctatttttttaaatctgaacatctccttgaaatggcaagaatttctccttgttcaaagatgactttcttcatttcttctgtcatggtagcccttccaaaaaatgagaataaaataaggtttttaaatacagatggttcccaacttatgatggctcaacttataatttttccgctttacattctgcaaaaaagcagtgcacgttcagtagaaaccatactttgagtacccatacaaccgtcctgtttttcactttcagtatagtattcaataaattacatgagatattcaatactttattataaaatgggctttgtgttagatgattttggccaactgtaggcgaatgtaagtgttcagaacatgtttaaggtaggctaggctaagatgtgatgttcagtaggttatgtatattaaatgcatttttacttacagcagtttcaacttaaaatgggtttattgggacataaccccatcataagtcaaggagcatctgtattatattgaaattagttgttgaacattggctttattttctctatcattagctaaaaaggagtttgtattaatgtatttgaagaagttagtgtttaagttactcttaatgacttaaaatgactctgaaagaatagttaatggtatcttcaaaacagctgtccgtaaacataagcgtaagtgatatcttgattaactcctcgagaaactgagttatcctgggggtatcccactcagacaaaggtcactactgcttccctggcattagaattggcttgggtttttcactccctattgggaagataagcacttggcaactgaaaaggtttaaagtttcttcattgagatattcagcagttctaagaaagaactggaaaaagtgaaactatttgtaaaacagagatttcactcagtcaaagtcacaaataactgccaaatttttgaaacctctgtttactactctttggttaggatccagtccacagtggacttttttgagaatagttattacctaggtgacaaaagaaaggattgagagtagccttagaacttatattcttaataaattaaaaagccactctgttgaaaacaatatgagtggcccagatgtctgcatatagggtaacacctggtaaatcttgaactctctgataagataacttttcaattaaaaaaaagttaaaattgtgctgttgccttctaccaaaattcctattacattctatgttagttatttgttagcatatgacatctaatgatgatctcataattataattttattggccacactgccatagcctttatgcgttataattctcaggctgggccaggcacagtggcttacacctgtaatcccagcacttcaggaggccaaggcgggcgcatcacttgaggtcaggaatttgagaccagcttggccaacatagtgaaaccccatctctactaaaaatacaaaaattagccgggcatggtggtgcacgcctgtaatcccagctacctgggaggctgaggcaggagaatcacttgaacccaggaggcggaggttgtagtgagccgagatcacgttgctgcacaccagcctgggcggcagagtgagactctgtctcaaaaataaataaataaataaataaaaaataattaacactctgttagccaagatcttgtgattatttattacagaatatagatatttcatgattgacaggtactaaaagttctgtcctctgaataacagtataggctcttttcttttttttttttttcttagacatagtctcattctgctgtccaggttgaagtgcagtggtgtgttctcttttcacctgagcctccacctcccagattcaagtgattgttttgcttcagcctcccaagtagctgggattacaggcctgcaccaccacacttggctaatttttgtattttttattagagacggcatttcaccatgttggccaggctggtctcgaactcctggcctcaagtcatctgcctacctcagcctcccaaatgctaggattacaggcatgagccactgcacctggccagtataggctcttttcataagatgactgatgtatgtggaactgcccctgtttgagagttgtgcttttcctccaagttattccaagcatatcacaacggttttttttttaatcagccattgattatttattggcaagcaaaataggtatttagaattttttaatgtttgcttttttaaggagatggatttttttttaaactgtccttcccatactagtcttttggtttcctacaaatcacattttatttcacttgtcctgtgagaagtcaagggaaaattagtaggaaagggatatgttcatatgtgggttttcaaaaagcagactgactcagatctaaagtaagggactaaggcagtattcctggcttctagttacaattttttcagctactctgaaattaatcagttttcccttatttatgtctcagtttctccccatttagtctgagacactgttagacagtcctgggaattttccaagggtgctcaatatatttaatctgatcttcctaattttatgtttttattttagccatgtggtgagaaaattgattgagtatcatttatttttttgtttgggtttttttttttccttagctccgagtcttcaaattggccaaatcctggcccaccctgaacatgctaatcaagattattggaaattcagtgggtgccctgggcaacctgacactggtgctggccattattgtcttcatctttgccgtggtggggatgcaactctttggaaaaagctacaaagagtgtgtctgcaagatcaaccaggactgtgaactccctcgctggcatatgcatgactttttccattccttcctcattgtctttcgagtgttgtgcggggagtggattgagaccatgtgggactgcatggaagtggcaggccaggccatgtgcctcattgtctttatgatggtcatggtgattggcaacttggtggttagtactaatttgtagatatttttgttctacaccctgaatattctacccctggcccagaagcccaagtccttctactgcttagtccttctactacccgtcatgtttgttgatttttattctttcttggcccagaaaccctaaggtacaaatgaaggagaggagagagatacttacagagtgcctacttagtcatgacccccacaacttgtcaacccttttcctagagttaggaaagcaaactcagcaaaattaagtgactttcccaaataaatatagggcttgtatttgaacctagactttaaagtctgtgcccgttcgcctacagaagccttcctttttcttaacgacaatttctcatctgtggtgctattgacatcttgggctggataattctttgttgtgggctgtcgtgtgcattgtagggtttagcagcgtccctcctggcctctacccactagatgccagtagcatcctgagagctgtgacaaccaaaaatgtctgcagacattgccagatgtccctggggggcaaaattgccctccattgagagccactgctctaaaccatcttagagttttatttaatttatataaatgacaaatcactttattgctttactttgatctgtccacctgctctcttctacctctgtctttagaagagtcaccaacagatcttaacaccttgcttcttaaagtgtgatctgaggactagcagcaacaagatcactggagagtgtgttagaaatgcagaattctaggccccaaatcagaactactgaatcagaatctgcatttttaacaagatccttgtgtgactcaaaagtacactaaagtttgagaaaggactatcttacagatcaggcccctaatcccacctgcaagtgtagggcaaagaggactggaagaagacaagcttatctgtcccttaacatgctcatccacattagttctcttcctttttctgccacagagaagcatgacagtaaaaggctcctactcaccagcctctgaaccagctacaactattctgttcttccatttgacctacaaaaaaaatagctactgtaatgtttaattcttcctgttctccattcccagccacctttccctcagtcctaatccctctagtcttctcactacttcagtgactataacaatggcttcccggtatgtagcatgatcaacattttcaagccctgactttgccaccctttcttcactctcctgttcttatttgtctcaaagacatctccccatggctgtctccagatacctgagcacttgataaatatcagctgttaccactaccccctgatgacacttttcaggttcccctttgctcagtagtccttctgcccatctagtttctaggaacctataactttggagtattttctgtctcttttctctccactcccagcaaatatctgatgtgtcttaaatgcatctttcttcatagtatttctgtggatatctttcttcatagtatctaagatctgccccttcctttgcatttctataattcattcagtactttataaaaatgtggtctcaagaccacctgcatcataattacacaagtttcactcacaaaaaaaggccaagtcccaggctgtataccaaatctactgaatccaaatatctttagagtaggctaaggaaatatttttaacaaacatccacacccctcactccctgagattctaatgcatgctaagatttgggatttctgtagcctaatccagacccttatcaattcatgcatgtaacagcctcctaacttctgcccttcccctctgtatgtagttagtctgaatgactctttcaaatctctgtcatcatctgtgactcctttactcaagaaccagtagtggatctaattaaataaaattcagatccctcagcctggccttcaaagccctctccaactcacccgcattttaccaaccatattcctttttaactctacaaatggtgcagataatccgaacacttatagttcatttattgtttccaccctcccactctgcacatgactgttatctcctcctaaaatgtatgccttactcttcttcccaagtatgacaaagtaaggaccaagtgtaaatcaagaagtgagcacctctcccactcctaaaaagtaagtcttaataaaaataaattaattaaccttaatgttcaatgtagtaaaataggagattaaaacaaaaataaataaagcttgtatctgatggcttgacatttggctatgcaaaaaaatataaaagtcaccatcactgtcttgctaaagcgattttatttttataaatgttaggaaaacaaaatttgttcttaaaatatgatgacatgaagtgtatttcagttctaccttcttggttttttgtatgaaaggatggcacttcaagcctcatttttttttctgacgtgggtcctctcaaactctgctcatgaatatgtggcatctgtacactttgtgaccctccccagtaatgtatattcacctttttattttggggaaatgtccttccaaaatggatacagcctttgttttttctgattataagagaagtaatatattttcgggtacatatatatgtatgtaaaactataaaagacccaagaaaagaggtgctaaactccttgtattacaaccaaaaccaaacacattcccacctggtaacatgagcattaaaatactacgtgggccaaacacaacacaacagagcctctttgagtctgtcacgtgaagtccattggcttccagtttgcaaccctgagttcgatggataacttttctgcatttgttccttttttccaatgctactggcataggtgctgaacctgtttctggccttgctcctgagctccttcagtgcagacaacctggctgccacagatgacgatggggaaatgaacaacctccagatctcagtgatccgtatcaagaagggtgtggcctggaccaaactaaaggtgcacgccttcatgcaggcccactttaagcagcgtgaggctgatgaggtgaagcctctggatgagttgtatgaaaagaaggccaactgtatcgccaatcacaccggtgcagacatccaccggaatggtgacttccagaagaatggcaatggcacaaccagcggcattggcagcagcgtggagaagtacatcattgatgaggaccacatgtccttcatcaacaaccccaacttgactgtacgggtacccattgctgtgggcgagtctgactttgagaacctcaacacagaggatgttagcagcgagtcggatcctgaaggcagcaaagatgtaaggtcccagcctagaaacagccttgatcctgtgtgagagcaaacagggtgctgtcagccttggggattggttcagctatgggcttggtagagagattctggaataaccaatttacttggagaactgattccaccatcccagtatcattctaggcctttcctaaatgaggtggaatcctaagatgatcctggacccacctctgtcacttctggatcatctgggtcagaggctgggataagccctcgagtacttccctgccattcatctgagttatagccctgaaaccaacctatagccgcatttagctttgggtgggtcattgccgtccgtgagtaggttttgatgttatatcccatctggacagaagttttgggggcccgtggatatggtttgcttatcgcgagttgtagtaagaattctagagaggagtcagagctggcccctcatccccaccagaggcagagttctcagtgtggagtgggcatgttgcctcagagctgcctgatctcccttttccttgcgtgtctagaaactagatgacaccagctcctctgaaggaagcaccattgatatcaaaccagaagtagaagaggtccctgtggaacagcctgaggaatacttggatccagatgcctgcttcacagaaggtgaaaggggatgaggagcagatgggctggggacactcgtgttgctcacagacacagttgtgccagggctagtggtgggtgaggggcagctcagtggctatcttcaagaactttgctccccaccccaccattttgaaggaaacttagattgtttcccctatttgtatctgacaagtatataacaagtttctattctcacacttttcatcatccattttctcttggcatcagcccaaaaatttccattagaatgtcctattctgtcatggctgtgcctgcctcctgactacccttttctcctccctctcactgcttctttgtaggacatcttcttgactcctgagggccttgccccattagcctttgcagcatagccccagccctgccaccctctccatttctgaatcagacattctgattcagccactgtcctcctggctgtgtggtggggcagcacctggcagggcctgggagatggaggagagggcaggtctgggcggggcacgtttccacggtctgacccgcctctcccgctggtgccaggttgtgtccagcggttcaagtgctgccaggtcaacatcgaggaagggctaggcaagtcttggtggatcctgcggaaaacctgcttcctcatcgtggagcacaactggtttgagaccttcatcatcttcatgattctgctgagcagtggcgccctggtgaggtccaggggagagtgtgaggagggattggctggggaagggtgtagagaagccagtgggaaaaggctgaggccaaagcccagtggctctgaaaacagattggctgtggtcccaagaagaatgatctgttaaagtgctttaggctgctgctttgagcctgtgggattagaatccatacttgttcacattgtgatcctcttagcactgtccctctcatgtgtccccactgcctggtttaccccatccttagcagcccctaaaatgaacttccctctcttacctaataccccagatctcttgttctttgcttttcagttacccaggatgggagggaggtgttattcctccacttactgtcccttcacagcctactggatttagagaacccatggcattagcaaatgtttagagtcagatctctggtacaaaggttatttatattcacattgtcctaagtgcttattaatcagtgaaacatacaaggccctgaacacacaggctcctccactgctgagactaattatcttggcatttgcttttatttttagctgggttataactgaggagacctggacagggtgtggtgtgagggagttgcttgctggttgaatagttttgaggactgccgggactagagacagtacacactttccttaagggaaaggtgaagaatgcataatgttgaagtatatttaaagaaggtgggcacattcatgtaggtgtggaatcaaagcttaatctggaagcaaaaaaaaaaacatagcaagggagaaaccccaaattcagtgttaaagattttgacagtgacttgggaagtttcactgacttgtgaggcaggagaataagaaaagctgagagaggcagcagtgtgtattaaagacaagcccaagggtgaagaagacagctttcatgaaaagaggaccatgggaagtaaggggaaggtttacacaggaaggtgtcaggattaaagtaggaggcaaaaaagatggcttggtagccactgatctgagtgaaggggagccagaccaccccgcctgcccctgggccacttgttgcatcaacgagcattcacacaacacttcctgaggtgccgcagaggcacccaaaatgacagcatggtctctgcccttaagaaaagagaggatcagactaagccgagtgattggagaaaggcgttttattattgctgtcattgttattcttcaaatctagtgaacaaaaatctaaacagtatgacccatcatttggctcttctctttcccatctctacaaaaaagaataaagcagtagtgaactaaaggttttgaactttctttactgctcacctttgacagtttttatttgtcttaatgattaagcaaaggatatttggttcagtacctgcagaccctgtgcaacagtaggcatgagatttaagaataacaaagtggcccggtccagtggctcacgccttaatcccagcactgtgggaggccaagacgtgcggatcacctgaggttgggagttcgagaccagcctgaccgatatggagaaaccacgtctctagtaaaaatacaaaattagccgggcatggtggtgcatgcctgtaatcccagctactcaggaggctgaggcaggagaattgcttgaacctgggaggcggaggttgcagtgtgccgagattgcaccattgcactccagcctgggcaacaagagcgaaactccatctcaaaaaaaaaaaaataacaaaatgaagccacagctaaaatgtccaagaagaaactagaacgtggttacaatgggactaaagagggtggggattagggccctcagtgacatgagatcagtcttgggcatctcacataccttggattatagaagggatttccaacagatggggttaaggggaaacctgacatggaagctgttgcctttttgattgagcaaaggggatttatttgcaccgagaccctgagtaggactgtggaacccatgacccctgtcccccccactgcctgttgatgaaagtggagccgggcacggtagctcacgcctgtaatcccagcactttgggaggctgaggcgggcgaatcacgaagtcaggagattgagaccatcctggctaacacggtgaaaccccatctctactaaaaatacaaaaaaaattaaccgggcatggtggctcacacctgtaatcccagcactttgggaggctgaggcgggcgaatcacgaggtcaggagattgagaccatcccggctaacacagtgaaaccccatctctactgaaaatacaaaaaaattagccgggtgtggtggcatgtgcctgtagtcccagctactcggaaggctgaggcaggagaatggcatgaacccgggaggtggaggttgcagtgagctgagatcgcaccactgcactccatcctgggcaactgagcgagactccgtctccaaaaaaaaaaaaagagagaaagtggagcacctgatatccatgtgcctccattttggaaggtgacgctgcagacaacccaattctattcttctggagctgttcagagcaagcacttcccattgtatcacagaggacttcctccccacctccacaggttgtcctatgctttagcaattccctcctcttggcaccatacctgtatagtccaccactctgcagatgggaatgctcacaccaccatataagggattatcccattcatgaatgccaaagaaataaaatagtgataagattttcttcacctgagtatctcccacctgtatgaccctccacccatactgtggtgtcaaggaactaaaaggaggaaagattttgtcatttcttttatatatagtattggtgaggatgtggagaaattggaacactcatatgcttctggtaggaatgtgaaatgatgcaaccactttggaaaacagtttggcagttcctcaaaaaattaaacagttaccatatgactcagcaattccattcctgggcatatgccctagagaatgaaagcatgtctacctaaaaacccatacacagatgttcacagcagcattgttcacaatagaaacaatacacatgtccatcaactgatgaaggataaacagaatgtggtatatccatatattggactattactcagccgtaagaaggaaaatctagagagagaaagtaggtgagtggctgcctagggctagggggttgggggtttagggggtgatagctaaagggtgtgggggttcttttggaggtaatgaaaatgttctaaaattgattgtggtgatggatgcacaactctgaatatactaaaagccattttaaatggctgaattttatgatgtgtggattgtatctcaataaacctattaaaacataaaaagcctgtgtagtcggggagtaaagcgaaggagacagggagctgatgacaggccagcccatgtgggacggctccctgaggatagcagtgctccctgtggcctgcttgcctttaggcactgtcataggcagctgctgcctctcttttaggccttcgaggacatctacattgagcagagaaagaccatccgcaccatcctggaatatgctgacaaagtcttcacctatatcttcatcctggagatgttgctcaagtggacagcctatggcttcgtcaagttcttcaccaatgcctggtgttggctggacttcctcattgtggctgtaggtgtcttgctttctgtttcccaccccttccagcaggaacacagaaacaggggtctctctttttctaatggcagtagctgccctgggcccaggttatagatcaagatgtagatgtaggtgtgggtaaagttcctttcatagcactgagatcttcatattaggaaggggaactctgaagtccctgcatttgctccagggggactaaccaaccaactctttagtctggtgggtttggcttaacttagattcagagattaggagaagtggaatcactggtctcaaaggcccttgttattaggctggggacaggaaagttcttgccccaggccagcaggatgtcttctttttgtggctgggagaaggggtgagagaatgagatgggggctgttgggacgaaggtggtagtgggatctgtggtctctcctgctgaccattcccatgaacacttccatccaactcaagtcttgataccggactcatccaaacaagtcagtttattaggtgaggggagttcatactgaaataaaatacccccttcttcccacacgttgccattctacagtgatcatgaaacttgagaaatccttttttcctccaggttccaagactatctccgaggtttgctggccatgacctcctgtgttttttccaggttggaagtgacatcctctctttctcaccccaccatcacttgtcccttgtcagctttactaaggatgatgactggtctcttattctatgtaataactaaagcttctttctttcagccaagtcagcattttaaagaaaggatgaatgggatttgtaggaccagggcctgtggaaaatttacttccttctgagggctgttaagtgccaagaaagtagaacggtggagactagactggtcatgtagaatgcaggtttcattggctgcatggtgaactacctgtagagtacctctgggatccaggatagagcagcatagaaatctctctgatggcaagtgcccaacactgagccatgatttctgctctataaatggatttcttttccaatacattgtctgcaatttccatggttaatgacccccttcccagaactgtcactgtgccctcagttgcatccccatttcaaaaagccagcctttgggaaatgcctaaatgaggtgaggaccccagccctagagggtaccaacgtgagaccctcgcagcgagagatgttagcatccctccagcaactgttgataccatcctgtggtggaaggatctgtaccccccacagacagaaagctggagctctaagacttaaagaatgggattgagataagacccagagagccaaagtgagactgggccagttctctttctggagaaagggcaagtgccatagagtcttcatttcacaatagctcctcaggactacctggcgtcaggtgggacacctgaactcaaactggtactcccagctgcctggggaggctgtgatttgaaacagagcttccccaccatgacctaccctcaccagaacacgttcttctcttttccctagggtgagctacccagaatttgaggatattgatcaggtatcccacatgcccctgctaaacaaataagctgctaaagcactaacagtcctacacattagcatttatttattttttgagatgaggtcttactctgtcacccagcctcaagtgcagtggcgccatctctgctcactgcagcctctgcctcctgggctcacacgatccttgcacctcagcctcccgagtagctggggctgcaggcacacaccaccatgcctggctaatttttgtatcttgggtagagatggagtttcaccatgttgcccaggctggtctggaactccttggcctcccaaagtgttgggtttatagacatgagccactgtgccaagccagcatttatttcacaaactttttttatggctatacgcaaggtggaagggggtaaagagcataggacaggcatgcagccaactgacactaattcataagctcctctagcttttgggggttgcttgatcattacattactgtggtgcccaactggctcctgtgaagacctctgtgccagttattagtaaataatatagttgaatgccattatctgtgtagaattgctccagaagcaataaggagaaacagaggttatccttgttgcaagcatgttcccagcccctggggagcttacactagcttccatagcaactatgtcctgactccaggcttgtgctaggtggggggacattcccaggccatcacagtggctccaatcgctgccgcttttgaattgtggatgaacaattagtcttggactgtcacctgaacagttggaactgctggactttttggtgtccatttgagtaaagtgtctgatttctttggcattttagaacatccagaaggttaggtcctaacttagcaccatccactggtgacttgatgtctgagtctgttactcatcgcatttgtttccctaattgattttcattcttccttgttgcctcttaaagctgtgagtacttttcagagtcatgggattatccagatgacttccaaggttaattccttttatttataatccatatgagttcccaaacaaggaaaacattctgttttgctcaggtccttggctgcattggagattgtgtcctgtaaaagaattttggcatcttttccccaggacatttatcccactgtatgtggagatcagcaagcctgtcagttctggaggtggggacttgcagagactacttgccttggcctgaattcagactgctgaaaacattccccgtttgaaaatattcacatcattttggaaaaatcacctaatgtctttccccctttttttccagcctgcaaccatagatgccctgaatttattttttttttcatttttaaaatttttttaggtaggtctcaccctgctgcccaggctggagtgcagtggcacaatcatggctcactgcagcctccaagtcctgggctcaagcagccttctcacctcagcctcctgagtagctgggactacagacacgtgccaaggcgcccagcttgatgccctgaatttgatgtctcctcaattccttttttttgttgtttgtttgtttgttttaggtttgattctttccttaaagaatactttaagcaatgttaggattatctccaggaggggcttaacagagactcagaggattataagagagccctcaactactaaagaataacccagataagacccttattgatcctgtcctgggccagattaatcagctgagtaacagcttatctcccagcaacgtttagagccagccactgaattggcctttagacctcctccttcattctccacactgtgggcctatttgttatcagataagtcacccaccctgaagagctgggatcttcttaccttatatggtgcctatagccactcaaagcttagtttcttgcaatctttacctgacaaagtttcgtaagatgaagctgacccaggggactgttgagtccaggtacttggttgagaaagaatagcttcccttcagatatacttattaaggcctcatgaagaatctggcaactttcaattcttttggagttaagagttggctgcacttggcaataatagggaagtagatacctccatataaattcttattgataatgatggatagatggagagaaagggattagttggtgctactatgttctagatagggcttttgtggaccatagtttaggcagacattgaactctggaccatctgccttttcatgaaaattagggtagcctaatagggcaacatttacttccggatttgctttggacattgcccagggcttcagagaagataactacactggtggattatgagcacatgcatagatcaaggtccatatccctttttattttatttatttatttatttatttgagatggagtttctctctttttgtccacgttggagtgcaatggcaccatctccgctcactgcaacctctgcctcctgggttcaagcaattctcctgcctcagccttccaagcagctgggattacaggcatgcaccaccacgcccagctaatttatttttgtatttttagtagagacggggtttcactatgttggccaggctggtctcgaacttctgacctcaggtgatccactcacctcggccacaacacctggccatacctgtttttaaatcgaaacctttaaacctgctcatcctgacccttgctaggtcatacaccttccgcttctaccccctgccagtcatgctgcttaattataaatgtcttcatttttttaaaaattgtgtgtgtgcaattcacagacacaggatcaaagaattaaagccctaggatagagataaaaagcagcaaatgaaactaatttgtagattgtttctttttttttcctctctaaattttctttaaaatatcatcaatttaagtaagctaagctgatatgcaaccaccacttcccagtaggaagaatttaagagctgttgatggaaatatcttaacctatcctagaatttgtgttgtaagaaacccagaacccagccaggcatggtggctcaagcctgtaatcccagcactttgggaggccaaggcaggcgaatcacctgaggtcaggagtttgagaccagcctggacaacacagtgaaaccccatctctactaaaaatacaaaattagccgggcatggtggcacatgcctgtaatccaagctactcacccaggaggctaaggcagggagaattgcttgaacccaggaggtggaagttgcagtgagccaagattgtgccattgcactccagcctgagcgacagagtgagactttgtctcaaaaaaaaaaaaaaaaaaatagaaacccagaccccaaacattctggagtttgactaactaaaggtatttttaggtctgctctcccctgaaaaattctgtaactctcagctcaggcccaggaaggcataaatgtagttagcatggtgttgagaaagcatcgtggtaactgctctgagagctctggtagaacaaggtaagtttgcctctggcagagcaggaaagtgtttgaccatacgtctaagcctggaggtctgcaggcttcttccccctggtacggcaacatattcaactctggattgtccagatagtcctgttggaatgttgttgtgtaacctgcccactggggacgtgacctgtctgtggaagaaaaagcattggcctgggagtcaggcagtggaggtctttaatcttggctgcagaactgccagtgtaaccctgggcaaattcttgtgtacgggtctcaatttcctcatctatcaaattttgttttccaataattcttccaactgttattctaatgataaaagttatagaagattgacatggaaatgacagacctgaggataattcattttggactgttctggaaggaaagaatgagaattataaggaaaagtgtggattcagttgtccagactcacccaagttcttgtggccatggaggggtcctggttgtagttaaaagtcagaaggttattttagttaaaagtgagagatagaaggatgtatttaaaagatagagatagaactcacttaagcgagttctcatggagccacagttcttcttgggaactgcaagtcagccatggtacttattgaacgttttcattgttgttaatgtcgtgacgcatcagattctcaaacaaatggttttttgtcaaccaggagtaaaagagcttgtccctcttggaaagccaatggtgaatgagctgaggagggggcagcttgtgtggagtatgtgtatttatctgtattcttttccataggtaccattaaatttgtctggcttaatttaatggggacttctgggacctgcagagactgtaaagggcgagggtaaggctcttgtcgtctgttcaggctcctctccttccagtggaacttcctcactctctccctctcctgtcagcctctccccttttccaacttgtgtgtatgttctaccgccttctcgattttctcttccctgttgttttttcttctgcctctcaaccacctttccttccaggtcgtttgagtcaagttgaaataggcagctggtgttacccacttcctctacctggggggcccaatctgtgtctgcagtgctaggggctttattctaacactctggaacctctgttttctttcttttttttttttttttttttttttttttttttttttttttttggttaccttttttgtttttgtttttctcttctgtttctgtgtaggtctctttagtcagccttatagctaatgccctgggctactcggaactaggtgccataaagtcccttaggaccctaagagctttgagacccttaagagccttatcacgatttgaagggatgagggtaagatactaagagcagctgatccttctgcatgccagtggaaactgtttaagcatgctagaactgatcacatggtggaaagatcattcaaacacgaattctgtgatgcagctgctgatttgatcctccactctctcccccacacctgccccgtgcaaaggggaattgcgttaagctgcctcatcacattaatattggccccacccccaacaacatgccatcgcagaacatgttaacattggctattctcatttggcctggcttacctgtagcactcggggcggctttctgggctgttgatttaatagggagaatcaccaggtgcaaagaaggggaattgtaacccacagacccactgaaaagcacaagcttcaggcagggagagtgctgtgtaggggcatcagccaggtggggactgtggccttggggtcactgagaaagcagctgagaatgggcttgaagatatgacggcaggcctggaattggggatggagcagaatttggcatggccctgggagaagaaatgcttttctttctattcagattcctcttattgcaccttgttgttctcagcccagtcccaaatggactggcagcctctgtctgatagcaaagcttttttcctcacccccaacccctctgcccatgctgtatggtcccctaacactgtcaaaatgacaaccaggtatgatgctagatgactgaatatcagctagttctcctgaaatttcttgatacctcctattcctgctttggtgatactccacccaaaacaatacaaggtgttgtcaccctaccaacttagaaacaaggtgccttcttggtgccattttcttgtctcttttggtttaaacaattgtgcgtgtgcgtgcgtgcacgcgcacgcacgcgcacacacacacactaaaaagtcaatttcttaaaatcaaaggggcaactggctttggtggtaatagtcctgtggtgatcagagagaggtctgttatacttaacgagaccaagaaaactcgcttcaattcagatgttgaatacatgcaggagagcaaaccagaggatatatttttaaatgtgcaaacgtcagaatgtaagaataaaaattaaactgttacgatagtctacgtgaagcaagaccgattggaaaaactagataccaggacagtgctgctacgttcattcctcatctgtgatccctggctgttactccgtgaagccacccacagttgtataggaagatgaaaacttaattgggacttgggaattttattatgttaatttatccagacaaatgctttttgcaacaaattcatgtttcttctgtagcacagtcacagtttggtgtactaaatgtaagctttctgcaactctcctgaaaccatctgcaggaagggcagttccacagtagtgtaaatttattttaatttttcaaaaaacttgggattttaagactttgtcccacagataagagaggttttagaatgtgcgcaataaggtcattgctatgctcaggctaaatttaggaagagagtttattacacaagattcagtggtttagacagccacggtgagattgaaaatgtggttaaaatgttcttctctgctccctgcacctttgcatgttttccagagggagctaataaaatgttttaataaactatactggttttgttataaagttgataatccactttggtgactgaaaaactgaggacaagatgcaaccaaaaaagtccactgaagacagtacttgtcctgagctcctccgcatccccttacggtgatccctgatcttccaaaaagagattggtaatacctgaagaaatccccccatccccctacaaaagaaatgcccatctgacccatctgacgcttgttactaactatttccatctagatgctcattactgtcactcctgtccaggcagacagaagcagtcctcatggccgctgaggccagtttgctcatgaggcagttatttgaataacctggatgcaggagccgttttgggagccacacctcttccctttagctgccccttctttctgtacctttcctggaccctcagtttccagtcccctaaaaactttcatttgtcaacttgaaagtagtttaggagcttggaggtcccgaatgaataatcaaaacagtagataattttatttgaaaagcattacgatgttttatttgaaaagcgtctacatcaagatttttttcggtaagataatatggtcaagaacaagtttgaacccaaagctggaatttaaaacaataaatgcattaagggaagctttggaataagagtgccacctcatttgattgactccagccaactaacagacagtattgaccatggctggttggacaggtgaaaagggatcagggatccattcctgccctgtgggtttcctagcccttctgtgggagagtaactgcaagaagaaaagattggatttggctaagcgtatagtaagtcccccagtaataaacagaattaggtacacatgttttatttaaatgttgtttttctatggggcattttttttttattctttggttttggttcttctatatgccaacacttgagagattacctttagaatattttaaataagaaatcttcataaactgaacaccatccatgcagatgggctcaactgtcactgtgctgctccaattacagactcagagcttcgcttgagagggagcatatgacccaagcctgtcctggggcactgacttcagtctcctcttcttcctcaaaccaaagaccaggaaaactgaagcacttgtgctataggcaaaggaatacttaatgtagttctttgcttttctctcctccatagtaatcttcatttaaagatttcgctgtgctgttaaatttttgagggtatataatattagtgccatgaaacatgcatgcatttttgttgattgtcagtacatagttgtccattaaagccatgttccctctgccagatattaaaagccagctgacagattttatagtatttattgagcaacaataatgtccgagacattatagagaagacaaaaatactgtaagaattaatatccattggaattttctcatcaattaaatgggatttgtatcaattgccaagtataaacttccattgataaaagtaactttttatagattactaaaacctagctttgagtgatatttccatgtctagttcttaacaataatagatttcatgataattaaaggcaatgtagagtaactagagaacttgagaagagaggatcaaattcattaagtgactaccagtggaaatttgaattatcatttataatatatctttagtgtgagagttcaaaataagaaatatgatctcttgcccagtggttgctgagaataacagcacaatgatcattacatatggagcacagttaaatagtttctgcttaacatattgcagcttatcagctaatgttcaaagcaaggaagaattattagtacgtttaatcaactctgggctgggcatggtgtcttatgcctgtaatcccagaacttttggaggccgggatgggtggatcactttgaggtcaggagtttgagaccaacctggccaacatggcagaactccacctctactaaaaatacaaaaattagctgggcacggtagcacgcacctgtagtcccagttactcgggaggctgaggcaggagaatcgcttgaacctgagaagggcctccccttctcagtgagccaagattgcaccactgcactccagcctggtcgacagagtgagaccctttctcaaaaaaagtaaataaaaagttttcctctggttatgattaaagtacatttgcatcttataaaactttggattttataggattttatatcatatcagagaaaaaggctctgaatatttttgtatattgattcatttgatcaaatggatcaatatgtaaaattttctatatactttatgagaataaaagttcaaagagatcacgttaatgtttcttccctatggtaaatattaacccatatttaactgtaacccatagtatgtgggacaggttagactgggtttgagtagaagcatagtcagaagagttcctggaggaagtaggttctgaattgagattaaaaagcagcatgccttggtttcaagtctttggggcctacttcctgtgccacatttgtaatggtctaacagaaagtcacgatctcccacctaaggtctgctgtgaaatgctgtcacatagacttgagcttttgaatctttacctaatctactcccgtattgtttgagaaattatttttccatttgtggatcatcctccttttgcctgttcttttgcacatttcattgctttttggtgctcccgccaaagggtgagcaactgtagaatgaggaggtaaattcaaatctgggtacatgacaaatttggtaacataaataaatatgaatatcattctccaaaaaaagtgaagattttccagatttcagatatcctggctttccttgctcaacttaataaacaaagtaataaacactttaatgacagagctgtcagatctagaagagatttcttggtctaagaattaagaaataactgcctctcagtctaaaggccctaatatatgaattggagaaacacaaaatgaatattttaatctaaaaggaagagtgactccttagcagaagaatatcattgcattttttacacaagatagaacaggtagctctgatcagccacatgtcctgatgagtgacaatgcagtctaaggcaaaaccagaagataaggaaaccctaaactctaaattgtgtgctgctctgactgatactgtaaagcaaaatcaaagttgaaaacaacccagaaactttgattcctaaggggtttttttcttttgctttttttttattcctgagcttactgtagtcagtgactttttaacaatatgccaatttttttagtttcaagagcagtaatgatctaacccaaaactctcttaaaaaccttaagtcatccctatttctaatacactgtgatgagtggagtcaagccctggaatgagcagagagacgacagcattagccaagcagggagcgactctgatttaaaagcctacaaagtcagaataaaaaggctggagaagtataatgaaccttgagtgaaagcacatctgttcagattttattttatactgtttggtagagggaatatagctttttttttcttgagcctgcaaaatatgcatgctcagctattgcctgaaataaaataactggccttgcgtagtcataaaagagacattatgtactgttaactggctctctattaaccacaacgggtagttctctgtgattttgaacaattataccttgtttttcagagggggaatgtctgttgaaaggcaactagcaagctgaaagttactcatattttcccattgggcatattttatgaattgaggaagagggagactggactaagaaataatttttcagtcccaggctgatgcataggaaagaagacctaggtcagcttggctggggaatttgtgttagtcaaaataaaggtgtaactttttaaaattccttcaatatagtcctagacttagaaatttttggtcctacttgtcagtctgtccagttactctaattccaaagggaatgtaatgtttccatacagaacaagccacacaatgtcattcccctcctggaaatcaaaaaatgtgcttgctctcatttccacccaacactgagcaacctccccttccaatgcaggtggtggtgaatgccttggtgggcgccatcccctccatcatgaatgtgctgctggtgtgtctcatcttctggctgattttcagcatcatgggagttaacttgtttgcgggaaagtaccactactgctttaatgagacttctgaaatccgatttgaaattgaagatgtcaacaataaaactgaatgtgaaaagcttatggaggggaacaatacagagatcagatggaagaacgtgaagatcaactttgacaatgttggggcaggatacctggcccttcttcaagtagtaagtagtgtttttgtttttgttttttcagttctgtgaaattcaggcagctagcacaaatcccatttggcttcttctcaaccctacttctagaatcaggattattctcaataagtccaagaaaacagtattgttccccaaaccagtttcagagagatacctttcctgagtattctctgacttctacaagatctcactcaaaggaaatctctcattgtgctcaggaacagagctgtgcccagcaacaaataaagattcctgcagtgtaataaagtggcagagagatcatcttcccttcccggtcagagagtgcagttaagggcaaaaaaaatcaagataagcacatagacaaaaaagtaatggcaattgtgatggagcaaaataatagtacatactcaccacactccagttaacttaggaaaaaaccatggcagtgccttggtgccacactcacctcagctccaccccagagaaaggtatcagattaatgtatcacagtaaggaaggatttaactatctagataattttcttttgcctaatttcattctttcgtgcttagttttcactgcctctctcaccagtgtttcagaatgtgtgacaagacaacataatgcagtgaaagctcgtaggctttgaaattagactgttatagatttgaacatactctgatacttactggatatgtaactttggacaaattattcagcctctctgattctctgtttcttcatctattaaatatagataatgacactttgcatggttgttaagaggatttgtgatttttaaaaatttcttagcacaattcccagcatataaccatgcttaattaatgaaaattgctattaagtatttttgttactatatttccatgcctatatcatacagttcttgggagactaactgcaataacagatgaagctctcaacctaaccttacatatagtaagcactcactgtcaactcatagtagaaggcaaagttcatggaatgaactgtagtttttcctaccccaaagcttttttgctgttgtatcccagttcaaaaaattggacccacaaattgaatccgcattggagcatctccagaaaaccagtgcacatccacaagccagtcaaacatggtagtcacagagtccctgccatatgcaagatgctgtgcttgacagtacagtactagggccctcagatgaataaagaccttcctgtgccctgaaaaaaccttagaatctggttgagtacataaaacacggtgaatagtacatggattatccatatttgtttccaaaatcagtctagatatagtagactgaaggagtagaattgggaagggactgtcaaggataaagctggtattgctactacataggctatacatgtgtatattagtaaagggtaagtctgatcttgtttttctgttaaatccaactatgagtttttccgacccccatcgcttaacaccttttttttttttttttttttgcttaccacctttttaaaaaatgattcctcagtggaatggaatgctaagttccaagcattttcagtagattcctgccattcactcataaaagttttccctaactttaggcaggcttctcaggcccatgtttttgagtcctttcgtaaagccttaatcccattaccattttcaacatgtttatttgccaaactttgttgttattttcaggaacaaagccctcctgggacctgtagtaacaaacagaaaattctgtgtccaagggaggctgcacccaaacccctgttctgtgttctcactgaacctaagcctggcctttgggacccctgcctagactcccatccactccctttataggcaccgtctaatgactgactctgtttgccaggcaaccttcaaaggctggatggacatcatgtatgcagctgtagattcccggaaggtaaggatgtacatggcgaaaataccaccttctcagatggctggaaagcaagcagcatggtataccgagcccaccaagaaagaggaagggatgaaggaatggaggagttgacgtttctctttggaacatttattgcttgtgttattgattatagatcattttcctcgtctcagtaagtcatcactctcttacattggcccccgatgattagactgttgattttttacgtggccccagtgaagctgtctatgcttcaatcctgcttcatagcaaaagtatggctcctagcagacagccctccctccctgtggcctcatgatttgcatgttctccacatgagtcagaggacgactagtgtcctctcaaggcaggccatgccagtgtagagaaggaggcaggcagaaagaatctagggctctcccaccccaagatgtttagcagctcaaatggtcacagttacggctgatggccttggcgtgtcaaactccaaactaggagctgattctcttccttttatcctgtcctttgacagcctgatgagcagcctaagtatgaggacaatatctacatgtacatctattttgtcatcttcatcatcttcggctccttcttcaccctgaacctgttcattggtgtcatcattgataacttcaatcaacaaaagaaaaagataggtctcctcccctcattgccagtggttggaagtcagcccagataagaggcacctttgtccctatctctagaaagaaaatgtccctctttctttctctaaaatctatattgttagctcactgtgaccctggcccccatacgttagccccaacccactctttctgttcggggctggattttgcagcatgtagtttaccacacttactagcagtcttttattcttgaggcctattactggtcttggtctcccaccagaagcaggtaggtcagagagtgcagttgagcaacagagatgaaaaggaaagaaacagatgaatagctatcgcaagaagtagaaactgtctagacttgtgattatctagtcaatctctgagcacaagcaaattgggatttgagagacccacctttggaaagtttacttccttacttgttctagatggttaacaagttttacaaagcaaattgaaaaaattgctcgttgctcattttgtaagtcaagtctatcccagcatactccaagacaccctccaaattgctttcttgcaccagaatttccaaattttgggtatcatctaaaataaattggctatcagccaggacacaaagatctttttattctaaaatgtgttttctagaatgtatcaggaaagctggcccccagaaaatgagactctgagatatgactgccttcagagtcactgctctcaagtttaccctttctgagggtctataattggatagtccatttcctttctaccttgggactggaagatcttagaaatcctgagctaaaaacaaaggcaggtatctctttagagctgaatgattatcgcgggtctaccccactctgggacagctattagctacaaaggaaagggataggtctcccctcagttctcagtattgaaccttaggtccaaacccatagcatgttgagagccagttgtaattgtctgttttcttcttccctcctttacttcggaggtcaggacatcttcatgaccgaagaacagaagaagtactacaatgccatgaaaaagctgggctcaaagaagccacagaaacccattccccgccccttggtaagtgcattgtgcaggctgaggccttggtgagaacccatataggaaaagtactagtagagttactgcaaaggaaggaaaaaggtaagtgattggctgctttgtgcctaatcctctcctcaccacccatccaaaagatctgaataggacagcagaagaacagggattaaggcatgggggcttttacatcaatcctcgacctatcctctgagccttccttgggcagccaccaagaatcagcatgtgaaccacattggctttggccctagtagagagatgtttttagagacaaccaaaagtcaacaagagaaaatgaaataaagttgctctctttcctgccagttcaagataggatttggtcataattttttcagcttctctctgctcaataaggatgtctttgcaggatgtatctagaagttaaaatcatgcttctggttatttgtgggagcagaagagggtaaaactatgggagtctggtgccctgattccctctcttgagctgagccttttataaaacagattagggggctgagattctgctccattgttccattggtgatggttgtcttgtttcagagaaggagaaggagataccctgctcctgattccatatatccggttggatgggacatcacccccaaaagccaggcccaaagttccttcttctgtaacttccatttagcaactttaaaaaacagacacaacaccaccaaaaaaacccagcagaacctttaatacaaaagcttccctgataatctaatttgtagaaataaaagtagagtgactatgtttgaatcaagagttatagttccagaacgttttctcccctcacccccacacgccgcacgtggtacatctaccgcatcaacttttgaaggaaaagaaattctagggctttgcagggcagattgaaaaccaccaagttaaagtaatcctggaaataagcaccagcccaagtatctcagtacttcaaacaaacaaacaaacaaaaaagcaaggaatctcaagaaagagaacatttggggttttttatttccttgatgttaagccttcattttgtgatagaaatgggactaaagggaatagaaaagggttaacatttctaaagttctgtttagtactttccatatgggaacctgagtgtattttcttccacattaaaatataacttccagcctaggcaacataatgagaccccatctctacaaaaaaattttgtaaaaagtagctgggcgtggttatgtgtacctgtggtcctcactacgtaggaggctgaggtaagagaattgcttgagcttggaggccaagactgcagtgagccatgaccgtgccactgtactccagcttgggcaatagggagggaccctgtctcaaaaaatacaaaataaaataaaatattttaaaaagtaggaaacattaataaagagtgattaacattcatttagcaaatatttatcagtctttactatgtaccgtgcactaagcattatgtgatgaacaaaaggtagactgctgtcatggagcttataataattggggagatagataataaataagtaagcaaacagctacaataaaatgtggaagattgtaggaaaaaaattaactagagggctataagtggtggatctactttaatatagtagtcagagaaagcctcactaaggagggtctacttgagtggatgagaaggaactggctgggcacggtagctcatactgtaatcccaacttgggatctagaggcaggcagatcgcttgagcctaggagttctagaccagcctgggcaacacagtgaaaccccatctgtacaaaaaaaaaaaaaaaaattagccgagcctggtagcatgcctgtagtcccagctactgagaaggctgaggtgagaggatggcgtgagtccaggagtcagggctgcagaggatatggtaagctatatcatgccactgcactccagcctggggaagacagcgagaccctatctcaaaaaaaaaaaaaaaaaaaaaaaagatggaaccaaagagctggggaaagagattcctggcagaatacacaagaccccagaagcagaaaacagtgtggccagggggtggcgagccagaggagggacattgatgagcagagtcagactgtgccaggtgtctccccgtaagccaggttaacaaatagggattgtgttgcaagcccagtgggaagctcttgaaaggttttaagtaggggaatgatgtgatccatttgttttttgttttatgttttgagacagagtctctctctgttaaccaggctggagtgcagtggcgtgatctcggcccactgcaacctctgcctcccaggttcaagcaattctcgtgcctcagcctcccgagtagctgggaccacaggcgcctgccaccatgcccggctaatttttgtatttttagtagagacaaggtttcaccatgttgaccaggctggtcttgaactcctgacctcaagtgatcaattttgggaggcctcggcctcccaaagtgctgggattacaggcgtgagccaccgcacctggccatgatccatttgttttaaatcattacacttgctattatatgaggactgcattggatgagggcaagagaagaagtgggagaccagttaagtggccagacaagtccagatgagagatgatggtggctcaggttagcatagagccaataaaaatggaatgaagtggatgaacccaagttataattttggaggaagaatcaacaggcccttcagtggatcagatgagggagaagaaagagacaaagatgatgcccagattcctggcttgagagcctggatgaataattgagatgagaggaacaagctgggtgaggggcagggaacagacttggctctgctttggacttaactgtgagaggcttggacatggtaagtttgagatgcttatgagtcatcaagaagaagtggcaagaaagcaactcaggatcagaggaaaggtatgggctggagaagaaaagcttaagcataagtacataggtatcacgtaagcagcaggaatagatgagctctcatagagcaaaaatttagagaaagaagggattgagagaagaaatggctggcagatgagaccaaaaaaggagcagctgggtaagtaggacgacagccagagtgtgtggtgtcacagacgcaaaagagaagtgggtcagctgggtatagtggtgcacacctgtaggcccagcttattgggaggctcaggcaggaggatcacctgaggccaggagtttgaattgctatgtgctatgatcgcgcctatgcatagccactgcactccagcctgggcaacacagtaagacccgtctctaaaaacagaaagaaaggccaggcatgatggctcacacctgtaatcctagcattttgggaggccaaggaagacagatcacttgaggccaggagttcgagaccagcctggccaatatagcaaaaccccgtctatgctaaaaatacaaaaaattagccggacgtggtggtgtgtgcctgtaatcccagctactcgggagactgaggcatgagaattgtttgaacctaggaggcagaggctgcagtgagtcaagatcgcaccactgcactccagcctgggcaacagaatgagactgtgtctcaagaaaaacaaacagaaaacagagagaagctggtaactttggaaagctcttggtgaggtaatattgatgttggtctccatccatgctcctgatagagcagcagagctgaccagtattacagaaaaggagggagagggtacctcgattagcagggtgacagcttccataggttggcttggaaaggttttcatgaatcttttatcttttccttcccttcctccccagaacaaaatccaaggaatcgtctttgattttgtcactcagcaagcctttgacattgttatcatgatgctcatctgccttaacatggtgacaatgatggtggagacagacactcaaagcaagcagatggagaacatcctctactggattaacctggtgtttgttatcttcttcacctgtgagtgtgtgctcaaaatgtttgcgttgaggcactactacttcaccattggctggaacatcttcgacttcgtggtagtcatcctctccattgtgggtgagtggggttggggaagtaggcgaggggaaaggggacctgactgattgtgaggatgagatttcccaggagaggaatgaatgacacaggtctgaagtgcaggcaagataccctcatagcttaagtccatgtgtgcccctgagtcatctcgggggcctgcctagcaggttccatggtcagtgagtttctactgagtgttctcggtagtcttggattataaattctgtggctcagggaaaaaagaaaaaaaaagaagattggttcttgcttttaaggagtttaaagtctaacagggaaggtaaaagaaagttgtcattaaaaaatgtagcacaatagaagtataaaatgaaagaaggaatgattgctaagttggccattaatgaaatagtctaggtaagttctggtggtgatggccatggtagtgctgctgttactggcagggcttgtttactgagattttactgtgggccaactacagtttgagagtttcttcacctgtgttatctcatttgattcttattacatcccaggaagcaagcttctttattatctggactgtatacatgtccacagccactcgctaggaggtggtggaggcataactcgagttgatcccaaagtccaagttttttaacagtgactgtgtgcattttgcttcaacctaaaagtgtggggggatgatgtcctggcaggcaggcagaaggaaatgccaccctgttgattgccctcccaaaatgtttccttgccttcctgaaaggcatcttttgtgataaaactcagccttgtttccaggtaagtttgactcatttacactagagagagtgctcgagacccatgggaccagccccagagctccagcggccatgctgggcctagtgtagtggttataaggtaccagaaggcaggggtctccccttggcctgtgccaccctctagttctgtcctccagagcagcatgtccaaaagtgtgttgatatgtggaacactaatcctagacatttctcctcaagaaaagaatctcatgagggaattactttaggtaacactgcctttaattttcctttgaggattcacagtgcacattactgaattctcttggaaatcctacggtaaagaattctgggccgggtgcagtggcgcatgcctgtaatcccagcactttgggaggcaaggcgggcagacaacttgagcccaggagttcaagaccagcctgggcaacatgataaaactctatctctgaaaaaaaaaaaaaaaaatgagccaggcatggtgatacgtgcctgtagtcccagttacttgggaggctgaggtgggaggattgtttaagcccgggaggtcaaggctgcagtgagctgagatcacgccattacacttcctagatgacagagagagacctagtctcaaaaataaagaattctgtttaaatgtaacatagcatcccacctttattagaccacagtttcctttttttcagtaataataatgatagctcacatttaaatggaacacattatgtgccaggtaccataataagtgctttaaatatgttaattcatataatcctctcaacaaacctctaagaatcctgaggaactgaggcacagagaggttcccaagacatgtggctggtaagtgagcaagtggggattcaagcccagcccctggcctcaagtccattctcctaatttctcacaaaacacactttggacaatgctacccttgtccactgctcttgaaactttcctggccacttatcgttgagtgacacagaaaatccacagaccaaatcataccccctattttcaaatggtactctaaaaagaggaagatgtttttgatgatggggatttttattaacattaatttgttcagaaacaaaagtatagaaatcatctttttaaagtaagaaatgtattagagttttgtagagggacaaaactaataggatagatgtatatatgaaagggagtgtattaaggagaactgactcacgatcacaaggtgaagtcccacgataggccatctgcaagctgaagggagccagtagtggctcagtctgagtctcaaatcctcaaaagtagggaagctgacagtgcagcctttggtctggccaaaggccagagagcccctggcaaaccactggtgaaagtccaagagtctaaaagctgaagaactcagagtcttatgttcgagggcaggaagcatccagcgcgggaggagatgaaggccggaagactcagcaagtcagcttcttccatcttcttctgcctgctttttctagctgagctggcagccgattagatggtgcccacccacattgagggtgggccttcctctcccagtccactgactcaaattaaaagtaatggcaaaaactgcaattacttttgcaccagcctaatctctggtaacacccagaaacgatactttgcatccttcagtccaatcaaattgacacttaatattaaccattacaagtccaccccttgccaacttgaacccatacacatctcctgaaatcatacttaatctccaaataaatacaataataaggtcctaattacgcctaacataatacagctatccttcatacaaccagaagcgcactaatccttaacctgaatgctattacataaagttaacaacacttaaatgctgatacgaagtcaacaaatcttacgtcacatgataaaggaaaaagaaaagaactaaaatgaagatattttcctagtacaagtgtatacatgcacaaacatgttcttaacaaaataaggaggaaatactcatgacaatagtcttcatttctgcaactggtcacgtggtcgtagctggtattgatgactaccttctactactcattctatattcactttgccttcagcaagcaccacggctggttgtggttatttacctggtggagtgacccaaatcttcattcctaaagggtttggggcatttgtagtcctacctggattgggctgttgtagtttcccattgaccttaatcacagggcatgctaatactaagagacgccctaagggatctcctgtattccatgcatactcttccatacctccattgtggagcagtagactgatttcatcttgatagtctgggtcagtcaccccagccaacactataactcccttcttagactgttgacttagaggtagcccaaagtggctaggtggccatcttaacttcaggtttaatggaatcattgttgtgtctcctagtgacagcattcctccctctggaactaagacctttaggccagcagaacataatgtcgcaggaacaggaggcaaaaattttgctagccggtcactaggggtgatggggagtggtgccacttccatttccaccccttgattcctggacccatgaatcctggctatgggagaaacagtaccatatattggacactgattcaaagcatacatggccttctggagaactttgccccagccctgcaaagtattgttacctagttggcattgtaatcatgacttcaaaaggccattccaccatgctatcaatccagctgcttcaagatgatgaggaacatggtaacaccagtgaattccatgagcatgaacccactgccgcacttcttagctgtaaagtgagtgccttggtcagaagcaatgctgtgtggaataccatgatggtgggtaatgcattccgtgagtccacagatggtagtcttggcagaagcattgcatgcaggataagcaaacccatatccagagtaagtgtctgttctggtgaggacaaaccgctgccctttccatgatggaagaggtccgatataagcagcctaccaccaagtagctggctgatcaccccgaggaatggtgtcatattgagggctcagtgttggtctctgctactggcaaattggacactcagcagtggccacaaccaggtcagccttgatgagtgggagtccatgttggtgagcccatgcgtaacctccatccctgccactatagtcactttgttcatgggcccattgggcaatgacaggggtgcctggggaaagaggctgagtggtgtccacagaatgagtcatcctatccacctgattattaaaagcctcctctgctgaggtcaccctttggtaagcattcatgtgggacacaaatatcttcacagtttttgaccactcagagaggtccatccacatacctcttccccaaatttgtcaccaatcatgcttctttgaagtccctgaccatccagccaaaccatttgctacagcccatgaatcagtatataatcacacatctggccatttctccttccatgcaaagtgcacagccaggtgcactgctcgaagttctgcccactgggaagatttcccttcagtgctctccttcagggatgtcctagaaaggggctatagtgctgcagctgtccacttttgggtggtgcctgcatttcgtgcagaaccgtctgtaaactaggccctagtcttctcttcttctgtcagttgatcatagcgaactccccatgaggccatctctgcaggctctgggagagaaggtagggtggcagcagtggggaccatgggcatttgagctacttcctcttgtaacttacttgtgcctttaggacctgctcgagcccaatcaggtgcataccatttccatttgacgatggaatgctgctgtgcgcacccaacttcatggctagatgggtcagagagcacctagttcatgagaggcggttcaggccacatggtaactgggtgacccatggtcaaacgttcagtttccaccaaagcccagtaacaggccaagagccgtccctcaaaaggcgagtagttatctgcagaagatggcagggccttgctccaaaatcctacggacctcctctgtgattcacctatgggggcctaccaaaggctctaaacagcatccctatctgccactgatacctcaagcaccactggatctgctgggtcatatagcccaagtggcagagcagcttgcacaacagcctggacctattgcagagccttctcctgttctaaaccccactcaaaactggcagcctttcaggtgactcaataaatgggccggagtaacatactcaaatgaggaatgtgttgcccccaaaatccaaataggcccactaggcgttgtgactctttcttggttgtaggagaggccaaatgcaacaacttatccttcaccttagaaggaatatcttgacaggcccctcagcactgggcccctagaaatttcactgaggtagaaggtccctgaattttagtctgatttatttcccatcccctggcacccaaatgtctcaccagtaagtccagtgtgtttgctacttctcgctcactgggtccagtcggcataatgtcatcaatgtaatggaccatcatgatatcttgtggaagggaaaagcgatcaagatctctgcgagcaagattatgacacaaagccagggagtttatatacccctgaggtaggacagtaaagatatattgctggccttgccagctgaaggcaaattgcttctggtggaccttatggacaggaatggagaaaaaggcatttgccaaatccgtagctgcatatcagataccaggagatgtgttaatttgctcaagcaatgaaaccgcatctggtacagcagctgcagttggagtcgtcaccacttggttcagcttatgataatccactgtcgttctccaagatctatctgacttctgcacaggccaaataggaaagttgaatggggatgtggtgggaatcaccacccctgcatctttcaagtccttgatggtggcactaatctccacagtccctccagggatgcagtattgtttttgatttactgtttttctaggtagaagcagctctaatggcttccatttggcctttcccaccataataggcctcacactaccagtcagccaatatggggattctgccagttgctaagtatgtctgtgtcaattatacattctggcactgggaaaatgaccacaggatgaatccgggacccactgtaagtcagacctgagctgaaacttcattaattatctgacctccataagcccttactctaactggaggaccacagtgatgttttgggtcccctggaatcattgtcagctcagagccagtgtccagtgtccagtagtccccgaaaggggaccagttaccctggtaaaagaccggaggtctccttggggaagcatgggagaaagattagcagtataaattgtcagtagtgtagtggggtccttcctcaaagggaccaggcctcccctttattcaaggggaatattattctgggtctgtacgctggttcaagtctggaaattggttgagggggcatgattctctatttttataattcaaattagccttttgtccacttgacctggaagttttctgcttacacaaatcaagaaagaatgtagtaggcttcctatcaatttcacttctaggaacaccatgattaattagccaatgccagagctctacactaatcagactattctgaatgctgctttgcctctgctatccattatggtagctacgcccaccttgcctttgacagttgagtgcccccactcagcccctgccaccttgggatccaattattcccattgcatttaaattatccagttaagtgactgcagttcccactgtaagatctggcatacagggaagagcaatcacagagctcttcaaggatgcaggtgctcccctcacaaatctgttttgcaagctattaagggtatgtcttctggaccctaccagttgggatgagtaggtctaaggtgactaatccactctagcattccaatctccctaagcctttggatcccttcctctacattaaaccaagggagatcaggcatttccagcttactcacagtgggccatcttttgatccacgtttcagctaaccaagcaaataaactattagaacctttttaactccccgagctgcgatattaaacacagaatccctgcttagtgggcccatatcaataaattcaacctgatccaactttatgttccttccaccgttgtcctgcaaccttaatatccattcccatacctgttctccagatttctgcttatacaaattagagaactccagcaggccaggcgccatagctcatgcttgtaatcccagcactttgggaggctgaggggggcggatcacttgacgtcaggagttcaagaccagcctggccaatatggtgaaaccccgtctctactaaaaatacaaaaattagccgggcatggtggcatgcacctgtaaccccagctactccggaggctgaggcacgagaatcacttgaacccaggaggtggaggttgcagtgagtggagattgcaccactgcactctagcctgggtgacagagcaagactctgtctcaaaaaaaaagaaactcaagcagttcttttggagtgtagctcatctcgtgagtcacactctgaacctcacttctagagagctgccatgacttgagtctagttacaggtctagaaacaaacaggggtgttgggggtgggttcagaagagaatcagcattgtcttgcttcaggggagaccactgttgcctcaagcattgcagggttaatctcagacaaatgtggaaaggctggtggcagcctgggtgggggaagggatattgccaccactgggggtgaggaggctgttttctctggcaaaaaaggctgtcagagtttacaagctcagtgtccccagcttcatcagggtcctcccacacatccctattccaagtcgcagggtcccattcttttccaatcagtgccctcactttaacaatagatacctagggaggctacgcatgcacctttccttgcaggccagccacttgcgtggtaagaacttgtgtctgattttccgcaaattcagccctttgtctacaggagataagactcagggaaatcttagaagacttgaggctcagtatgtgctctggagctgggagttagaatccctgagctcatccttttctttcattactttctccagtgaacttaggagaaccaaccaacttcattatattccttggttctccacatatggtcaaatgtattacgtacagagtcactaaactccttgcctctcaagaacgacgaatcaggaatatcaaatgccatctattttgcataactctctaaacagttcacaccagggactatcagtgttctccatactatcagaagtagagtccttagcatttttgggtctaatcagattaagcagccaactccagaaaccccaaaaccaactaaagaaatctattcttaaaattctgttcctctagacccactcctggtaccaaaatctgtcagggttttctagagggacagaactaataggatagatgtgatctcacatgatcacaaggtgaagtcccacagcaggccatctgcaagctgaggagcaaggaagccagtagtggctcagtctgagtcccaaatcctcaaaagtagggaagctgacagtgcagcctttggtctgtggccaaaggcccgagagcccctgtaaaaccactgctgtaagtccaagggtccaaaagccaaagaacttggagtctgatgttccagggcaggaagcatccagcgcgggaggagatgaaggccggaagactcagcaagtcagcttcttccaccttcttctgcttgctttttctagccgagttggcagccgattagatggtgcccacccacattgaggatgggtcttcctctgccagtccacagactcaaatgttaatctcctctggcaacacccagaaacaatgctttgcatccttcattccaatcaggttgacaatattaaccatcacaaggaattggggtaaaactagctctgaaaccacctacagtaccccttaaatggtgtttctactgcctacattactgtctgccccatttctccctttttctatggggacaaacacacattcatccttcaaaacctacctcagccatcatcttctctctgaagccctacttgcccaccatatatgggctgcaagtatcacatatacttgaatatatattatataacctgacttctttggtcactggttatgatttaattgagaagctgagaaatcatcatgggtgggtcctggctaaggtagagattttcttgaaggctcaaatatcccatggaattctagctcctgaagaggctccaagaggttacttgacccgctcgctgaacttaccgcatcttgtcttttcctgaaaagctaagattcttcaaaggggattctatagccttctgcagttaactgccccagtgtttatgcattcttatgagtgagaaatgtttccttaaattaaatccctcatgtcagctgaagctcccattgtcttgttagtgcctggacggcaagagaaggtactgaacgaagagaacatgtcagtgccttcccttcggttgtcatttcccagacttttcaactcccttccttctgtggcccctcatttgggtcccctcattgctctgtagctttaaagaacaagtggcctggttgaggtgaatccctggacgaatataactagaaaaaggcgctccgatttgtacactttcaccttctgcctttatatcctaatgccttggcatctttacctgctgatactggtttcttttctttttctcttttcatttttttttttttttaaagacagagtctctgcctgtcgcccaggctggggtgtgatctcagctcactgcaacctctgcctcccaggctcacgcaattctcctgcctcagcctcctgagtagctcgggttacaggcatgcgccaccgcgcccagctaatttttgtaccttttttttttttttgagatggagtctcactctgtcgcccaggctggagtgcagtggcgtgatctcagctcactgcaacctctgcctcctgggttcaagtgattctcatgcctcagcctcctgaatagctggaattacacttggctaatttttttgtatttttagtagagactgggttttgccatgttggccaggctggtcttgaactcctagcctcaagtgatctgcccacttcagcctcccaaagtgctggattacaggcatgagccattgcgcccagcctgatactggtttctgattcacgacttgcagcacaaaatctatcagctcagagttgaaagtcactcctgagagtccctttagttttctaggctagtttggtagactagggaggtagggctatgggaaaccaaagatgttttttcagagcaaagaagaagatactttgaaaattgctagcattagaataagtaagacatcaaagttaaaggataatgaggttatgaggtgtagccaggacctctcatttattgtttgtggatatggaaatttgattccattgtggagagtatcagtatcatcttggaaaatcatatgtgcacaaatctggaaaaaaaacctaatcattcttgagtagaaaaacaagtaaatgaggacctattcataaaagggactaccactcaattgttagaatgagtaatctaaaattatttcaacatgagggatcagtctcacaattgtaatgttaaatctcaaaaacaaggtagagacctaaatagatggacctcataagacaaatacagcctggatgtggcagttcacacccgtaatcccagcactttgggaggttgaggagggaggatcggattgcttgaacccaggcattcaagaccagcccgggcaacatagcaagacccccatctctacaaaatatttaaaataaataaataagacagaaacagtataatttcctaaccatagtaggaaattatatatatatatatgattcttacatagtaaatctataaaggcacacactagaatgatacataccatcttcagcattgtggatgcttcatctgggaatgatgaaagaggaagaaaaattggtaaaatgctagcctctattaaatctgtgttccattccagttactcaggaggtctgaggcaggaggatcacttgagcccaggagttcaagaccagcctgggcaacatagcaagaccccatctcaaaacaaaaaacaacaacatcaaaagacaaatgtgtgtgttagttatgtgtgttaggcacataggtgtctattttattgtttacttttctatatgtttaaaatgttacttttttttttttgagacaagaatcttggtctttcaccaaggctggagtgcagtggcacgatctcggcttactacaacctccacctaccaggttcaagcgattcttgtgcctctgcctcccaagtaactggaattacagatgtgcaccaccatgcccagctaattttttattttcagtagagacagggtttcaccatgttggccaggctggtctccaactcctggcctcaagtaatccacctgccttggcctcccaaagtcctgggattacaggcgtgagcccccatgcccagccaaaatgtcactttttgagagttcagactgaatagtaaggcacttattctgcaaagccctttgaacctaagggttccacaatgccaggtaaaaaaaataaagagaaagggtgtctccaatctcaataacataacttcttctattcctcttcttaggaatgttcctggcagatataattgagaaatactttgtttccccaaccctattccgagtcatccgattggcccgtattgggcgcatcttgcgtctgatcaaaggcgccaaagggattcgtaccctgctctttgccttaatgatgtccttgcctgccctgttcaacatcggccttctgctcttcctggtcatgttcatcttctccatttttgggatgtccaattttgcatatgtgaagcacgaggctggtatcgatgacatgttcaactttgagacatttggcaacagcatgatctgcctgtttcaaatcacaacctcagctggttgggatggcctgctgctgcccatcctaaaccgcccccctgactgcagcctagataaggaacacccagggagtggctttaagggagattgtgggaacccctcagtgggcatcttcttctttgtaagctacatcatcatctctttcctaattgtcgtgaacatgtacattgccatcatcctggagaacttcagtgtagccacagaggaaagtgcagaccctctgagtgaggatgactttgagaccttctatgagatctgggagaagttcgaccccgatgccacccagttcattgagtactgtaagctggcagactttgcagatgccttggagcatcctctccgagtgcccaagccaaataccattgagctcatcgctatggatctgccaatggtgagcggggatcgcatccactgcttggacatcctttttgccttcaccaagcgggtcctgggagatagcggggagttggacatcctgcggcagcagatggaagagcggttcgtggcatccaatccttccaaagtgtcttacgagccaatcacaaccacactgcgtcgcaagcaggaggaggtatctgcagtggtcctgcagcgtgcctaccggggacatttggcaaggcggggcttcatctgcaaaaagacaacttctaataagctggagaatggaggcacacaccgggagaaaaaagagagcaccccatctacagcctccctcccgtcctatgacagtgtaactaaacctgaaaaggagaaacagcagcgggcagaggaaggaagaagggaaagagccaaaagacaaaaagaggtcagagaatccaagtgttagaggagaacaaaaattcagtattatacagatctaaaactcgcaagtgaaagattgtttacaaacttcctgaatattatcaatgcagaacagctgtggagactctaacctgaagatctataccaaacgtcgtctgcttaccacgtaacacagctgcatcttgagcagtgacctgccaagggcaaaggaccccgctccctagacttacagattttctaatgcttgggcaggtggttactgcatgttccacatcagtcaatgcaacttaggacaaaactaaccagatacagaaacagaagagaggctgccgggaccagcatatttccgttgcagccaaatggattttattttttcattttattgattctcagaagcagaaagcatcactttaaaagttcgtttgttcatgcaaactatatttgcattcttacattagttaagctaagcagcaaaaagaaaacacacacacacactcacatttagcccatgtcatttaattgtcagtttctttgacataaagcgcatcttctccacatgggcttcacgtggtttggagatgggtgggggaaaacaatcaggtttcttcaggctgaggaggacttgctcaggccgattccaaacattgtgctcgttcaatgcgtagaaatgatttgcatgatggcatgccgtgatcagaagtcatgcatgagatccatacaccacaggacactactaatctagtcccttgcactgggtcagcctttggacaggacccagccctgcaccgttcactgtatttggagaaaatggtaagagttccataccggctacaattctttgagttcttaaaagtccttcatacaccttctgggtagggaaacaaccaactaattgactaacaccaccaacaacaaaaaacaaacccaatccaacaagcagatggatccgttgcgtgtatatgtttaacagacatctctaacatacagccattgttgcacattttgcaagatgaactatttaatgctgctctgtgtccagtacatgggggagactttgatcccaaatggcttgtactatttatgtcactgtaaaaccaaatcctagggctaaaaaaaaaattcatttgtatcttgcaatatttatgacgatcgtttagccttcatactggagaattgacacttatttggggtagagataaaagtgcttttcaaagtagcaccagttatctctaggggtaatttggggaacttaaaatgacctttcattgggagttatggggtgctcatttcatttcgtatcatgtcctctgcattgtggctttctccaggcatgggtcgataccgcgaggggttcagatattctgaactgacctctctcttctgcagaggggtcatcgcatactcacacactgcatggctccccctgcctccatcacatttctccactgagcagggcttcccttgcccacagaggtgggtgagggtagcagcattggggttacggctgtggtttctttcacttattattagaataatagtcactggtgagacctgaggtagagatggagccgcctctgaaccaagcccacttggtttctttactgcactggttttcatgagaaagcaatttaatattaattctttaggatgttccagcttccctcagtgcattcccttgcagccagttttgctatctgcttagcgacctgcccattgtcattgaagtgtggcttctgggggagcgtcatatcttccattccatctcctgctttaggaaagacagtttttagtccaggggtttctcacctaatgactggatttcaaagccaagatgctgcagttgaatgtgtcaggaagtctctatacaaagagtgaaaagagactttagcatgtgaaccaaatccaaataaattcttcctgaaccatacactagagggggaagaagaaccaacccataatcagacacaccgatctgccttgcagtagaagcactttgaaggtaatttcacagtccaccagactagttttgcatagaacaaaccacagtaagtcggcaagcagagctttctatcttgttggaccactagaaactgtccagctctcttaagcctgcttctgcagcagcatccgtagaatttttgtactacacccaataccagactgggaaggcctatctttcagtgaccctgctaactgctaggatgaatgtatagtaacatgtacaggctacattgtaaacagcacaaaacagaagctgacatgtgtggttattctttttaagagaattataaatactgtaatatataattttattttattggcatgcctttttgtaaatacaaattattaacttattaaataggaaatggcttctggcttatgccattgtcatgtttatttttattttttatacttttctttcttcttagaacttagatgctgtcagccaatgtacatccccaaaccagacagacagacaaaaaattttttattgctaatggtcttttccaaaacaacaaaaaatatatatttttgttccaatgtgcaataaattctaaccacgtctatgcaagatttggctaaacttaataattgttcttaggtcttgagatgggcaacagagctgtaagatcccgccaagtacaccatgtgctcatgctagtgatgtcattaagctactagggcatagtgatgagatttttctgagatctaaccgtttccctccgctagctcctgaccccagcccagcaggctgtctcctcagtaacacatgggccttggtatctggcacccatcagccagcctcataggaaagaagccacctccgctgtatttgaagtttcactttttaaaaaaaaaatgtttcccacctttttatccttcacccactgtccttccacctgctcactc

SEQ ID NO: 15948 - DNA, 7299 bp, Human
ctctccacagcgtaattactctctacctgcgctctttctagaatgcctccaggccagggaggcttgggaccccgcagagccgccgcagcagcgggcccccagcgctccctccccgcgtgcctccggctccgcgctctgccctaccccagcgctgctggcgccaggcgccggggagagcggggggtttccagcccgcctcgggcaggaaaccaggacctccctgcaccacccccccatgcacctccagggcccacagccctgctgagctcccacaggtggaaccagcaggcccaggcttttgtctccgtcactcctgtatgtaaccccccacccttcattcactctcttgtccaggagtggaattccactcatccactccctaccggacctcgagaaaatcgctcttcttctctgggcttcacgttccatatctgttcaaggagagaatgggcctttctccctctgtctttggactagtaactatgataggcacatagtaggcatcaataaataattgttgaatgaatgggtgaatgatttgccttctaaaaagagcactcacattaacttctcctttccccctcccctcgactttgctttgaagagaggcacactccctctaccacaccgagggagggggcgttgagctgagaaaggttgagagaatgagggacccaggtaggtggacatcggccaagaaaggaaccacagcgggaggtaagaccgagagtccccagcttgaagcgtcaccactccgggattcccagattccaacgcgagcctggggaaagcccacagtggagagagtccggctggcagggaatggccctacccccggggtgaaatctcggagggtcgtgcagccgagtcgcgcctctgcgctgatgcgtgagagatgccggacgtcgcgtttgcctgtgcgagcctcgcggatgctgtgcagtcttggtcccctctgcgtgtgtctaacgccgaatgctggtgtctcgaggtgtgagcttcggggccggtgtctttaaagaaccaaagattcttaaggagtgatgatctgggtagagcggcccgacgtagccgcgctcccaggtctcggtgcgagtcctgcggacagaccagaggagacctgctggccagatgccccgggcccaaggcggacgccagactgtctctgcgccagccgggctggccttcggaatggatcaggcacccgggaggccggagtggatctcagaccctcaagccgggaacaaacccgtcgatgcccgtgggcctggagtccgcctcctccttcccgccccacccctacccctgcctccgaaaggcttcttcgctggtcagtagctgcgtgcccgtctgcctgaggctgggtcagaattggcgggctggtaacgaccccgtgcacaagcggctcccagtctctccagaaagggccgatgactaaggggtgggggtgggggcggagggctggaaggtgttagggaagaacgttagcggcctatcctgtcttcagcagcgccctctcatcttctagctctgacgccgagcagagcagttggagctcgggactgggaactgctggaattcctatttagacttctagacagtctagaaacaagaacctttctttccctgggcctcagtttccttgtctgtaaaatcaaaaggcgggctctaggtgtaggccttcttttcgcttggtgattctggattcctttccttggatccgtggggagggggtggcagcaacagtccagggcgttggccgtcctgtgcctcaagtacgtagtccccgtgcccgccccctcaacacccccagcagcccgcccccctaagcccgcagagcagggagctgagtgggaggggcagaggcggggccggttcccagtccctgctggcggactagagtggcgcgggctgagcgtaaaacctgggatagccactcccccttttccttatccccgcccccctgccattggctcccgggagaggttgacatcaaagccgcggtctatataagccagatccgcaggggagtccgcagaagggttaaacaggtctttgggcttcggcgacctcgcccgcggcagaaaccggtaagaagacagtgggctgcgcgtctcattttcagccttgcccggactctcccaaagccggcgcccagtagtggctccagagcccacaggtggcccccggcagtctctggggcgcatggagcggcgttaatagggctggcggcgcaggccagtagccgctccaacatgaacctcgtgggcagctacgcacaccatcaccaccatcaccacccgcaccctgcgcaccccatgctccacgaacccttcctcttcggtccggcctcgcgctgtcatcaggaaaggccctacttccagagctggctgctgagcccggctgacgctgccccggacttccctgcgggcgggccgccgcccgcggccgctgcagccgccaccgcctatggtcctgacgccaggcctgggcagagccccgggcggctggaggcgcttggcggccgtcttggccggcggaaaggctcaggacccaagaaggagcggagacgcactgagagcattaacagcgcattcgcggagttgcgcgagtgcatccccaacgtgccggccgacaccaagctctccaagatcaagactctgcgcctagccaccagctacatcgcctacctgatggacgtgctggccaaggatgcacagtctggcgatcccgaggccttcaaggctgaactcaagaaggcggatggcggccgtgagagcaagcggaaaagggagctggtgagtcctggggcttgcatgctccagccaagggtgcaggagcggtgagcagcctcaggccatgcaggtagtcgaaggaggctgtgttgtcctgtgtccgatttggaaaggttgggaagagttctgagatggttggtcacagcgtgcgatcctgtgcatggagggaggcagattcgtcatagaattcatttgtaatacgggagagtgtttgtaatactgagtgaataatctgtttggagcctcggaccctccaaaaatgcacacaccacaggttttgcttccaatttggagaagtcctgattcattcctgggctctcctggaagccaggttaagaatatgtgttaaagttctttactttgagtttgaatttatgtgcccgggctcggttcctgttttcaaagggcctttgctggaccggctagtctacttccatcattgtataaatagggaaactgagggcccagagtgggtcggggcaggaaaagcacctatctgaggagtccagggtggaggtgaggtaaaacagatcgggtcttctactcagtccagggccagttctggttctccccatggactggttctgaggacgacttcagtggctttgcatgtaaataagagccacttcttttagctttggagagcgcagtctcgtcttggccttcttgatcctctccggttagggtgacacttcctggcactcggtctggctgtccggggctgggggcttctgagcgctgggttttcaggctggccaatcagtttctctaggttggggggcttaaggccgtagcggagtggagccagctgaagcgccccacctggtttatccaacctgcgggggcctgtggtaaactgacgaaagctcatccagggacgagggaaagataaataggcatcgagtctctaaacggctgccccggactggggatggtgcaggccggcttctttcgaggtgcggcgcctcgaaagaagttgttattgggcggatcccggcccccacgcgtcgccgcctccttcaagtagcaccgcttggttcctgctgaaagagcgggaaggaggacgctaggccagctcgactccccgctcttttacctccgtatctgaggctcccagctccggcttagggggccccaagcctgcatccaagccctgatgtttaaaccaggttgggaggctggcggaagtgtgtggggtgcagcgagagcgggagaaccgtggatttccacccctcccttccaatatcctgggatctcccttaggtgtcctaaagccaaatcaacgcgcgtcagtttcaccagacgcagaacattttccttaccaaacctcccgaagctgcccagcccatcccgggtcccaggaactccgcgcataaaggcaaatttacgagcctgtttgcctatttcgcaaacagaaatccgtcacttatttaaagactcccagttactgctcccgacaccttcccctcctcctcatcttaccccatgccgggcgatcggagcagaaaaattaaaacctgtctctcccgcctcttttcttctgtgtgtcctttggcagcagcagcacgaaggttttcctcctgccctgggcccagtcgagaagaggattaaaggacgcaccggctggccgcagcaagtctgggcgctggagttaaaccagtgagccgaggcccgcgccgaggacctggccaggccagccactcctgaagccccgggaggagaggaaggcagcggcgaacgccaggctctgggctccggcgactggtgctacgcatcccgcggagcttctgctgagcgccggcaggtcgtcggctgcaaccacacacttggatcgcacgtgcaatgtcctttgattttttttaatacattaagagaaagagaaatatatatatatccacccccagcccaaccgagggcggcccttggcggcaacatgcaagaaggagggactgtcgaacccaagggctcaaagacgcactcttccacccttttggagcgaatttagaacctcagccctatctccatttccctatctggctctttctctcttgtccctccatatgatccgccccgacgccgtcttctctaattaaaatgcaataaggaatcaattcttttctgcctgagaaagagaaccagacgcaggaagatgaaaggctgccctttgttcttcgaatcgtggtggttttattttatttttctttttgtcgctgcacttcctgtttagttccaagggaaacactttctctctttctctgtctctctcttttcttccttcttttccttcctttttgtttctatctaaataaaagctttccctgtgttggaaagtttttatgtatttaaactacctaccatgcctgttgtgctcaggtgtttgttcatcctgccatccccaacccttttctacctcaagtctgtgtgaccactcacagcccccctcccttcgccaaagcagtgtctatgctcttgattaataaaacattttctgaaatcatctgaagcctgtgtcatgtctcaaccggggtccctcaccgactcccatggcttctgctaggtggaaagcctctgttcctgctcctcttcttttgataaacacgaaaccaaacttgaaatcaagggaagccggcagataaagaatgtatttcaagaacaagagcaaagttctctttagactagaacgggaggtgggggtaacttatgggaacggggaagaacaaaaacggaaacgaattagtctcagagggcctgggctcgggtttttgtgcgttgagtattcgtgcttgtctggaggttagtatgcccactggtgtctgcaaagagtggtttggagtgtttattgggagggaagggggcctagcacacaggtgaatcctatccctggggcagggtagctcaggagagggggtgttggtggggaatatgttcatgtatgtgaaattctcaacatatagatgtacatgtgacagtgcagcaactcatacggagcctgaggctgtgcaggggccaacaagggtctgcttagtacagctccaagcacacagtaaggacttgacaagtcacagcagctattattattttatacctgagtaaaataagcttgtgagtgcttatatgttaaattgaggtatttaggtttctctttagcaacgaagcactcgacagaaggttgtgagagcatatggatttgtgcaaagggatggggtgtatgtgtgtatgcgtgctcattcgggcacttgtgcaggagagccagtctttgtgttctctcatgcgcacccatgactaggtgtggtgggtataaattcggtgcatttgccaaggatcttggatgcgtattgggctaaactggggcgggcaaacgcagtggtttatacttccaggaataataatgtacgaatactttggttgcgtgcaactgtgtgctaggcactgcgctaagcacttctgtgtctcccaacagctcccatggttgccccacggagcgcacgctctgcagcgcctgagggtctgcggcgctcactgcgaaggaggaggggagacccgtgaggctgtcttggaactttcgctctgcgcacctggagcctgagcgctcggcttgggaacaagaaaggagacctcaggcagctccggggcagggcctcgtggggcaccaggcgtgccccaggcgccttgtcccagcgtcggggtgaatatgggaccccattagtcttggctgtaaacaccgtagcaggggctgagaggccacgcgggcctttccggacgcgaaggagttaataaaaggtgttttatgggcgctaggaaacagtgggggaggtgtgagcttctctctctactctcgcccccctacttttttcttttttccctctcgccacccgccgccagatcaaacaggcccgcgatttaactagggcaacacttggcggtaatgagcccgtccgacgcaccccttcctcggcctcagtacccggcccgaggccccagggcccttggggaggagcagagagaaaaatcaaagtttctttcttgttgttttgtttttcttttctttaccttctttctttccgtttctttctgggagtccgtttagaaattccggcgcgcatggagaaacagactcagggagggaggtgatctaagccccacagcacggagggaagcttatctagattcgaacccaggactccaacttcgctcacacacaaacctctggctatacacaggtcccagctcccaggactatttttagcaccgtgaagtatcctaggcacgggaagaatgcgcaccctggtctagctttcttatagccggggaaagaagagggggtgctgagggagacccgccagcggccgccaaagccaagtctggcataaccaggcctcttcagaaaacccaatcctgctggccccaaaccctctttgggaagagagccttggagccctaaactcggtctcagaaacgtgcagtccctgaacccgggagccgagacggagccggcgcccattga

SEQ ID NO: 15949 - DNA, 23222 bp, Human
atgagtcacagagtgggcacactatgaagagcaggtggcagcagtaggcactctttatgtagagcaggcagcagtgagtaggcactctttatcaggagcagatgatactcagtaaacactctttatatagagcaggtggcatctgtaggcactctttatctagagcaagtggcattcaataggctctctctcttttttatttttttgtgagacagagtctcactctgttgcccaggctggagtgcagtggtatgaactcaactcactgcaaactctgcctcccgggttcatgagattctcctgcctcagcctcccgagtagctgggatcataggtgcccgccaccacgcccggctaatttttgtatttttagtagagatggggtttcaccatgttggccaggctggtcttgaactcccgacctcagatgatctgcctgccttggcctcccaaagtgcttggattacaggcgtgagctactgtgcctggccagtaggcactctttatgtattgcaggtggtactgagtaggcactttttatgtagcgcaggcaagagtaggaactcttcatgtagagcaagcagcactcagtaggcaccctttatgtacagaaggcagcccacagtaggtacactttatggagcacaggcaacactcgagcaggcagcactcaatagaccctctttatgtagatcaggaaacactcagtaggaagtcaccatatagagcaggtggtatcagtaggcactgtttatgtagagcacttggcactcagtaggcatgtgttatgtagacagcaactggtgctcagtgggcactcttcatatacagggggtggcactcaataggcactcactatgtagagcaggtggcacacagtaggcactctatgaggaatatcaggaactgagtatacagggttaatgtagagcacctggcacacagtaggcacactttatggaaagcacttggcacagagtagacaggatttagcacctggcacacagtagctgcccttcatttagagtattggcacacagtagaagtactttccatgcagcctttgtgcagagtagagactggcacacagcagctcaagtgctagttgccaccctttcccttcactcctttttggggctccctcctcttaggagccctcattgtcccccgctaaggccctcatcgaacatcccatttcccagatgggaagactgcacccaggaggggcagtactgaccaaagtcagagcaaggatgaggcagaatgaggactccattcatggttccctggctctgcccttcccctgcctggaccccatccgttccctctcatcctaaccctccacgtccccgctctgtcctcctatactgagtccggcctccagatttgcttttccagctgagctcttaatctccagaatctgacccaggtaatcctcagtggggctggattctttgttcccgttcctagcagtcaggtctccaacagggccctggactgcctggaggcaagacttgaactccatccagcagcagggggatagaggcttgtctcttccaggttgcctgattcagcatccagaagtggtacacggtgtcctaccggcccagggttagagaggagcacaggagatgatctggaacaaggcttggcctggcctggctcgcttgacacctgaactctcaagttcatgcttttatctgccacacactcagtaggtgctctttaagagcaggtgtcacacagtggaaactctatctgacccctctcggcttactctccaccttatgtgggaggtgctgagacctgaggatccagtgcctgtgctgtgtcaccctgagctggttcctctgcatccagctggtctcccacacccaggttttggccagctgcccagacatgggagcggcacccaggctgtggggattggctggcccagcccagcccagcctagcctcccacagccttccctacatcaggggccaggggaaaaaacctcccagaagaaggggagaggaggttgtgtgggacaaggtgctcctgacagaaggtgccagggtgggggtggtgggcctggggcatcctagcctgtgatggagatgggcactgggcaagggattgggcgcacacataggggagccccagccttcccacattctccattgctgcccaaggcccaggcagctcctggttgctggcttggaggatgagtggttttctaactgaaaccaagcccctggcaacgtcctaatgattcaggctgggcctttctggactttaatcagtttctctgtctttctcaatctaagtgcttaccgggtaactggaggccacttggttgctggttttggctgggcctttctggactttacccctcagcccctgtttatccatccctgtttactcttactgttctatctccagcactgcccgtctctgcctctctccactgtccctggagctccctgggcccttccctgggcctcaggacctcactcaccaccccatctgccctgcaggatgccacagctgagcctgtcctcgctgggcctttggccaatggcagcatccccgtggctgctcctgctgctggttggggcctcctggctcctggcccgcatcctggcctggacctataccttctatgacaactgctgccgcctccggtgtttcccgcaacccccgaaacggaattggttcttgggtcacctgggcctggtgagtgtggcagcaggacgggtctggggtctcagggtggatggacttcctgaggggtaagaatgaggctcaggtgagagggggtgggctggggtctggggtggcagagaagcaggggaggcgtcttactcattcctctgcttactcatttctgtgaggtgccaacccaagcccttctcacctccctgttctcccactcttggcctgtgttgaatccttttcctgcctgtctttccacattaatgcacctctgcggggctcttgggcagggggttgggtgcacagaaaggtgaacccctggcgttcccacattctccattgctggactcgaggcctcctgtacccactgttcagggtcctctccctacctggcctatttcctcttatgagggtataggtgggccagaggagaggtgtgggctgtctctcacctccaccacatccggaggcaccttcctcttatcttgttcctccccagtaagatgtcccaatggggtcctgttgccaaacccacataaaagttggccactcacttcccctttcagaagccttccctgacctttctcctcccccagaccttgccctctgacttagacctgctctcccctttgcggaacgtggtctcaatctgctcattgcaaatggcaggattgatgggtgtgtccacaggtgaagtgggagggtgcacaggatgcactagcacagagcctggtgcagaagcttctcccaggtgggagccactgtcatgatggacagttagagtcacctctgctcccctagtgactgctgagaagggaaggtcccctgtgtgcagaaccttctccatgggaggaactggaacctgtgtggctggtggaggaaccagccagggcatgaagggatgtggggaccagccttagggacatgtcctgagtccacactgctccccacaaacctcccctgtgaggacctcctcatatgcccacctctgggctgaaatgactcccagaacaaggaaatctttcctctcaagctaagtgggcctctgtgagtggacagtgtgtcttttccttctgccttgggatgcgctcttgggacttgggggtggccccaagagagatagagcaggaggaatgtagacagatagataggtaataggatagatggatggatggatgcacagatagggtgaatagatggctggctggctggataagtaggtgggtagatagacagatagatagatagataacaggatagatggatggatggacagatggatgcatggataagatggatggatggatggatggatggatggataatacatacataaagtagtagataagatggatacattaggtggatagataggtagagtggatatgtaggatggatagattagatggatggatagatagctagatgattgatagataataggataaatggatgagtggatgaatgtacagataagatggatggatggatggatggatgggcagatagatatatagatagaaaagttagataggatgaatagattagatagataaatgaatagatagataggtaggtagatagataataggctagatggatgaatggatgcacagataggatagatgaatggatagatagacagatatataagatagaatggatggattagatagatggatagatacatagaaacataggtagatagatagattagatagatagatagatagacagatagatacatacatacatacatatatagatacatagataggtagatatgtagagatatatataggtaaatagatagatagatagatagatagatagatagatagatagatagatagatagacagacaggcagacagacagatagatagatagaagagggagtttatttcgggaattggctcacaggattatagaagctgagatgcgtcatggactgctgtctgcaggctggataaacagacactggttgtgtaactgagtccaaaggcctgagacggtggagttctggtgtccaagggcaggagaagatggatgtgccagccccacaacagagcaaattagcctttcctctgcatttttgtgctacctgggctctcaacagattgaatgagctctgcccacactggggagggtgattcttccttcctcagtttaccaaattgaatgccagtctcttctggaaacaccctcacagacggatgatcaactatctgggcatcctttagcccagtcaagtggacacctagaattaaccatgacaggaggtgacggcccctgccttgcttgcaggtcacccccacggagcagggcatgagggtcctgactcagctggtggccacctacccccagggctttaaggtctggatgggccccatcttccccgtcatccgtttttgccaccccaacatcatccggtctgtcatcaacgcctcaggtaccacctggaatacttggtggtgggtgctatggtgcatttgaggcctgcaagtccctctatccccaagccgtgtgtggcccctgcagtactctggtctctcctttccttctctctcagccatcttcatctttctttcatgtattcactaattcccatctcagcatctcctctctccattgccatctgaccccctgtcctggtgttctgggctgccctggggccccaagagacctcaacccaaggccctgtcctggaggaacccccaagcttaaggaggtggatgtggacagagacatccccaacttcatggggtcaagaaagggccagagggagatggatgacagcccagagaagagcaagttctctgctggggcaggctggaagccttcctggaggaagagttactggagccatgtctggaacaatgagtagggatgtttgaaaggagagtgcagggtgatgcaattgggcatcgttagtgttcaaggccccttgccaggtctagcgtcaccttgcctgtcacaaaggttagaacaatgaggacttgtggctggtggaggatctggactgttatttctgtgatgtccatctctggtgtgggtcaagtccttttaccccatcctgtagtttgtctgccctaagttcattgcttttctgctctaggccctgggaatctccaaaaggagactccagcctagtttggggccctctccttgacccctgtgcttcccttcttggacaggccaggctgagcagggaaacaggcagcatcctacagagaccatggctctggcctcaaaatgctgagtgactctgggctggttcccagctgtctctggttactgaggtctctttcagttgtgagtggtggaaatccaacctggtgtagtctaagcaaagaaagagaatctattgattttaaagtccagggaggatggccttcaggcatggctggatccaggtctcacacagtgttacttcctctcttggctttagctttctccacgccacttttggcttgtcttcctttcttggctttagctttttccacgccacttttgctttcaagacagtctttccctcatgacgtcaacaatgagtcctagaagctcaattctcatgggaaagcccacatttcccccagagttcccagaaaaggcccatgatttacttctcctggcctggatcaccagatcaatttttcacccagtccctgtgtttctgattgcctagtctcggcaggcctgggccttctagagctactgttttgggggcacaaagaagtttgatggttaaggaatcaggccatgggtgcagatagacccagtctcaggcctcaggtttgccatggtctgggactatgggcaaattactttatcatttagagcctcagtctcttcatctggaaaatgggatgaatgagagcccagggaacatggtgtgtggatccacatggggaaagagcttttctgtctgtgtaactgaaggactggagagtcctgcatggaggatgtgaggaggaagcccagtgggggctcagcactgagagggagatgagatgctgcttgaaattctcagggagagggcttccacctcttccctgcagatccttctctctcgcagcctaggagagcatgaattgggtcctgtgtctttctctccagattcacagctcggaggaaggtctcctatacacacaaagcctggcatgcaccttcggtgatatgtgctgctggtgggtggggccctggcacgcaatcgtccgcatcttccaccccacctacatcaagcctgtgctctttgctccaggtagacactgcactggccactccaggtagacactgcactggccacgccttgcccacagctggggtctctgtgctgcctccagcgggtcgcgtgcccatgtgcagacaggaggggctgtggtggagatgccactgcttccatctcccctggacttccatctgtctgacctctgttcctgtttgctcatgtctgggaagtgtctctatggtggctgttatatggtcaagtctgctgtacggctacgtcttgtcacctgtatatttacacctgggtcctggttacacctgaaatatgttatacccggttacatctggtatatcattccaactgaggtcatgtagagctggtcatgtgtggagttcatgtgtggccaaggacatttggggcatgtgaggggctgttttgttcttgtcgcaggtgctgtttgacactgccgttttctcctgctggtcacatctgggccatgtttgggggttgtgtgaggtctgggacccagggtccctaagtgaactgtctgagacattatttgagtcttgtctgaggcatgtgttgtagtatgtttgggtcatacgtgaggaacagtctgggtcacgtgttggctatgtctgggtcgttaaaggtaccatatttatattcaacctggagcctgtatgtggaacacgcttttaaggtcatgttagaccatctcatgtgcatgttagagcataccatctcatgttaggaattgtcatgtattttgtggccatgtcaggacttgtgaacacatgtcagtgtcatgtctcatgtctaggtccatgtcagaagatgccatgtgagaatatgtcagagagtgctgggacagacagggtgtcctaagtccttgtgaaggcattctgtagagtgctgagcgtgttcagggtttgcagaacatgttggatcatgtaggaggcatgtcaaggcatgctggagccctgacatagctcctacgtgccatgttaggcagtgtcattgctgtgctgtgctgccgtagcctggtctggtcttccctcccctcccccatcctgccttcttcctctccccttgaccctcttcttgctatgtggggcttggagggaagaagtgcaaacctcttgctgggagcctccccccacccccaaagttcctccttcacctgcctccatggcccctgattgtcctcatttatgtcagctgccattgtaccaaaggacaaggtcttctacagcttcctgaagccctggctgggtgagtatctgtaggtgaacagggttgggaacaacctggggggccaggggagggagatgcccttgcccatggcccttggctgccctgccaggggatgggctcctgctgagtgctggtgaaaagtggagccgccaccgtcggatgctgacgcctgccttccatttcaacatcctgaagccctatatgaagattttcaatgagagtgtgaacatcatgcatgtgagttatttgaagccaaggtcccagctgcagcctttggttggggggaaccacagacagatctagtctggaattttggctctgctgggtgcctctgggccattgtcttcctctctgagctttggtttcctcatctgtaaaatccctacttaaaagaaggtcaaggtgatgtagtggagtcatgtctctggcgcatagtaggtgcccagaaggtgtctgtttctatgttcgcgtcacccgaaccctgtaaactcaagagggtaatgacaacaattgcataatagctgttgctgataagaaacaacctgaaaactcattggtttaaaccaataaaggtttatgaatcctgataagtctgtgggacagttcgtggattcttctggatgtggatggaagggatcagtcatggtacatgagcagcctggggtcaggtaggcagccttgctggtgttggctgagttctctcacatgtttgggttttggctggcttcagaccgatacagatggcctcagcttagacccctggatgttcctccatctgattctctccctccagaaggagtcccatggtttacaatacagatagggttccagggaataagatgaggcttagcttcattagttatcacctcatcatttttaccacattgtattttgacatcaaaagccaatagtccaacacggaatcaatggcagggggtaaaataggctctgtctattattgggagttgctgaaaaagcacattgcaaagggtgtggatatggggagaagggaagaattggggcgaaggttttgtgaagtgtttagaattttttaactttaaaattgatgttaagctagttactgtttcataaattattctggaagaacaagaaactcctgggtcagagacaaaggatagttttactactcatgacacagagagcagcatgtgttgcttgttagattgcacttcttctccaagcctctcaaatcccatgggctgacacaagtgggcttctataaatgcctgctgacatcatatattgcattacagggaaggggcattaggcttaggaatctgtttttatagcaagcagaagcagcatatccagggggtgtcccttatcctcaaagttattttctgcaaacacaactctgagaaatttttcaagttaagaacatcagcgtgttgcatttgtgacatgcccagaaagggtgctcaggactcatggaggactacctctacaaacctaggatatttttataatcaatttataactgcagatgaggaaacccaacatttattgagaactcacaatatgccagaaaaaatgccatgtgcccattccatgatacgagtatatattgtctaatttgattttaacaactctgcaaaggagagattatgtatttctgccccatggtagatgatgaaactgcaggtctgagagattagggagctaacccaagttcacccagctaatgagtgagcttggcatggtggagcagagtttctaacatgaattatatggctccaaagcacatcatcttaactgttcctgaatatctgacaggtgggatataggggagggtaatgagttgactaatggcacacagagcacagaggacagagctggaacttgaacctaggtctcctgactcccaatcttgggtcttcatctcttaatagtaacagcttttgcttgcaccataacctggtgctcccgggtaaagggtccctggggagaagatgaagaggcttattctggggcgtgcatattgattgttggggttggagagctgctcaagggagcaagggacctgccccagctctgtccccttctctggctaggccaagtggcagctcctggcctcagagggtagtgcccgtctggacatgtttgagcacatcagcctcatgaccttggacagtctgcagaaatgtgtcttcagctttgacagccattgccaggagtaagttcttgcccagggtctgggatcctgggccgtggacacaaagttggtaggtggggggctggggaggactgagcagggaaatcagacaaaccttcttggaggagttgttatacctgatcgttgaaggactggtatgaattttatcttgaggtttccagggactcattaaaagggtttgaactggtgggtgtggtcaaagtgggtctctctcagggactgactgtaatgtagcactaaatggagttaacactgatgcaaagaagctagggtggaagctggaccatggaccagttggaagaggataaagtctgagctttgtggacagcttcaggaaggagaaggggcaagactgtatactgggagggagagagggaataggagcataatgtgcaaactatcctctgggtgcctagctgcatggaggcatctcacagagatgggatgcagggagagataagagagcctggagagtcgatttcatgctgatccccatcctgcatctgaggggccatctgttcctggataccccgtttactgataggaggtagctcctagctgctggtgggaggtgatcctggggcttcaggtgtattaaattgttgcctccctttctgcccttatcctgcaggaagcccagtgaatatattgccgccatcttggagctcagtgcccttgtgacaaaaagacaccagcagatcctcctgtacatagacttcctgtattatctcacccctgatgggcagcgtttccgcagggcctgccgcctggtgcacgacttcacagatgccgtcatccaggagcggcgccgcaccctccctagccagggtgttgatgacttcctccaagccaaggccaaatccaagactttggacttcattgatgtactcctgctgagcaaggtgggcctctctgggatctgaattcaagaagtagaagggagcttcatgtgaaatgtcagatgaaagaatttgaacttgacccagagggcactggggagccatggaaggtgattgaggaagggagggacaggtcagagataggttttggagatagctctgtggactagcacctaccaggggactgctaaatgaaattgtgatgagtctgagatttactctatttataagttaataagctaattggccaccttttaatctatatatctacatctatacctatgtctgggtctatgtttatgtttttgcctatgtctttctgtatctttgtctctgagtttgtgtctctctctatgactatgactatgtctatgtctttgtctttttcattggccatatctgtatgtctttgtctgcatctgtgtcttcatctttgtttatgtttatgcctttgtgctctccctccctccctgccttctttttctttctttctttctttctttctttctttctttctttctttctttctttctttctttctttctttctttctttcttttccttccttccatctttctttctttctttttctttcgttctttctttctttctttcttttctctcttctctctctttctttctttctttctttctttctttctttctttctttctttctttctttctttttctctctctctctttcctttttttgacggagtctcgctctatcacccaggctgcagtgcaatggcatgattttggctcactggtaacccctgcctcccgggttcaagtgattctcctacctcagcctcccgagtagctaggactacaggggcacgccaccatgcctggctaacttttgcatttttagtagagacgaggtttcaccatgttggccaggctggtcttgaactcctgacttcatgatccatccaccttggcctcccaaagtactgggattacaggcgtgagccactgtgccccaccttgtcatgtcttttctatgtctgtgtttatgtctttttctatatctatattttcgttcttgtctatgtctatgtgtctgtgtctatgtctttttcttttctctgtgtttgtgtctttgtctcagtgtatgtctatgtccatgtttttttgtctgtgtctatgattatgtctatgtcaatgctatatctatatctttgtctttttttttttttgagatggagtctcgctgtgtcacccaggctggagtgcagtggtgcgatctcggcttactgcaacctccgcctcctgggttcaaatgattctcctgcctcagcctcccaactagctgggattagaggcacctggctaattttttgtatttttagtacagacggagcttcactatttttagtctcaaactcctgagctcgtgatctgcctgtctcagcctcccaaagtgctgggattacaggtgtgagccactgcacccggccatatttttgtctttgaatttgcctgtgcctgtgtctgtttttgtctgtccatgtttatgtctatgagtatttgtgtctgtgtctatgtccatgtctatgtttatgtgtatttgtgtgtctgtgtttgtgtctaagtctatgactttttccatgtgtttctgtgtctatgtctgtgtgtctatgtctttgtctatgtgtatgtctgttgtgacagaggcatttaatctctggatcagagcagctcatgtcttgcttatggcaatactatcagccagagtaggattgtggcactgactctccattcccaagtcaaattcctccaagggcaatgcgatgttttcccctgtacgtgcagcagactttgtaccctaggaaaggcaccctatattatgagtctcagcacattttctatagagagagagagagaggaagaaagagagagggcaccagctttgtgagagattatgtgctttgttctggatgccatattccatagacttacaactcaaatgtctccagggagataagattcatttaccactgtagaatgtgggcaaatatctttgaagcaatacttaatctctaatttccaagacaaattgccatttaattatcctgtaacccaggttgccagtgatttttttctcagaaagttttcatcaagcagaaacatgaaagcattcatgggtcattgagtcttcccattagggaccaaagaaaaggcaaggaagccagggaggaagcccatggggttggggctctggccatggtgaccaagaagggtctaggagagcaagatgggcttgggtttctcgaaagaggatgaatcttcagagactgtctcagattagactcaagagccctcagaggtactgtgactttttatgggggtgggggtggggggttattgccttctctccaggatgaagatgggaagaagttgtccgatgaggacataagagcagaagctgacacctttatgtttgagggtgagggccccagtgtggggctagagtggggacttggatatctccattccaggaacagggtgggtggacccctcgcacttcccatcccccttcccccatcctccctgaggtcctcaatgcaaggttgctgtacaccctcgggtgctgaagcagcccagagacccaagcctgccttgctgccccccaggccatgacaccacagccagtggtctctcctgggtcctgtaccaccttgcaaagcacccggaataccaggagcgctgtcggcaggaggtgcaagagcttctgaaggaccgtgagcctaaagagattgaatggtgagtgcaggtgctggtgccctgttcctgagcctgtctcattggctctgttccccaggtagggaggggagaaggggttgtttttgttgattctgccactattgcttagtgggaataggagcagaggaccacaggcaggacttagtacccatcctgactgtctgggcaaaggttataggcccttaggacagaaagacctgggcttctgagagaattgttgatgatatgtgaggacagataacgccacttagcatgtgttcagcaaatgaacttcccctccactctcttccttttctccaagaaatatttttttgaatgtcttcacttgttgaatgtttgctcttctgttccctaattcctacccttccatccagtccagggatttataagggagacctgggggtaaaattcatccattcttgtccagaacacctgcatcattcatccatccagtcctcgttcagcaaatactctcatactgcattccaacccccacatctgtgcacagcatctttctgtgctctggagacctgggaaggacccaaccagggatctattttccaggtgctcccagcctggtgggggaactgtccctgggcaggacagtcccagcccacgtgggcagggatggggtttacagtaagggaagcaggactaggggggtatagaaagtgtctcagttgaaagcctgaataatgatcagtagataattgggtacagttggggagcagtgctgtaggtcaagaagaccacctggggtcttcgggggaggaagagagagaggagagagagagagagagagagagagagagagagagagagagagagagagcagggtcaggacagaaaggaggagaaggggagaaagagggagagactgacttgtggtgagatgataaaactggagatggtagcaggggctggctgtggaagccttggggaaaatgttaatggcttcagttttagcccaagggcaatagggagccatgagaagtgtttgaacaggggagggacaagtcacatctgggtaccaggaagatctttctagggctagtgtggagggtgtactggagaggaccagctatagaatgagagcgcagtggggacattctgaggctcaagccaggccaggggctggaggaaggagaggaagcattggagtggacgggtgtcttggactcagtgtcctcccgtccatgcctttgcccagcacagcagtcctgggaagggaagaaacatttttatgcttctaaaataaagaatatttttgcaattttattttttaaaacacatttttattgatgcataatagatgcacatagttttgaaatacatgtgataatctaatacattcatataattgataaagatcaaatcagtgtacttgggatatccattgcctgaaatatttgtcttttctttatgctagaaacataactaacataagcaaactactttctaatgtacagtacatattgtaaactacagtgaacctactgatctatcaagtgctaggttttatttctcctatcaaaactcaaattcgtacccattaatcaacttctccttatccttccctcccctctgccaatctatcttcttttttcatgagatccactttttcagctcccacacgtgagtgagaacatgcgatatttgtctttctgtttttggcttatttacttaccacaatgacctccagttccatccatgttgccacaaatgacaaaatttcagtcttttaaatggctgaatagtattccattgtgtatacacactacattttctttatacattcatctattgatagacacttaagttgattccatattttcgttgttgtgaatagtgctgcaataaatacagaagtacagatgtctcttccatatatttattttctttctttgggatagaaatttcttctctttcttttcagtagtggaatttctgggttatatggcagttctagttttagtttcttgaggaacctctgtgctgttctctgcagtggctgcactaatttatattcccaccaacagtgtgtgtgagttcccctttctccatatcctcaccagcatctatcattgcctgtctttttgataaaagccattttaactgggatgagatgatatctcattgtggttttgatttgcatttctctgactgttagtgacattgagcatttttccatctacctattggccatttgtatgttttattttaagaaatgtctattcagatcttttgcccattttaaaatcagatatttggttacttttcctattgagttgtttgagctgcttatgtattctggttattaatcgcttgtcagatgagtagtttgtgagtattttctgccattctgtgggttgattcttcgctttgttgattgtttcctttgctgtgcagaagcttttttgcttgatataatctcatttctctattggctctgcttttgaggtcttacatagaaagtctttgcccagacccatgtcccggagtataaaaccaagatttcaagcaaaattatgcgtgtagtttaaaaaaaatggtcgaaagactttatgacaaaaatgaagttccttattaagctccaccttagcggtgactacagtcaacagttctctgtgtattcttctagaaaatggctatcccgatgcccacatttatatgaactcacactgtgacttttatttatatgaacacttactgtgcttttctttgtaagtgaaagtccataaaatagacacgggtctgcatattatctctgagatcttttgcttttctcaaaatatacattttggaaaatgagtttgtttttaaatttgttctttgtctttaattgacaagttttaattatatatgtttagaggcacagtatgatgttgtgatatatgtatacaacctgaaattattaaatcaaggtaatgaacaaatccatcacttcatgtgtttatcatttttgtgttgagaacatttgaagtttactttcttagcaatttcaactaatacaatacattgttcactaaaggcaccaggctgggcagcagatctcaaaaacttattcctgttgtctaactgaagcttctaccctttgaccaacatttcacccttctctgtccctcccccagccctggcctctggtaaccaccattctattcctatttctatgagctcaactattttaggtcccaagataagtaagatcatgtgtgtttgtctcttctgcacctggcttacttcacttagcatgagttcctccaggttcttccatgttgtggcaaatgagataattttttcttttttaaaggctaaatgggattccattgtgtatatatatatatatatccacatggaaaaacaacattaaattacaaaatgaatgataaaaaagagttcttcttgtaccaaatgagacattacagataagactagggttttccttgacaatcctgccacctgacctaatcctttctcattctccaaaggtgtttctagagccatagatttgtttatctatctatctatctatctatctatctatctatctatctatctatctatttctatcatctatcaatgtatctatcattgatctatctatcatctatcaatgtatctgtcatctatctctattatctgtctatctatctatcatctatgtatctctgtatctatcatctatgtaactatgtctccatcatctattatctatctctctacttatttatctacctattatctatgtatctatctatatcatctatttatctatctatctatctatctatctatctatctatctatctatctatcatcatccatccatcatgatctatctctccaccatctatgaatcattcatttttataaatatatatccatatgcttcttgctgttttacatgtacatatgtatatatttgtcactttttttcactcaacagggtgccttaatgctatctttttctgagtgctgtatattttattccatattttattcagctcatttctatgttgaagaggacattaaacattttcaattatagtcaatatttccaatttgccttccagagtgtctgtactgatttaccttctagcctgcagtatgtggtgagactagtgatccctatttccttcttttgtgtaactgtatagtattccattgtgtggctgtttatctaaacattttcccattaatgtatatttggcttgtctccaaacttttgctaaactggacatgaagctgtcagcacgtgtgcacagtgaccattccttacatgcataggcatctctgcaggacaaattctctgaagtgcaattgctgaatcaaagaccatttgcactgtataatcattatttttttgagacagtttcactcttgttgcccaggctggagtgcaatggtgtgatctcagcttactgcagtctctgcctcccagattcaagcaattctgcctcagcctcctgagtagctgggattacaggtgcccccccaccatgcctgggtaattttttttgtagagatggggtttcaccatgttggccaggctggtctcgaactcctaacctcaggtgatctgcctgcctcggtctcccaaagtgctgggattacaggcatgagccaccatacaatatgactgcaaatcctttactattagctgagttttatggcacaaactttcccataactttaccaatagtactattgtattattgaattttaaatcttggccaattttcatatttcttcttttgatggacatttaaaaaaagtaagagtgaggctgaacatcttttgcacgtgttgatgttatttgctttctttttatggaactggtattcttattatttttcctctttttctttggaccctttaaaagtatttacttttaagaatgtgtattaagattgatttttttctgcctagtgttgcaaaatattgccttttaacttttggagggtacttttgattaatttttatgacgttaagtaggtccacatttttctttcacagctgtaaaatccatcaacttcccaggattttgtttagggtgggtgggggcccctttaccaaatgtgaagttttctcttattctcatgtctttttctgagctctttatgctgttccatgggtctattttcttgtttctgcaacagtgtcacactgtttttattcctgcgactttgtaacaattcttttaaaaagtttatttcgttacagggagaaaaggtctcacttgcaaacagagagaagctggagagttgtgtctttgctcccttgataaggattggggctggggtgtttccttagggacgacctggcccagctgcccttcctgaccatgtgcattaaggagagcctgaggctgcatcccccagtccctgccgtctctcgctgctgcacccaagacattgtgctcccagacggccgggtcatccccaaaggtgccacagcctcagggggaggagcctcctgggtaggaagaggggcccctcaggcagggagcattgtcctgactgcccccttctctcccacaggcattatctgcctcatcagtgtttttggaacccatcacaacccagccgtgtggccggaccctgaggtgcgggccccccgtctctgtttttgtccattccaaggctcctagaggagggggcagggttttgatcaggagaatccaacatcacctccctccaagacacacaccactgtctctccaaggctggcggactgggagaccccacccggcaacccttcttggtctcgcctccaggtctatgacccctttcgctttgacccaaagaacatcaaggagaggtcacctctggcttttattcccttctcagcagggcccaggtaagagcggcctgtgtttgaggcggggacggggagataggtgcaggggtctgggcatgacagtggggaaaagggggacattgtagacggtccgagttccagctctccttccctcacctcctctggagtttatgggaaaaggcccacagagtaggattgggttggtcctagaaggatccctagtgagctcagagctccctcctaccccaccttggtctaggctggggggttggagctcggctaggctcgcaggatatgcaagcccacatggggatccaggcacggatacccccttctctgttcctcaaactgctctaggtggggttgggtgtcccaggccaggttaccggcttgatggggccaggatggggctcctgggtgcagtcagagtttccacccctctccccaaggaactgcatcgggcaggcgttcgcgatggcggagatgaaggtggtcctggggctcacgctgctgcgcttccgcgtcctgcctgaccacaccgagccccgcaggaagccggagctggtcctgcgcgcagagggcggactttggctgcgggtggagcccctgagctgagttctgcagagacccactctgaccccactaaaatgacccctgattcatcaaaagtgaggcctagaattaccctaagaccctgttccacagtcctgtattccatcctagatatctactcaaaataattgagacaagtgttcaaacagaaagacgcttgtgcgtgaatgttcatggcagccctattcacagtagccaaacgatgaaaacaaccccaagctatatattaccagatgaaaggataaacaaaatatggtccatccatacaatggagtattacacagccataaaaaggaatgaagcagtgatccccactacactgtggatgaaccttgaatgcatgatactgaatgaaagacatcagatgcaaaaggtcacatagtgtactgtccttttatatgaaatttccagaacaggccaatctgaagagatgtatagtggattggtggctttcagcagctgtggggaggtgggactgaggagcgactgctaatcaggatggggtttcctcctgggatggtgaaaatgttccggacctagatagtgatgaaggtagcacgacactgtgagtgcactaaatgctattgaattggacactttagaatggttgaaatagtgatttttatgtgaattctacctaaacatgctattacagctcatatatactttttccatctggattcttcacaaaagaatatgttgtgagcatctttccatgatattaaatcatcttaggaaacattattttgtgttcttcaaaatgtgcatgttaagtattcaaatcagtcttaaatttttaaaaatatgtaattttagaaaataatttaaaaggttttgtttcagtttgtaagatttcttttctggcactttaatggcttgaggtatcattatcagttacaaattgagttattcttcatcaaatgacttttggagtagagattttatttttatagcaatagatgcacagatattcctgtaagatacaggtgtggttagacacttttctagaacaggcatgccctgcaaactccacagacactgactgtttttgtcctattaagaagtagaccactgagaagggagaaggtgacattttagctttcccaggtaaaagtggttttcatcctcacaccaattttatggactggacgttaactctcttgctcaaggtcactctgagtggaagagtggggataaatctggttcgtttggcatcagaggccatgacttttcctaccacagaagtaattttcaaagtaagtctctgccctaggcacatcagatcacctggggaccactccagagtgagtagacaagactttgacaggggtgcctaatttttttttttttttgagatggagtctcgctctgttgcccaggctggagtgcagtggcatgatctcagttcactgcaacctccgcctcctgcgttcaagtgattgtcctgtctcagcctcccaagtagctgggattacaggcacccaccaccacatccagctaattgttgtatttttaatagaggcggggtttcgccatgttgcactggctggtgttgaactcctaacctcaggtgatccacccgcctcggcctcccaaagtgctgggattacaggcccggtccagtttgatagtttgttatcatgttatacgtacacttagaataatgatccagccatctcattctaacagcaatgagaacttaggctcccctctctactaaaatacaaaagttagctggtcatggtggtgcgggcctgtaatcccagctactcgggaggctgatgcgggagaatcacttgaaacccacaggcggaggttgcagtgagctgaggtggtgccactacgctccagcctgggggagggggacatagcgagactcggtctcaaaaacaaaacaaaacaaaacaaaacaaaacaaaaacaaaacaaaacaaaacaaaacactgccaaactgtttccaaagcatctgcatcgtgtttaatttccataagtaacgtatgagaattctaggtcctccaaataattagcagtccttcgtagtgtcagtttttgtttcagccttccttatgggtatgctgtggcatatccctgagattttaattcgcattttccagtgactaagggtgttgaaccactcgtgccttcctgtgcctatttgacactcctatattttctttggtgaagtgtctgttcaatcatctgctcattaaattttccttcggttgtttgccttcttattgttggattttgagagttctatgtacaagtcctttgtcagtcgtgtgatttgcaagtcttcttcctagtctctgaagtttctttctttcatagagcaaacgttttaaatttttatgaagtaagacttctcagttttatttttggtgaattatgtttatactgccatatataggaactctttgcttaactggaggtcatggagattttctcctacattttcttttaaaagttttatagtttcagagtttacatgtaattccataatctccatttagttaaattttgtatggggtgtgaactgtggtttgactgttttcttgtatatggatatccaattgtttcacacaatttttttgaaaagaatatccttggcagggcacggtagctcacacctgtaatcccagcactttaggaggtcaaggtgggcagatcatgaggtcaggagtttgagaccagcctggccaatatggtgaaaccacgtctctattaaaaatagaaaaattag

SEQ ID NO: 15950 - DNA, 17865 bp, Human
  misc_feature (1)...(17865): n = A,T,C or G
taggcagaaccatagcgacatttcaaccaatccagctcaaaagtgtctatgttgtgggaggtccctgaggccgctgaggtcgttcgtgtctgttgaacggctgtgggcgtcttgctgccttgggtagggggttaaaatcgttcttgagaggaacgtctctgtgcgaagagataatgagtttagctctgaggtcggtaataaggaggcggcagtgctctccacaccccggagcggggcccagggagggtgtgtgtggaagggaggacgtttggggccgaggcgaggcaggggatgtagtttgggacgcgggaaaggagcctagggcagcctgcccggatcactcaccctctgggctctgatgccctgcagggaacgagaccagtgcatttctgctaaggaggttatttctgtcagcgcgtagggctttggactgccagaaggttgggcttagttgcgagcgaggtgggaatgaaatatcgcgaggcttctactcttgtttctcagatcaggtcgcggacatcccttcattcatccgtgtgcctggtcagggccccacctcggctgctccgctgctaatgcaatcacccacctataaattttggaaataacaaaaactctttcctcttctcccagggccctgctttacggtgtaattggagacccattttagtgactttaattggcagtctgtctcttggatttcctaaatttcttgcatttttttacctttcagttctaacctctaaccctctgttgccctctcccactatgtagacgttgtaccgtaaaactatccatacacttacgacactccgaaaatattccatgttctgctaagggataatcatggtacccttggatggggtcaggggtgggtcggttctggacttggcctccaaaagtctcaggaaggaaaagactgaccccaggaatacccaagtttgtgtcaagtcaggtctcatgaaaggaagatcttcctcagctttgttatactgcacctactagtcacttcctagctttttttttttttttttggagctttcagagaccaaaacgactttcaaatgcaactagataggtgttttaagtacagtcaactggtttgacatgttaatgtgttaccggattgtgtttcaaaactcgttattccagtgttgcggctccatttgaaaatttggagcacatttagatgggcagctcttaaggaaaacatttctggctttaaaataatttttgctttttttctttaagcgtttccagagtttatgagaagttaacctccggtttacatgttaaatgagacaagactcatcacatttttatatagaatgaagcacaaacattgtatattggcatctaatatttgtcatatgtttagactcattaatattttcgatggtttgttaatatcaatggaggaaatgacacataaattgccaaactgttaaaaacgtgtaatctaaaaacattttgaaccaacagtgctaaaatactgtataagttaattcactttttttttgtaattttatgaacataattatcagaactatcaacagtaaaccgatatatagtgattgtcagttatgaattttggtttcatttggagattttttttaaattctttaacattcttgtaggataacgtgtttttgtttttttggttggagttggttggagtttcagacataaaagtagtgttgcttattcacagttcttgtttcttccacagtaacattagtgggaataaataaaaagctgggaaaaagaaaagtttggtcctcatttcttttaataatctgtaacactctttagttttgcgaagttcagatttatagcaatttagactatggaataaacaggtcattgactcataaagggaaagtttccctatctttctccaaagtactttcttttttgaaatttagaaggtaattattggctaatttctgttagtaaagagaattaaagtggactaagggctttttctttccatttcatagaagtgagcttgtagtggacaaaacaaagaggaaaaaaagaagagaactgtctgaggaacagaaacaagaaattaaagatgcttttgaactatttgatacagacaaagatgaagcaatagattatcatgaattaaaggtaatggtatactttaaaatatttgtttctgtgttaaaatgatttgcatttttacagttgctttacattacatttctaaataattattttaactaaattggttttggaactatgaaggcattttaagcattcatagttagatgctgtaataaaactgaagagaactcctaacatagtttttagaaaatctttttcacatgagaaaacgaatagtattttaaatgtaaaaatacattcccagggaaggtgcttatttttcactgtcataattaaaggatttcaaactggaatttattcttaccatcttcttttcactgttttttgtttttgtttttgtttcttggtgactcatactgttttcagactgtgggagtgttgtcttttaatcttataatttggatttgttagtaacatagtctcaatccactttctctggtgcaaacaactttagtgctgtttgatgttgacacatgctaataggtaaaaatgtcagctttaagacctagaatgtcaaagtgtagggagagatttgtaaattattatttgtcagggtataaggagagatttgggtttagggtagaatgggacttactttcagcacagtgggaaagatagtattttgagatttttaatggccttaatggataggtgaatgtaagtgtttatttggtagttttaatttttgtaatttcgtaagggatttttaagcattagaattccaagtagggataggaactatgcagtgacaggatagaatgtataaaagcagttaataggcctgctaagtctagctttctcaatcttgcagtcctctttggctctcttttcccactgttttttttttttttttttttttttggttacccagatttgatcttcctttataatgtctgttccatttgtaaccattgactatcttggtttgggaccttatttcatacctggagcttcctaaatgatttcttactagttcaccttgtacactaccactgaatttagatagtttaaaaattctttcaccattgctcataaattgttcattgctcataaaccataactcctcattgtatactacttaaagttcagattcctttgctttctactgaatgttctctacacttttgccaccaactacttttttcatttgctaactgctttcttcctcctgaactcttctaattaaggtggaattcacctcctaattcaggtgagcagtttccggcatcctgaagcgacttggaaccaatccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgaacctattcgtttcagtgtttcttttaataccagtcatccttcccaaataccctactgctcctcttcatctatccttcaaggaacagtttgaatctttccaaataagacttctctagtcagtaatatgtctccttccttattattagtaacaaaatctcttttttctctaaactcagggtccttagccctatcatttacctggtaactaatcatggaaagactgatgataattcttgttttaatgttttatctcttctatcatgtaactgtttaatatttatgccacgcctttttctcattttgattgttaatcccttcagaacaaataacaatcaaattatctgtgcaataagttagtgcattttatatagtaaaatctgtaaacacttgttggttactttgtcatataaaaaatgcaatttataaatgaaaaaacttatgcatacttaatttcagtagtgaagaacaattacactatcactgctattttaaagaggtaaaacatgcaaaaaagttatattttattaatgtgttgtcatctcttaagatgtaaaaacttaataattagaaattcttttgtaaagagtgctttataatttgcttttcctttttaatccaaaaggtggcaatgagagccttggggtttgatgtaaaaaaagctgatgtactgaagattcttaaagattatgacagagaagccacagggaaaatcacctttgaagattttaatgaagttggtgtgtattttaatagtctttgtaatcagcagctgttaggaaattgtctgattaatatcactttttaaattttaaattctctaggttatggaattttcttatagaacactggtgtataatgtgactcttactcagttttgttttgttggtttttttttcaaagaaaaaatatggctttgctctgagatttatagttttgtcttttgttttgttgtgaagattctaaccaaggaactattgtgtagctttttatagaaagatgcttttccaagttgtttgtatttatattatgtgataaaacttgaagggtgatcaaaaaattatttttgcttaataaaacagaaaatttgatatcctgctgtttggaaaatgtttcccaagacctttctggtatgtgatttttgttggctaagtgggagaagagggaactggtagtagttggtatctttggctgtagatgaaatgcacgacttcaggttgacaaagtttatgagaggctacatcctctggatgaccttgatctcagtggataaagtcatctgtttagagggtagtagtaaaggaggcagtgggcatactggaagcaggagaaaacatcctagtaccaccaactgaagataatgtgtcataggcttaatatggctaaatttttttatagttgattttagtgaattatttatagcatatatagaccaggctttttcaaaatagaagagtccggaaggcaaggatgttgctattataacttaaatgtattgtctagaatattatctacaaaatatgtaaatattcaggtttatttctttttttttttttctctaaaccaatgggtcacgatataagcacatcatataagtattttaagatattttaaaaatttggaaacaaattctgctatatacacaaaccccttattttaaatattaatcaagaagcaataggggaagcaaaaagaaatggcaattagtagacgcagagaaaatttagattcatgtcattagtcagttttttaaatccaaaagctcaagtcataagcagttgagatggaaaataaatgatgaacctaagagaaaaaaaacacagcacagaagatcctcaacttatgaactaatatatgactgtttagagaggcaacttgtccattggggacattttccttttttcctctaatttgtagaattaattatttgaggaaagggagagagccaccttttgttctcccagaatggacactctcctgaagtttatgatcgtagtattcctagttttaccttagattgtttatttgtagaaacaaggtgtttgtatatagtggaaatggtactattaggaaggagctataatccaggtatgtttagtacagtatagtggtttagcacttggaaccagattcccttggttcataccttggttttgccactttacagctctggaacttggtctttttaataccccatgcctcattttcaactataaagtggggatcattgtattctctcatgagattcttctaaggattaagttaatgatatgtgaagtacctagaaaagggcctagcatgttgtaagtgctactaagcatttgctattattattactttaaaaaattgtctttgtttcaggggctcgaaataatcatatatgcatcactgggacataaaatagactttgtgtatattttttattgacttttttcataaaggctattgtaagcactgtatcatcactaataattttacaaaatatgttatttcaccttaaatgaacacaatttaaaaattgtgaatttttttttttttttttttttttcttatgagacagagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccaaaaattgtgatttttattggcagttgggaccagaatcccatgccacctccactttttcctgacaccccatctgttctatgttattaacagagcagaaatactgggttccttctagaataaatagatgtggctaaacttcagctttgacactaaaagattaaccttttgacagggtcaacatgtatcttagctatcttaaggctacctatggagagtaccaggtgtcaaataaaaatgtattactgtttgggaatcattcaggaactatgtattaccccttttgttgattatttttaactaatcactgaccacagattaatatgttttatactttgggacagatgattctaaatcataacatttgagtcctagttttatgaactacccaaggacactgttccacagatatatctggatgaagtttggcagttaactattatagactcttcctagtactggaaaaaagctttaaaatatatttaatttaagtttagagtcaagacagcctgaggctagtgagtaacatagatattttaggaattagtgtctttaagactaacataagtcaaacgtttgtacactatttttgacatgtactacttattattgctgattgagattgtaatactgtattattgtcttcattttgcttatttaacactgaattttttggtattaggtactgtactggggttgggaagaagacttaattaaaagttactaaaaggttcttctttcagggagtttacaatgtaaatataggtgacaacaggctatagtactatgtggtaaattgtaattttgtctaggacagaagtcagcaactatagcctttggaccaaattcagctgctgcttgtacaccaccacaccccttcttttatgcagcttttgtgctactatggcagagtgagtagttagagactttatggccctctacaaagcctaaaatatttactattggccttttacaggaaagatttgttaatccctgatctagaggaattgaagtctttgcagaggagattttaaatttaggcctttggaaatgtgagtaagatttcattccaagattgccaggaagagtagagaaaaagcattctaggcttagaaagcagcaacaacaaagaatggtactagacggatagcatgtttgggaaactaggtagtgttctgggctagacatagggaaatgactggaaacataggattgggccagattggtaaagtcttgcaaaacatgaagattttgaattctagtcagcagagatcattcacaatttttaagggaaggggatatgatatgtttgagaaagaaaactgatgagagtattattgatgatgagttggaaggaagagagactgcagacagaaaatactatttttttcgctgaggatggcgagggtgaaaagaaaatacatttaagaataaaaaagaggctgggcttggtggctcatgcctgtaatcccagcactttgggaggtcaaggcgggaggattgctcgctcacaggagtttgagaccagctggggcaacaaagtgagatcctgtctctacaaaaaaattttaaaaaattagccagacatgatggcacatgcctgtagtcccagctactttggaggttgaggtgggaagattgcttgagcccaggagttgaggctgcagtaagctgggatcacgccattgcactccagcctgggcaacagagcgagaccttgttttaaaacaataaataaattagaaaaaaaacagtattctcagtactataggacctgattaagtttgtgggactgaaaatgatttatgcttttcaaatatggaatctagctgtaaatgttgctgttatcttttggttggggtaggggaggcagctgcagttactatggtggtagtggaatgagtttggagtccaacatgtctaactggtatgtttggatagaaatttccgaaagacattgagaaatacagttaaagctgtatttctagcattacctataataatttttaatttacttttgatgtgatgtttttggatttgccgtattcttaagtgatttttacacattaaaggtctaagaaagtattttgatgaagtacatttctgatagtatgtgtaattaaatcatttgaaaatacagttgcatggacagaaatttggagttttgtgaaataaatgaaacccaccttaactgcctctatatcagtttactaatattttcattgaaaataaatatattccttataattaaattctactttgtggaacaagaatagaacctgaaggcatggaggagagtcattataaagttatatattaggtaatgtttttgctgtccaaaatgatgagcatttataattcccaagaaaagctgcattttaaggaagaatattgataaaagaatatatagacacatagctctgaaataactaacacaattaaagtaccagtgggataagaatttatacatcttggagccccatctgttccccaatcaccctgttgcttctttaagtacattaatactttcagcaagctgcttttttggttcacctgtcatgtaaattatttaattggtgaagaaaatttcttaacactttttttccttgtcctgcttttttgttgggactaaattcaaaataagttgagtatgtgccatagagttaagtgtggtattttattttggtgttatggctgtagatatgccagcttctttttgactgaatatttatgagctttgatgatttgcatacttacagtaatatacttcaattagttacttggaagcctttttggataaaattaatggataaaaggaaactattgaaaatatgtgtagatgatataatagtcatttgaataggtgattattgaaccaaatacgggtgaaacagcagcaaaacaacagcttgttggagacttcgattgtatttttttcattctgggttccttaaacattccagtattttccatctataagcagttgcttttttttttttttttaatgattctgtaaccttcaacaggaccgagttatttttaatagcatagtaaaggccataaataccttttcttgtagtggcagatagtgtatataattacttcagagatacttatttagatactgttagaattttatttagtaacttaccaatttttatgccatagatttttattttaatttttattgtggctattgattaaagactggtaaaattgaaaatacttaagcttattactatgttattacatgtgattatatttagtgtattaaaatacacaattaccattgaggtttgaaactacatttatttttagttagttgtctgagagtgatttatccaaacaaaatgggtaagctttaaggagaccttctttgcagaggttttttttgggtgggctttcctgctatagtcagatttgatcctatttactactttgtaaattttggaaaaccaagaggttcttctaatcacaaaggtattagtggaattttcaaatgctgtctgagattgtgcctgtgtctgcgatggcagtactttttgtctcttgcagtttttcttgttttgaagttggattaaatttgaggaagaatcagtgttagtatgacgtttagtcagcaagcagcttttatttagttagctccaattattttgttggtatgtctctccacaggtagatgacacactccttgtgtgcttgatgtcagtggagcctagtacaattcttgataatagtagatcttaaataaatatggtataaatgtagtcctttttattttgcctctgtgtgatatagttttgcttacttttataataagacaagttgctcatgataaaaaaaggttaacatttaaaatatggatttgatttttctaatttcaggtttatctcggggtttggggatctcatttgacattttattgtcagactaaaagttgacagtcacagctttaattctcatctaatatttagttgatttcacaaatgaatgcctttgtgattatgcaggtttattaaaatatatatgtttttaaactgtagtgacagactggatattggaaagagatccccatgaagaaatactcaaggcatttaaactatttgatgatgatgattcaggtaaaataagcttgaggaatttgcgacgtgttgctagagaattgggtgaaaacatgagtgatgaagaacttcgagctatgatagaagaatttgacaaagatggtgatggagaaagtaagttttaagtgaaacgtattttccaggttttcctgatgctacacatgtaatacatttttctaaaaccaaatgacttgcaagacttttttgtaaacttaactgcttcttgtaatggaccttctgtctaaataattcacatattcaatttagaatgaagcagatctctaaaaccaattatacttcaagaaggtccttcacttttctctgaaggtgaaaccaccaaaatttcagcctttcaatataatttcagtctttaatggcttctccctcaacctacatgctaagttctaagttctattgattttccccttcaaatgttttgaatctgtttttatctttgtccattgtggctgtcctagttcaggccctaatttctagttaggaatgttataatggcctcatttattcttgccttggctgcctactgggtgcagtgtcctgcgtgttgactggtgctacacaatgaaaaaggcagatgtggttcttgctttcactttgcagtctcttgtagtgtcctaattgccctttcggcatataaaagtctctaatctcttcttcagtctcttggtatcattcttttcctaaaatatacatttgataatgccatttctgtgtttagacacttgaaacgattcttcagtgcctacagagtaaagttcaaagccttctatgatctatcccaccttgagtaactgattttactttccagtgtattctttcacttttcttctttaaccctcacctcctgtatgtacacattttgtcaacatatgctatcctgaaaacacatttttatgctattcgtttcatcctgctgtttcttaatcttagaatgctctaattgttaatttctgcctgctaaaatgtgattcattctctcaggtaaatattaaacaccatctttttcccaaaagcttcccataacgctctatgaatcatgagacttccattgaaggcctatagcatttagagaaacaaattgttttgatactttcatacacttaatatggaatcttttggctggaaactaagttttgttgagataaaaaccactttatttgtatgttaaactgctaaagattagaccttgctgtcttttttgtggactttagtgttcttctctctttgtgactttttcatgcttttcagtatctaagagcaatgaaattttaaaaatattgggtatatagaataataaacatggtgaatgtgaagttaaaggtaaataagatgtactacaagatagacataaagctgtggtaatgatacagaaagagtcacttccccctgccccctcaacagcatatataaaataaaacacagcacatcttttggaaaaaatgaaaggaacgttttgaaaagccagaatggataatcttttaaataatgatgatgttttttaacatttatttagcagctactatattggatattagcattaattatgtcacttaatttccataataacttgtaaagtagatatagtattatacctatacatgtgtataatagatgcatatatagagatgaggaagctaaagctttgagagattattaatctgcccaggttatcacaaagctaatactgtacatggtagagccagaactcaaaatcaaatctccaaaatggcaaagaatgtgcttttaaacgtaatattgtattgcctttcgggctatgaagtaaaatattaactagacttctatgtttatggagttttaaaaattacatgctattataggaagcagtgtattagcaacatactcagttggaacttccaattctaagatttgcttttccccttcaaagccagatggtctctaaggtacttaatctacttagttctgtaaaattcttattgttagcaacttgtaataagatttgctctatgaaatggttgatgtatgaaaaattttgttaaagaaggcagtataaaaggaaacaaagtgtcatattttcttgattcaataaatgttttaccaaagcttattttaagctaggcattgtggtagatttattagatataggaacttgatataagatattgttaatagagaaggttataaaatcaaatgcacagagatatagaagattgtcttttaattgtctacaagacaattaaagtaaagtagctagtttaatttcctgagccactttctaatttttactttcttgggtttaagtagtgtgtttttaggtatgaatcatggaattcagttgtcccttgataagcacaggggattggttccaagtcgcttaaggatgccagaatctatggtgctcaagtcccttgtataaaatggcatagtattttcatataactttcacatatcctcttgtatacgttaaatcatctctagattacttataatacctaatacaatgtaaatgctatgtaaattgttatactttattttatttgtattattttttattgtgttattttcccaaatatttttcatctgcagttggttgaatctgcagatgtgaggaacctgtggttacagaaggctgaccgtattttaaatacttttgaaatgctattatagtttaaagtttttgtatataaacaatataaaaattaagtgttttgtggttttcaaacttatatatgaaacttaaaatttgcagtttgagtattgaaattttacagatcaagaaaaagttctagatctttaagtaacaagtactttttggattttgaatattttaatcatggatgtattacactgttaaaatgatttgtaatcaaatcattctaaggctgttttatgttttttctcttaatacagttcttaagaacatactcttgcttcctatttggtctagatgcctcagtctaaatcgggagttcttcagtgaaggtgcacactggctaaactgattaataattttatatatttgaactgtatttattggaaagagagagggatcatagctttcctaagatattcagacatggctatttaactgcaaaggttaaagatcactacatcaatttgtaagattcttgaaagtagtttggagtattacagattttgtattacgttcttaccatgtttgtcatagtgttttgtagatgttaaatactgattgcatggcttcatagttccctgtcagcttctggagggtgcatttttcctaactcatagcttatttctgtgaggcatacactattctttctttgactgtatttctgatggtattctcccaccccagctctctttctacttcctttccaaattctgtatttttattttagagcccaagtaatgatttacctttacctaaatttttcttattagtaataatttttaccattgtgaaggattttttttcaacactgatttggtctttgttttaataataaatagtattttgtgttataaaacatttgttctgtttcaagtataaaaactgactaacatagttatcaaaaccggttttctatgtggtttctagaaccagtgcagtatatattcttttcattccctatgaccatgttttatctcctcaacattttttaattggttaattttttctaactgttcattatgaatattctcaaacagaaaaattgtcagactagtacaatgaacaccattgtaccttctgcctagatttagtaattagtattttaccgcatttgctttacctgtcgtgtgtatatttttttctcaatcatttgaaaataaatttcatatatcaagaactcagtctttaggccaggcaccatggcccatgcctgtaatcccagcactttgggaggctgaggcaggtggattgcttgagcccaggagttcaagaccagccttggcaacatggtgaaacctaatctctaccaaaaatacaacgattagccagtctcataacccggtctctaaattaattaattaattaattaaattttaataataaaacaaaaacttgatcctttaatattttagcatatccatctactaagaacaaggatatatctttcataaagctatgataccaatgttacacttaagaaagttaacaataattttataatatcatataatatctttctcatttcggttttaatgtattccagaataggaagcctggtgtctgttttgatatattacgcaacacttattgtggtgttggcattcactagccacttaaaaatgtttgattcaatggagtattttcatataataccttctatggtaaataagagttaaacaatctaaaacatcatctcatagttcagtgttttcagatgaaggaaatgagatgcagagctgttctgtgcagagctgtgactagagaccaggtcttaagtctcagtgtagttttcttttggcattatcaaaattatcattcataatttatgcattgtttaggtatgtattaagtcttagggctaaatgctaaatacttaccagaagtatcttctgaacatttttcttaattgatacgtgcgcatatgtcgggttttcaaaattatattctataagattatctgatttcttatttctaggttgctgtcttaaacattatgttttataaattggagattcttactatatttataattttggcaaactaaaaattagtccttatccatgattattttctgcctttacatctatatagttactggattactttggtgattaagattacatctgtaatcttttcaaattgccatttttattgatacctttgaggtatggtgacctggttttaattattctttaacataggcttttaagtatataaaagttcaaaaaataataatttaacttctttttataattttattatattttcattctttagaaatctaatttacatgcatgatatgttcaagcttacttgtaaaggaaggatttgctaaatgaactagtagaataaagattataaagagggttgtttaaagaaccttgaaatgtcaagcatttaaaatgttttagcaagtatgtacaaatatgactgtgattgacttttttggtaacattatcttttccccagttaatattatagaatactaatttgtaatgtttatcacattatatgtatttttgcatccaagaagttacatttaataaacatgttccacttcctaacaaagaagtaaaagcaaaaagccatgtcttaatgtaataattttgcataatgtaaaattttttaaatacttagtgtaaaatggtagtcgtggattctgaaaaaataaaatgtttatatttctgactatttcattttctttcttaccacagtaaaccaagaggagttcattgctattatgactggtgacatttaaagaattacaaggataaacactaagaatgttgcagttaccatcttatattctatttttgtgcctggagccatgtgaaaaaaaccaacttagttcttttatcctaaaggaccaaaaataagcatcttatatatctgtattttactactgttaagtttctttgtatgaactgtgttgttagtactcagatagtttagctttgtatttataatagagcttttatataaagttttaaaaattgaatgtgtgatatgtgttctttgaaggttttttaatttaacatttatagtcactttttagtgcacacattttccagactttcgttaataaaatatttattttattagaattttaaagtttggtaaatttgtttttattcctagtatctgttaaccctcaagagtggatttcttaaatcttccctttataattttactagtttctgaaacaaaaattgaaatacaattagcaatagagtggcacatttttccattacctaacatttcatcaattttgacattctatattttaatacaagctgactcaatataagcctaattccttttttaagagtcctgtctttgagtttagaaggaataagtattgtgcagatagacccatttatccttgtgtattatgtttcttaacttggtatcattgtaagtatgaaagttaattttcttctgaatatttccttaaacaaattgaatgaatacaatttgaattttctaacttcttgactgagagatttaaattttggaattttgatttgttaaggtaattatcactcaattacatgtcacagtgatgaaaatagaaaactgtaagccacagaaataatttaagtctatgttttacctatatgaaggaacagtctgtgattcaccaggaaatagtagagacacagtttccaagtactggtgggctcttctgccttgtagaagtgtatgttagggggaaacaagtggttatggagatcgatcatagaaaaaaatagtacctatatggatccttcactcatatctagtactcggtgttatgggctctcccaggaacggaattgagttgtctatttcagcaatctttctttagaattcttgttttaaatttttaagtttaaagtgtagtatcatttgaggcgctttaaatgttgtgagccttttaagagtattacattaagggttgtccactagaaatttaacacaaaatcagtagggaatactatagcagtagtgacatttcaaacagttatctaggaagcaagtgtatattaagtcattcttgtattgctacgaagaaatacccaagactgcatattttataaagaaaagaagcttaattggcttacggttctgcaggctttacaggaagcatggtgcttctgcttttggggaggcctcaggaagcttacagtcatggtagaaggcaaagggggagcaggcacatcacatggtgaaaaccagagtgaacaagtgagagaagtgccaagtactttgaaaccaccagatctcatgagaactcactattgtgaggacatctaatcacctcccaccagacctcacctccagtactggggattacaattcaacatgatatttgagtggggacagatatacaaactatatcagcaggttaactagagtaaaacttaattttgaatacaaattcaatggtcacagtcattatattcagggcaacagaccttgaaattaaaaaatttttgtcgcacactgatgagttccctctgtcttgatcatgaaatatattgatttccaggaaagtgaaaaataaaacagtaaaagtaaatctagttttgtgagtcttctgtgactttattggaacagtgaagctatttttttgccactttacggatatattgtcttttttctttctttctttttttttttttgtttgggtcagaatctcattctgtcacccaggttggagtgccgtgacatgatctcggctcactgcaacctccgcctcctgggttcaagcgattgt

SEQ ID NO: 15951 - DNA, 31075 bp, Human
ctgcctgtgagtgtagcagtacgtgaagccccacatagggtgtactcttaggccaactgatcagaaccattactgtgcatatatatatatataatatatgtatatacatatacgtatgtgtatatgtgtgtgtgtgtgtatatatatatatatatacacatatatagtaaacttgcttagctctaaatacacacatagtgaaagaacaagttgaaccggtaagttctaccaagaaccacatgaaactaccagcagacactattgtaagcgccaaggggacctttctccttggccctctgaggtttggctgaaaatcactaacatgaggaacattaatagaaaaaacatacaaatttacttaacgtgtatacacaggaagaatcacagcgtgattacccacccctcagagggcttcagaagcttgtggatacaatcccagcgacacaggttatgatagggagaagaggaattctgttgagggattacaaaggagaatgaatgtatcaggaacacattaatttgtacaacatcttgtgaaagggtctgctcaggtgtgattactacattcttggtcttacagggaggcaacaaaaacaattatgttccttgtgatgtgtctaaactttatcctttgctttggcagagatggcgtggggatttaggggagtgggaccttgaggcttcttcagttcagatgtcaaaacgccattatttgggggtatgtttctgcgcctccaacactgtttaacagggaggcttgtttcatccagtaagggagtcaagaaatggttccccgaagaaaacgattcttgaaatctgacaataaatgaggtgtcaaacaggcaaaaagtgtgtcggaatgagcacggatgagggtagggtggaaaaatcttggtacttagtctgtgggaagacctgaggaaaaaaagccactacagtttatagttcagtgtatggtgggcgaacgagatgaagccgaaaacttggacaatcagggattgtccaagagcaagggaaagccaccaaagatttttcagcagattgccgtgatcatatttgtatttgaagactacaacgatgctgtatgaaaaatggatgcacaaagccgaattgggaagctattgttcctggaaagtataaccctgaaggcggagagttgtagagaacagaactgatgtttaaaaagaaaaatccacaaaacgtggtggtggagcacgtacctgaagttatgcctattgcgcttctgatttcaaataagtaattgttttaaattgcctactaacataaaaaagcccagtcgattccaaacactggcacccaggcgtgagaatccatggttatttccttgggtgagctttattgtatttttgcgggcgctatggaaatgctcctccaggcagtacagatcagcagcggctcgtagtgaagaacgttcaaggaagagtttgtcccggatcaacaggacatggggcttgggaagcctggactgccatgaggaaggtcgattcaccactacagacagggagcctgaggcctgggtggtgccgacaagtcggcagtcacgccaggtcaggaagcgccgaagccgcgggaaaccctggactccatcccgggatttgtccccgtgtcgaagatggtatccaggtcgccgaaaacttcccggaagtttagaccaagacctacttattatctacggtgtccgggaaggtccatgattgttccacataaagtcagaagggaggaaaggcgcacgcgcattggggacttgactctggaaagcgtccagaccaaggtcagcggagagtaggcatgtagcttctgcagttgctcctcctcaccctccgcgacctgatttcctagaagggctctgtcacccgaaaagattttccactggcttagaggagggagggcccgccttcccccgttatccattggctgctcgttccgccgcaagttgggggcggggttagggcgcctttcgattgcatcagctggtccagccgaggccaagtcccgggcgctagcccacctcccacccgcctcttggctcctctcctctaggccgtcgctttcgggttctctcatcgcttcgtcgttcgccaatgtttgaggagaaggccagcagtccttcagggaagatgggaggcgaggagaagccggtgagcaaacttggtgggacccagagaccagcctgggactctagtgggtgcagacgctacgctcgcggcgggagcggggggcaggaagcaggaagcggccgggaccgcgtgggtcggagaagtgggggatggtgggactcctggaaagtcggaaccccctttgggaaccatccattcataaattagggtggggccttgcagttcatctgtgggtccattctctttacagatgaggaaacagaccttgagtgagcgacttgttcagagcctcacatctacagtagttagacgcggagacagaatcagaatcttaggcttgaggcttccaaacttgcgtttatggcttactgtaagcgggaaacacattgcagagccttatttaatcaatctcctaagatcctgcgggggtaaagagctccattttaaggaaaggaaaaccgagtgcccgagatctgacccagcttgtccaagtttgggtggttaagtatacattttgcccggcactgatctgggcggtgcatgtgggaagatgaatagggcccagttccccgactttgagggcctcacaggctgatgtgtaagagacaggaaaacagccctagtgctttgtgatcaaccttgtggtattacagaagaggaagtttaggaaggcactttagaatttagtttggaagaatgatttcaccaggtaaacaggcaggacggggcttcccacgtaaaggtagggaaggcagtgaaaaggggcacgcaggtgaattgtctttcgggttgtttgcaagagatatgccagaagggttaaaggaacagtaatcagaaggatcttaggcaacaaggatgtttgaaacttgtattctatacatgaaggatcttaagcaggaagattgtatttgtaaaagtcacgctggcattgggatagaaggttaggccacatgcagaaggctgttgtaatagtccaagtgagaagtggtgacgtcttcagctaagggatcctctatcccaagtctgtgacaggacagttcacttaaaagccaaatttttttcttgattgtccactcgagattgaatggagaaactgcatacgggcacattctaactatgtaaatttaattctagatgataaatggtgactatacgtagatttttttcacataaaatgatatttttactgttttgtaacttttttttttttttttttttttgcttaatagaatgtggtcaacaactttccatgtccataaatattctcctgtgctattcttaattggacgtgatatgtatggttaacacatatgtaatttttccttcctgtaataattatacaatagttaatatttattttgagtactaaatacgagtttggcactgtattaatgcattccatgaattaactcattcagtcttcttttttttgagacggagtctcgctctgtcactcaggctggagtgccgtggtgcgatctcggctcactgcaagctccacctcccgggttcatgccattctcctgcctcagccaccaggcctggctaattttttgtatttttagtagagacggggtttcaccgtgttagccaggatggtctcgatctcctgacctcgtgatccgcccgtctcggcctcccaaagttcttggattacaggcgtgatccaccgcgcccggcctcattcagtcttcttaataacgctgtgaagtgggttctgttattatctccattatacagatgagaaagcaggcgtaggaacagtaacttgctcaaacccagtatccccgtttttttccttcctcaaacccagtatcctatagccaatactaataacccctgtgctgttctgagtgagtcagggacagatcattcctgagaaaggtaattctgtagcttctcttcacaatccggttctgtttcccaacttttgggttgagattttagattacttgtatgtagatgtacataccatatatactcagggaaatagagaacagttgcctactctcttcccagtgttgtagaaaaggggtcataggcctcagggttccagagagacctgttgtaatttcccagctctattacttaatgatacaaatgggcaagttacttctttgagccagtgttcttgtttgtaaaatggagccgtatttagaaccagaaaacctttgtggtgattccctctctctctctccctctctctctctctctctctctctctctctctctctctctcactacccctgttcatttggcaaatggtcaaaaccaaaataatcttatcagaaatataaaacttattttatcatctttccattttaaacctgcacagacctgcaatttttctttctttttttttttttttttgttgtcgttgttgttgttgaaatggagtcttgctctgtctcccaggctggagtgcagtggcgcgatctctgctcactgcaagctccgcctcccgggttccagccattctcctgcctcagcctcccgagtagctgggactacaggcacccgccaccacgcccggctaattttttttgtattttttagtagagacggggtttcaccgtgttagccaggatggtctcgatctcctgacctcgtgatctgcccgcctcggcctcccaaagtgctgggattacaggcatgagccaccgcgcccagccgcaatttttctttttacccagtatacttgatcagttacatcacttctgcagtataacaaaggctctattgaatctaaatgaacctttaaagtttattaaatccagacttctggagtaggggggattttagctcagcatgaaattaggagtcatattttaaaattagttttttttttaattatacaagtaacgcattttataggatttaaaagacaatggccaaaatgtccatcaactgataaatggataagtaagcaatggaatattatttgataataaaaaggtacaatgacaagtattgatgcatgttacaacctgatgatcttgaaattattatgctaactaaaagaagcctgtcacaaaagaccacataatgtgtgattctatttatatgaaattcccagaataggcaaatctatagaaacagaaactaggttaatggttgccagggtctggagatgaaggcaacagggagtaaactgctaatgggtacaaggtttctttttgagggtgatgaaaatactctaaaattgatggtagtgatagttgcaaaacagtgaatacctaaaaaccattgaattgtgtactttacatgggtaacttgtatggtatatgaattgtatcttaaaacttaagaaaactaaaggtcacaaacatgcaaactaattaaaatccctgtttacattcctggcacaggatttattactttaaaactttctatgacttcacttgcttctaattgaagtctgtattccttatggtaacttttagttcttgcttctgtgagccttagtctgtcttaccttgtattactttctaaaacaatccttcattaatcagcctggtttagtcattttttctctctttaaattttaacatttctgacaacaagcttatgtgtacacataggacacatttcctgtattctcagaatccacctgttgaaatgcattccatcctttaaaacgctagtcctagcttatttgacatctaatcgtagcgttactactgtgttttctcctccgggagtttctcacacatgtatgccttactttccctggagagactaggtttacacatggtagggattgggccttatgtttgcttcttccatggcttttgttagcactggtggaattcatgggcacactttgcattcagtttttttttttttcccctggaaatatgcttactgaatcaactgcgtgcttccttgtggccatatgtttggtatgtggtccaagtaaacctgaagcgagagtcacaagaatagttaaaataaaataaatgaaatttgaggagttaaacatcgttagtaactccttcctactttttaaagacttgcctttattgtaagttgttaacctgtctttgccagtgatgaaattgttcagtctttcaatatcagatttccattttttttaaattaaataacaaatactaaaataacattctcaacacttcctggggcatcacaggatggaggtgtcacattagattaaaatataaaacgttttttgcttatttagattggtgctggtgaagagaagcaaaaggaaggaggcaaaaagaagaacaaagaaggatctggagatggaggtcgagctgaggtaaaagttatcatcacagagggctctgttatcagaggttggcaaatcgcagggaactttctgagactttcctaatgtgtaagggttctaatggtttacatggtagtgtaagatggtactggttggaaaaatcaggaagaagaattaggaaagggtaatctgagaggggaaaaaagactttcagttgttactgtaaaaggaagcaactggcgtatgattgtataagatgatctgattgtagggttgaatataaaaatcagagaacaaaagttgaagaggagactggtaattattcagttgccagatgtgatgccagctctgacatttcattaaatgagatgttagggaatagagacttggtgtttgggcttacactgaatacaatgaaaaccaaagaaagccagttttttgaccccctccttgccctttccatctggacctgccctagggttggcttctaagccaggacagatccccttaaggcctctcaagtctgcagaaaatgctttcacttctccaggctcacactgaaaggaactggcatatcaaaagccagccctaaatcaacctggttcctgagtattttgcttttacaggcagttaagcttgcctttctactttatttttactgctgtgaactgtgcttcactttttgctttagtcattacagctgttttattggagactctttagaaagctaccagaaggaagaagcacaaaggaacagcctttttagaagtagcacagtaagctggcttttaagagccacttttacaaatgctgcaattgctaaatttatagtgccgtcatttactttagggtaagtttatagatgatcaagtgtagtgttgcttagaaccctacctaaccatttatcttacggctgatcagttgatcagtctcccgaccattatacccccactgtaattgtgaagaaaattgttgattgtgaattttaaaatttgcaagccaatggaaaaatgcatatgttccctaatttcttttttatactttcaatacaaacatacgtgctgttccatcacagcttgagaaatgacctggaaataagacaaagagtataattagaagactcttctgaacagagaattttaagtgggacatgtgattatttatgtttaacgattggtctggaaaaaagagtgtacagtgaactgtccaagaccttggtcttcccctccaagggcaacttgcaggttttattcatctctgcaatcacagagactgacacagagggtatctgctgaatgaatgttgaagagattttgacacgaaattctaattgggacattgcaagtggctatgatgataaactgcagttaagatacagagggtggtgcaggtgggtaggattataatgatgctttagagtggatggaactgggtactgtgcattagtctgaggggttcagattatggttgtagaatgacaggctctgtctgagcttttagttaattcatgggttcttcaccattgaaggttatggaccgttgtgataatttgatgaaaagctctcaacaactgaacgactaaagaaagggagggactgctgtgggtgggaattacaaagatattagggcctgatacggtggtaggaaccaatcacttgagactgagtgggagaatcactggagcccaggagtttggggccaaaatgcgctgtgactgtgcctgtgaatagtcactgcgctccagccagcctaggcaacatagtgaaaccctgtcgttaaagaatggaaagaaggagggagggaaggaattactgggcagacaattaatctttttcatttgatattattttctattatctccagtcaattttgttttgttttgttttgtttgagacaaggtctcactctgttgcccaggttggagtgcagtggcccaatcttggctcactgcaacctccacctcccaggttcaagcaattcttatgcctcagccccacaagtagctgggactacaggtgtgcgccaccacacctggctaatttttgtatttttagtagagataggattttgccatgttggccagggtggtatcgaactcctggcctcaagtgatccatctgccttggcctccctaagtgctgggattacaggaatgaaccaccatgccctgccccagtcagtttcttaaggattagatattcccttgtactcctttcaaattgtggtatgttgatatatatggagacatatgtatggagacgttggtagcattatcaacattgaataaatgttaaaatctgtattgcagtaagtcattttatatctgatagattgaaattcatttgaagatagaaagtcatggcaaaattaagcaatctcctcttcacttttgtatgaagtgttaatgttcatgtaatttgaagatgatgaatgctgtagatgttagtttgactgttttgttaccacagattcactgcctttttgaaatgttccatagattatagagtgacagtagaagaagtcagctctctgattgctgtctctttttctttctttgccaaacctctagaaacctaagtgggtgttttatatagaatatttttgttaattttatctgctatagaaagtagtagtgtgttgttttatatagttgctaattacatactccaagctgatcatggcatctttgaattcagtaaatactttccttgaaggggagaccttaagtcaaagaaatttgtgattggttgtgagtggacatataggctgacccgctgcacagaccatcacctggacatgaatgaaacaaaatagaaaagccagtttattgtttttatttccagtattgtttatagctctatttgtaaaataatttagttagaaaagatcctaagaagacatcttaaaagagaaaagaccacttgctgtaaatagtagcaaaatggtaattgtcgattcagcataagaatagggcatttaattccttcttttaccttcatttagaaccaaattgaggtaatgccgggtgattttggcagtgtttatttaccacattgaatcaatagtcctgggtttctgtattgtttttattatttctttcccatttctaaataggaaagcaatatttactgatcatttatttcctgatttgtttgttgtcttgcagttgaatccttggcctgaatatatttacacacgtcttgagatgtataatatactaaaagcagaacatgattccattctggcagaaaaggcagaaaaagatagcaagccaattaaagtcactttgcctgatggtaaacaggttgatgcggaatcttggaaaactacaccatatcaaattgcctgtggaattaggtataagctacacccatcatgaccttccatagtttgtggtctaactaaacttccttttattatcttgccatgttttattcttataatatttttatgttaccattcagtgtttttaatctgtttaattttgcctacttgagattttttaaaaatcaaaatgatacagagctttgtagtcaaaattcaaagttaatttctgaaagagtttactttggtcttatcttttggggcattgtatatttttagtcttactatgattataaatgttacaaaaccgactagacagtgtttacctatttcgacttaaatgtcttggttttgaagttaaaaatgaagctacataatctcacatggaaaggttaagaaacttcatataacacatgaaaaaaatgtactatttttataaattcaatgaaagactattcctagtcttaaaacttttattggggtgggaagaagttatttcaattaactgagaattagatgcatattttgtaataggggagaggctttcttaatctgatatgattgggatcaataattggtcagtttatcaaaataagagttggtaaaacatatatatgtgtatatatatacgcgtatatatacacgtgtatatatatatatcttaaactgggtattgggaaactctagtcataatctgtttgtgtatgtcctgaaagcgaaaaataaaaatgattctttttttctttctttttttttttttttgagacagagtcttgctctgttgcccaggaggctagagtgcagtggcgcgatcttggctcactgcaagctccacctcccaggttcacgccattctcctgcctcagcctcccgagtagctgggactacaggtgcccgccaccacgcccggctaattttttgtatttttagtagagacggggtttcaccgtgctagccaggatggtctcgatctcctgaccttgtgatccgtccgcctcggcctcccaaagtgctgggattacaggcgtgacccaccgcgcccagccaaaaatgattcttaaatttttaaatagttggaaaaaataaaacaactaagaatatacaacagagaccatgtttggcctgcaaagtgtaaaatatttgtgtggccttttacagaaaaagcttgccaatcttggtcttaaacacttcaacttaaaatatgtgaatatgtatgtattcactaactttatatacatacataaaacagtgaatatatatatgtatggcaaggtttgggggatagcgagtgctaattagagttcttacattatcttaacacatacgagaagtagtctgagcacagaatccttgcagattttcatgtagttgtagagttacacctaacttgacagtgtttttgtgtgtgtgacttggatttatcaagccttctcaaacattcaacttggttttcatagaatccataattcccttattgtgttattttataattatatatttttgaagtttatttataagtgttatgtattgaattgaaccatttggaatcaccatatgaattgtcatgtggttgattatcatcaattttgtattgttgaaccaaacacgtaaaagaacaagcacaaaaacagtttggggaaccaacgtggctgattcttggtaagcgtattatacaactagtagaagcagaaccagttaggcctatgagccatgagcatctactgtaccacagacattagttagtactttttacaaagtgaatggagtgtttccattcatttgacaagtgcttctacctacaagttcttctaccttactccaaaggaagtaaaaagttgtaataccatgcaagtttctatgtgagagcatagagaactggatagacctttacgtatcagttcaacctttcattttagagataattttgaaggtcaggttgattaatagattcctctgttgtcacacaatgagattgtagccgtgtcattaaaatttaggcttctgttagtttgggaactttttcctctaccttctacaatgttgatctagattacattgtaatttatcaagtcttcagttgaaaaatattcttcaagaactataaaattctaagttgaattacatagctgggcgtgttggctcacagctgtaatcccagcactttgagaggccaaggcaggcagatcacctgaggtcaggagttcaagaccagcctggccaacatggcgaaaccctgtctctactaaaaatacaaaaattagccagtcatggtggcgcacacctgtagtcccaactacttggaggctgaggtgggaggatagcttgaactcgggaggtggaggttgcagtgagccaagattgagccactgcactccagccttggtgacagagcgagagtccgtctccagggaaaaaaataaaaggttgaattacataaaacattgatgggctttagctctggagttaagtcactgatctgcactgagaatactttatgaaatttttacaaaagtccagaataactttttgttctgtgaaaaattataacattgataacaggctatttaaagattcacataattagtggtgaatatgaaagggaaggacaaaaaagacatgttccatttgcgtcaaaaggtttttctttgaagttttgttataaatcttttttttttttttttgagacggaggagtctcgctctgtcgcccaggctggagtgcattggcgccatcttggctcactgcaagctccgcttcctgggttgacgccattctcctgcctcggcctcctgagtagctgggattacaggcgcccgccaccacgcctgcctaatttttgtatttttagtagagacggggtttcactgtgttagccaggatggtcttgatctcctgacctcgtgatccacccgcctcggcctcccaaagtgctgggattacaggcgtgagccactgcgcctggccgttttgttacaaatcttaaagattattttacccttctttgaaaaattgaaatgatccagtatggcccatgtgtaatctacattttcagagtaactctattcttagaatcttggggctccatattggatcataagataaaagtcatgttcttcccaaagaatatagagaatatgattatcctttttatcagttctttaatctcctgaaaactgttttacaccaatatgatgaaatacatttctctctgccaaattcatgttatgttttgtgaaatgcatgtatttattttattgactccatctgatctcaggaggaaagaaaacattgtttataacctatggtaaagttagtaggagcattgaaaatagaaaggagtttgttgtttactttctgtttggttcttttctcttgatcctcagataggagttgtatacattttgttgtaaacccttagacatagagagccaccaacacagcaagcctggctagcttaaagccttctagtggtaggtttctttgagatttacagtgtaaagggtgtatactttttcttcacagtgtagaatgttgcctaccttcgttgagatgtccaggctgttatagactattatttctctagctgtgcatttagatgtataatctggctcacctactcaactctgctctagtcacacagcttcctgcaaaaacctctcttcacttgcatctctgcttgcatctgtggccattccctcatctggaatgccatggcctcctcttttcttcctgtgagtgctttatcctcaaagcctttccagatgactctgacctgtactgctttccctcctcagaactcctgtagcttttacactctgtgtgctctgatatttcatcacttgatgatactttatgttcgatgttgtatattgggtgtgtaatgtttttactcacattatatggaaagttttattaaatagtctttcattttacctctatatttgttataaatattatcataggcatttgcagaatttattctgaggttagcattgtctgtcaaagaaaggatctggtgtacattttaagcaggaagaggaacagagaagttatttagtaggccttttttttttcctttggagtctacatagcttagctttgtagaaagagaaaggtgggtgtattaagagaaaactcggtgtggtgacttgtgccagttgtcccagctactctagaggctgatgttggaggattgcttcaggccaggaggccagcctgcgcaacatagcaagaccctgtcgctaaaaaattaaaaaaaaaaaaacttatttgttggagaaattaagattattcaaaccattggaaattgatagtgcttatttatcagagttgccatatctgcttaaacaggaggcattcaatgtcaaatgataatgttctgcattttcaggatcttccagttaggttcttaggtacatttttggaatttgttgtttttatcattatatttcagaaaaatagagatacatcaatataaaaaaacaatatataataaaaatagtgtttattttcctgttttcaaattagattcgtgtgtacttatatatgtgtggacttttttttttttttttttttttaagtcaaggcctggccgacaacaccgttattgctaaagtaaataatgttgtgtgggacctggaccgccctctggaagaagattgtaccttggagcttctcaagtttgaggatgaggaagctcaggcagtaagttgctgattagtattcattgaattttaggatgcagattcacatttgaagtcttttccagctcagtcctgctgcgattgggtggctaacatttattgttgtctcactgtcatatttgaaatcttcattttgtccttcatttagggaacataataaaagtgcttgccttagaaaataaaggggtgaagctgaataagtcttttcattactagacacttcaatagggaaaatgttttgggaattgtattaaacattgattaagcaagtaaaaattgttttctaaactgtgaacactattttattttaattttttttttttttaatgatggagtcttgctttgtcactcagactgtagtgcagtggtgcgctcttgcctcagtacaacctccacctcccaggttcaagctattctcctgcctcagcctcccaagtagctgggattataggagcgcactaccacacttggctaatttttgtatttttagtagagatggggtttcaccatgttggccaggctggtcttgaactcctgacctcaagtgatctgcccacctcggccccccaaagtgctgggattataggtgtgagccactgtgcctggcctctaagctatgaacactctagcaagatatgtacatttgacaaataaatttgaaccttacttcaaagcactgcctttattggataatttctgtatttttttctcatcttaagatgcaaatctgctggataacactataaaagtcaacctgcatgtgatgacaagattttctttttaattctccatggctgtgtatcatataaggggagacaaagtattttgttttagtgatgattgttcacttatgtatgtggattagtggttttcaaatgtattttggagccctcaagtttcttacgagaattttttaatgtcactttggtaccttaatactaaatcttgaaaacattgctttgggtgtattctgactcatcccagtgattactttaaaaccaagtactgccatttgatttcagtgtacagatgtttgtcctcgtgttttgtcattgtgttgtggggtcgggttgtaccacctttgttttgggccagtaacaacatgtaatttctaagtgatgttccatagccagctaaaggccagatcacagtgtctgagacatggtgctgtgggcacattgactcaaaagaacctgggccattgcaatcaatgagttagtcacattgtgagtagcagttgttttcagagaacaaagtctatgtcatttaattagtgatgccaagtttagtttaatttgtttgaaaacagctaaaccagatgatttccaaaataaaaatacactagtaattggaagccttttgaattactttggctatggatagaaacagtagtttatagatttagaaatttaggattttatatattgggtttacttgtagtaaatattatcatctgtctctttcagacaaccacattaattggcaacttgtatgccaagactcagaccatgccatttttctttaaattttcaggtgtattggcactctagtgctcacataatgggtgaagccatggaaagagtctatggtggatgtttatgctacggtccgccaatagaaaatggattctattatgacatgtacctcgaagaagggtaagccatcaactagataaagaaaactgaagtcaatgactatggatccataagttattcttaagagttctcagtaagggaggaatgatatagatctcactgcttcttcatcaggtatgcccattatcagtacttgaagtgttgcaatttacctgaagtaatagaggatttgatgagacctctgttctagattgatggaggtagagtcctaaggtattttgggaaattcagggagactggtcctcccctctcctttaaaacctggtgatagagttgcgggaaggggtcactagtgagaaaggtctccatggatgaccaaggtagaagctactgaaaatataaaatgtaaaaattacttatgaaaaatgttttgtttagaattctaagatacgatgcaatagtctaattttttaatattaaaacccttgaagtattccaaatactatttccaaatgaacatttttcgaagccatggtgtgattcgaatggaatgaaaagattatactttcttctccttcaggggtgtgtctagcaatgatttctcttctctggaggctttgtgtaagaaaatcattaaagaaaaacaagcttttgaaagactggaagttaagaaagaaactttactggcaatgtttaaggtaaattgaaccatagtgcgtggcccccactgttaatatcatttattcatgttagttgaagtgacaccactggcgttccgtgtactaagctgaagtctaattggttctttagcaaaaattaagtgtttttattatttttttaatttcatttttttcctagcaaaccattccttcaacatgtttttaaaacatgaagtatcaacatttatattcatacagtgctacgttttagctatagtacttagaagtaaaaattaaaggacagttttttaaaataataatttttcctgttttcagtacaacaagttcaaatgccggatattgaatgaaaaggtgaatactccaactaccacagtctataggtaagaatattagatgtcattaaatgtatctggtatgtatgtcattttgtctttgttaaaattcctttcattttatctttagatgtggccctttgatagatctctgccggggtcctcatgttagacacacgggcaaaattaaggctttaaaaatacacaaagtaagtaatgtaactttaaagactgtgaatgtatctgtctagaatagatatatgtttaaactttcactgatttctctttaccattttctgttgcacatgaaaggatggtattttctcatgctctctattaactgggagctgtatgccatcaggattttataattgaaatccctcaaggggtgactgacttgctgtcattgccagagcaatcacaggggatggagattttacaaaatcatacagcatgggccatcctggctctataaaagctttgagactcactgggagtatgtgcttttgccctttatatgtctaaattaataatttcccaagttgttgtttttaacagaacccagttttatactagttcataaacattttatggaggtttttaaaatgcactttaaatcaagagaataattgagtcatttcaagattttttttttattggctcatttctatttttgctcattttgtgagaaatgcctttgcaggcaaagtaatgtttgtggaattgtggttgagtattgaggggtgggcagttttgggggtattggggtgtagaatgggtctcactctgttgccccaaaaagacagagtggaggaccacttgagcctgggaaatgaggttgcagtgaatggagatcgtgccactgcactccaggctcaagcagtcctcctgccttagcctcctgagtagctgcgaccataagcgcacaccaccatgcctgggtaattttcttttttttaaataaagaatggggtctccctgtgtttcccaggctggtctcgaactcccaggctcaagcaatcctcttgcctcggcttcacagagtgctgggattacaggcatgagccactgcacccacctgcagattgagggaggggcatttttgaggatagaaaacagccaactttgtgctgcagaatgagtaactactctaacaaggcctcaaagcaattgggagttaaaataagtgagatgtttacaaatttgaatgttgtttcatggttaatccttgttttcagaattcctccacgtactgggaaggcaaagcagatatggagactctccagagaatttatggcatttcattcccagatcctaaaatgttgaaagagtgggagaagttccaagaggaagctaaaaaccgagatcataggaaaattggcagggtatgttcaagaacaatgatgtgtcttgactgagttttcttcaacttcatttgaagtttgaaattcagctgcatgaagtactaggaattttgttttgaagagatgttgtggctttttagtaactggtgctatgtcctgtacaaactataaacacttactgattgtccacattatctgcctggagtatgctcagtaccgcacaaaaatgcatttgaactacttttattgagagcaaacactgatgatctacggttttctgtaaaagaagtataacagcttctcatagagctgggagaactatggaaaccctctagtttcactgactcatttaaaatgtggaaacagagtcccacaaagattaacctacttgttgcccaaggtttagcagcatgtcgcacatggatcctgtgctatcatttcctctacccattatctctgttactgctgaatgtcctctaaactggaagttaggctagataaaacattcccccttaaaataggcactctgtgccaggggtccttggctattaggttatgaagcttgagctggaggtagcagccactgccttgcacccctgactacctgacattccagctatgaggcagccagcaatgattgatgggcccttccctgagggcttttgggcacttggggaggcggatgttggcaaggaggtaggagggtgtgtttctttcaccatgacccaaagtcagccaactttaccatcatctatttcattatcagtgtctttttcccagtctccttcctgatactcttactaagaaaataaatacatacataaataaaatgaaaaaagatccagatcttggagctttaaggaatttaagaaccatgagaggtactgcagtggatagttaaagaactgaagggacccttattccctgccactgttggggaaacttgactggattgaggaatataacaggcagggcatgtgttacacgtctgccaaattgtaaatcagctgcaattctataacatcagaaacactgacatggtttctttgattcaggagtggcactgattgaaatatgggacatcatgaccatattctgagctcaagaacactgaaatttatgtatatatacacacacgtatacgtgacgtacataaacattcttttgcttttcttttacccaggaccaagaactatatttctttcatgaactcagccctggaagttgcttttttctgccaaaaggagcctacatttataatgcacttattgaattcattagggtaagtcatatttattgctttcttctttagatttaggatatgtgatcattttattaaataaggtctactaaaaggaaagataatctgtatttgagaagaaatatataagacgataagtaaaagtagaagtctgtggcctcataaatcatccctaatagttgattttgcccatatacacatagaaactggtgagcttgaagggggacctgtggtccttgacataggagctctgtgccctctttgactttgatcatttatttgtattttctttgaaaaaacggtttttacattgcttttttcctttgtaaattatgaaatgtttcaagtataagtttatagagaatagtatatccaatatcttgtacttaactacccacatttaacaaatattcacattgggctatatttgcttgagattttttcattcatgatattaaaaaaaaaattagttgtttaaaaagcctctctttaggacccagttttgatccatatacctccatatactggtatatatatccatatactggtatatcatataccagttttctagaagaaactactgttttgaagttggcatggattctttttgtccatgttacttatatctagcccatgtatttgtacccttaaattatttatgtatttgtgtgttacatataggaagcctcattgtgtatcagactgccttgtgatttatttttagagacatgcaaatcaagtttattttcacttgctacatattattttgttatataactaccacaatgcactcatccctgtattgatggacactgatgtataattgtcccttattatcagccatgctgcagtagcatcacttttataagcctccttaggtacatgtgccaagagttttctctctggtatatacttagaagtgggatttctgaatcatggcatgtgtccatctttttcatgagagagtataaaatcactctttaagtttttactcccacttgaagtatgagcatttatttgcctacacatgtttctgtttattttctatcagagcgaatataggaaaagaggattccaggaggtagtcaccccaaacatcttcaacagccgactctggatgacctcgggccactggcagcactacagcgagaacatgttctcctttgaggtggagaaggagctgtttgccctgaaacccatgaactgcccaggacactggtattcggcagctttgaatttctactgaagattttcacatgctacaattcatcctgggttcttccctcctttaacaacattttcattaaaaacaaattatgtgatcagaagagcatttaaacgcaacatctttgtattatatcttctgcacctgattagatccccactttttttttttttttttttaaagaggtcttccaactggagtgcaggtatgcgattatagctcactgcagctgggactgcaggtatatgccaccatgcccagctaatttttaaaattttatttctgtagagatgaggtcttgccacgttgctcagcctggtctcaaactcctggcctcaagcggtccttcaaccttggcttcccaaagcgctgggattacaggcatgagccactgtgcccagccagatctccagatctgtgggcattcagtaatggtactgggatcatagcaatgaccaaggcagactataaaacaggaagatgaaatatgggggtgtaacaaattacctagtgtgttgttgttttaaagaaacctgttctgtcaaaacctgctaatgactcagcattcttggaaaatgttccttgtcatgaggccgctctgctttctatctttgaaagttgggtgaagaacagcttaagggaagacacaggagagctgtggatacaggtagcttagtgtctgcagctcctactagccaggcctggagggcagaggaggtgagagaagaatctttgtgaagaagctgtattataggctaggggaccaaccaagttcattcttaattttcccagattcttcagttgttggaatacgttttttaattcttcactgtggttcattgagttataacttatttgctgttttattcatgcaagtgcttttactgctgtatgtagcccagaatttgagaaatgttgcttggatggacagctagaatcagtggctttttgacaacctttcgtgtaattaaatatagcattacagaagcagttttattcttaagtgtccgtggacttttctttttctcttcagccttatgtttgatcatcggccaaggtcctggcgagaactgcctctgcggctagctgattttggggtacttcataggaacgagctgtctggagcactcacaggactcacccgggtacgaagattccaacaggatgatgctcacatattctgtgccatggagcaggtatgagaccctgggaataaaatacttagaaagaagagtcaagaaagtcaaggaaaataactactgtttctttttttgttttttaatttgaagattgaagatgaaataaaaggttgtttggattttctacgtacggtatatagcgtatttggattttcttttaaactaaacctttctactcgcccggaaaaattccttggagatatcgaagtatgggatcaagctgagaaagtaagtggtgtttttcagcgtgcttttgaatactgtttgaaattggcttgttctgagatgtaagaaagccaagcctctttaaatggataaaagcaaaatgaaattggaaatggttcctaggtttgtgtaagctagtttttttctttatgattgtgtatttttgaaatggttgaatgttttcatgacttttttcagttatcaagctataagctttaaaaaggggttggtatgagcatatgttcaggtggacaaaattctaaagcagagaatattgatctatgaaagtaattactgtatttttagtctcaaattaggctaaaagaagggaaattgcgatgaaaaaaataaaaatcattttgctttatcctcagcaacttgaaaacagtctgaatgaatttggtgaaaagtgggagttaaactctggagatggagctttctatggcccaaaggtgagcactaaagtacatttgggtaatatgattttcacttgtggatgaagaagatacgacttcgaaaaaagttggaaaaaagaaaatcagccctaatccaactattgagctccactttagtatcactggcattttataataacccagtctttgcttcttagattgacatacagattaaagatgcgattgggcggtaccaccagtgtgcaaccatccagctggatttccagttgcccatcagatttaatcttacttatgtaaggtgagtttctggtgtctgctctgaatattctccagggatatataagagaaaatatatataataagacaaaacaattttttttttctttatagccatgatggtgatgataagaaaaggccagtgattgttcatcgagccatcttgggatcagtggaaagaatgattgctatcctcacagaaaactatgggggcaaatggtaatttttgtcactgtcttttttttctgattagtataaattggctacaagaaatgtctacttttcgatttaattatcagatggaaagggagaatgattccaatcggttgcttctaactaacgacaagtgttcattaaaaaataaggaatcacaatctaaacacaaactttttagcattaagaacaattgctaatagtaattactttaattccagaacttgatttgtttggatgttgtgtaatactttctaattaggaattagtattctgtaagaagtatacttactgttttggatgcttttctagtaactttgttttgggatttagatggctttgctggttttacatagataaatgaggaggcttatggctttcttcgttcagccttgctaatcataacaagcaggtatttggacatgttttaaaagccaagcattttttaaaacagatgccaaaccgatcaacatttgtgattcatttctgtgaggttaagtaagtttttgtttccaagatacatggccacataactttcatcttaattcttaagcagttttttctggacccacagtgcatttgaaagcagcacagggttataaaagcacccgtgtgtagagccttccatattaatcatattgatttaaaacttttgtaaaatgacgtacattggtttaatcttacacattactgtcatttcagttttatttgaacttggttacttcagaaattaggacagtttctcattctgatcaatgatacaagataatctctagatttctcaaagtcagataaaatgtgagacacattctctgcaaggtatttcaagaattaagggagtcctcagctaattgctctgctaaacctgttttaggtggggaaaagtccatgattagggtagaatttagtgcctactttagccttttgcctgatacaacagaacaactgaaaatagaggaatgatggagaaaaacattagcctgatgtttgcagcatcagaagcatttgacacttgtattgcttcaaagggagaattggatgggcttattttttaataagtagtgaaaactctgatttttaccaagtgccataaccagttattatcaattacaatttgctgaatgatacaaaatggatgttgagtaaactgagggcactgtgtccccgtgaagaataagtaataaaatgaacaattaatcactacatgcagttattaaatcatttgttacctcctctcacagccaatacacagtgttttgtgatgtattaaagtgtgaggcctagtcctatcctcaatttgctttgctatctacttagcaagacaaattgtagttacaggctttccttacgtagggttagttttcttctcctgcatctcctcgccttaatctttattggataggtcttttcattttggggttttttaaagccaagttttaaaagtagtcgttacatgttccaggaaaagatactgaagagtagagtaagaaatatgctgtccctgtttagtgaatatgcccacatctacactgaatatttttattctcttccaaaggcccttttggctgtcccctcgccaggtaatggtagttccagtgggaccaacctgtgatgaatatgcccaaaaggtaagccttagatatgaattttctttcaatttaacatctgttgttcagcttttcaaatcacataagccctgtattcttggtgaatcgagctgttgtgataaagagaaatgttactatttttaatctttgttaagcctgaatagattatattacttctttaatgcttttctccatgattccataatcagaagacatatttggatagtgttttatgtacacttgtatattttattgtatttgttttaagagatgggatctttctcttgccccaactggagtgcagtagtacagtcatggctcactgtaacctcaaactcctgggctcacgcagtcctcccaccttggcctcccgagtagcagtgactacaggcaggagccaccatacccagttacacttgtatattttagtatttagtattttaaaaaaccagattagcagatatcaggtacttcagtatggtaggtaaattcccgttcaaaatacagtttaggctgctctttgactcagtgagtaattttgcttcattttaatgtaaatttcttcaggtagttgaaattttttcaggttaatagtatagcagaccaatgtcttgcctctctaccaaaaaaactaacttaccaacaaatgtatagccattcataacttcactttaaagcattgttctgccatagtgaaaattccatactaaggaatttcaaattattaaaagttgatgagtgaacaatactgtaacatcaaaaccatcatgtcttcagaccatcagaataaaccacactcagttcttaattacccttaagaaataaatgaacttgagcatggagatgcatacctgtagtcccagctacttaggagcttgaggcaggaggatctttgagggttcagggtgtgatgattgtgcttgtgagtagccactgcattccagcctgagcaacatagtgagaccccatctcttaaaaaaaaactgaagtgggccaggcgtggtggctcacgcctgtaatcccagcactttgggaggccgaggcgggtggatcacgaggtcaggagatcaagaccatggtgaaaccccgtctctactaaaaaatacaaaaaattagctgggcgcagtggcgggcacctgtagtcccagctactcaggaggctgaggcaggagaatggaatgaacccaggaggcggagcttgcagtgagccaagatcatgccactgcactccagcctgggtgacagagcaagactccatctcaaaaaaataaataaataaaaacaaataaataaataaaaaaaatgaagtgaacactaaaccatctaatagataaaccattcagactattcctgttactgcactcagtagttttagttacaaatgatgacaatcaaagttatgttccatggttgagtgcactttgtcttatttgtatgtgaaaactcacacagtaggaagaagttctgtattggttaactgagttctcaactggagacagcactgacttccccatttccctttgcgggtaggtggcattccagattatgtggtggtaagcttttcttttgcggggagagaagacagggcagtactcctgatacctaataactatagagcagacatgttaaacaccctgtaattatcaggccacttccccaactgcagaattgcccatctcacgtgcacacacaggacccatgttgagaaaaatgaagaaactgatgccttattctttaaagtagttataagttgaagatgtagacctatcttggcattctaaaattctgtaacaacccttctgaaatgggtgtaataaaatgtcaacaggttaattggttcgtgatcactgtggcttaaaaatctagttaaaatgctaagacttgtgcacagtataggcaaagtcacttagattgtttcaaaaagtatgccttatagaaataaacatttgacatacataaataacccttggtttacacataactcgcatttgagaaatgaatgtgttgtagatcatttagaatctttttcaatcaaaaattgaaagaaatatttcgtcacccaggtcaaccagagattgctggttttactcatgatacttaagtagagtatgatagttactatttcaccttcagctgtacttaagatgttttcctggaaaaattcattctgctttctgaccaggatttccagaaactctgacccttctaagaggtctgggtggaattgtgatggtgattctgctagtagacagtgtaacttctgcgtctacaaaaagaggataggccgtcactgctcacatggctttgcgtgaaagcccaatggtactgtctctatggcagagatgaggaaggaacaccagcgtcctccaactttcctgttcttcctttgggttaatggccactgtaaggaaacagttttctgccacgtgtggggtgatttgaatgtaaaatgcccaactctcatagcaggctgaacagaaacattttttatactcattgttaatttgttctaatctaaattacttttagactattaaatattattctattttaaagttaagggactaatgcctctgataacctgattaaaaaaaaaaactttctgatactcagaagttaagatttattcagttgaagatcatttctttcaggtgttgatcgtgtgatatttttcacatctgtaatctgaggttcatatgaaatgatagtgaaataaaattgttcatttaggtctttttgtcatgttaatatgttatcaggttaatgggaagtttaatctagttaatgtaaaattaataaattgtaatctagtttattgcttttttggaaaagaatactgaaaacattgtttacttaatacacatgacctgaggtaataaagaggagctggcctttttgaggggggaataatggcagtgaataatattatctaagacagttttgccagctttaaattcctggaagttcatccaagaagtcctgatccctgtgttcagtaaaatcatgtgagatcaaaatataattctgattttagatctgacaaattctgtatctctgttacaataggtacgacaacaattccacgatgccaaattcatggcagacattgatctggatccaggctgtacattgaataaaaagattcgaaatgcacagttagcacagtataacttcattttaggtaagaatggaaacttaccaaagaaaatttgccacacctcaggaaaatctactgaaaccttgagacaggtttaagtgaattgtaatcaagaatttatttagttccttccagtcctgattttttttctattatatattttaatatataataactataaaaataggctcatgcatacatactgggtttttttttttttcacttaaatcatggatgtctgtgagaaaatattttgctattataacaagaatgaagacgcattgcttttaaacacatctattggattactttctcaagataatgccttatgtgggattacttgaaaaaagatattcatgatgtttggggttttattatttggttgttacgttgtctagattgactccataagcacagtagttttagatattgcaaagagtttcttttaaatatcaacacatggtcacttgtaccttttaatgtatcagaagctatggggtaggttttgggtcctaggatcatttcttttcagatgttcagtgtgaattcttccatatctttagattaagtctgacaaagctttgtgtgtttgttttagttgttggtgaaaaagagaaaatcagtggcactgttaatatccgcacaagagacaataaggtccacggggaacgcaccatttctgaaactatcgagcggctacagcagctcaaagagttccgcagcaaacaggcagaagaagaattttaatgaaaaaattacccagattggctccatggaaaaggaggaacagcgtttccgtaaaattgactttgtactctgaaaacgtcaatttatattgaacttggaggagtttggcaaagtctgaataggtcaacctgcaggcgtaactatttttgacctagtcagtttttaaacaatgtgcatttgaaggagttaattaaaagagagccaataaaatgattttactcattcagtatctgagtactggaagtgaaacatgaggaatgctttagtgtaatgtgggagaacttttttgtaaatttaatgcaattgaaaaagttttcaaattcaattaagataactagaattggattatggtgtaaaaataaaaaaaaaatttattcacataagtttcaagactgctctgtccctcacatgtacacatacatgcctgagacagataatgtggttcagtatttatctttacagttttacagcaaatataatgcagggtggatggagacggggtaggtctgcagcatcataatgctattcataaactgggtgtgagctgggtgctggcttctcagaggataaacacttttgggagtgtcatttttacttaatgttggatggacaccttttcaaacaaaaactaccatggatctattacagagtagatttgcacaaatgtttaagataaaacgtgaatcttcagagaaatatctgtttatggcagactgttctggaccatagaatcacttggtttacaaattccctattttctcataagggatcattttcaaaatcttctaccaataaatggtgattgaaaggacagcacaaagtaaataatttcttatgtggataaatactaattcctccttgttagaatgatattttaaaagtaacatcttttttttaattttttttgagacaagatcctttgtcccccaggctggagtgtggtgccatgatctcggctcactgcaacctcagcctcccaagtaggtgggactaaagacatgtgccaccatgcctggctgatgtttgtattttctatagagatggtttcatcatgttgcccaggctggtatcaaactcctggataaaagagacccacctgcctcagtctcccaaagtgctgggattacaggtgtgagccaccacgcccagcctaaaaagcaacatcttgtcagtgctataatctcaaatagcttgtttgcaaggtgtgatggttaatactaagtgtcaacttgattggattaaaggatgcctttattgtttctgggtgtgtctgtgagggtgttgccagagagattgacatttgagtcagtggcctgggagaggcagacacaccctctgtgtgcgtgggcaccatccagtcggctgccagtgcagctagaacaaagcgggtggaagaaagtgggattaagttggcttgctgagtcttctggctttcatctttctcctgtgctggatgattcctgcccttggacatcagactccaggttcttcagcttttggactcttggacttatacccgtggtttgccaggggccttctggcctttggccattgactggagatggcactgtcggcttccctgcttttgaggcttggactcggactgaaccactactggcttccttgctccttagcttgcagacagcctatcgtgggacttcaccgtgtgcttgtgtgagtcaattcttactaaatttcctttcatatatacatatatcctattctgtctctctggagaaccctgactaatacacaagggtcacttcaaagagaagctaatttgcatagattaattttcactttaataaaggagctaagatctttaatcatagagggcttttcttttgaaactttataattaagccttgcttctgaacagctttaaaattaacttttgtgatagagttgtaatttttatgtgtctgaaagaaacttaattttatacttaaaccagactcaacatttagagaagctttataaatctttcaaaacttgggataaaaaagtgtaataaagacatagtttagtgggactggaaatcaaaggtttctcttgatctaactaacacctacttagcttagtcctcacttctagtggaatcattagagggccactgtcttgatgggagggttcttgtgtggggttttttttttttttttttttgagacagggtcttgctctgtcaccaaagctggagagcagtggcacagtcagggcgcactgctgctttaaactcccggattcaagtggtcctcccacggcagcctcccgtgtagctgggactacaggtgcatgccaccacacttggctaattttttttttgttttattttttgtagagatgaggttcctactatgttgc

SEQ ID NO: 15952 - DNA, 119601 bp, Human
cttgtccttttggcatcctctcaccccacgagctacttctgtgtcttttctttatgtaacactgaactctccagctcaggcctccaggtcctaagttcataatctcattacaactaatcctgtttacggccattctcttggcagaacaatcttgtctggaccaaggctctttcctcaccacccaatgttcttgttgctccattgttcctggggactgtggcctggctgagtataagctttcattgatagggtttatcctgtttacagggagtctgcagaagggcctcatcaaatacttccatcccttccttcaataaatggctccctttgatctgtgcaaggcacaactttgtttatcagaagctgggcttcctctagctgatgatggggacatcctgtcccagaaaggctccccaaaataacaccttctgaatttcagaatattttcaggttcctctattttggaagcattttttttttttcttgcatgccatttcttatggcaagcaaagaaaggagctgattttgcattttgaagcccaaggtaacacaaagttgaacaggtcaccgccaaaaatgaggaaaggacagtgttgataataatataaacatttggaaccagaacaatatacaagattagggttgaccaggtgtgatcgtttttcatattgtcaatttaaaactggaagttatctaacaaggtgaaaaagaggtcatgggtgttagtcatctatatgacaggatggtagaagctagctgaattatgtggatgaatggtaagggcgattttacactgtccgagccaggtaaagagctctatttacagcaatggttctcaaagtgtggtctctagtccagcagcatgacctggaaatgttttagaaatgtaacttctcaagccccatcccagatagtgaattggaaactctggaggtggggcccaggcacctgtaagctcacaagccctttaagtgatgtgattctcatgcttgctaaagtttgagaacctctgatctgccccaataatcttcaaacttcggtgtacacaagaatcacataagaagctaaaatgcagattcccagatcccatacctaacgatgcagattcacttggtctagagtggacccaggaaagtttgcattgctaataagcagcccagggtgatttgggtgcaactggtccatgaatcaagcttcgaggagcattggcctatatataaaggagtggtacaaattgtccatattgctccagtcttattctaaagaggctccctccgtggctaagaatgagccagtatcacaattcatcttcccttcccagtcatctcatgaagcaggctgctaagattacctattgtgggccgggcgcggtggctcacgcctgtcatcccagcactttgggaggccgaggcaggtggatcacgaggtcaggagatcgagaccatcctggctaacacggtgaaaccccgtctctactgaaaaaatgcaaaaaaattagccgggcgcggtggcgggcgccttgtagtcccagctactcgggaggctgaggcaggagaatggcaggaacccgggaggcggagcttgcagtgagccgagatcgagccgctgcactccagcttgggagacagagcgagactctgtttcaaaaaaaaaaaaaaaaaaaaaaagacctattgtggttttcaggattactctaatactagaaggttagattggccccatggattcctttcacactgacatctgaaacacactgctgactcctaacctgggttggactcatgctgctggcctggaggcaaaagctttttatcccattactagttccttgaaccacaatccaagacacaatttggttttcccaagagttttgttttgcactgctgatgcattccagtcattgttgtgatgcatttccttctcctctttccctccagtccctgggcaatgccacacatgtatatatagcctcctagtgtgaacttactcaaatcctaaccctctctcccagaacgtgtctctgctgcaaggcaccgggccctttcgctctgcagaactgcacttgcaagaccattatcaactcctaatcccagctcagaaagggagcctctgcgactcattcatcgccctccaggtacagcactgctggggtttgcttccttccttcctggctttgtgtcccatgtccccttagacctgtcccccctttagatttcttttcactctgctttaataccagttgtgagggtctctcagggctctgaccttacctctttgtcctacaaaagtgtatttcttgtgtggtttcctgtgacctgtacttacccagactttctccagtcaatccttggcatcctacagagatggtcttcctcagtcttcagtctctgtaacgataccagcccttgtttagagacccagagtagaaatggtcactgtatacagttgtacagtttctgcaccgcacagacacctgaggaagagagcaagtggttaggaaaatccagcttgcacactgctcaccaagatgaatgcctgaagctgctctgtggaaacctagaggaaggtacattgtttcgctttttttccatgtcagatattgatagaatcacatataactacattagattatcagctaaaaccagattagtgtgttttattgtcatgtcattgtgtatgtgaacatgaagacttttagagtgcctgaaaatattttatgagaaatagttaaatagcttccctttttatttttcattactagaccttatttcttagagcagttttaggtttataaaaagccagagcacaaagtacagagagcttcatatacccctgcccaccctgtccaccccactcccagtctcccctgttagtaacatcttatgttagtgtggtacatttgttgcaattgatgaatcaatattaatagattagtatgaaccaaagttcatggtatacattactatgtatactatgtatactcttcgtgttgtgcattctatgggttttgacaaacgtgtgatgacatatatgcaccgttatagtatcttacaatagcttcattgctattgctaaaactctgctgtgctccatctgttcatccttcttttcttccctgccttctccaggccctgacaaccactgatcttttaaccatctccatcgttttgaggaaagtacacttttttctttgcacaaagaactgtctactagccaaaaccacaggatgcttctgcccagaggaacaccatttaaaaaaacatgcgcaaaggttttatcgcagccagccaatgccttgaatccaagctctaacccaattcaagacctttccctggatcacgtccgtgtgtcctgtctctcttgtttccccttatccatctagcatatacttttcctggtaaacgtttctatttttttctgtttaggctgctgtaacaaaaatacgatagtctgggtagcttaaacaaaaatcatttatttctcacagatctgtaggctggtaattcccagatcaaggcaccaggcagaatcagagcctggtgagcacccacttcctcgttcttagaggaccgttttcttatcatgtcttcacatagcaaaagggacaagggagctgtctggggtcccttttataagggcactaatctcactcatgaggcctctaccctcacaatctaatcacttccccaaggccccacctgctaatgccatcacattaagggttaggattttaacatatgaatttgggggagacataaacattcattctgttgcaattaccttatgtgcccctctcatctacccacccatctatccccctcctcttctctgatgcatcttctatgtcagccctgtctgaaagcattttctgcaatgatgagaatattctacacctgtgtggtccaatataatagccactagctgcatgtggctattgagcacttgaaatgtgtctcatgtgacagaactgaatttttaagttacatttcatttgaataatttaaacttaactccatgtggcaagcaacaattgtattagacagcataggtttaagtttttacctatgccagattccccattctaacagaattcattaacatcccccccagtttcatactggacatcttcccctcccctgccttttttatgttttttgtttgtttgttttgttttgttttgttttttggttttgagacagagtctagctctgtcacccaggctggagtgcagtggctcgacctcggctcaccgcaacctccgcctcctgggttcaagggattctcccgcctcagcctcctgagtagctgggattacaggcgtgcaccaccatgcctggctaatttttgtaattttagtagagacagggtttgaccatgttggtcaggctggtcttgaactcctggcctcgtgatctatccgcctcggtctcccaaagtgctgggattacaggcgtgagccaccacgcccagctgctccttctccttgattctttcctggctaatcaggaaagatacaattgttcctgaccccattgctgaaatagtcagctactatgtccgtcacatttattaccattaaatttgcaaatatatgtacaaccattatatatccatacaaactaaaaatagttttaaaagtattagtttaatttaattaaactattagttttttctaaaaaaatagaaaaaatgtgcacatatggtgccgtctcacgtaactttttttttttttttttttgagacggagtctcgctctgtcgcccaggctggagcgcagtggcgcaatctcagctcgctgcaatctccacctcccaggttcaagcatttcttgtgcctcagcctcctgagtagctgagattacaggcatgtgccaccacacctggctaattttttgtttttagtagagacagggttttgtcatgttggccaggctggtctcaaactcctggcctcaactgatctgcccacctcaggctcccaaagtgctaggattacaggcgtgagccactgtgcccagccttacataatgtacttaaaatttctttaatttatgaagctagttgatgttgcttgtctataccttttaattctttcctctttttttttcttaaagaaatttccaatttctttaaaattttctgtttaaaactctatactcccagaaaacagagtagagttacataactaatgctttatttggcaaaaactacaaggccatagttagtgggctaatatatgtcagttcagatgattgtggcaccacctttaaggcatgaaaaggagagaagggaagaaataataacaccaaaagaaattaagagtttaagtccaagagtcagcatggagtggagttaaggaactatggattgtggttcttgggaggctggagttagtggtaagcatgtctgtgccaccaaccagtccagggcattggtgatatcactgaatctctcagagactcagctctctgcttcacagcatgcaggttttcactagaccctccaatttaaggtgtcttctagatcaaaatgctctttaggtcaaacacagtcttaggaataactaggaaagttgaaacaaactttcgtcacacagactgtttcacattatcccacctcctgtcacccccttctcccacctagcaatgtttgtgacgaatacaccaactttcctgaggacaagagcaaaacaatattttaagaaacaacaaaactcagtttagagtgagtcactgggcctgaccatggtggctaaactgaccacaaaagtttgtgaatagtctatatggtgtccttcaaacatctgcacaaaccttttatttccagtgctttgaacagaaataaacatagtcattaagccaaattctacattctacaaaacagatgaaaagttaaagcataacgttaagtccaaaacattagtgtggagtcctcagctgaatacctcttgcctgcatgcccatgtgagcagtcagttaaatgcctggtgtctgttatatgagcagtgggaaatctttgcatacaaaaaagtgtgagttgtactaaagtaaaatcagtattctggatcccttaatgtgcacataattaccacttaggcttctaagcgaaatgatttgctaatggcaactaaaatgtgacatggcccagagtgaaaaaattgattcataacttgggaaggtttgactagattgcccttaggcaagtgcctagagggctttcctgtctctccctaaaccttgcttctgcagttccaatgtacaaaatagggatagggttgttgtgaagattaaatgaaactagggcaggtcttctggacagatactattacagtgctgcaagcccttccttcagaatccttggcaccattacagttctacatttatttatatcatcatttgactactgtccctcagctgactgtacattccataaggacaggatttatgtcaactttttctcaacattgcttcaccacctcctcatagaacctggcatataaaagggagtcaacaacaatcttttgaatgaaatgtgtaagtcatttgcagtcactggtgtcagatccccgggtttgaatgctgtgtgcttggacaagtaatgtttctgcctttgtcttagttcctgctttctataaaggggagataataatggtatctacttgactgaatagttgtacaaatttagtgggataatacttgcaaagagcttggaacagtgtctggtacatagtgaggactcaatacatgctaatgaattttgatgatgatgatggtggcggtggacatgcaataagctcttcataaataatagctcttcttctaattgttattcacggtcatcattgaaacagtatttgcctcttgattatcagtcataggtggtccttagttacctaaaatatcacaggaccactgctttacctttccatgttatgccaggcacagacaacagaggcagtgtcaaaggagatacccaaatgatgtttacaatggtacacgggtctctagggtccaaggaaaagttaccaagtattttcccacctccctactttcatctccctcttacttcccagtcccttccccccatgcttgtatggtcttctggctttttgaccagtcctccctggggattttcaagtacccagcttgcaaatcagcctccccagaggatctgtctctactcatcatagtcaaaggatgtaatctgttctcatgtggaaataatttgttcagagaatgtaaatgatcaaagcctatatttctgtattcaggagaggaagagaaaataatagaaaagacttgaggctaactctaggtcctgcatttactaagtcacctctgataaattacttggtaaattatgtcttagaaaaaccattggtttggtaggaataatcaaaatgggatccgtgtcccgggtttgtaagaattaaatgagttaactacatagatggtttggttccaattagataagagagtttctaaacagtgaaaagtagaaattttgccacaccctgccctcacaattctagcatttccaggtttccaaatctgggaaatgtagctaagggcttttcctttctctagggactccctttacaagtggtggagctactttctgctcgaggacaaagaaggagggaggacacacacacacacacacacacacacacacacacattttcttctctgccttctgaccctttgctattgcaactctaatttgggaattaaattttaataattctaaaatcccatttccgtactttccatatactattatttaatggaataaggttatcaaatcttatccttaacccttttcccatttttttaaatttgatggtactagatttgaattttatagcattttcaagaatcacttgggattaatttgggattcaatttcacttgagaactagctgttgtaaagttgaattatttttaataagcaaaattactttcatccattttatttttttaatagttaaggaacattcactttgatattcatagtcctctaaagtataacataagcattactatttcttgtttaaacatgatcagtagctaagttgtaaaaaaacatggggaaaggagttagccctacacttaaaggaggcagtatcccaaagaatatgatttttaaaatgagatcagtaacatagagctcttcatcctggctaacacagtgaaacaccatctctactaaaaatacaaaaaaaaaataaaaattagctgggcgtggtggcaggagcctgtagtcccagctagttgggaggctgaggcaggagaatggcatgaacccaggaggccaagctagcagtgagccaagatcgcgccactgcacttcagcctcggcaacagagtgagactccatctcaaaaaaaaaaaaaaaagaaataacatagagctcttcaaagtagaagtacaataaataccaataaacatatgcataattggatctactttatttttatgggtaaaatgtataaatgcattgctaacctatagatagatgatttggggaaataatgaaaagctcagagtgtttcatacactttctagagtaattccagttctaaagaaaaatttccaggcaaattctcaagttcagatcgtaatgtgccttttatcctattaggggtcatttctttcctgagcattgtaaggacaatatctgagatgtgcttgattaatccatagggatttaaggccttttgaaaaagacattcaaagacctaagcaaatataccttctgatttttataaatattttattctttacttatttatctgagcaaaattgcataacttactagcaactccaaccacatgtaacatttaacttaaaaaacaagtagggaagaaaaatgaggtttagttaaaattgaaaattaatttcttttctctgtaatactgacttctgtgaggatttttaacaatgaggtcaataaaagtatttaaagccacggggaatgattagacagtctcatcatcctgcatacagtgtccttcatattaaaattcttcctcaagccctttcttctccccttccttccttttcagactgagcacctgatcagagaaaacctgcttgactgtgtagccctgagagtttggtttcccagaggacagttctaggcctctcaacctagaactttccacctgtgtgaccttgggctagtggcttaaccttcagaacctcagtctactcatctgcaactgggtatccatgtcacatgttaatgttggcattatattgaatattggggattttgctaatgagagaatggtttccctcacaacctccaattgcagctaacttatgctttgatataatgttgctctaggtcaaaaataaaacaggccttgtgatatgtattaatggatagagtcagaaatacagattccaaattctacagtagcaactgagaaggaacagaaggcagggcatatctccaggccagggcctttgaatccctacacctaatgtaggcccaggcacatggtaagcactagatacatgtgcttttgaagggtcttttgatggattttgataagttgccccgactagaatgaagctggtaaaactagaaggcaatagagattcatgggttaggagcaaaaggtgggaatctagcccgctgggttcaaactccagctttaaagtgactttgggcaatgttatttctcagattctgggtttaaatctgatcattcttctccctatttgtcccccatcccgtacactcttttaaaacagtaacaaccaccaccaccaccatctttaatagcttttcactgcctttaggataaagttccaaatgtggcccacagcatctggtccctgcctatctcaccagtcttctcttgctagttctgttagctcaagcaatagtggccttttttttttttcagtccttcggaagtgctacctgactctttcttgctcctgggccgtcttgtccaacagcatcttgtctcatctgcctggagtgattttcacctccagcaccagtaacgcctccctgtttgccagaataacttttaatgtccaggcttaaacatcttttttatccgtgaggtttttcttcccatccctgtctaggttaggacccctggtatatgctcctcagtttccctctttcttgacactcactgcattgggatgtctgttccccattagactccatgggatgtttgtgtgtttgtagagggctggggtggggaggggtaaggggcaggaggtctacttttttcagtactgtattcccagggtgtagtcctgtggctgttcataaaactctccaaatggatgagtgaaggatttaatatcgagagaccaacatcagtctaccttatagactggtgaagggtaatgtagatcagcacaattcttggcacacagtgtctcagtcaatggtggctattattaataacacaaatgcttaattgatggatttctttcatttctaaattctttggtggacacttttccaaaaaggagagttaaaggaagatatgcaagctgccattttgcacccattcatctgaaaactatttgagagttttaaagcagaacgagttgaaacaatgtgccagacctaaaattggaagcaacacagaaaatggctttgatgtgatggatctagtataattgtgtgtttgcaagggcctcgggtctggctacactccaggtgtaagcatccctaacccagtctatcaatcagatgttaccagtttgaacgtttctgttgttttttaaacagaaatatgagtggtgcctataggaatctacatgttagcacttggaaaatgactacagtgagtatcacataaaaacaaaatttgcaaaagataattatggaatccacatgaaagtcttacatctgaggcttctacatgaataatgaaaggtgaacactctaactacagttagaattctgaggtaggattttcataatgaggaccatgttatgtacagcttggtgtaacagacttgtatcttcttttatttaaacattataagtgtgagacttcttttatttccaactgaccaggtctcttaagttataaactttgctgaaaatttaacataggtaggacagtttgtcataattcttagcactggaagaaactgtgagttaaaggaacgaggccataatgttgctatgtcatgggtcagagccgatgttttaaaatgggggcttttcattgacacccgggtgacaagagtgaaactctgtctcaacaaaaagaaagaaaagaaaaaaggaaaccaaaagcttttaccagaaccccaggcaaatatctacttatgtctcagtggctggggaagtggggaaaaggggaagcggataccggataagtaaccaaaagtgatgctacactcggcttagttgcttcctattagcccagttgcagatgggaaacagaaggggattgactgctctgggtcatcaatcatgctctcttggtggggagtggatgaagaagagaagatgtgacaggtcatttctggcaacttccaagtctataatagcctagctagcaagggaacttacggacaatattttgccattgacttatattttttaaaattattatgttatttagagtaaagtagatagccatatgagctgacctagatgctttcctccatgaaaaaaaaaatgagcaactaggttaccatttacaatggttcatatgtgactctgaatgactgtgtgtccctctattttagaaatatctgggccttcctgatgtccaggttgacacacatcctgttttgccaagttggaaagagttctgaaaatcccattccattttatttgaagaaactaccacagcatttcttcttctaaccctaatgggaagcacatggagatcattgaacgttgggagcccttttatgcccaaattatgttttttaagcaaagagctatgttaaagcgacctccaaacatgaccctggcaaaagtcagtagccttgcttgttctggccaggttcctgatgtaacccaaggttctgggaagattcactttaattacaaccccttttgatctgttcctcatggtctcttacataacatgtattacagttactaaaactgaaattttcatctttgagctaattaaatggatgtaatttgtacttgacttcttttcttttagaagagctggttaagtcagtatgttgtactgtttttctaaagcacgcaacttaaattctctttatttctttaatttttgatttaagtaaaactttagcttttgtattctattacaaagataataaaaacacttatggcatcatctaatttttctttagccatcatacaatatcctatgaagaatatttctttggaaagcattttcttcttttttaaaaagtaaattttactgtgtatatttgaggcttacaacatgatgtgatgagatgcatgtattaatagatagtaaaacggttgctataatgaagcaaattcacgcatctatcctctcacatagtcacttttgtgtgtgtgtgtgacaaaagctgctgaactctacttatttaacaaaaatccctaatgcaatacaattttactacctatagtccccattttttacatgagatctctaggtgtgttcatcctacttatctgctactttttatcctttgacctacatctccctattttctccccactgacccataaccactgtttcattctccttgtctatttgattttctgttttaagattccacatataagttaggtcttgcactattttttttttctgtgtctggcttactcacggagcatagtgtacaggtccatttatgttgtggcaagcattaggatctctttcttttttaaggctaaataatattccagtgtgtgtgtttgtgtatgtgtgtatatgcatatataccacattttctttatccattcatttgttgacacttaggttgtttccatgtcttggctatggaacagtaccacaatgaacatgagagtgcaggtatctttatgagtgggtgatttcatctttgtgtgtatacccagaagagggattgctgggtcatatggtagttccatttttaaatttctttaggagcctccatactgttttccctcatggctgtatcaatctaaattcccaccaacattgtacaagcgttctcttttctctaccatctcaccaatatttgttatttcttgacttttcaataatagtcctattatcaaaagggtgtgaaatggtatctaatgagtatgagatggtgtctcacagtggctttaatttgcatctccatggttgtattaatccattttcatgctgctgataaagacatacccgagactgggtaattaattaaaaaaaaaagagagagatttaatggactcacagttccacatggctggggaggcctcacatggtgaaaggcaaaagttacatcttacatggcagcaggcaagacagaatgagagccaatggaaaagggaaaccccttataaagccatcagatgtcatgagacttattcactaccatgagaacaatatgggggaaaccaaccccatgattcaattatctcccactggatccctcccacaacacataggaattatgggagtcacaattcaagatgagatttgggtggggacacagtcaaaccatatcaatggtgtttagtgatgttgagtacccttttcatatacctgttgatcattttatgtcttctctggagaaatgtctgtttagcttctttacccctttttaaatcaggttatttatttttctgctattgagttataaatgttctttataaattttgggtattaaccccttatcagatacgtgttttgcaagtactttttcccagtctgtaggttgccttttctttttgttgactgtttcctttgcagtgcagaagctttatagtttgttgtagtctcatttatttatttttgcttttttagcctgaacttttggtgtcagtgttttcttaatacactaataagttctcatgagaattggttcgtttccaaaaagccttgcatggtgcttatatatgaaagtgaaaatctacattacttaacataaagcatatgattaatactagaaacactccattctccatgtatcatgaaaatattagcatatgttagaatgcaagatcaaaaaagtgttataagttgtaccatattactgatcatgaaatttataactcataattttggccttcagttcaacagcagctctacgtaacaagcaagcatcaattgaacacgttacgtatgtgcaaggcactctgctctgagtatagggaggaattagcatactgcagtgcctgttctcaaacgactcttattccatcaagaggaaacagacaaataaacaaataattacaatgcaatgcgatcaaacacaatgataaaaagttacacagagaccggatttaactctgttggaggacggtgaagatagggcgtcagagaggtttcagaaggaaggcaatgcctgatgaatagcttcttgattgaagggtgctgaggaagtggcagcagggaattccctgggcagaaggaaaccaagtaagcattgtgataaaagtgcagattaacagtgatgagaaccgaaactaagacagtgccagtgaaatgctggcaggggatgaatctgcagtactttggaggtaacactgaaaacctagcaatttgatttagtattgtccaaaaaggttactaaagatgaagcttactggtggttcatggagataattttgctggccttgtctttttaatagatcacttgatgtgaagcaaagttttaacaaacactatatgtgcataatttattttaatttgaatattatatatatataaatgcccaaggctgtttgcataaatagcatatctctaaggtatttgttcttgcatagcaacagactgagggcaaaataagaaaacgatgtaagtatttagtgaacatggagaaaaaaccaaactgagtctcactgatccttccaactcctttctgcctgattgaaggatttacttggtcacctacctctgcatattagttcccaatcctgtctaataaattgccaagcaacaaactgcctgatttattcattctgtcagtatgttctgagatgcttggaactggagacagagaaatcaagaaaaggctgtagccaggcatggtgtcacgtgctacttgggaggctgaggagcagggatcacttgagcccaggagttcgaggctgcagtgatctatgatcatgagactgcacttcagcctgggcaacagagaggacaccatctctaaaaaaagaaaaaaaaaaaaggaaaaaaaaagaagtggtcatttgtccagtgtaataagcacattcttagaagtgaggcttgcaagaatgcggagaagtgagctaactctacctggtggcaaaagaaacgcttcacaaaggaagtgataatgcagctttgaaggtttgaagaatggggaaaaggaggaatgtgtggtggcatttcaaatataggatactgtgcgagatcacattattgtttccaattacttgttccatctccctgtgacaggtttatatttccctgccccatttaaggtcaattttggccatgtgacttgctcagctcaataaaatgtgaacagaagtgatttgtgtcacttatgagcaaaattcatcgtgacattccagtattactcttctccctctgacatgtgagaaaaccatttccagaaaggacctgctcatttcacttcagtcccagaaaaaagaagactcttggaataaagctgaggccaacctgcagccaatgtgtaatatacaagcaagaaatagaccttgctgttgaaaacctccaagacatgggatgctggttacagcagcgtaccttaggaaagctgattaacacaaaaatagtcactgaaaaggcacaggactatgaaagggcatggagtggttgcggaatggtgagaagttcagattggctgagagtgtagactccgcgtttagagaaagacagccagaaatactccagaaaggtagcctgggaacagattttcaaagggtcttaaacgtcctgctaggaaagttgagttttagtctttaaatagtagaaagccagcagaagctaaggagtgacctgataagtttttttttttcttagaaagatgattctaataggaggggaatgatgctagtaccagggaaatcagctaaagcgtttttataatcctaaccaccactatttattgtgcacataccatgtgtgaggcattttgcacctatttaccaaagtaatacaaccaccccctggggtagacattgtaatgatcctttttttatagatgaggaaactgaggcacagagaggttgaataacttggctaagtcactccaaagacattgtagcattagagttccatcccaagcagtctgggtgccagaatccatatcccactctcagaagcctagaaagtggtaataagcatctgaagcacacggagatagagaagaacatctcgagtctcatatttatggggctgcagaggctgaaggtgggcatgaggtgaagcttaggggtgacagagatggaggagccacagataatgcctcattctttactgaagaggctcaattggtgctgaagcaatgaattggaacgagggaaaaaaagagcaggtttaggaaaggaaaatgacgagttttgcttgggatacattaattttgaggcagatgtgaggttaggtggagatgacctactggcagttagaatacgggaccgaagctaggagcaatgtggggtggagacagatctaggtggggcagaaggccaggtagcagattaattcaccctggcagatgtagaaagtgacttgaaaagagtgtcaagggaagaatttggaggaaccccatgatttaaggagtagatctaggaggaagagccagagaaactttgactgggaggcagtgataagggaaaggaaggtggcagggagagaagagaggatgggttttcaaaatgatgatcaccacaatgacttaaaactggaggaattaggaggcaaccacagccacctctgtttgtggcacactccagccatagtgactttgagaaacaagaacctccacttccacagcagcataaatcacattgcaccttatgagtatcccagtggaggaggtacaaggatgcatttgggtggaggtggagaaaaagtagaaaatgagcttccctgatgatgactctcatagaattaagtacttttatactaatttataactgcagaacttatttatgaacttctaaaatgacagattcccataaatggggaaaaaagtgcattgcttcaatttacaggaattgcctaattccaaacatagtaatgagaaggatttaaaattaaaatccttttgggaacactcttctacctggaagagctagcttattagagtcacctcttatgtgttctccattaacactattaaatttcaacagcctgtaactgttgaatattaagatatttgcatagaattccccaggtttttggatgacctagtagaatatcacatttttaaaaacacacgaatagctcaaagctacacagagtttattatgcaacattctattaggaatagctcaaatgaatgctttatagtagaagaaagtgttgcagtattttgtctataacataattgactttcttggtgagtatacctcaaattattgaggtatgttgagatggtgtttggaaaatgttccatggaaacaaagcttggaaacttggggttaaacaatcttgattttatttttctattgcaggacttctgagagccttcggtgtgctggtttacattgcatagctctagagatgggtattatgtaggagttcctaaacttaactgaccatacatagactcccctcttttttttttccaaaaatatttgacctactttatgaaatgtcctatatagcagattatatttctgttcaaaatgttggctgctcctccctgtggtatcccttttctgtagaaatattatccttctctacttcactggccccaagtgtggccacgtgacctgttttggccaatgtaacatggctgtgggtaaggtgtgtttcttctatcagacactcgaagagccaggtgtagttcatctattctttgtatcctttgctacaagaccagctatgtcccaaagtttgttctgacatcttagagttctggagagtcctagaatggaaatgtaaatgcataaaacataagtctttgaaattgtaagccattaatattttgcatcatttgttaccacagccaactgagcctaaggtgactaatgccttctacttctaagtatttctaaattatctgaacctttaccacttttcacaggtgtactcattctgtattgattgtctaaatgaggaagtgttcttggaattattctttaggttaggacagtacacttgaaggtgaactaaaaaaaatatatatgaaacgtgtcttaaagaaatggtgtctaggctgcgcgtggtggctcacgcctgtaatcccagcactttgggaggctgaggcaggcagatcatcagaggtcaggagtttgagaccagcctatccaacatggtgaaaccctgtctctactaaaaatatttttaaaaagttagctgggtgtggtggtggacacctgtaatctcagctactcaggaggctgagacatgagaatcacttgaacccgggaggcagagtttgcagtgagccaggatcgcaccactacactacacactacagcctgggcgacagagtgagactgtctaaaaaaaaaagaaatagtgtctagtagttacctggaattttatcaaaaatgagtagtcttggttgggcgtggtgtctcatgcctataatctgagcacttcgggaggccaaggcaggcgggtcacctgaagttgggagttcgagaccagcctgaccaacatggagaaaccccgtctctactaaaaatacaaaattagctgggtgtggtggtccatgcctgtaataccagctactcaggaggctgaggcaggggaatcacttgaaaccgggaggcagacgttgcggtgagccgagatcacaccattgcactccagcctgggcaacaagagcaaaactctgtctcaaaaaaaaaaaaaaaagaaaaagaaaaagaaaagaaaagaaaaaggaaaataaaagaatattctcaggctcaattctcagagattctgatttaatgggccttggatgggtcctaggaatctgaattttaaactagatgttaccaatgcagcttgtctgttaaccacaccttggaaaaatgccactctaaagccactgtttgattaacagtcatgtgataacatgcatttaaataaatgtcatttcaatttaagaaggcaccatggagggtcctccttggaattcctggaagcatgtatgaaatcagttttatcacatttgagtttatattcattacattttagtgcaaaatattttatgcacaaatgatactttcatgcttaaatgcctatgttgttcaaaaagcctgattctaagtgacccttagctctttcaaaaaaataaaaccaaaaccaatctgctttaaaaagattaagttctgttaccaatgaagatcaagggctatttcagttgcaagtgacagaaacttaattcaaactgtgttaagcaaaacaaacattggttacagagctaaaacgtccatggtttttgagaggatgaagttcttggttgacagggcaggacatgtcaaaactggagagaagcactctgggaaggtgtctgggaggtggggatgctatcagtcagtgggcaggaagaggagggtgtgcaggttcttgtgggaggaagactaggcaggcaaggcactatctggacagtgtgggaaaaggtgaaggggcagtctaggcagatgactggcaccggggagatttgcccaggtgtggtaaatggaagtcctgagagctgggtagggaataatcagaaaggaaggagtaggtgggtaggcagagcgagaggtgtcagtcagctgaaatcagggctccatttacaattagatctagatactcaaaacgtagcttcaaatatctgcttctttccatcaatcagcactacatcctcctccattgttagcttcatactcagacattaagtcaggatgagaagaaaggagagggaggagaatgagttggctgaataccatgaccagatgtttagaaaccaaatcataaaaatctttttaactggtgtctttgaatgtcttaagcttttcaagaaattcttataaccttcaatatctgtttgtgtcatcagtgtcagttcaaatcgattccactgacagcttgataaatgatttccaattttatctcagacaaatgcagtatggttcaatcaatggttttgcttatgtgagcactttaggattgtgtccgatccatttctacttaaaaatttagtttcagtgttgcttgactaattttcacaactctgtgctttgaatgtgtctgaatattgccccgaatccctccctataacaggcatgaagaaaatctgagatagaaataatacgtacttgattacttgatcctttatcacaggcaactaactactgtaaccagatgattccctgctgacactattgtgatacctgccaaagaaactgtctaatgtcacgttaacacattaaaaatgacaaccagccaagcctctaagccttctttcactcttggcatttgtagttgtttgcttatcggatggtgtcacgtttctatgagtcccagcgctggctcgcattatagtcaagtggaaccaagaaaatgctggcaagtctgtcatggaaagctaggcctataatgcacaggacaaccctctttaaccaaaaattatctggctctggatgtcaagagtgccaaggttgagcaaggttatgcctgttttagataatcataggaactctggctcttacctgtaagaaattgaaaggcatgatcaggttttaagcaaaaggaagaatcatccaagttacatttttaaacaggattgttctggatatgatgttgaccacagatggcagtggagcaagcaggaagcagagaggactgttagcagattattgcaataacagacaagagatgatagtgacttagaccagcaaggtggtttttgaggttcacaactttaaatttggttcttttatccctaccatagagatgaggaaacagaggctcagggaggaatataaccaggccacgtggctgattaaaccacggcattagtatgtgggcccagcagtctgatttcaaagccatggtctttccacagcattatgatgcccttcccccatcaccttcctctgtatctctttctcaaacaaaatgcaaaaccagtgacacaggaataaatcctagaaagagcaatcttcacaaggttcctttccaggcctaccattccaagtatctgagctaaaccgacttgagcccgggtcacctcagttacccaaatctgtctctttaaatttccccctaaggacaagattggtcccagaacccagagcagggatgagcctataggtggggggcctctgggtcctacagaggatggagaagagatatgagaggtgggaaaccagtccagcacattttctggatcagcggactgtgtaatgtgtgtttgttaatttgtgccccaaaccacagctgcccatggactcagcacagccattagtggatttctgacagtctatggcaggcagccctgtgttcttcacaattgtcacaatttagactttaaacaattcagagtggtctcttttcatgtataggaagctctctctgggcaaacggtgggtaaccagcacatcagacaacggcatcagattgcaaacttgtctccgtaaattgaagtaatcagaaacaaacagatacaaagttgttttataaaacctcttaaagtataatatacataaatataagtgcatatatcataaatgtatatattggtgaatttttataagctaaacactaagaacattatcagtaccctggggcccccaccatccccttccaatcactactcttccaagagtagctgccattcctgacttttaatactgtaaattagttttgccagtttttgaactttttctaagtggaatcaaatagaatgttcttgacttatttcctccaacatcacatttgtgagattcatctgtgttgttaagtttagaccatttatttttgctgttatataatatgacatatgaatacaaaacagttgatctgttctgcttggatgggcatgtggatagtttccagtttggagttattatgaatagtatgctgtgacaatttcagtgcatgccttttggtgaaaacatgcacaagttcctgttgagtatatacgtaggtgtggaattgcagggttgcaggggaacaaaagatgtcttgataggatgaaatataacatattctagctatagaggtaaaacaatgtgtatagatattacagggaaggtttggataggctcaagaatgaaagcaaaagtccagagcttaggaaaagactgtgaccgtcagcatgcaaagtagagtatagtctaagctaaggaaaatgatggtgtgtgtagatagttaggtaacttgcagaaaccaagtggcagcagtgctgggtagtaaagggctttcgttgaaagacctgagttcgaacttgctctcagtttgactgtgtaactgaggtgtgtcacttgacagctcaaagccttgactttcccttacagaaaattgttgagaagattaaattcattcattcaacaatgattgattgactacctacccatgtgctgaagactggagatccagcaggaaacaaaaaagtgtccttgtcctcattgattttactgggaaggaatacccatggtaaacaatggccatgtaatgacaattatgaaaattgcaatcacggaatctaaccagtccggggggtctgggaggagtgtctgaggcaagtagacatgagccaggccaagaattggggtgacaaatttcaggcagatgaaatagcatgagggaagtctatagagggaaggagcctggcatgtgtaaggaaaagagacagtgagtgtggctgacaggagtaagcagaggggagagtgaagaccagatgcagtggcaggccgggcttttaagtggttggcttaccttgattgctttttttttgttttgttgtgtttttttgagatggagtctcactctgttgcccaggctggaaagcagtggtgccatctcggctcactgcaacctctgcctcccaggttcaagcaattctcctgcctcagcctcccaagtaatttgggactacaggcatatgccaccatgctcgactaatttttgtatttttagtagagacggggtttcaccatgttggccaggctggtctgcctcagcctcaagtgatctatacccctcaggctcccaaaatgctgagattacaggtgtgagccaccgcacccagccccttgattgctttttaagccttttaaactgaaggcaaaaagaggactgggaaatagggtgggagtggtgacaaaatcaggaaagtgcaaaaatatatgctgatttgtaaatttacatttcagtattcatccagtcattcatttatatttatgcgatgagggactaccaagtgcatctgatcatgtctgaaattatttgggtgtcaataactactgaatgggatgaatgcataaacagtaacttacaaggtcaacacgctggcaaaagaaattctgtttaaaattatttaatttcatttgctctgatattaagttagttctttcagtagattttcattctaggaacagtcgctaatatttgttgaatgcttactatgcatcaacttctgttctaagtaatatggtaatatgtaacaggtatgttttctcattcactcctaaccacaacaacgcagacaggtaggattcattattatcccctgctttactgatggtgaagtagacatcgaaaggcacactgacccactggcctgagatcacctagttagtaagcagagagtcaagatttgcactcaggcagtctgattccagctcaaaagctcctaatggctacttctagcttccagaaagaagtcacagacaagcaacacaaatatctggttggtttaattgttgcatttctcattttaaattagtaaattggtattgtgcattacacattaagctcttgtgagctgattagtgtgacttgactctctagggttttgctcccttctagtgaactaataaggctgaatttccaaacctgcaatccagctgtggatcaatggttagaacacaggagagtgacagaaacaaagatggggaaagttgcagcggccacatcttgcaggttatatagaccatgcacacagtttgaactgtttcgtagtgtgtagggaaggagtatgattggttaggatgtgatcacaacagtttgggtgagagatgatggtgacttagatgactatgatggtagttaaaatggagatgaaataacagattctaagtaaaaggctgcacaaagtgcttggcatgtagtaggtgtgctattaaggggtagctattgttaacaaccatggcaaattcatttcaatccagcaggttacatttcatggattggaaatgactgcctgaagcatagcgttggaaagatattctgaccccccttcaggcccgcacagaaggagcactaggatagactggagatgtctgtcataagctctggataaacaggtggtagcacaaatgttgaggggtgctttataaggattttcaaatcaatagtttggatctgtgcccccacccaaacctcatgttgaattataatccctaatgttgcagtggggcctggtgggatatgaatgaatcatgggagtaggtttctcatgaatgatttaacactctccccttggtgctgttctcatgacagtgagtgagttcttgcaagatctggttgtttaaaaagtgtgtagcaccttcccctcactctatatatcttgttcctgctcctgccatgtaagacacctgctccttctttgccttctgcatgtttggaagcttcctaaggtcaccccaaaagcagaagctgctatgcttcctgtatagcctgcagaattgtgagccaattaagcctcttttctttataaattacccagtctcaggtatttctttatagtaatgtgagaacagactaatatacaagtaaagacaagattcttatacagacgattttgaatcgtttttctccataataatattcaaagataaagtgggcttaagctatagtaaaaacaatcctatttattagaaaaaagcaatacctaatggatgatgaaccacagaaacttacaaaattgaccttcggtttgaaagtactcatgggtaatgccctccctgcaaacaaaagattccacaggcaagttagtttgacttaggtcaaatgttttaggcctctcttagaggttcatgatgcatattagcatgctaaaagttcagaaagggaagcacactaaaagacacatttttaaggttgtttaaccagaagtttccaaattcattgaccatgggatattttttcactttatgcttaacatctcatagaaacataatgcctgcattaatattgcattatgataacaagacattgtgctacaaaattggtaatgtcatgtcatcttttttcttctggcttttgtacagctcaatcagtaggagcaaaggagaggaggagaaggaggctagtgcttttttttttttttttttttttgagctggaatgcagtggcacaatcttggctcactgcaacctctgcttcccagattcaggtgactctcctgccccagcctcttaagtagctgggactacagacacccaccacgacccccaactaattgtttttgtatttttagtagagacagggtttcaccatattggccaggctggtctcgaactcctgacttcaagtgatccgcccgcctcagcctcccaaagtgctgggcttacaggcatgagccactgtgcccagccgactagtgcatactatttgttcgtttctagtgaaagatgctcacttaatgataactggttgtatatagcagcaccttggctctgaatctgatcactgacgttgtggctaacaatatttaacctttggctgatgaagatcaagttgcagcctacacccacattttgaagttgcttaaatttggactactcaggagacacacagattctacagatgtgagccagtcacagaacactagggcttattcattttcaaagtttccaatttttagttcagtgcttcgtacataaaagaggctcacaaatggcttttgagtaatgaatgaatacacaaacgaatgaataattatggtaactatttttgctcatgagaaaaggtaattaattataagaagagtaagtattgtgccaaatctaggataaattttaaataacacaatagccttaaaattaaacaagagttctttttttgttctgtggagatttagcaagttagatctacttttgtctgaattatacatgctgaaaaaatggcatcttcagacacaaattggctaacgttattaagtaactttgtcctttaattaggcaagtcactgaatctctttgttttcttgtctcctgcgataggtgaactctaagttctaaagtgtccatgaatctattcacttataaatatgatgctttgtactttttttttcttgcaacaccgggaaagtgcataatgttcattctaaaacccagtctaagtccagaccgaaaaagcctcaggaaagcacagaattccaacatgttttgcaagaaaatcctcactcattaaaggtatgctcataagaggaaaacaagaactctattatattttcctacagaagaactgtatgaagtcctctccacagaatctcagcaagaacaacactctcttctgggacaatcttgatgaacatgggctaccttgggaactggtgacttgggcaggtcccctaataatctttaggtaccattataagccaacacttacatgtacttattaaatagcagccactgttctaaatgctctacttagacaaattcatttaatcctaaccatagccctaagaactgggtgggattattatcttcattttacagacgggcaagttaaggtatagcatgcttaattatctaactgttatggacctattaaatggtgaggaatcaagatagtatgggtccagaatctctgctggtaacccctctgctatactgccactcaggatatcatctagctattgacgaaggctgaaacaaactaagtcaactaacacttatcgggagtccaccatattaaatgctgtaaagaactaagggggaataaaatgatgagggcctcattactgcacttacccagctaacaaataagcaacatactctaggcagaatgaaatgaatattagaataaagattcttcggaaagaggaggtagaatttgatatagccttgaagaataggattttaatagatagagtggaaagacaacatttcagattcaagcaacagtgcgattttagggtgtgccaattaggcttgtctgcccagattgtaagacacacagtagggcagcggtccccaaactttctggcaccagggaccagtttccatgggagaaaatgtctccacggactggggttgtggagatgatggtttcaggatgaaactgttccacctcagatcacatcgggcattagattctcataaggagtatgcaacctagatcccttacatgtgcagttcataatagggttcacactgctatgataatctaatgctgctgctgatctgacaggaggtggagctcaggtggtaatgctcgcttgcctgcttctcacctcctgctgagcagcctcctgcttctcacctcctgctgagcagggttcctaacaggccacagtccagtgaaccctgcagtaggggatgacatctggctcttgaagagtctcaatgctgtgctgagtctaaatgtcattgtgtaggcaataaagactaatttgacttttactttggagtataactcgagatagaatggtgggctataatctgagcaagaagaatgagaaattaaatcaaggcagtttcagtaacaagtgtaaaaatgggtgatgtggtaccagggtgttgcgatatggtgcccagacctccccttcagtaataatgatcagattatccaagtcactgggaatgctgccaaaagagggccttcggccaaggtcatgacctcttcctgggatggtggcatcaatgactgatcatcactggggatataaaggcccctacctctcaccacagctcaggacagctctgaagggccatctcagcctcagaactcaccacattgtagttgaacttctttctctgcccagttgtgctttctttccttctctttgacaaactactgtctcaagagcactcccaataaacctctcccacactaatctctgtcctagagtctgtatcctgggacgctcaacctgcttctgatggctgtaaggtgcattataaaaacaaaacccccagttgggcatgtatgcacgaatgtagcaaatgaaggagaagaaaaagtcatagatgatgcccaaccagcatagctaggagggtggtcttagccagcatggtcactccctactcagcccctcagtgcagtgtctcttcttgacccctataatctactcctcacacatgtggcagagggattcatgctccaaatcttgccatcatgtgcagaagaaattcaagagtcctttatcctgcctacaacatcccacctaattggccccccagatacctctccaacctccccatgcttctggactccagccacactgacctccttgcagttctggaacatgccaaccatgtgcctgttggtcccccagaaactcccataggcccttgtctcatttcatttagccctctctgctcaaaaattccttctcaagaaggcctcctccaactactccatttagcatagaaacccctgtcattctctatccgtttaaacccacttaatttttttccaaagcacttatttcaagttgccattggtacattatttacctatgtgtttatgcatggtctctttctctctctagaatgagagctccatgaaggcaagaactttatcatcttcactgttatatccctggtcaggcacataatttgtacataagttaatgaaaatgagagtcataggagaagtgtgttttcagcagaaaatatcagttcaattttgaataggttgaatctgaacagcctttacaacaaagcagtcagatcagatgtttagaagacagttactcatagtacccagtctctgtgaggtgtagggagagaatgagctagaatggcagttcctaagttgctctgggggaatattaacctcatggcaggctctttgaaatacagaatggttgggccaggtggtggctcatgcctataatcccagcactttgggaggttgaggtgggcagatcacctgtggtcaggagttcgagaccagcctggccaacatggcaaaacctcggctctactaaaaatacaaaaattagctgggcatggtggcatgcccctgtagtcccagctatttgggaggctgaggtaggagaattgcttgaacccaagaggcggaggttccagtgagccagatcatgccactgcactccagcctgggcaacagagtgagactcagtcttcaaaataaataaataaataaataaataaataaataaataaataaataaataaatacagaatggtcatattccttcaatgaaataaaaaccaaacagctttaataaaagaaaaattaataaacaaataatggataagagggagatgaagagaaacagaatgagagacagagaaacgaaggggatttattggctcatgtaacagcaatgtccagaggttcaggctggacaagatccaaggactccaacagtgatcccagaatttggtctgtctccatctctcagctctgctagtcacttctctgagggtctgcattctcagccaggctctttccaaacagaccacatggaaagtagatcaccagaattggttccaattccttcctttcaacgaacgcagtgaaagatggtgcctcttccacaacagttctttaaaaaaatcaaaggaattggacctaaggagctggtctggcttgagtcctaggcccagagggataaatggtctgattcacttagactgggtcatctctgacactgtgcgctgcaggttcccaggagctgatgatgtgcctctcttcccaactccatgtttagtgatttcaccttggtagcttaaagttggccatggtaaaagtatttacaccatggaaaatgtcaaatgctacaaatcaaggattttcttctttttttttagaattggtttttaacacttaccaatgaatcacttgtcatatgaacatttctaaagccaggaatgggggacagattcaccagaactcagggactaagaatgaggaataggttccctaaaggacaatcaagatattgttaccaggaaaagggatgactgttgggaagcgtcctcccatatattatattattacattacattatgttataattgaggatccacaatgaactaagggttctaaaaaggcctgtgacttataaagctgtttaactcagtgttagccaaccttctgtgattagaaagtctcctttttcataaacttctgattaacttctcaatgcctttggaaaatagtgaacaagagtatagagatattaatacaaaagaagggaactaacaatttatatgtagatctattgctgtgttagtggctgggggaaaaaagattcttaatgttttcctctcccttgaatggcaaatagaaaatgcctaaaatgaagaaaatattgattttaaaccaactgatacgtctgcaaactttattttaactttgagccactaaaagggatttaaaatcaaaggaacaatatatttcctatatcttttaggctgaatattatatgttaattctaatatttttatgagctgtaattaaccttcggtcattgagaaatcaaatactcaggcttttaagcttatatctaaaacttcatctagtgctatgataggaagaaaaaatgaaagacagaaagcaataaaaattaattttaaaatagtttctttttttcttttcttttttggcaactcaggctaatcaaggacattctgaccatgttttgagagtcttaatacgtaagcttcatcagagtcttcataagacaaagggctttatctcactcactgttgtttccttagcatgcatatgtattaagtactcaataaatatttgttgaacactaagttttaaaaatcaacaatggggctgggagcagtggctcacgcctgtaatcccagcactttgggatgccgaggtgtgggggatcacctgaggtctggagttcgagaccagcctaacatggagaaaccctgtctctactaaaaatacaaaattagccaggcatggcagtgcatgcctgaagtcccagctacttgggaggctgaggcaggagaatcacttgaacccgggaggtgggggctgcagtgagccgagactgcgccattgtactccagcctgggcaacaagagcgaaactccgtctaaaaaaaaaaaaaaaaaaatcaacaatcatgacagaggtatattttatccacttgatgctttctcatacacatcatctcatttcatatgttttgtggacatatgaaggcactgtctgcccttcccaccttccttcatgtaggaatttaccttcccccaatagctatgtcaccatccgggactttatattcttttacgtggcctttctcccttccctttttgcctaaattagttaggcaatagctatgctgccatttgggacttaatattctttttcatgatatttcccccttccttgtttgcctaaattagtgagggctgtatttctaccacttgcaggaaaggaatcttcattgaacaattttcactgttatatctgttatactgaaaactatattaatggaatactgatatgctttgttcttcaactgaaaatttttattttctaaagataaagtattaaacatccaaggctcaatactgaatataagtctagtataatttcaacaaattccttactaaactgctgtgcaaaataaagatgaaagctcacacctgtaatcccagcactttgggaggccaaggtggatggattgcttgaggccaggagtttgagatcagttggccaatgtggcgaaaccctgtctctactaaaaatacaaaaaattagccaggcatggtggcaggcgcctgtaatcccagctactcggcaggctgaggcaggagaatcacttgaacctagaaggtgtaggttgcagtgagccgagattgcaccactgcactccagcctgggtgacaagtgagactctgactcaaaaaaaaaatatatgtgtgtgtgtgtgtgtgtgtgtgtgtgtgtgtgtgtgtgtgtagtgtgtgtgtatatatatattgtgtgtatatatatacatatgcatatgtataacactctctaaatccaatggagacaaaaataacactctctaaagccaatggaagtgtctagggatgctcccggctgttggtggttttgaatataacatcactttcaggttgaagaaaggagtaacccaccagagatgaatagcagtatgagaatccagtcatgggggactgggtgtggtggctcacacctgtaatcccaacactttgggaggctgagatgggaggatcctttgagcccaggagtttgagacaagcctggcaacataatgagaccctgtctctacaaaaaataaaattagccaggcatggtggtgtgtctgtagtcccagctacttgggaggctgaggtgggaggatcacctgaacccaggaggtcaaggctgcagtgagctgtgatggtgccactgcactctagcctgggcagtagtctaaaaaaaaaaaaatccaatcatggggtctcaaagcagaagagtagtgtggggaagggggatgggctgatcctacagagacacaattctgcactcaaacaacacccgaaggaaagagcaagtctctatctcaactagcaatacaatctgaaacaggaatgcaggagagaaagagttagattcaaccctacagagacaaaggacaggagccatttggactaaagagagacagaattcagagcatgtcctttgggttgagaagagcctttgacagcactcagtcaaaacccaactttgtcaaagcctcactcacagcggcactacggtgtaggtgagatcctagtgaagctcctgaaactagaagtggcaggagaaggttcagtggccagcactgaagtggaacatagcgttcaggaatgaggagtgtgggctttggagccagactgccatggtttgaatcacactgttgtcagtaaccgtgtggcctttggcaagttagtgaacctctttgcctgatttgtaaatggagatgacagccctccctgtaacttgcaggattgtagggaggatgggctgagttggtacacagtacctggcatgccgtaagtgcttaataaatgttcaatgttttctagtgattatgaattctgagccccacttttagccaacatcttctaaatcattataaattatgatgactttggaattaaacagactggtgcattcatatctttgttattttactcctttgagctttggtctcttcacctgtaaagtgagactaatatctacatatataaaacacagagaaagtgcctagcatggggactctttatgttaataaccaattaatattaatctcccaacctgagagtcacctgcacagctatgtttctcttttctagagttaagaaaaaacccagtaaggttagactaattggtatagtccaggtcaagactacttgggtaggtagaatggaattctatgtgaactcacatttgagtgggatactacattgattagggtagtggaaaggtttctgtcagcccttcaagtccaagaccctgggaacaaaatagcctgaaacacaagatttcttgggcgtgtcacagaaaaaaaattccaagctgcagactttccctttgagagtggcgtcctcagttaccttaaattccagtagaaacaccatccacagaaatgtccctgtttgccagagctgccatagtgatggccacttttgttttcccaatatgagacccaggcagtgttccagattaggtacccgaagaaaaccctggggatattactgttatttaaattaattatttaactgactagttatttttcagctacccagtgtttcagagaccttgaattatgcctattggcaaatgtgtaaccactgaaaattcttcacagtcagaaactggaaagaaaaattcacccctgtagttttaggttttttggttttgtacataatattgaaggtggtggattaagtgcaatatttagaataatatattcaaggatttaaggaatttgagttcaattttgaaccactcgaccacccctggctggacctcagctcaatcccttaatcttttggcttctttctccatctgcacaagatgcctctggcaacgcactgagtgcagtagcataggaatacattcaataatgggcttaatatcaccactcaaaagggagtaaattgcttttttgtgggatccattagcttaattgagaatattagctcagtattctggatgtacgatgggctataagaaagaaggtagcatcaatttaaatgttttgctttgcctccctaaatgactctggtcaacagctaagaataagaatataagaataaggggacagaaagaaaagcagggacagaggagaatgctcaggaagtcaaaaggaagaggtaaagggatggaggctcaatggctaagaagtgaggtatacgtgaagacggaggcggaaaagaagatgggagaggcaagaagggaaacaataagattccttaaggagaggaagagtaagaatgtgaaacgaagattccaatcagatggaagttaattgggaccaaccatatggagaggggcagagcagaggggatggacagagttcactcgggaaagagagggtttggtagggctgtctccctccctcctgtcactggctgtcttcacatttgcggtgctcccacgatccccaacactaggcttttggctcagggagttggctttaacagctgtgccatttagcctcccaagagtataagaggtctccaagacccagggagttaagcaaatgttagtgtatcgggggaaagtgttcttacttcatgttcttcaaattaaacaatgaagtgaagtcatagaggacaggaggtgatggtaaacaatacaatggaaccaaagggaaaatgactgctttatgggtatctcagtgataccaatttactcctcataattctctaagctttactttgcaaggacaattggaggctagaactgcctcaccatcactcctactcccaaagctttgatagacttaggagtggtagtagaaattataataacgataacattcacagcaaatatttattgcttactttgtgtcaggcacatacacatgcatccttccaaaagggatttcagatggtctacaataagacaacttctaagaggggaggaaaaaatagatatatataccttggctgaggaaagctacagtaaatttgatatagcaataagtggtttgataggaattaactcattttgtcatctctacaaccctacgaggtaggtacttttaataagccctttttatagagaaggaaactaggaaaaccaagacttgattttacatcattggcttcacttcaaaggctagggaaaacaaaaacaaaaacgaaacaaccacagtaagagtctcactacttactttcaacaatagcaatgttcaagttaatcaccagaaaaaaaattagctctgtatgccaccaaaagatagccaaaattgttgtgtagtgtccctcttaacttagatatgtgagtatcgctcaggtaagtacccttaagacaaattcttcccagagactgggtcaggaaaggctttctcctgatgaaactgtaggactccttccacttgacaatgagagctatgcaaaccttcatttcccctatttcactgctatgaggaagcttgggctcagttttatgctcaaatactattgtttgtctcagccagaatttcaacttttcttttttaaaaaatatttgtctttcattgtaaataaaccaccttaagtcccttttggaagaaggcacggtataaataaacaaaagacaggctgggcgtggtggctcatgcatgtaatcccaacactttgggaggccgaggtgggtggattatgaggtcaggagttcaagaccagcctggccaagatggtgaaaccctgtctctactaaaaatacaaaaaaattagccagacgtggtggcggacacctgtaatcccagctactcaggaggctgaggcagataattgcttgcacctgggaggcggaggttgcagtgagccgagattgcaccactgcactccagcctggacgacagagcaagactctgcctaaaaaaaaaaaaacaaaaaacaaaacaaaacaaaacaaaacaaaatgcaatcctgttggggccaagctagagatataatttatcaaattacttgacatagcaccctgaaatcattgcatctaaaagagaatatcctaaacagaattttgagcagatactatttttgatggtctttgtcatatttttcatgtctctcaaatagcattccaaaccactttgggtaaagaacataaaatctagagaaaattatctgattactctcaaatgtcttcatgttacagggatataattaaagttttgaatcttgtccaacactgtgctcaaaaataaaccaatttaagtctacatttatcagtcaggcttaaaatgaaaaaaagtttcactcatttcaattattcaccggttaataaactatgcttaatttgtagaatgtttttttttttgcttccaaaatttattccaggaacacagccatatcttctcctgctgactgataaacactatatatattagatcacacatagagaagcctgtttaagggtcaagatgtaggtgatttaatgaaaaaaccaccatcaactcaaggttgctgtttctgtgagtaattgatctgttcaaaaaacaaagcgtttcatttccagaactttcattacaggtgtgactatgatttttgtttcatttaaacattattatataatgatgcatttcaaatgcaatagcatttacaaaaaagaaaataaattatcaaaacaaaaacagaaagaagagccagtagctgggaagaagatcacagacgtttagcacaaaataattaactaagaagtcaattctgcttatccagcaagtacttacagctcaacattttgctacttcagtcccattcaattttagcttgtgacaaaacctacacttttacttcagttttgtgacttactctgtttcattattttatttattcaacaaacacttatggagataaggctcgttgtattatgcaatataagcatcaaacaaagtacgttcttgttctgatacttattttgcaacacttcatgaaattgcaaaaagtaaatattatataaattagaatttacaacacagactggtctatgacaaagtaagtaaaaatagtctcaatccatgagacttgaaattgagctgaaattccttcaggagtccatatggattaattcagatttttatacaacagataagaaaaatttattcttgacagcacagacagcagtcaggtgccccaagctgggttatggcctggtcaaatattgctaacatatttttaaagctcttgctttgttacagaaactccgtttttcctcacgaaacagtgcgtataccgcaactcttcaaattgtacctcagtatggtgtaaggaatgtggtgttccttagaagctgtggcaaatccctaaatttcttacctgtaaaatgggtatacatggaaggcaggtcttctgtgaagctcacacagcataaactttcgggcatcttctctaggcctccatcccaggccttggcaggagccttggcgatacattcacctggtcatatgtttatgtacaatttgcaaaagcaatatattgtcaccacaattagctgagactgaggtctctttccactaggactttccctctgccattttcccttctattgggtggtgctagggcagcctggacatgctgtgggatagggtcaggctttgtgttcctacccaaacctcatcttgaattgtaatcctcacttgttagggagagaaatgacttgattatggggacagttttcccgtgttgttctcgtgatagtaactgaattctcacgcgatctgacggttttgtgtttggcaagttcctccgctcacaattctttccgcttccttgtgaagaaggtacttgcttctccttccaccacgattgttaagtttcctgaggtctccccagccatgtggaactgtgagtcaattaaacctctttcctttataaattacccagtctcgcgcagttctttatagcagtgtgagaacggactaatacacagtatttgctttttctttaagaggaccacccaaattgcataaattgcaggccccacaaaacctgcattaccccctaagtgtgagaatagtacctatttcacaggtgtgctgtgaggattaagaggtaatggacacatggtgtgtatcaggtggatgttagccattatcactactctgaatctccatctttctattatagcaaggccacagaaatgagcattttatgtaatattcttaaaactaaattcttctcatggaatgggatttttcaaccccaggcaacagggccacatcatgtttttcttgggctctaggcctttttgccttcgttgagccccttactccattaaaatatatatacatatacacacacacatatatacatacattttaagattgtattagcacaaaaacaaatatattaatatatattaaaatactttcttaaacctaaattttttttccttctgatttgaaaagaaattaaaatattttttgtgggcctctaaaaatattgtggaccttaggcactgtgcctaatggaaaagacagtgacaggattgtgcaatatgaataatgataaatttcccaaaccatcaaggactcaagaataagggtaaacatcttaaatggggttggtttcgagtacttataatagaaaaatgttatccaaacaaggtcttaggggtaacaggaggcgtttttagtgttcaaaatacgcacatggatggagttggccattaggacgctaatagcgaccgtatctagctgtgaaatacatatttttgttttgggagtctacttttcagtaaatgtcctttcaggtgttttgttgcccatttaattacatgatcaacaaggaagagttattttacaaaacaagcttcattttgccaatttataaattgctttggagtttcatcgaaaggtctttaaaaaacacgttggccttggtgctggtgcatcacataaatcacagatgaaacaaacaagcctgtttcctactcaaggtgtgtctgtagagtcctgactgcgtgccaggggctctgtctggcacatttctgaactttgcaaaattaattgtgccgaagagaacaccatcaaacgcgtccggcatacagcgtaaacatcttcagaccgtgattctgcgccatcaaacgctctccagctaatttcatttggtgattactctgctagaaaaccgaggccaagtgaaactgcggaaatgggaacaatgtacggaggaaaaatctcaccccattaagagatccgtttcttctccgcacaaataagcccaccccgcctccgaggcaagactagatggctccaggatactctcggcgcgcccgctggccatctcgggcaggggagccccacacccggcaggaggaccaggacgcgagcggcggcgcctcggccctgggctgtttaggtaattcgcaaagtcccaacaatcatccccctctcccagaagctggttttcttgtgtgcagtggttacagaggcggcgaaaacacggttccccgctttcctctcctcaaggcactgtttgcagcggcagcagcggccgcattcggggaggcgcggtcctccccgcagagccgtcgcgcactcggcctttctcgaggatttgcctgggctcggccgcctcgctctcccctgcgcttccatgaccttctgagagcggcctcaccaccggaggctcggaggaagcaccaccctcggcgtccggggcccgtcgcgcggccgcgttcctccgactccttggagcacccgcgcgcgcgggcgcgcggccggggatcggcgggggcgcgcgggttggggcggggccggggccgggggcaggggcgggtcaggggcggggccgggcccgctgcgcccccagccgagcggcgtgcaggcgccgcccccgcgcgccgcagtcccggctggagcgactcggccgtggcggtggccgttaccgttgcctctgggaggctctggcggcggcggcggcccgcggggttcgcggagcgcagcgggccgcccttcgcccgtggccgcctcaagcagcctcgcgccgacacaggggaggcgagacggcggctgcggaggcggcggcgcattgtgcccggccccctccttggcggctcctgcccccgggcggctgtgggatctgggcagccccggggcggcggccgaggctacagagccggcggcaggggatggcaagatagcggcgcgggagcgtaccgtgagtcctgggggcgggtgggcgcggcgcggagcaggggagccgcggagccccgagcggggtccccaggggcggcccgggcggggtggggcagcgctcccagctctgcggagcgtcctaggggagtgaccccggagagcgccgctccgggtcccgccgctctccgcgcgcccttgggtcaccctcgtgtcctgggggacgcggactccagcgcccagaacttctgccccacgcagggcagtgagttctgaggccagaggttacctgggggatgggagggagcttgaaatgtttttccttcggagaggtgacctgccaggtgatttcgtgcccctctgcttcaactcccctttaaacctgttcctcgtcctttctgtatccgtagtgcatttgacttacctgtatttttatgtgctaacttccgaaggtggtgtactggttaaacccaaagttaaagtgttggaggtcaaagttaggctttgtgaaagatgccatttctgttatgttgtgtaaaagcacaaagctggattcaggagttctgagcgacacaaaactgcacatcacgtgttctgaatttacatgattaatctgaattaatgtgatttttgccccccaccccccacattccgctaccaaaaatatatgaggtcttttatttgcagttgggtatctttgtgttcctttttgaatgtttaatgcagtcaaatattgttataacctgtattgttattgagtggcatttatatggaaatcggttctttgcatttctttttatgtgtctttaaaagatacattctttcaacagaaaagtttcagtttaaagtttgtcttccgattcctgttcagtttcagattagtttttaattttaaaaagtatttgcttgaagtaagattaatgtgatatagtagtatcgtttaggcaggggtccagaaatggtacagaaattaaatttaaggcaaacctttccttttcacaagtggaaaaaccaaggagttttttcagcgcgaatgctacttgcccttccccttacatgattattttgtcacagatctgaaattacatttcactgttaccagagagtttcttgtctaagcctggcagagaaaaggaagcctaagtataatgtgttttttaaaaacacgagaccattcttttagttgtcttctacgttgactttatgctttatagtcgggggcaactgttcatttggaaacttcattagggagttagttgcaagctcaatttaaatatatgatgtgttcccaaggtgatcggagcagctatttcctcttcaagaattgaattgagacttctttgctttgtaataggtgagtgagatcactagcaagcctcttgattagtggagacttgtattctcttctggggaatgagaatcagggactctgctgttgaaggagcaaaacttttgtgatttttgaaaaatttgcttctgaatggtcatccttgacaaatatgttggtaatagtgtgcatttttcttacattaattgtgcagcaggtaatctattcacactggagaagattcaatagatataaaagatacggagtatacctctctcccatcatgttccacagctactggctccttgtgtatgtctttccagacatagcctatgctcatgtaaacattctgtacgtgttctttttgtttgtattcctaaagatgaggacccattgtatactctgcaccagctccccctgccccgcttccctccccagagtactaaatcatggcagtctccattggtatctaagagaatctgcctcattctctaacagctgctgagtactccattagggatggaccataatttatttaatctcttcattgtgatatatgtaggttgtttctaataatttgctatgaaattgtaaagcattagtttttgaggtttttaagtggatttggttattcccaaaggcctaaaggcagtagtcatttgtttctttatatcaccttccaggaaataagtgtgccttctccccagcatacactgtttgcttctatataacttcacagtaatccataagagtctttggcatctttgctgtgaagtgggagccatgatggtcagtaactaaagtcattattccttgggtaacaacttggctctttgttttaacaaaagaaaagaaggaacagatacacattttaaagaataatctgaggaaaaattcttaagtgtttaaatatttttgaacgtagagaggcagcttgtacctttgattaaattgaagatgagggtagtttatgtttcataaaattcggttgccattaggcactcaaatccctgccttctgtagattatcaccagtatcttatattttaatgttagtataatatggttacagattttacagtttatgatggggttaataacttttaaggggatggatgcttttaaaacatacttagctcttgcttttctttaaaacaaaaaaattggggtctcgtcagcatgctcttgaaaaagaataaattgtaaaagtaatgctaatgctagaaattgagcctaatacattataaagcttgaacattagccaatgttgagcttcagtattttcattatgcttatttttgagggcttttaggactagtgtaagctatcataatcttttaaaatatatacatacatataatatatatatatatatatatatatatatatatatatagtttaaatggtccaaactcctcttagaatttaaggcattctcttgccttttatttggtactgttgtgatacaaaactgctaacgttgtctgtattttttctgaaataggtgtttattgggcatctgttaatattccagacaactttctagggactaaattatggcactgcacaggacagacagaccctgctataatctcagcgaaggagatggataagaagcaaagatacaataagtgatggtgactagatagtgctaagtgctgtgaaagaaagcaatcagggttgcatggcagaatgggacaggatgtgggctgctgttttacatcaagtggcctgagaagcctctctggggtggaggggtctgagctgagagttgaatgagggggaagaagcctatgattttggagatctgaaagaagagtggcttaggcagagggaagggcaagtgcaaaggccctggagcaggactgagccttgcatacctgagggacagaggaccacctctgtggctggagttggtgaaaggaaaggagagagctgcaggcagaagaagagtgggctggggttggtgcccatatgtgttgcatgtcaagaaatgtttacagacgtgggaaagatgtgagtggtggagttcctctataggctggaagctccagggggctagcaacacatctgcttgttacccattgcatttgcagcaccaggaaccaccttcatcacatagtgggctatgaatagttattgagtaaatgaataattagagaatttacgaaataatcttacctgcttttggtcaaaatacttagattcgggagtcttttagttttccagcttggctctggcctttgacatcagccaatcggttatactgttatcacttttctttcaaattatcacttttgtcaaactgttgctttaagtcaattacacttgactgctcttccatgaaattcaagtgtaaaaccttaaaaacaaaccttttcagtaaattatagtgatttatgagagattttcagaaaggtgagcatttttatcttttatttccgtggaatagccatttgtataagtgtaagagttcaaagatgccttttgtgtgtgggtgtgtgtattgaatgttttaattctttgggccagatgacagactaatgagtagataaaatatatgtaggtacttttattctcacaggaggaatgtgtgcctgccctatagggaatatcaataatttgtggcatttccttttcccaacttctaatctgtcattctaaatattaattgaaaacttgggaaatgagttttatgccaagcaattgttatagatgtctaataagaatctacatctttctcctgtgacttttggactcctgttccatattagaagtgttgtgatcttccagaatgatggtttttaacttttttatttcctatcttaatcaattaataacttagcataataagcagtttctacttaagacaattttatttccaactgtttctcttaagttctgtgcaaattatatgtaaaggagggttctttaggtcctcagtcttcagtaaagaagcctgtgtccttttgtcctgatatagtaaaagctcttcagtaaaagagtagaaacacctaccagttggggtaaatttagaggcttagatgcccgagttaaagtacttttaccaattcctttacctttccttttgtgaaatatgggaattgcaaatttgtcttacgttgtctaaaatgacaacacatgcattcttataggatgttgctgctggtactgctcaggtgagcaaagatatgtgtttgggagatactattctatgctttcatgttggaagttgaggaaaaacttctggtaggtggattttttctatacttttgcacagaggtgaaaatcttggcttccaatcattcttctggtttgtaaggcagatacagagaaagaattggaatcattgtttatatgctatattactaagcggcagtatccttagaggccacaaggcggtgatatcactacctaaagtgtatgtgtggtgctcttccagagaatgccttggaatactgaggcctcttgcaataccttcttttaacttctccccaaagtgggcttctccaaagacaccttgaatccgaggactgttgaattgtggaacatctggtggaaaatagcaagaggtgacagaaatgctaatggggcagtgagatgtagacttcaggcagaattgttgtacctgtcgagttggaggtaaggtgagtgggagagagatgagaatcgccaccaggactttaggctgcagcccctgaggacacccgagtgccacagtaagcactaaggcgcctgctgcatggggacaggatgccaactgtttccatgcaacgggcctggagacccatagccctgccatgcttcatgccttagtgtttataatgcagtacaaaggtgaaggaggcaagaccattgcaaaaacatctccatagaaacagttaaagttaggagcatacattttcttcttgctggaacttcatcatgactacatttattccttgaagttgcctggatcaccacaattttactgtaaatgtaaaattgttcttttgggagagtctgattttgtggaaaaactatttagagcttaaaatgcatagctcttatgaataatagaaaattaagcacttaaacaaaaatcaagtaaagtagataacttgattgaaagctggaaggcccttcagatccatctggtcagcttcttaagataaagaaacttagacccagaggtggtgttataatttgccgaagaatccaggagtcctgattggcagtgtaaccatgatcttcggactctttaagtgcagggttctcaactcctctctagaaccaacagctcctcaagggcaggaacttttgcgagatttaccaccgtgtccctagcattagaacagtgcctagtctatagtagacgttcacatatttgttgaataagtgattatctaaaggaattttaagaacttcagattgccatgttagctataagacagtacttatacaatctgaaagaatatacagttttatgagtttcttgttagaaaaatagagcatgttgctattaaaacccaaactcttaagccagacaggcaaacgaaggtgcagtgttttacatcttagcttggtacctttcaaagtctgttatcactggattttctaaagccattctgttaagttcagcctactggtatctggtatcattaagttttatattttgtatttgaaaacagatgctttaaaatctagcatttattgtttgaatttttccctgtttttttttcagttgtgctttatcaatagctcagctattttaaaaatttatggccatatggggatatgattgtttaaaaccaaatctaatcaactggaggattttggaaattgtcactttcaaatgctgttggtgggtgtttcaattgttataactttacaggagggcaattttgtattactcatcagaagcctcaaaaatgtgccccgtcccttagtcaggcatgttcaccgctagcaatgtaaacaaaggagaaacgataaagtatgtgtacagtgaccagtctttagcagtggttatagtgcatttgtgcaccatactcctgtcgatacctttctcctcgcagtgattcttaagaagcctacttactgggatgtaccaaaatctggagggaggtcctctgaaatttggaaaaaactcacttccagattctagtgaccaccacaaaaaaaatacatttaaaaaaaccctcctctaatttgcaaaaataatttttgtaagtttttttttgtgtgtggaaacggagtctcgctgtgttgccctggctggcgtgcagtggcgcagtctcagctcactgcaagctccgcctcctgggttcacaccattctcctgcctcagcctcccaagtagctgggattatgggcacccgctaccacgcccggctaattttttgtatttttagtagagatgcgtttcaccgtgttagccaggatggtctcgatctcctgacctcgtgatccgcctgcctcggcctcccaaagtgctgggattacaggcgttagccactgtaaccagcctgtaagtttgtttataatagttataaactagaaacaccttaaatgctcaataatagggggactcattaaatgaattgtggtgcatacatgtgatagaataccctttctttaacagtgatgtaggggaatatttatagatgtggaaagatactcaatatttgtaaactgaaaaagcagattgtaaaacatatgggtacgttgatccttgtttttgcttatggagtgtgtgtgtgtgtgtgtgtgtgtgtgtgtgtgtgtgtgtacaattttctacatattatgtagtaaaatgccaggaagactataggccgaatgttaggtgatactgtctttcatgtgtggaaattacaattgactgttattctttttactttcctggatttcccacacataaagcatgccgtgtggtgaagagtcttggatcagatcccatttcccatttgctactactggttgtgtgaacttgggcaagttttgtatttccttatctgtgaaatggggataataatatccagctcacggtgcccacatgtagtatttaataaacgttaccttgatctcactgatctgatatggtgattaaagccagtattctattcttaatacagaatttccaagcagaataattgtgttatgtaagttttatcaaactgttacggaaagcatttcagggcattctgacaaactattttgttgcttctggtcactgggaaatactttgtcgagttttatttactttaaaactgaaatgccttccattgccaatacattttattttgaattgaaggcatttttcttctttttctgttgttgtcttgaatagtcctgtataaatttttgaaggtcagggtctgatctttctttccttttatagaggtgttagagtgggatgtgagtcattcaagtcactgttgagtgccttttctttaacaggcactaggtaggcatcagatttgcagcagtgtcctggacccacatgtctctgccctgtgaatgacatatggaagtgaccaatgtggttcaaagccaggaggcccactcaataaatagatagttactgcagttaagtatcaagtagttctcattttctctcctctgattttaaaaggaattttgttgtgatgttacatcttactgaacacaaacattgcctcctgcttattcaacaaactactgtatatgaggaacatactaggttatttcacttcgttgacattcatgaatgatttagtgatgacttacattacacaagtgtgagaatatcctaggttaataggcttaaaattgctactatatatcttctgtgaaggataatctttcattatcttaagtatgacctcatgcctttttgagattatcttttgtaaaattattgaaaatgagctcctcctagcaaatctaggatgcatggaatttatggctatcccacttgagaaattctagcacatgatcttactgagagagagtggcaataaagcatttatagtcgtgtaccatagaaagatgtttaggtcagtaacagaccatatatatgatggtggtctcattagattatgatactatatttttactgtaccttttttatgtttagatacccaaatacttccgttctgttacagttgccttcagtattcagtacagtaacggtgcacagatttatagccttaggagcaataggctattataccatatagcctaggtgtctagtagactataccatgtaggtttgtgtaagtacactctatgatgttcacacaacaacaaaattgcctagcacgtctctcagaactgtatccttgtcattaagcacacgtgactatatttaaaaataatgtttccatttgacagtgtgtaaaactacattagttttgtaattagttttatgtagggactttttttttaaagttggcaactgttctaaatattttgataacatgtagaccctcagtagtcgtgaaagatacgtcttggaatctatgacaaatactgagcttgcattttattttcctcatacggccaaataaaaaaaagaaaatttcttgagtcatgttttcatgttcctgtgtagaattcatggtaggataagttacatcacaggttgtgtaaccaacagcaaagtcaccattttacttctttttttgctttaataaattagccatattttgagagggtgtaagttaggggaagaacaaatttaggagagttatgaatcaagaatcatttttggacacagtttaagatacgtgtgagacttgcaggtgacaagttgtgcatatagatatgtattctatctatctcgtcacactggaggtgacaagacttgcaggtgacaaattgtacatatagatacatattacttctatctcacattgttctaccccataccattgccttacatggactttactccccttgcccccactggaactggcagttagctttcttttgggggtgttggggatttacttttcacaaagaaacactgtatgagctgcactgagtatgtaatggtgactggagagcaaccaagctgtgttgacatgtagacattgggtcgctggctagacttaggactttgccaactcaccctttcctgaaggccagcttcaataaaattacagatgactgttttgaaactttttcagctcacaaatagtcaaagctgtgagtgctgaactcagtacattccacaggctgcattgctgggatcaaaaactcaaatgcttacagggacagtggacgttacataaatggcagaagtgggcctgtcctgccttttgtctttatgcttttgatatagagacaatcagaaatatatcactttctctttaactctactgcaagatagacaacattgacaatctagatggtaaatggcaactggaacttgtctcagttttgaagaccagtaaggaaaggtgagaactatgaaaaactccagaacacatgttcttaggaaggagtaactgctcttacctggagttgattgttatcctgtgagatgtggaatgagtatttccagagcttcttaattttgatttttaaacactccattttgcaatattgacaaataattcaagggtttttaaattttgttttttttatgtatatggttcaaacaaaacacatctaaaggcaaagcctgccagttttaaactatggtaggtaacatttctttgcccatcttttccttcacttttttcatatagttcaggtcatactggatattcagttttgttccttatcttttcatgtaatggcgtatatatgtttcttcatgttgctaaaaattctttagtatgtattgatgactgtgtaacattttattctctggatgaaccataacttgagcatttacattgttttaaatttttccagttcgtaattaaagttacagtaaatatatttaagcataaagctggatttttccccttctccaataaatttcacattcttcccttaaaattggtttattgagtcaaaacaactaaatatctttaagacttttgatacagttgaattttctccacatttatttgaatactaggaaataaaatatttgttcattttattagctggttttattttgtgatttatccattatttgattttacattggattttttcttttttttttttttttctttttttttgagatggagtctcgctctgtcacccaggctagagtgcagtggcgtgatctcggctcactgcaaggtccacctcccgggttcacgccattctcctgcctcagcctcccacatagctgggactacaggcgcccgccaccatgccccgcgaattttttgaatttttagtagacacagggtttcactgtgttagccaggatggtcttgatttcctgacctcgtgatccgcccacctcggcctcccaaagtgctgggattacaggcgtgagccaccgtgccctgccctggattgttatttttttaaacataagtagctttttaaaaattataaaagtaaaaatgctcattttataaaaattaaggaagctcagggaatataagtaaaaatacaaaaaaaaattttagtttcaccattcagagataaccccaggcaacattgttacatatccttctagattaatttctgtgcatatatatatgtgtatacacacacacacatacacacacacacacatatatttatgtctacatctccaaatatgttaaaccgtatgtacattctgtcttgtaacatgatttaattttttttttttttgagacggagtcttggtctgtcacccaggctggagtgcaatggcgtgatcttggctcactgcaagctccgcctcccgggttcaagtgagtctcctgtctcagcctcctgagtagctgagactacaggcgtccgccaccacgcccggctaatttgtgtgtttttagtagagatgggatttcaccatattggccaggctggccttgaactcctgacctcaggtgatccacaggcttcagcctcccaaagtgctgggattataggcatgagccactgtgcctggccatgatttaagttttttaacttatattaataatcttccatggtgcataactgcacactagattcagtttattcatccattattcagtttacttaacaaatatttactgcacactttttgtgtgccaggcagtttttctagctcttgggggctatagcgctgaagaggagtgctgaacaggagcctgctctctgtctcttcctccccacctatgctgaactctcaggtcatgctggatattcagtactggatactcatagagctcagcatctaggtggggagggagggacaataagtcaggaattatgtatgcatagatacctctaggtattgatgtgtacgctgaaggatataaaataggataccacaaggaagagtgagcagtgtgtggttgtggtgcgggatttgggggagggaggcaagcagggaattgtccccctttctaggtgatgagtagaggccttcctgaggaagtgagtgttaatttgaatgatgagaagagtcaggggaaggtgattccccatgataggaatgacaagtgccagggcccttggtggatcaagcttggtgcatgtgaggaatggaagaaggccctggaggagactggaagccggtgaccaaaggagagacgtgtatgtgaagagtgtggaaggggatgcaggacagagagtggggtgtgcttataaggagaatccactagacggttttaaactggggagtgacatgatctgatggctgtttttgaaaggttctgctttgtgcggagtggattggtggggagcaagactggaaacaagaggaccacttcagaggctcttatagcagttcaggcaaaagaggttggtgcgcttaatttgggggtggcaatgaggatgatgggtgttttttcccttcggcatgcatttgaaggtgtagcagctggtagtacatggggagtgggtagaggccgatagggaaggaaaggaatgactcaagggtgactgctaggtttttttgcttgaataaattagctatattttgagagggtgtaggttaggggaagaacaaatttaggagggttatgaatcaatcagttttggacatagttcaagacacctatgagacttccaggtgacaagttgtacgtatatctggagaaaagtcaggtagaaagtggcatataaatctgggaggaaggaagggtaagataaatttttaaattaccacatatagattttaattaacatgattgagaaattattaagagtacagaaagagagaagtgggctggaatgcatgcagagatgtcatcttctttactcaatcccaaattgatgaacattcaggttatttcatttaaattataagtgcatttagtgaacacacctttgaaatcttgtctgatatctcctgaggagaatttcctagaagtagatcataagttgcatgtgaagtgcttgaatggagcctaccacatagtgagctcttgataaatatttgtagccttggtttatcttcatcattcttactgttattgagtgaaaggctttcaattggaaagacaacataatggctcacaattcagactctagagtcataattgcaagtctaggttcaaattctggctttgctccttacgagccacaatactttggataagtcacttaatctatttcctcatgcatgccatgtgaaaaataccaaacctctttggagggttgagagagtacaggttaagtgcttgggcctccctggagcatgtggcctgtggctttacacaactacaggttgggttccaatttctccacattgtccagggtagtatctagtatcattcttattaaccttttccaatcagtagaaatatggtttcacgtcattttcatgtttattgcctatttatatttcttagtatgtgagttgcatatttttatttctattgaaggtattcatcttgctttagcatcttttttagccatttgtatatcctaagtatagtgacacttgtcatatttgttgcacatattttttcccagggaaaaaatcttcattgtgctcagtttggtgagaaagatggttttataaatcattgctatataatattatatgtagtaatgtaagcatatgcattacgacctgagaacactggggaaggttggatttggaacagtgtgcactgaaatttgaaggacgagttgatatttgttaaagggacaaggaagagtggagtgggaaggacattccaggtagatgatctgtctgtgcgggaacactgaggcaccacagagcctgacatgtttacacatttggtggaacttaagcacggggccactgtgaggaggtgcacagagatggcactggggacttaggctggcatgaaaaagctagagcctcatgccctgttcaacttgggacctttccctgtaggccagggagagccatggaggattctaggcatacaaaactgaatttgtgctatgggaggatcagaagtcctgagaccggttagaagcattgcatttgtgcaggctgagggaaagaggccccaactaggcccgactctggaggtttgtccttatttacctggtaaagttgagggagtggcacaagtggtagtcataactagaggcatcatgctgcctctaccgtcttctatcatgtcctttttataaagcttctgattaaacttacataataaaaaaggatgtgttatttaaagctctcaaacacagatttattgatgccttaccctcaagttgctaaacgttcaagtgtccccacatgtgggtacttcttctatgaaataggtagtagctggcacttacggtgagatgggatttactagagtaagatttacattgagcaagaatttatgatgacttgggcagtaataaaaccaacaatcataatttatgtttcatgttaatactttgatattagattatctacttatttttcaaactaaaatgaatcctccaattttaataccactggaggacacgattttagacattatgtgtctgataaagtgagaagacaaaaaagtagtccttcttaatatttttatggccatcttacaatattggcccagcttattaacctttttttgtggttttcccgtgtgttgctgctaaatcatatctcctcccatctgtatttgttcattttctgtgtgttattgttatcaacattatcatttcattttggaccctgacatccatgctgaatttattttattggatttatttattagaatcctattattacaccctgtatatttgctattttgcccatttttttccatccacagataagttggatatgattcctatatcttcatgcaactcattaatgaagataccaagaaaaacagaagtttttgatatctgtctatatcacttttgtccaggttgacatcatcctatgaattagcactctgagtaaggttgatcatgtgataaaagcagcctcttcactctgtttacacagcttgaatttctttaccttgctaatactcatctttcatgtattagaaaagattttgttcaaacagagatacattttgttgtttctgatccttgcttttcccagtacaacagcttatcaagtcgaggctaaggatgggctgacgtgcatgggtctgaggttttctaggattcctttcttagtactgttgatcatcttatccaggatcagttatcaagctcacaggcctctgtgtctgtaggattttatttcttaacaagaatgcccctttctgaaatagctttgccaaatatcagttattttaggtgctgttatgtttttcatatgctgttccactcttacatagaagatgtttcacctgcttagatgttgtagaccgtggtctgaagccagagctaaaggctttattttagttgttgttttgagaagcataatctaagatgatgcttaagattttgatatctggggttaaataatgtcataaagaaaaaaattttgaattattttggagtggaaagcttcagattctgaccctaaagaatgttaagaaagcattcaggcacattttggtcaacatctgtgcattgaaatctaggtcttaaaacagtttatattttaagattatttcagcagcaagacaagaattttttaatgccagtacattttgtgacaggttaactggctccctaagaactatatttggcttgcaaatgtattttgtttggcccacatagtgttttttttttaattggaattaattgccagcatttaaaaataaggatatttcataataataataataaaaaaaactaaaaaagcaacaacctggatttcctgcccttttggaaaaactggaagatctgtggctgtactggccgctcgtcctctgtggtgtaatacagacacaaggagctggcgaggggctgcccgccagcctgtgtcatgtgaatggctccagtcatttcatctggctggctcttggagtatgtttgagtttgcacctgctgagttgagagcttaaccaattaaaagtgtacttagagttggaaggagaacagtaagatggcagttattttccatttgttctctgaacatagactgtctgatctttgttataatgtgattagtggaagtgcttggtagagcaggtggtgtttcccccagcaacagtattcaccggacaggtcgggggagagctgaatttctaatcacattgtacatctaccagtttgttcctgcaggtgacaaacaaggttttctgaaaacaaaacaaccgtaagtttcttatgatacttaaagtagggaaagcaggtgctgggtcttagttgtgtaatttgagagctaagacctgagatgttaggtgatttatctgcgagcccctacctgtcacctattcagtggtagaatagggactggagtccaggactcctgactccagcttagttgctcattttacagtttagtataatggcctggagctgagatttgcagtcagagttggctacagatcccactttgctccttactagctgtatgacctttctgtgcctcagttttcttattataaaaagagggaaataatatgaataataccgaccttataggattgatatgaaaattaaatccaatttttcattgaaagaacttagaaaagtggctgctccttaataaacagtatttaaataatgcataatatctgaaatatatgtataaattatattttacatggtagagttagctaaaaccagcttgttacctagatagaattattgtgtaattagtatttttccccctcctagaatttagaaaggcctttagggatagttttactctatgtattaccccccccaaaaaaccaaaaaaacttcaatttgagccagtattctttttattaatgaatttttgtatagcaaacaggttcattgaaaagcataaagtttgtcagcttactcttcagaatgtagacaaataactgaatggtatgaaaatattttaagtcctcaccgaggactctatttgaatggatttgcttcagtcaccaaataaatcttgtacgtgtggtggatataaagcactcctagactatggattttacaaagataaggctctgatcttagcttatagtggaaaagagggtggaaggaagggagagaatgatttccataatacctggtatgataagaacaatgcctaaaggggaaattgatgtccagtgggagcataaacagagcactgtgtctggttggacatagtggtcagcatgagaaccaagaggaaggccgggcgcggtggctcacacctgtaatcccagcactttgggaggccgaggcaggcggatcactaggtcaggagatcgagaccacggtgaaaccccgtctctcctaaaaaatacaaaaaattagccaggcacagtggcaggcgcctgtagtcccagctactcgggaggctgaggcaggagaatggcgtgaacacgggaggcagagcttgcagtgagccgagatcgcgccactgcactccagcctgggtgacagagcgagactccgtctcaaaaaaaaaagagagaaccaagaggaagagatgcccctaggaaaggagtagaggaggtggaagaagattgcggaatagacgtgtgaattttagtgtggacggttgtctgagctgttggtgggccagccttctgatatttggcctggagcttcaaagaatgatagggttagtgatatagatgctatttaaagctttgcaactcactatggaagatggattgtgtgaggcccttgccagagggttgtaaattacgtatgccagagagtgaggagggcctcagcctccagagcagtagaaatggactggagggagaggatggggaaagagtcaaggcatgttttaggtaaaagtggcaagtcaggtgggaggtgtgaggaagaaggaagagtcagggttactcagaagacactggtgccatgggctaagacggggctacaagagagcaggtttggaggggaaagtgagcttaattcagtacatctggagtttttgaggaatctgaaatatccaagtggatatgaagcatcagaatattttgtcatgcctgaaggaaccttacttgagtggatttgtctaagtaagcaagaaattgtctagtgaatggttaatctgtaactgggaagaggccaatcctgggaacacggatttggaagtaattagcatacaagtgatgttatagccacaagcacagataatactgttcagtcaggaagtgaaggatagaaggagcagtaggctaaggagtcccaccaaggaagctaagtaggaatagaatctgaatggcatctcaagtcagtgagagaaggaatggattacctaataagtggtgttgggataagtggtaaccacttagagggaaacagaaaaggtgggtccttgactcaactgtacactgaaattaattttatatggcatgaagcttaaaatgtgaaacaccttaaatgtacttgaaggcaacatcaggacaatttgcatagtcccggcatgagaaaaacctttatggttagaaaccacaaaggacaaaatagagaaatctgatctagtaagagttaaacaaaagactcactggaaagtaaaagcgattggggaatctatttgctatgtatgtaacagagttaatatgcatattaagattttttttcttagcaatcattaaggaaatgattaatgcccaattagaaaaaggagcaaaagagaataaacagcttataaataaagcattgcaaattatcaataaacatatgaaaggatattttaattacgcaataaaaagaaatgccatttatggcccaacagaataattttttttttttaaagacaatccttggtattagtgagaagtactgggaaatggagatgttcctgtttctttttagagataagttttcgtcatgttttcctgcatgttaaagatttattggaggaatgttcttcaggttgtttaataatagagcacttcatcgttaaaagggaagaaacaagttcattcgtttggtagacttttatatttattgaagactgttacataccagtcactcttatagcgtagttgaagtgggatatgagtagtcagatgttactctaaagtatgatagcgtgagtcccgaaagatggaagaatgggaaatataggagacattgcagggggcactccattggaggcagtggttttgggagaggccttgagaccaaagggaatgtggagtgtttggggagctgctgcggtatggagaggaaggggttcatggccgtctcgaagggctgtgcccacagtatggaactggaactgtgtgttgaaacagtggagagcctttggaggattttaagcatggaagtgatgtattcaaacttgttttgacatgctgaggttcataatggactggctcttgaattaacagggaagtccacactgcaatggagattactaaaactgacatggaggatcctgaaaaagaaaaactttggaagacagtctatttttaaaagttcccaggaaatgcaaaggaattaagaaaaaaaaattgacaagattattctatttgaataatagaccaaaaagttattttggggaatgaatatcctgcattatgcacagtgatagatttgtctttataatgtagcaaatgttaaatttcaatattattttcctacatgcagaacgcatattgaagtatgatacagtggaatccctaagcagccaagctatcctctaactcaggtccccagactgtcatagttcacagtgcccgtcgtgttttgttaatgttttttatgatgcttgtagtcaaaagaattacctaacagttctctttatgaaatagctgggtccaaacaatttaatgagtatttatgatcaagcactttagtagcagtttgaagaaataacgtgtatccacttaaaaggaaaaatataattgtccctctatctctgtgggggcacgttccaagaccttcacagatgtgaaaatctttggatgccaagtccctaatataaaatggtgtggtatttgtatataacctgtgcttatcctctcatatgatttaaatcatctctagattactttaaatcatccctaatacagtgttaatgctatgtaagcagttgttaaacggtacttttttttttactgtttttttattgttgtactgttgtcttttattggttttgttttctgaatattttcaatccaaggttggttgaatctgtggttgcagaaccctgggatatgaagggtctatggtagtatttttatttcattcttaaaaagccttaattactgatgagatgtgtgaagctattgagtactgcatagcttcccaaatcttggaaaccagcaccctcatttccatttctacattgatttgtttgggtagtacttgtgttttatcccagcaattactagtccctccctctcttcaccaaagataaagatacgatgtcacacaaaaaaatgtagcatgagcaaatattgaaactgtggactaccttgaactaacggttttcagagtgttggacagatgtcactttatttccttcaaaaacttagatattctgtgatagctctgtcagtttgctttggtgtcttggggtgcctcagtgcagtttgggagccagagctttaacttgggttcctagtgttggcagtacctgggttagcatgcagcctaacaatgaaagtatactgtgtgggcatataataatttgtgccttggtattcattcagccagctggcttagagtttttggtgtctgctttgtgccaggtactgcttggacactgagggttacagtgaactcggatgtgtttgctctcaaggatctgacggtctgtagggagaattataagattaggaagtgaagcagtagagcagaagtcagcaaactctttctgtaaagggccaggcagtaaatattttaggctttgtggaccattcaatctctatcctagccactcagctctaacattgtcatgggaaagtagtcataggttatacttaaactagtgggcgtggctgtgttctaggaagatttacaaaatcaagaggcgggtaagatttggcctatggaacatgaattgtgcaaccccatgacataaatataattaaagtgttgtggaagcagcagcagatggcatctaacctgtggactctcagaggcaatgacaaacatacctcctgctaggagcatcactgctgacttgaggagggtgcagatgaaattagcaagaagggaaaaagggtgctggcctaaggagtcctgaagggtctggcagctgtggaatggcagccattttagtgtggcccggacacacagcagaggcagtgtgcaaggcctctttctaggttctgactccagttgtatggattgtatattttctctcttgttcttttttgttttgtacctcattttggtcagtcatgtcctgcagtagcttccagagaatgggtacacggaaggtgatacatcttttgacattttgcatgtctttgtaaaatatatgttatccactcaacagtttgagtatagaattcaagtgtgacaataattttcacttgtattttggaaggtgttctttttagcttttattgctaaaaagtctggtgtgttcctccccttctcaagaatatttatgggtcacacacccagtgtctcatgtacacccgtaacctgctctggaggtggtgctgtcaccatccctgtgttacaatgggggtttgtccacactcacaccgcaagtcacagaggcctgacttgactaatttattctgatgttgttcttattcctgagcccttgtgtatggcctccactccctggaaacttgtaacatctttgatacagatattttgatattctcagtgatgcatcttggtatcagtcttttcagattccttgtgctgggttatgtgggctctttgaggactagatttttgctaggactagacctatatactgataaattttgcatacatctttgttactgcagctatgtcctagttaatctccttgaaacatcactttgttccagcttccctctttctgaaaagctattcatgccttcctgtgcagtctagtcttcccagatagaacttctcagtctggccaagtgtatgtttttcgtaagtatttctttcttttaacttgaagagcccctacacttcacttcaataacacaatggagtctaccaaactgcagagtttatgatcctgaaaagccttcttcactgggagctaatgctggaggaatttaagatcttgtgggagggaaatgggataaggaaaatagttgctggtcaaagtttttaaacaatgttgatgtttcctcctaggaaacagtaaagaaagggacactaggaagaatacaaatgagcagtgcgggtactgtttactgcctgtgtgattgcacttgttttgctcaactcccagcatctccactcctgtggatgggtgacccactcgtaggcttatttacctttacagtagttcagagtcttttctccctcgagtgttccagcttagtatttaatttcttttgagaattaatgacaagggagtcatcttattgtatggcaaaaagatagattcttgagataaaagatgctttgggctgtcttgattcctttcaccctgactgtgcaggtgttgcctgaggcctccttctgcacacaaggctggaggcctcagtgccaccaggctaggttcgtgccagcaggacatgctaactcactctctgtcacgtttcctgatctgtctctacctacctgtccccaccaccgccaccatatttatgtatatagagaggggttgggggacaggggaacagagacaaaataagcaacaaaatgtgttgggactagtttctggtatttagctttacttttctcaactctttttttctaattttcttcggcagaaaagccctaaacctcatgtacactggaaccagaattctcaaggttgagaaaaatacaagtcaaagtacatgtgtgaacactcatcttcacaaacaaggcctttaaaagctcaggggcccgtgttgacaggactgaactttgccatgtggggccccaggctcaagttctgcctgtgctttatgatggtctaagattgaagtcagcatatgtgtaaagaaatagaaccagatatttttctttccattcaacagtcttacagatttattctgcatgattacttttctttagcagaagggtttattgactttttaagtcctttaaaataattagtataggaaacaaactggtcacccttgggcaggaaggatactgcccatgagcatattttgtctggcctttagaatgtgtaaaacatatgcattattttctcacatttacaaactttggtgtttcatttaaaatgccagatttctacctcatctggaaaaatcagcatatttggcaaaatgaggctggtggctgccacttttatgctaggcagaggggctgcagtttgcacctgctgtgaacacgtttgttacttgctttgcccctgcatatttgcatttgcaccctgttgctgcatcctaattttgaaagttagctcctgaaatcgtataaaaatttgtgctcctctaaggaataaggcattgacaggggaaaaaagtgaattctgacaatgtttctatcaggagtgagcagagaaaagcttcacaagcatcactttttttctgaaagtacttcggaaggctctgttcatgtattgttctggcccacagtaagtccatttgaaagttttgcttggtggggaagtctgatgtgttataagcacaatattgtattgcccaaatagacttgcccagaattctctgtgtaaatgtatcacaccagaaagtcttctttattatcctgcttaagttaagcaggcttcagtgacactgccgttgatccttctgtccctgggcatcgccttcctcctgcttactgacctcctcagcagagtctttgatccgtggctgttgctggcataggctttgtgcgagctcgctactgtctgcgtgcctgttccctgccagcaggaatggaatattacagcttcgctttgggaagtctcttatgtggatcctgaatagagagcatgcctctctgctccaatggttgaggctgaagcagggagggattaagtgatttaccctcagccataccactaattagtaatggagccaagattagcatctaaatctggaagcacctggtccagagctctttctcagctgcctccctccgccccttcttgcacttcttcctggcatggctgtagggcctgtgtctctttttagaataatcgaaacttgtagtgagggactgtttcatttcaagataatgtttagccagtcagtgaatatggtttatgattattttagtcagagtttgagttttagggtcatgtttggctccattactcagttattcttgtacagttgtataattctataaattcagcaactggcattttagatattttgtgaatacattttcattctactaagtaaactcaatgaccctggaattgactaggaagttattcattcatccagaaaataatagaacacttttgaaatgtgtgctcacgccttttgcatgttatggttataattaagctatttgggattcatttcctgggtttttgacagtacttgacagtagccgagaagagatcttgccatctgctttcactaagaaaaatattttttcgaattctctcaatgggctccagttatttaggtgttggatctcctttcctttatcaagtcttcatttcttatctcttttcccacattttcaatttttttttgtattttgttctgaaagattactcaatctttttcttattttaattttaatatcagacaatatgtttaacttctaagagctatttttatttcctgttattcctttttcattgcatcctctagttttttatagttatgccatgtttgctcagaggacactatttagagttttttaggttctttttttttcttttaagttttcttgtttcctatatcatccccattttctctggaagtactttttattttccttttggttatcctaaatttctctttaatattttagcctttgcttatatgttttgtgatctttggtgccctgtgccaatgttgtaataaatgaggcaattttaggtctgacacaagagttttcagtgtatcataaggatcttgttggctggtggtgtccctctaggaagaaaggatgaagggtggatgggaatttcattactctgggggatccctaaatgtccaatgtgcaacatctccatactgttaccctagttttttctttttaaattattaaatttgtatgaaatagaaactttccaacaccatgtaaatgggagacaaaactaatataacttgtcataaatgactaaacacaagttaacgtactaataaaatacataaaaatatcaatccaggtatcacttaaaattgtcaaaaattcagtctcatgcactgcttttctacattttagtagagttggagtagagttgatagccatgtgcttataattttgttgtaattttataattatagttatgatctttaacttgaagcccatcatttgaaaattggcctcgtagtagatacctaaagcaacagctgtgtccaattattgatgtctccacaagccagggaagcttgagtttgagtatctccaaagtctctaaatgtacagtgtttcagaatctgtcagaatctatttgagtgtttgtgtgcacagtataaggtgagccttcagaacaatctgaacaccatctggaattcctctcctaacctaggactgactgcattgcacagatgatggatatttacgtatgtttgaaacgaccatcctggatggtggacaataaaagaatgaggactgcttcaaatttccagtggctgttatcaacatttattcttctatatctaatgaatcaagtaaatagccagaaaaagggtaagtgcatcagccttccagagaatgaacagattgcagttttatttccattttgatgacgaagcaattttgttgctttattgacccctttaggattttgttggttaaaattcatttttttgtcatcttttttctatgtacttttagtttcttttaaaaagatccttaatgatagatcaaaatattattttaccatgaaaaattaaaatataatttacatacaataaaatttgcctttttaagattcagttctgtgagttttgacaatgaatgtagttatgtaaccaccagcacaatcaagatagggaacagccccggcactgcaaaagcttcctggctcctctgtagtcagccctcccaggcccatcccctgccagcactgccttgtctccatagacactgttttctgtctctataatgttacctttttagaatgtcatatcaatgaaatccaaatatttttaaatgtattatgttacatcttaaatatattaagaatgtttatgtagatattttatagcttatttatataaagaaattatcatcctcctgcccgttggtttagtttttatattatttccatatttaaatagatctcttttctccaaggtcattcattaaattactttattattatgattagtgctgctttataatgtgagtacttttaatgtaatatttgtttttctgtcatataaatagccgtataatttattgctacagtgaatatcgtaccaaccatgtacaaaaacaaaaacatttttcataaacatttatagaatctgagatggactaccttttttattctatagttgccttttccccttgtttccctcctttcttccctctttccctctctcttataccccccttctttttactcattttcttttcggggtgacttttttcattgcatagtgcttacatattccatggtgtaatgttattttatagatgtgagtaagtactagtaggattgtaatcttctgaattgttactttcaattgtttaggcccacaccaaaaatatatttctcaaatgaactcatgagtttattactgtttaaatttaatatacttcataataacctaaagattagttatgggagttctaccaagggggcagtctggtagcaagcaatgaggtgggggtgactaggagtttcaaagttttgtttaaaaacttggaaggcacatcatttttacttaagacttctttgtttttgttttttgttttttccttaagtggggctattgaagattcaagaggtgctagaatcccctcaagccctctcttggtcccattattgaatctacatgactagccactcactcccttaatttgtcttagttgcttggaagtggaatttttgatagcagcctaaccccaaaatggtctagtagctggcccactttcatcagtttaccctttagttgtttttttttaaccaaagctgcaaaaagaaatagaaaaccagtccactcccatgacttgcaggatcatctctttgaaaaaaaaaaaaacatgggctctctgcagacacacatgcttgtgcttacaactgaaaatggttgactttttagagtgcagttgacttattcagcatattctgtgtttatgtgtgtctgtgtgtgtgtgtgtgtgtgtgtgtgtgtctcctccaggggctcctcatgatttgaagtgtgtaactaacaatttgcaagtgtggaactgttcttggaaagcaccctctggaacaggccgtggtactgattatgaagtttgcattgaaaacaggtaattttaatttactttaattcacaatgagctaggttgaattgcagaaacgaccctcagttcttaccttattgcttgtgaaactaaagggttatttcctgcttgtgttctgtgtccagcagagtctgccgtgacctctgcctcatttttctcctgtagggcaccaagcattatgaggtgtgatggcaaggtgagaagaggggacagagtctgcagtggctttcagtgcagatctggtagataagactgtcactcagatttctgccaccaaataaagccacatggccataccttgcttcagagaggcagggaaggacggtcttagtgtgagtccagaagggggagcctgaaaagtttgctgaagagcacacatgcccaccacaggccaaacagagaggaagttagttctggccccctgctcccctgggaggtcacaataaacaaatagtagcaaggctgtggtttttgtgcaagggagtggacactaggagtatgaatgtctagaaaggctgtcagaggaggtgtaattctggagtaggcacagtcagttttctcagcagaaaaggaataggaggacattctaccctgaaagaatattgagtacaatggcttgaatgtatgagatggcgtgatttggagaattcaggtgtttttgcattgctgatgcctaaagaagcctcaccatgtgagaggtttagaaggagatgagctggacccattcaagtccagagtcctaagcacccagccctaaggctggggctgggtagttggtgggggcaggaatgcaagaggcatggaaagtcctttcagtaaagtaaacatttgtataagaagtttgaaacatatatgaacaacagtataaggaatataagcatgctctggagagatatcaagggctgtggaacaagagaggaaaatatcattttgcctaagagataccaggggaactggaagcattttgaaaacagaactgaagaggaagttctgttaagaagaaaccatgagccaaggcagaggagcaggggagttgccagtttcatttccttcatcagcatccgttgaacatcatcctagcatgaggagcgctgtgatgcactggtccctcagtgaaggggtggagtgtgagtagtggaagtcagcctacaaagggaaggttgaggtgggattttgaaaggcatgcaaaaactccagctgtttggagtcatctatgcttattctacttttggtacaatgaggttgtttttcctacccccacattggtaaagttactatcaatctgttttttcagtcttaaaatgcggtacaacctatcatgtttttgcaacaaagagggcataaagtattttccattgtattttgtgttaaccaaatttttatgaaaattatactattaattttatttgctaattaaaattcaatttcttattacaggtcccgttcttgttatcagttggagaaaaccagtattaaaattccagctctttcacatggtgattatgaaataacaataaattctctacatgattttggaagttctacaagtaaattcacactaaatgaacaaaacgtttgtaagtatttgaaaacaaactcaattttaaagtaagtcaagtgtcacttgttagtattgtggtgctttctagttttttgaatttcatgtgttatgctattacttttaattcactcagcaacctccctatgaattgtagatggtagccaagatcagaaggaagcaaacttttcttctggccagtcaaaatagcccagaattcaggctccttccctcagttccatactctttctttagcccccttgactcctgcgtaccttccagaatttctcagatgccccttgctctagggtgtagtcttatctgggaagctactgaaaaatgacagtattagaatcagaaaggcaaatcaagacagactgtaggagactcagtcgattaatagttcattgtgttttacatatcatgtaatgtattggtagcattataaataataatggtcctgatcatgattagaataacagtattgggataagaaaattgaaaagcaaattaggtgagtgtaaggaacggaggagatggatacatcagcaaatctttgagcacctactgtgtgcaagagaagctctgcaatgcatgtatagctgtcctttagaggatctggatctcttgacaatttgctactaaataaaagtatgaaaattaagtgtctgtggatctaaagatgctttctaaattatataaagcaaacaagattttatatatatatatatacacacacacacacacacacacacacagtaaagtttgtacttaccatgtgtaagcatgaaaaattcttcataagatttttaatttctgcatttcttaaaatcacctgaaaatttgggtcattctgaagcagaatgtgggtcctgtaaaaaaaagctgggaatactcttatcttcttatgtcctaaggaagcaggagcacgtagattatgggtaaagctgaattagcattagaagaaaataaaaaagattttcattaaatttcttccctatctgagtttctagaaagcaagttaacattgtcctcacatgtctgtttagcacaaagaaatgcagatggcagttaatgggagcttaggggaaacttccctatatgctataaagaaaagaaagggagcagtggctttttaaaatccttgtacttgtaattatggccattactgtctttagcttgaaatgttggatattacttgtatttttaagagtagcccactgctatttaaataaaatgtaaattatgtggacttttcagggagggaagcattttaaagatgagcgttgtcttagtaaaatactcccgtgtttcataaattgtaagttactacatcatgtgacatcctgaatcatttgaaagaatagctgtgttcttggaagcctcttgctcttttctggtcacactggcaccctgagctttccctgtcctggcactaaatcaacttcttgcctctcgtttgtctgcatttttccttttccacaaggagctgcccacttaaaacttctttttaaagcatcctccactgtccttatacagctgtgtaactgttgactttgctctgtagtttagactgtaaatccacatgttctgtgtcctgtacagccctaaacactttacataaatccagtgttgaacactgtattggccaaattttagttaaacctatttttaataactatttttaagttccgagattaatgtgtattggtttgttctgccctttttgttatttagcatattcagctaccctagccctgcactgtcctgcagttttgggcttaccatgactatatgtaattggtccttgagcttctaggatagaaatgaggcaagaaagggtgagtctatggatttcttctaactcacctttactttactgttatttgaggaggaaacatggaagaaaatccaagtctctctgattctcaaaccagaaagtctacatttcatagaatggaacatgctcataccttctttgttttccattggtccaaaattttccatgatttatccgcccttagggagagttaatgattttcaaggatacattactcttcctgctaccttttttagtgtcctggattctccctaggagatgcccaaacctttgagcatggatttttttctcttttaccttttgtaatgcagcttcagagcccactgttctcctaaacttctttctcagatattaacagtagcctcgccagtggtttttccacagtcttcctctataaactgttttatttggcacaggtaacaactatttgtttttatttcgatgatcctggattttctctggtttccttctgcttctaggattccctctctggattcatgttggtgtttttggctccttgaagatgtaattgtctattggcagcccctaaaaggagctttggctggtttatgtctttgtgttcatgctcttttctaccactacactcaatgagttccttttaagtctgcatccacgttctgactccatggtgtcttcttcccctgacccttactcatccatagccaggcttctgtgtctcttcacagtgattcccgattccttttgctcctcttgctgctttctgagctagaaacttgagagaatattggttgtttccctttttcattagaaccaaccgtttatttctttgatgtagtcatttctttgaaatatccatgacatcttttccatagatggcatcttagtttatatccttgtcactctagccaggattgctccagtggtctcctaattggtcaccttatcccctgtctcaatcccccgcagtctgtgttgcatactactgataaaggaacctttctgacacacttcttatatcctgctacttctgcacagtaaccactggcttcttaactcaatgccttagtcactgagacaatcctgctactgtttaatggtattgaaaatcagtaatgcccatagcatttctcaagtgggtgacatcccccagcacgagagactcttgacaccaggagatgcctgagacagctgcagagaaaacagagagaagcctttaccaaaggaagctttctatattttgttattttcttagggctgccctacagccatacagaggaaactcgttttcttctctctgatgttgcctacctgtaggttcctgactaaatgacactagagtactgtggaaacctagttgctgtttgtattagaaaatgtgctgtggatttgaaacagccagctaataaataattttcttaaatttggctgatgaagcattgggagctgcctctacaaataaataatatatatgttcccctttttcagaaatttgagagaatattagtcgtttccctttctcattagaaccaacccttcatttctttgatccagtcatttctttgaaatatccatgacattttatcttttccatatatggcatctcagtccatgtccttattactgggttctagagtttccttttaaatcttgattattgattttttgatcaagaaggaatagagtttataagtagttgattagtggagttacagtatgaaaaatcattacttattttactaagttttctcttttgtttcctctttttaaagccttaattccagatactccagagatcttgaatttgtctgctgatttctcaacctctacattatacctaaagtggaacgacaggggttcagtttttccacaccgctcaaatgttatctgggaaattaaagttctacgtaaagagagtatggagctcgtaaaattagtaagtttgaacatagattttcttcctatgacattaaagaaactgaataattttttttaagaagccttaaggtggtatcagtgaacttttggattatttaggaagtaaatcagatacctttcagggttcattaaaaacatcatgcatgatttaaaaatcacttgttaattattaaatgatgtgtaaccattacagatagcataggaaattaggggggaaataagccgtgattctaccacttgaaaatagtaagtactgtttttgtgtattcctgtctggacttgtttatatgcatgtttttatgtaaatgaaagtgcacatttaatttagtgtattattttacctttgtctaatgttttgaagcatgtttagccagaacttagccatagagaatttttttttataaatctataagcttgaatttatcagtacatgctttttccctctctcgttttttcattcctgtttatgaatggcctctaaggagtaatgaacaacatttatgaaaagtttgacagctgttacctggaaatgctccctttcagccttttactctttttcttgatagatttggagtttgcttagttacaggtttaagaattagaagaccatctcatgattttacagtttatttgttcaagttgctcaagtacatagataaaatagtaaagataataaaaaagattattctatatttcatactttcttattgtttctctttgacaacccatgtatttcattcctaaaataacaatagtcagctagcacctagcctatatgggacaatagcctattgcttctaggccacatacaaacctgcatggcatgttactgtactgaataatggaggcaattgtaatatattggtaagtatttctgtatctaaatatagaaaagatatgtaaaaatatggtatagaagactttaaatggaggagggacttcaagatggctgactagaggcacctcgtactcaacttctctacaaagaagaaccaagatagggaatagtagatcttcacacttcaaatagatcatcctagagagagcatcgggattcaagagaagtgacaggaagcacctaaagcagggaaggaagaggaaagtgaggcagccagcagaacaccagcagtggctccactgctaaagtgcattccatgtgcccagagtcccctgcctgcaactgctgaagcacaagtggggcgtgatgtgccaccactaaggctgaagcgtgagtgaagcgcagactacagctactgagactagaatgcaaattgtgcgttccccacttgcatgcctatggctaccattgaaagcaatctcttcctcctcagtagcagggccgcagcacagccactgctgctgtccacctgagcattctggagggagcatggggaacaccgcatgcctgcctaccacagctagtgtctacatgtactacgagagggcctgaggacaagcccacccagctttgttcccttgccctggtgccagaacttacagcctatggacctaggaatcacctagcctagtctaccaccatcagcacctgagcacctcttctaggggcctgagattaggcccacacaccctgctgctaccaccacagctggcacctactgcacatgctacctgcgggcctgaagactggcccactcagcacattgtatctactgtcagcaccagagtgcactgctcaagacccagagggttatcctaccactgctactgccatcacccacaccacacctgctggccaggggcctgagaacgtacccagcccaccactctcaataccagcatccaagcaagccacttggacgctcaagaattggcccccttggacccactaacaatggggccagtgaatgccatcctggggtccaaagacaggcatactcggcttaccacttccactgccgggacccaaagactggaccacttacgccactcttattcaacaatagtactggaagtcctagccagagcagtcgggcaagagagaaaataaaagggatccaaattgggaaagagagagtcaaattgtccctctttgctggtgatataatcttgtatctagaaaagtgtaaagactcccccaaaaaacttagatctgtaaataaagttagtaaagttgcaggaggtaaaatcaatatagaaaaatgagaagtgtttctatatgctaataatgaactggctgaaaaatcaagaaagccatcccatttacaatagctacagaaaaataaagtacctaggaataaatttaaccaagtagttggaagatctctataaggaaaactacaaaactgatgaaagaaattgaagaggacacaaagacattccatgcttacagattggaagaattaatatcattaacaggaccaaactgcccaaagcaatctgcacatttagattcaatgcattccctacaaaaatgccaatgtcattttccacagaaatagaaaaaacaatcctaaaatttgtatgaagtcaaaagaaacccaaatagctgaagcagtcctgagtaaaagaacaaacttggagacatcacactactcaacttcaaaatatattaaaaggttatctatagtaatcaaaacagcatgttacttgtataaaaacagatacatagaccagtggaacagagtagagaatccagaaataactatgtttttatagcaaacttatctttgacaaaggtaccaagaacatacatagttggggaaaggatatcatcttcaataaatggtactgggaaaattggatattcatatgcagaagaatgaaactggatctctgtctctcatatacaaaaatcaactcaagatagatgaaagacttaaacataagactgaaactataaaacatggggaaaatactataggacattggtccaggtaaagattttatggctaaaactgcaaaagcacagacagcagaagcaaaaatagattatattaaactaaaaagcttctgcacaacagtggaaacagtggagtgaagagacggttgaatgggagaaaacatttccaaactattcatccaacaaaggacgaatatccagaacctaccgtgaactaaaacaactcaacaattaaaaaattaatactcccattgtaatgtgggcaaaggacatgaatagacatttctcaaaagaagacatatggacaacaggtgtatgaaaaaatgctcaatatcactacttaccagggaaatacaaattaaaaccacaatcaaatcagctcacctctattagaatggctattattaaaaagacaaaaaaaacttatatattggtgaggatgtggagcatgggaagctcttgtacaatgcgactgggaatgtaaattagtacaactactatggaaatcggtatggagatttctcaaaaaactaaaaagagaactcctataggatccagcagtcccacttctgggtatctgtccaaaggaaaataaatcagtgtattaaagggttacctgaattcacatgtttatcatgccactattcacaatagaaaatatgtggaatcaacctaagtgtccagtagatgagtggataaagaaaatgtgatatatacacacaatggaattctgtttggccataaaaaagaatgaaatcatgtcatcttcagcaaccaggatggaactggaggccactacgctaagcgaaataagccaggcacagaaagataaatatagtatgttctcactcactcatggagactaaaaaagctgatctcatggaggtaaagatattattagtaacagaatgatagatactagagactgagaagggtgtgttggtgggacggggcaggaagagaggttggtgaatgggtacaaatgtacagttagatagaagatataagttctgtgttagatagtcaagtagggtgactgtagttagcatccatgtattatatatttcaaggtagctagaagacttgaaatgttcccaacacagaaatgataatactcatgagataatggataccccaaataccctgacttgatcattacacattctgtgcatgtaaccaatactcacatgtatcccataaatactatgtatcaataaaatgtttaaagagataaaaaatggtacacctgtataaggcacttaccgtgaatggagcttgcaggactaaaagtttctctgggtgagtcagtgagtgaattgagggcctaggacatgactattcaccactgtagtctacatggtacaattagaccacactaaacttataaaactttttatctttctttggtaataaattaaccttagcttactgtaacttttttacttcagaacttttaatttttaaaaaatattttgactcttttgtattaacacttagcttaaaacaaacacatagtacagctgtacaaaaatatttttatatccttactctacaagcttttttgtatttttaaaaattatttttctttaactttgtaaacttttttgttaaaaacaaggacaaaaacacacacgttagcctaggcctacgcagggccaggatcatcagtataacagtctgccacctccacatcttgtcccactggaaggtcttcggggcagtaacatgcatggagctgtcatctcctctggtaaccatgccttcttctggaatacctcctgaaggacctgcctgaggctgttttacagttaacttttaaaaacatgtagaaggagtaccctcaaaaataatgatagaaagtgtagtacactaaatacatacaccagtaacatagtcatttattatcattatcaagtattatgtacagagcacaattatatgtgttatactcttataccagcagcacagtatgtttgttattccagcatcaccacagacacatgagtaatacgttgcactatgacattatgttggctatgatgtcacttggtaataggaatttttcagctccattataatcttataggatcaccatggtatatgtggtcccacattgactgaagtattgttatatagcacattactgtataccttgattctttttatcctcacaacagtcccaggagggtgatactattattattcccattttacagatgatacagagtcacaggaagactttaagtggtggagtcaggattccaacccaggcagcttggtttcagagtctgctcttaactgctacaatttatattttataagaaatatatatattttaatttaaaatgtcctccccttctcacgtatcctactcgaacctgcatttcaagacccaggtcaaatcctactccttattttattttattttattcatttgtttttagagatagggttctgctctgtcaacttggctggagtacagtggcatgatcatatagctgactgcagcctcaaactcctaagggatacttttgcctcagtgtcctgagtagctggggctacaggtgcatgctgctgtgcccagctgtttttttttgtttgtttttttttttttcatagagatggggtctcacttttttgccccatctgcctacttcttattttaaagcccatcctttttttttttttttttttttttttgagacagtgtcttgctctgttgcacatgctggagtgcagtggcatgatctcggctcactgcaacctccaaatcccgggttcaagctattctcttgcttcagcctccccagtagctgggactacaggcacatgccaccacgcccgactaactttttgtatttttagtggagatggggtttcaccgtgttagccaggatggtctcgatctcttgaccttgtaatctggccacctcggcctcccaaagtgctgggattacaggcatgagccacctcgcccagccttaaagcccatcttaattcagcctgcagactctcacttttcttgattctaatggcaagtcttgtctgttaatctaatttgcagctagctttgatacagttctgcaggtgctgtcttaaaggtattatttatttaaattatattgcttaacttgtcattatggcctaacattttgcattctgggttaccacttacaggcttaggataactcctcaaacctagtttgtatcttttgtaaagtggcaatatttgctctggggtctgcaaagtaaatagtatatctgtaaagctgctaaacaaatattatttgtcactactccctttagggacaaggctttttatttttttatttattaaattttataattttttattacactttaaattctgggatacatgtacaaacctgaaggtttgttacataggtgtatacgtgccatggtggtttgctgcactcatcaatccatcatctacattcggtatttctcctaatgctatcctttccctagccccccatccctgacaggccccgatgtgtgatgtccccctccctgtgtccgtgtgttctcattgttcaactcccacttataagtgagaacatgcggtgtttggttttctgttcctgtgttagtttgctgagaatgatggcttccaacttcattcatgtccctgcaaaggacatgaactcatccttttttatggctgcatagtactccatggtgtgtatgtgccacattttcttcatccagtctatcattgatgggtgtttgggtgggttccaagtctttgctgttgtgaatagtgctgcagtaaacctatgtgtgcatgtgtctttatagtagaatgatttataatcctttgggtatatagccagtaatgggatggctgggtcaaatggtatttctgcttctaaatccttgaggaattgccacactgtcctccacagtggttgaactaattcacactcccaccaacagtgtaaaagcattcctatttctccacatcctctccaacatctgttgtttcctgtctttttaatgatcgccattctaactggcatgagatggtatctcattgtggttttgatttgcatttctctaatgaccagtgatgatgacctttttgttcttggccacataaatgtcttcttttgagaagtgtctgtgcatatcgtttgcccgcttttttgatggggttgtttgatttttttcttgtaaatttgtttaagttccttgtagattctggatattagccctttgtcagatggatagggacgaggcttttttaatttttaatgtaacttgaggaggaactaactagagaatactagaattaaagagggacactctgaaatgtgagtgaaatcaaacttaaatgaagggactgttaggctaaaaccatatagctcattctacaacatgtgtaagtcagccaatgacaaggcagtaattccttacttttgggaaaaaatttgggaaaataatagcaagaagcaatgagaaagaacacatttctttagaactgtaaagtaagggaaaatgcctcagggcatttttattaatagtacgttattaatgtcagtatttaagacaaaattgcttgtgatcagtcattttatgatatcctattattttgcactaatgctattattttataataatttaaaaatcaagaacactttgcattcatgtttcatttgtgaggcacttgtctgtctgtggtctctgtgtccagcagtgggagctgtgtgctgcacacactgggaagagctcaccaggcactgctcccccacacacaaatactcctccttgactttccctggaaacgacctgtttcaactcttttaactgatctctttcattatttatcttcatttctccaaataacatgcttatgttgctatttcttgatagcaaccccctccctttcctcctctccccccaccgcctcatttctctctgctcctccctctccctccttctccccgcagcctgccattttcctagctttttccaatagagtctatgataatttttggtagaacagtattcatcatttgtattatggtctataaaaaaatccacaattttttgtacactccttatattatcttgtttttttgtgtttatttctctgcttcattactttaatcctaaattctttgcaggctgtgtagatctccttggaattttcaaatatactaagtactttatcaattttatctttgcgaataaatctctgagggctttctggctggcttcccaaccttattcacagaaggctcacatagacactgataatatttgtatagcacagagtgtggtaaatagccgagaccgcttgtggccagaggcatcacagaggctccagtagccccaacccctaccaagcagttctaggtttgaatggattaatacctagatatatttataactcactcaagatagacttcagtgtctttcagcacatttcttaggaagctgtggtccaagggatctccatcatctagggtatttcctacaactttgtcttatgatggatcttctttttgccaaatctccagtcgttctcttatttcctcatttttgtggaagcatttgcacttgtcccttggtatcttttgggggattgcttccaggacctcccttagataccagaattcaaagatgctcggtagcgttagcatacaacctacgggcatcctcctgtatattttaaaccctctttagattatttgtaacacctaatacaatgtaagtgttgtgtaaatagtagttatactgtattgtctaaggaataaggacaagaagtgtctgcacatgtttagcacagatgcaaatttttttccaagtatttttgatccatagttggttgacctcacagatgtggagcgatgaatagagggagccaactgtcagtagttatttgctattgtagatattctctgctatctataatagctagcttgcaaatataatttgttcttttaatttaattatttaaaaatttaaaagcttgtcaattactattactgagaagttgtagaggaactggaactttcatacgttactgggcagagtgtaaaatgcttaccaaaggaatacatggagataccacatttatgaaaatgtctattctgcactcgtgcgtgattactagtttaactgggtgtagaattacaggttgggaaattttgtcaagattttgaaggtatgattccattgtttcttagtgtggatcaatctttatctgttcttctggacactcattgggcccctgtcagtctaaaaacacatgtgtgtcagcttgggaatttcttgttttatttctttgatttgtccttctctgtcttctccttttttcttagaacttctgttcttcatgaaccttccacaacaatcctctaattgtttttatctttcttgttttctatgtattttctattttctcagaaattttttctaaactggattttgcatcctgctattgaatttctattcatatgtttattaatttatagaagatcctttctttgaaaggatttatgttatttttttaatgtatccagtttttgtttcatgatgcaatgtcttatctctgaggatagtaatgatttaaagtttttttctacatgccctgtttcctcacattttttctttttcttttcttttcaattattgactttcgtattagaatttcttgtacactttctggtcatcctggttgctgctcacagttaagcgaggggctgttaaaaatttttttttaatctaattggaactttggtttctctggataggacttgttgatgggggccttccctctagagtgatgaggatgggctatgcaggtggcaaacgccaaatattattttaggtatttcattttgacatgtttatgtgactcagaaaagttcatttagactattacctggtgaggattagtctggcaaaccagtatcctgggagctgagcagaggaagaaggcataggttagcaatccccctgtttttggaatgatagtccccattctcatctcttcctaaaattcttcaatccaaagatattctgttttacttttccagaacataaatctttattcttctgccaaggtaaacgaaggtagtccttcggtagtgtggagtgtgggaagggatctgggtagccaacatatcttcaaacaactttcaagcagtcctgctgttttgagctctttatttccaggggagcctgggatagccactcactgagccctttggcatttctgtgatagaaacaagctgttttcctgtatttcccattggatgcttaagattttgttttctcaggtcttctacatcagttaccattatccatctgctttccagcttccagattttagtgatgttgctttatttctatattttgtctttgtccattcacacctttaaaaaaaatctgtttactctttggagtgatttcaggaggtaagggagaaggaaatagttgtttaatctattgtgtttacctagaagtcccaagttatcttttatagcacctcaatattttattgaaatcttgctcatttctcacaattaataataatttgtattagtataacttacatatttaatcttctatttaaaaataaaagcaactatatagaatacttatataaaaaacaaatctagtctaaaactattttattgaaatgctgcccctctccttgacttaagcttttgaaagtgcaaccccattaattacttctactctatgaaaaatttagatcattaggcagtggtatacaggttgagcatccctaatctgaaaatccaaaactcaaaatgttttaaaattcaaaactttttgagcaccaccatgatgctcaaaggaaatgctcactggagcatttcagacttgggatttttgttattttatttatttattttttgttgtttttagacaggatatcattctgccacccaggctggagtgcagttgcatgatctcagctcactgcagccttgactttccaggctcaatagaccctcccacctcagcctcctgagttgctgggactacaggcacaagccagcatgcctggctaattttatttttttattttttatttttttatttttttgtagagatggggtttcgccgtattgtccaggctggtcttgtactcctgggctcaagggatctgcctgtctcagcctcccaaagtgctgggtaaattacaggtgtgagccactgtccaggcagattttagatttttagattagagatgctcatctgagaagtatataatgcaatctgaaaaggtgcaaaatccaacacacttgtggtcccaagggatactcaacctgcattttcttgcataccaaattgaatgtttcaatgaatagcaacatcttatataatacattagggcctaaagttgaagaagtaaacaaatgaatcatgattattgttactctgctattataccttacacaaaactgagttgtattaaaggacaaaacataaacttagctgatgattgtgtggaatctattgtgtcttttaattctaaaggaaagcaaaacatattgctacttggaaatacagttttgtgtttgtgttcatttttaggtgacccacaacacaactctgaatggcaaagatacacttcatcactggagttgggcctcagatatgcccttggaatgtgccattcattttgtggaaattagatgctacattgacaatcttcatttttctggtctcgaagagtggagtgactggagccctgtgaagaacatttcttgtaagcttatatttaaagaatgtttgtttcagatgaattaaattagtctcacttaagagtaagatttagtttgagctttcacttctcataacctcattcagctgcatgaggattacctgggagcgtctaagcccaccatccctggagattttgatcaaaaagtctgagataggcttcaggaatctgtattttgaaagaactttctgagtggttggataaacatccaggtttgaaaatcactgtcataggaattgaagagcattaaaaattgtgtgtagatgatactgagatgaaatctatgtttaaaaaaaaaaaacaaaacagttcccaatttctggctcacagagcagacccctagaggctgcatagttattgccaggaacacggggatctgcaagcataccaaaaagcatccgtacattaagtaaaactcatatacagggagaatgttggcagtttcgaatagggggcctggaaaattgttgaccataaaatgaaatcctgaaaggctggtagtcattgtagagatagatcactctatggataaaaggattagaggaaggaaggggactagattaaagtaagttgttttttagggtgtggagtacttgggcatatatttaggccgatggaaagtaagacatatgccctaaatacattgaataaaaggaatggaattatttaattagtgatttttggggggtgtggattgttcacatgtatatataaacccactgaatttcaacccttagacttcttagacataaacctgtggcattaactttagacactgacctgtaatctgcttctgcttcctcaccattatcccttcataagtaaataaaaccacatacacttttaaaaaatttatcgtatatatcttgctcctacaaaacctgtggaacacaccttatctttggaccattatcattacaaagcacctaacagtttgtagtgtatatactgggctattttaaaagtcatcttatgaaaagaaagtcttaaaatgcagaaaagtttatgtaaaatacttctatataaaatgtttataattcctctttttctttctagggatacctgattctcagactaaggtttttcctcaagataaagtgatacttgtaggctcagacataacattttgttgtgtgagtcaagaaaaagtgttatcagcactgattggccatacaaactgccccttgatccatcttgatggggaaaatgttgcaatcaagattcgtaatatttctgtttctgcaagtagtggaacaaatgtagtttttacaaccgaagataacatatttggaaccgttatttttgctggatgtaagtatatgattttaaagagagaattcctattaacctgttttggtcttccttgaaagccttaattcttctggagtgggggggtgggaggagtgattctgtttctttctcatttctttgttctttaatataaaggctatacaaaggcactagaatatttgcttgttttaaaatgaattgcaagcttgttttccacataacctgtatctgtgtaatttgttggttttgtaatcagatttgaaacatctagcttctaatgtttagtttaaattcttagttaacagctttgttaaggataggatataatatttcttaaccctgcattgtttagaaattatgtgaattcattttccagttaaagtataccttttttaaagtatctaaattaaagaaattatagcaattttacacaaaatctttcagtagcataacatatcttctccatcttttaactattatatttgaggagaacaggctggcaggaggacatgggtgaggggaaacatactctcccactgcgttctatatatgttgtatgctctgtcattcaaggtgtctattaacatgatcaccccacagtctaaaattccatggtatttccaaaagtagtttgttgtgggctgccctgcccatgtggcttgtgttgaatgtccacagataaatatgtagaatttttaggtctcaattttagtttttctgcctcccttccttgtagcaactgtaatgttttggtgtcactgacagcttcatctttatcagtgagtcccttcctccctttatgctgaattagaagtctgggattttggtctaaaggtcgcctgaataatgtgtataagatagattgactagattttatgatatttcttttgattccttagtgctttttctttctttctttttatgattctcagctgtggtctagatcagcagctctctcgtttactcatacagtacttcgtgatgaatttcattcagatactgatgtattcccaaaggaatagccgggtttaggtgctcgtctcagcttgatggctgtaatctgactctctttttgtctgctcagtaatgcatttggaattcaagtgaaagtgaggttatgttcaaatttaaatcctggaaatcatattatccttcttaatggaatgttaggaaattacttgcaacatttctcacaaatagtcctggagtctaagttgagacccagtggtatatgtagtgaagttgcttcgtgagcagtaccaaaagtgagctattacttaaaagtatgaaagaagaaattaaaacttaaaaaatgagactgtgcactgtttccatttgtgttatttcagacagtgttgtaatcttttatcatagtaatagaacaagctaatttatagtttaaccttcatttataacgtttggaggttgaaatattgtacaatatttgttgagcagcagtaacatctcccttcagagagaacttttaggaaatttataagagcaggttatttcgtgagttaggtatcaggattcatttatttcctttctttatggatatcctgttaagccaccatttacggaaaagactgaaaagaaatttaggccgggtgtggtggcttacgcctgtaatcccagcgctttgggaggctgaggcgggcggatcacgaggtcaggagatcgagaccatcctggctaacacggtgaaaccctgtctctattaaaaaaaaaaatacaaaaaaattagctgggcatggtggcaggcgcctgtggtctcagctactcgggaagctgaggcaggagagtggcatgaacccaggaggcggagcttgcagtgagctgagatcgcaccactgcactccagcctgggtgacagagcgagactccgtctcaaaaaaaaaaaagaaaaagaaatttataatcggcttgttagtttttccctacacacacgtctgcgtgcacacacacctacccaatcaaaacctgctggcgttttgattgggattacattaaatccgtggatcaatttaggagaattttcattcttacaatatttgtatctcccaaactatgaacatggtatatccctacatttacttgagtcttctttaattcatcttaatatgaggtctttatgtcttttggtaaattttttcctagtgctaggtgttttctgatattattaaaaatgactttgttttttaaattgcattttctattgactggtatataaaaatgtagttgatgtatacctagcttttaacctagtagcttcagttgattattttataagttaatttctttgaaaagaaaattagtacatttcaaatactgtcctctcaaatttttccccttctgtctgtccttctatttatctcttatttgctcttgttatttagattttaatatttcaacttaatatctaccaaatcctaaaataaccagcattttaaatatattccatatttttggtatgtggttttaatagagtgactgaatatttggccttagatttaaaacaattttcagaataaatatgtcaatgtttgtttacttatctaattgttaaactctcatataaacactcattaatcctcttaatgttacctgaaatatcattgaaggatgttatccttatctctggggaaggtatgaaattttccaagttttggttgataaactaaggagtattttttttttaattcagatttgtgaaaaaaaaattttacagaatttttaaacaagtagtttttttaaaaaagaacttttacctaaagtgaaagatagtttggataaatatgagagaggaaataccagtttctatatgtgtatggttaaacatgattacagaaatatgaatttctacaataagcagtgtcagactgcagacttttaatttatcacttttttttttttttttttttgagacggagtatcgctctgtcgcccagaccagattccagtggcacaatctgggttcagtgcagcctccacctcccaggttcaagcggttctcctgcctcagcctcccgaatagctgagacttcaggcaccctccaccacacccggctaatttttgtatttttagtggagacggggtttcaccatgttggccaggctggtctcaaactcctgacttcaggtgatttgcccaccttggcctcccagagtgctgggattacagatgtgagccactgcacctgggctcatttatcactttgaaggtctcgtcttaaaaaaaaaaaaaaaatttcttttaatttttctagtcctgccttaaagctggggagagcagttttgataaagagaaaaacaacaaaagagccgcagtcagtttgtatatactgagatgcagaattttaccaagagttttctaaacaacagtacttataatgtattttagaactctgaaacatgtaacatgacttactgattttcaatatgatttggtatttcttttcgaatcacagtatattgatgatagatgataatacttttaacctgtagatttctctgacaacatattagactcaggtttctttgagagatttggtagcctctgaaataggattaagggaaaaaaagtgacaactgatatttcaagttgctacagggagtttccagatgagctaagagtcatttttcagtatattttaatctgtcaattctaatgtaatatgaactctgacaagacatgctacagagagaataattcctgcattattcaaaagtaaaatgtaaatagtaaattatttcattttttaggaaattgtggaaaacattgacgtttataaaatattatgttttcagggaaaatatatgtaatcataagtacctgcattttttttctgttagatccaccagatactcctcaacaactgaattgtgagacacatgatttaaaagaaattatatgtagttggaatccaggaagggtgacagcgttggtgggcccacgtgctacaagctacactttagttgaaaggtaatgataactgggaaaagatgtcagatggcaaggagtacgttggaagtgcatgttaaatgacatagggaactgcactagatcatttatgttacaaacaagatataaaaccaaatatgctgtataaaattacacttataagcactgcagttcagccacatgtacactcaattttatgtctcctcttttaagaagcttagaatgaagaacacttgaacatgaacagagactgtttctcggtagtaaacttatggctgattaatttcttctattttctgtatcacatacattttcttctctgagtatgtaatatgcttctaattagaaatttaaactttttatacaaattaagtattacgaatttgcccgttttttcctgcaatatttatctcttgccattttgaaattatttttctgttaattaacagtttttcaggaaaatatgttagacttaaaagagctgaagcacctacaaacgaaagctatcaattattatttcaaatgcttccaaatcaagaaatatataattttactttgaatgctcacaatccgctgggtcgatcacaatcaacaattttagttaatataactgaaaaaggtaagctgtacataaactaatgtcttaaaaataactttaaaagtggtgaaatgctttaatgaaaaatgcttatagggattactttttgctgattattttctttatagttacttaatattaatttcataaattttatttataaaaactttaaatgtataatttcaagttttactattttattgaatttaaatacttgaattagtaatttactctttctgataatttttgatttctgaaatatcttctgcccaatttttaaaaacttttattttgaagtaattgttgactcactggtagttacaataataagagccttgtgaacccatcccctggctattcccagtggtgtcatcttatataattctagtacaatatcagaaccagggaattgacactcttaaaacactgttaactagactactgaccttgctcagtttttatgtgcattcatttgtactcgtgtgtgtgtgtgtgtgtgtgtgtgtgtgtgtgtgtgtgtgtgtagttctatgcaatttataggtatagattcaggtaaccaccaccacatgcaagatacagaactgccctgtcactacaaaggaacttgctcatgttgcccttccagcatcccctgtacatacagtcacatccctgtgccttgacaacaacgaatctattcttcatctctgttttatcagtttgagattgttacataagtaaaatcatacagtatgcagtttggcattttttttttaaggatgtcctggagagccatccatgttgttgtatgtattaatagttcgtcccttttattactgattgcatttttaccaatcgtattaatatatagctccaaataaaaataaaatgtgcttggtctttttggtattcattcccatggtccatgtgcattaacactccatgtcaggctcacagcacactgagcaacggcctagaccttctcttagagactcaggcaggggagaaagggcctaaaccgaaggcatgtctcatacagtctcacagctgattagtagatgatcctgttgccttatttgtaagcataagtcacttttatcagttgttctttcctgtcgtctttgcgatttctggatttttcctagtgtcaccatggctacattttatccttgcatggtagtatttgtatgtatttgtctgccctctgccatttcagccttatttcccatgtgattctttcccgccactcaactgggcatacacactatcaccagtgtaatatgcagtttgcctcgctgtaccttcattattggcatctctgcctaaaatgcttttctgcattttttttggctaatttttgtctgattcttcctgcatagctcatcttaagttccatcttcactgtaagacttaccttaccatgcttacatttacatagtggttaatatctgtatcattcatttagaacttggcatttatattcttattaattacctttctttcttttttcttttctttttttttttttttttttggtcattccctaagtaaattagaagttccttaaaggtagatactgtgatcttaactacctttgagtattcctgacactaatttaagagctttgagcatgatcgattgtttaaaaatgttggcaagatgtcagtagtagaaattaggtttgtcaattccacaaatactgggtaggatgttgttggtcagcactaatgatgcctcgttgttttttatgttttcttctcatttgtcatattagaagatagtttttccctttaaataagtgtttaatctttaaaaattatatttgcagtttatccccatactcctacttcattcaaagtgaaggatattaattcaacagctgttaaactttcttggcatttaccaggcaactttgcaaagattaattttttatgtgaaattgaaattaagaaatctaattcagtacaagagcaggtaagattctcttaaagacttcctttgtgattattttggataaaatagttctcaaaaagaattaagcaaattgatatgcttaagctctcagattatttattatagagatttactaagaaccaagaaagacattactatccatgtaataacagcattgtatcatttgaaaaacaattgtaaatatgacttttactcctcagaatgttcccagatgcactatagtacctggcacatagctggtgctccgtaaatttgtgaatgaatgagtagtttttgctgtaacttttagcatcattaatggatgaattggcactagacagcagaagtgattttttaaaactgtgaagtgtggcagtgggaacaagctgtaattggtacttaaaagtcacaacatgactttttaatacattttaaatatttaggttgacttttatattatactatcttgtaatttgtggtaagtctgaaataaatgaggtgtacttaactattcatttggaaatttactgatgtctagaaaatcagtcacaactgtaaaatataacctgaaaaccttctttgtaatgttttggggagctcagaggcttttgtgaaacaggcagatattcaaatttgtttagaaatgtttcattttaactatatttacttagtttaaggaagtatttgttgaatatttgctacatgtttagcatcatactagaagttctaagtgtcatattaacaaagatgcacaaaaggtaatgcctgcctccaagaaacttccaaatatcatccaaataatacatttattcctcacagtcatctcaaattataaatcacattaaggtttattgcatcaccattagccctttgattatcaaaattatataatcctttagataatttaattgaccattattacttagagccagtatttggattaaaaagataacccaattttttattactattacagggcataatttcattggcttggcaggtatataagaattaaaatattacagtggataaactgctttgggtgttacatatacaaactcattgacattccgttggtttgtgttacaaatgtgaaggctttcttaccaaaaaaaagtgtatgtatgtgtatgtatatatatatgtattcatacacataatatatacatatatatatatttatttgttttccaatagcggaatgtcacaatcaaaggagtagaaaattcaagttatcttgttgctctggacaagttaaatccatacactctatatacttttcggattcgttgttctactgaaactttctggaaatggagcaaatggagcaataaaaaacaacatttaacaacagaagccagtaagttaactaagtgatgtatggctaataattactgtgtattctgaagttttacaacttctttaaaaagaagatgttggccgggtgcagtgggtcacacctgtaatcccagcactttgggaggccgaggtgggcagattacctgaggttgggagtttgagaccagcctgaccaatatggagaaaccccatctctactaaaaatacaaaattagctgggcatggtggtgcatgcctgtaaccccagctatttgggaggctgaggcaggagtgaatcgtttgaatctgggaggcggaggttgcagtgagccaagattgcgccattgcactccagcctgggcaacaagagtgaaactccgtctctaaataagaaaaaaaaaatgctattagagtccttaaaggtgggggaatgtttagataaattatgtaatacctgctaataaaatatcacagatattttaaatgatagttttgaagttttgtcatagtatagaaaaatgattggcataaattatgagaaagccagggctcctctatctatactatgattgccaccatattacgataatgcatagaatgatttttctcccattcttttctgcttggaattttaattatgcttttaactcattggccttttttttaaaaaaaaaaaacaattactaaaaaagagaatttgttagtttttatttgtgacctagacctgagaaatgtggctaaaaggtcttgaacttcagtttctgtagtatacccaggtcaagttaggtataaaatcaggtaactggttttctaaatatgataatttccaaagacagaatgatattctatcttcgaataaccagatgtcaggtgtaaaaaaaaaaaaactcagaaataggtttaattttttatttttttgagacagagtctcactttgtcacctaggctggagtgcaatggcgcgatctcggctcactgcaatgtccgcctcccgggttcaagtgattctcctgcctcagcctcccaagtaggggccccaccaccacgcccggctaatttttgtatttttagtagagatggggtttcaccgtgttggtcaggctggtctcgaactcctgaccttgtgatgtgcctgccttggcctcccaaagtactgggattacaggcgtgagccactgtgcccggccgaaataggtttaatttttaggaatcatttaacaaaagatagcaaaagctttatttatattatgcagtataatacttcctccaaaaatttaagaaatagcaaagcaaataaatgatagatgttaatctagatttttgcctctccacatgaagacatgtgaagaatagagatgagggcattttgcgacatgtgtaagaattacttgtatcatcaaaagtgaaagctatgcatgagtacagagagggaggatatgagttatctattgctgtgcaacaaattaccctaaaattcagtggcttaacacagcagatgtttatgatcttcccatttctatgggttaaaaatccaggagcagcttagctggatctctctgacttggagtctttcatgaggctgcagtcaggaatgtgggtggggactgcaggcttcactggggctagaggatccactttcaagatggttcactcatgtggctaaaggcaggaggcctcagttcctcaccttgtgggcctctctctaggcctgcttaagtgtgctcatgacatggcagccagttcctcccagagccggtgactgaacagtatcttttatgctctaaaatcggaagtaacataccattatgtctactgcacactgttggtcacacaggccaaccctgatgcaatgtgggagggcaccacgcacatggggattattggtcattttggagactagccactgtagtttttgccttcagttaatgagctgttgtctccaagaggaaacatcttatttgcacctcattaagatgaaggcatcaatttactcaacaaatatttactgagtatgcattacagattgaacatacgtaatctgaaaacctgaaatgctccaagatccaaaactttttgagcaccaccaggatgccacaaatggaaaattccacacttaagtacttaacacaaatttgtttcatgcacagaattatttaaaatattgtatgaaattaccttcaggctgtgtgtataaggtgtatgtgaaacataaatgaattttatgtgttcttggatcccatcctccaagatatttcattatgtatatgcagatattctacaattagaaaaaatccaaaatctgaaacacttttgctcccaagcatttcggatgagggatactcaacctgtatgtgtctggaattgttctagttagcagtgatatagcagcagataaaacagagatctcggcctatggagtttgtaggatccaggactagaaataaatttatatatatacacatctatatgtatgtatgtacacacacaaacacaaagacacagacacatcagtttatcagctggtgacaaatgccacagaggagaggaagtgataggaatagaggctgagggataaggagggggtgaagggaatggcagttttaaatagggtagttagaaaagacctcactaataaggtaatactcaagctgagatacaaagatcaggaagcatgccatattgtttttatctaggagaagagagttgtaggcagaggaagagagggcacagaagatgcagagagcctgaggcagttgtgtctttggcatatctgagggacagccaggaagccagtgtgtggccaagaaaggagggagtgagaggatgtgaggcagaggggaacccagggaatcagtacagctggcctgcaggtagattttcacccattcgagggggccgtgtgttttgcaaaagttgttgagagcttagattttccattgcttcattttctaagtggaagccactgaactgcttcacgttttattgagaattccaaacatcctagaaaaaaaatgccaagcaccatatacatatagtatgtgtcttcagatattaactttaaaatctcctttttaggtccttcaaaggggcctgatacttggagagagtggagttctgatggaaaaaatttaataatctattggaaggtaaatatctaatttttctgtgaacatttacattactttgctaaactgcttaacttacgcatggtacttgggttatcaaggagctgaaacttcccagactggcttttgttgcaatattggtgagaatctaacctggttcctaaaccccccaaattcctcgtcactcctaactccccacagtcatttgaggatctcctgtgtcagatctgagccttctcgagtttgatcttataaggcctgtaaaggacctgaagatttcatgaattccatctccctcacttcagtcaaaatctgtaggttagaatcctaagtgtttgttatatttttttctattaataggaaagtaaatttttatatacttcatgtgtaatttatttcccttcaataaattgcattataacatgccagttataaagttttgtatgattttgtaaagtatttagatgaaatatgaattgcatattttactaatttttctctgctggaacattttttgttgccatatttttaagtattttatgaatatcaaaaacatgaacaattgttttctatattagattttacacaagcagtcataataggattcctttaaatagtgaattttgttatggaaagtaaaacataattttatttaaaaaaacttttgacgtcgatacagctttgagtaaagtgaagtgtacatgcaggttcaatgtgagttccattgctttgagattgtatttgactgttacatccactcttgattagaaaatcccccagctactctcagttgcctgtcagatttcatgataatatagcaacgattatacaatttacttcaatatacgaaagtttgaaatattgttcaaactagacgaaaacttaagactaaaaacattgaaatgatttagattctagcttcattatctatgctgatggtgccgccatttgccaagtcagagtgtgttcgggtagaaattatgtagttttggtcatagtgagttttcagaaggtatgccactgggatatcatgagtagagttcagtaggcggtttgatatatgtaaggctctggagctcaggggagaggttggcactgaaaacagctttgagtagcatataaatgggatcacttggagatgcaaggtgaaaagtgggccagggatggagcccaggtgacagcagcatgcatagaaccagcagaggaggaggaaccagcagaggagatggggaaggtttagaggggcaggaacaacgaagaaaatagaattagagaagctgggggaggaggacatttcaaacagtgtgtggtctggagtatcccaagaagcccataagtcttaggactaaagcctgccccttagagcaggccatttggagcatcacagagacctctgctggagcagagtgtttcgcagtgttagatcatcctcagtcttgaccagagagccccatacattggtgtataaattaaggcagttgttatgaaaagcagttcagtataaatgaagaggtttgaatgttcatttgtttttatacagtaagttcacttttagaaattcatattaaaaatttctatgaaaaagaaaaaaagtggcacaaaaaagttcaccaaaatatttgttttagtattgtgaaaaattagaaacaacttaaatttcatttatttaagggatattcaagtacactggtaaaaatgctacataagacataaaaccatgaaaatgtatataactgtattatggacaagcgtatattagcatatattatggaaaagtaaaaagtaaaatggtgtaatatgattaaaacaatgttagtaaaaaaatctatacctagaaaaacaacttgaaagaaatatcaaaatgaaagaatacttaagaggtgggaatatgggagatttttacttgtttcaacttctatatattttccaaattttctgtagtgggcatgtaatactttaaaatgagaaaacaaatgtttagaaaaaaacccatgatgctattttttaaaatgttttgtttgttgctaagtagagcagtgcttctggatagttttaaaagttttgctcctgaaaaatgtggagataaatattgttttttattcacttaatttttaaatttttgtgtactcttactgcttatagcaagtatagtttttcttcagtgtctctttcctgatttaccctgctcccagtggattttaaatctgtgttttacactgttgagagattcatttttgctgttgttgttgttgagacagagtctcgctctttgaaccagtctggagtgcagtggcacaaactcagctcactgtgacctccacctgccaggttcaagtgattctcccgcctcagcctcctgaggtgccaccatgcctggctaatttttgtatttttagtagagacagggtttcatgtttgtcatgtttggcaggctggtctcgaactgctgacctcatgatccgcctgcctcggcctcccaaagtgctgggattataggcgcacttggccagcttcatcttttctgatactaccttgtaactggttgttttttgtttttgagatggagtctcgctctgttgctcagactggagtacagtggcatgatcttggctcactgcaaccttcacctcctggcttcaagtgattgtcctgcctcagcctcccaagtagctgggattacaggcgctcaccaccacacctggttaattttagtatttttgggagagactgggtttcaccatgttggccaggctggtctcgaactcctgacttcaagtgatccacctgcctcggcctaagtgctggaattataagcgtgagtcaccacgcctggccaaccttgttattgttaatatagtgtccagtttaaacccaattaccttgcctagtcacagtcacgttttgcagggttttataacaatttgtctgtttttcatagcctttacccattaatgaagctaatggaaaaatactttcctacaatgtatcgtgttcatcagatgaggaaacacagtccctttctgaaatccctgatcctcagcacaaagcagagatacgacttgataagaatgactacatcatcagcgtagtggctaaaaattctgtgggctcatcaccaccttccaaaatagcgagtatggaaattccaaatggtgagtgcttgagatgatttagtatataagaacgggaaactaaagtgagaaatgtctgatgttacttgctcttttgtcatgtcagccttcttctcgtataccttgttgctgctgacctagaaggcagaatgagcagattgatgtctacagttcattgagaaagaagtcattagtattgacttgaagcatgtgcactgatggatacaatcattactgtactcagtaactatagtggataatattggagagttacagtggtggatagtacttttaggaagaaatattttaagagtttattcaaatgatattcagacgcttctccaagacacttccccaagactaggaaagtttattttaggtcagctaggctgttttgcaaattgttgggcaggaaaaaaaaaaaacgcttattttaattagcaccttttttgataagaaattccttattaatagaaattctttattgattaaaaaaagtcttcttaaggtataaattagatcttcaatataggccttagaaaaacaactgtggtgtagtttttaaaatttagtgcctttctttaaattttacagatgtccagtgattaatacattcttcccagcttctgccttgacaactttgagagttatgagctttaaacggccacttccacctcttcttccacagacctctgtgctccagtcattttctgcctacccacctttgctctcttgccccgatatgggagcacctttctgtaaccacagctcctagaggaagaaaaattggtccagttagggtcctctaagtagctttccaactccagtttgaggctgtttcttattgttacttgactgcatctttgttctctttgagtcagtcataggagaattaggaggaaggaagggggaaaacaaagtgcatttcagagatacaaaccccaggcagcagtgctgctggagatgcacaggggttgtggcaggtgctgggaggaggggcttaataatggcttcttcattttggcctggcaaaaataacaaaataaaaaatgaaggagacagagatgtgaacatccataagaagataacatactgatttagattatatgtttcattgcactcacaatgctaggcaatagctatgttgtcttttaattcaggaaacataatcctaccttttctgtgtatcccttagaaaatggtaatttacagaactagcaattctgtcatcagcttccagacactttctgaaaccccagaacaaatcctcattccttgaggatttcccgagtggagggaggctctgcagcctcaactcaggtttacactgtggctttttaatcacgttgagcaaaaaaagctgttatgtccgaagtgttctctattctcagccaaattgttgtcttgcgtttagtagtagttgctttatgaatgtacattttgttcaaaaaacttgtctgtgtttatttttactgaacccttaaatataaatcagttatagctattagttactttctcctgttacagtgggtaatgtctgtgttggttttactgaacgctctctgtagcctgtgggtgattaagtactctcccatggctgcatcccgtcaagggccgctcacctgcagtttgcaggctcctgagcatctggctcctgcgacaattactcgtctaaaaatttattcttagaaacctttctatgtttgtttttactgaacccttaaatacaaatcagttataaaatctacctcttttctcctgttacggtgggaaattttcttctcccttttgaccacactgccctatcttctaccccaattcttcacccccagcctggggttccacttcttacctaggccaagatctggcaagacagggaaacaaaaccttgccagggcctctgcgcctgtcttctgccctcagcctttgccccttgccccttgccccttgccccttggtgtctcctaggacgctgtgcagacttctccttctcagtgtccacactggccatcccacctcatcgcctctgggtgtctccacagctttctcccttgcccccaccctacccctggtcagccagacaaccccttcagcccagctcttgggctgcagtcttcgttgaaagaaagagggggctagttcttctgctgtttccacaagtttgttgtgtgcctactctgcacattgtactgggccccgcttgttctctgcacgcattcatagtgagtgatgagaggagggcttcagactgtccactgtcccctccccagtctccctctcccaccctgtcccagccagtgtccttagctgcgtccttcctgtgccttgatcttgatgtcctagtcccagtatgtcactacctgatcctaggcgctttttaaaaacgactttctttgagctgctgtgttaatctatgtatacaggtaagtgctacagttgttaaaatgaaaataacagagcaacacttctaatctttgctctaggtttatctagtttgagcactattttataatttcttcacaatgaagtgatttttctaactcatgtccatttttatgagatttgccttatattattgtttttaatgccagtaaaatatcctcctttcttattgaagatgatctcaaaatagaacaagttgttgggatgggaaaggggattctcctcacctggcattacgaccccaacatgacttgcgactacgtcattaagtggtgtaactcgtctcggtcggaaccatgccttatggactggagaaaagttccctcaaacagcactgaaactgtaatagaatctggtaagatgaattagtgtctctcaattaagttctacaaaatatttttaaaaggcaacacgtaagactgggtgcagtgaagtgattctctttactgctggatgggtataaataggtttgactttcctgggagggtagttgtggcagcacatggaaggatccaaaccctttgatctggtaattactggtctagaaatttattcttagaaataatcagagaacaacacagatttaatctaagaatgttcatgacagtattattgataattgtgaaaaattaaaaacccaaatagcaaataagggaatgagtaaatgatggtacacctataaaatggaatggtaagtaacattaaaaattatgtggaaaattaaataaatgttcatgaaaaaaaaaaactacggaactgtagcctggtctcacacaagggcctttgccttgtttgcccagggtccaggttaccaaggttagggagagactgagcacaaagaccgtgaaccccttaccacttaaccctgatgcagggcaagggggcatcggctggactgagcgcagtgtgggtgggaggccttgcgttccatgagcctgatgctcaggagcttgtgagctgccggtgagtgtccctctatgggatgcagcctgagaagtttttccacagaggagtgtttaataacctacaggctaatccagccttgtccttaggaattagagccctctctgcaatatcatcgttgttttcctggcacaatgggagtgtatcctgcctgtccccatgggatttctggaccctgtagcttgtcagtagtgatgcttcgtgatcattcctgtctcctgcctccctcgcgtgttagggaagtgcagaagagcaagcagcctgctccttacctctctctcagggaacactttctacttgcttactgtttctctctcagatgatgaggatgggtcccattcattggattatcatgtatgagttcagattattttccagttctacttggaatacagccaaactcctccacatgtataattggctgaagtggtaatgatcttcctgagttgttccctttatccttccttacagtgcactgtacttatcaaggacccagccacatgctacccttcttttcctgcaccttcccttccatcccctcccatgttgctgaatgagccttacacgattccagtctgtcctttctcacctgagcttttagaataatcaggatggactgggataggctggagtggatataaatggagtatctacccatttaagttttagctgagacctgcaggatatggggaagctgccccgcgatgattgtgggaagagaactttctgtgccaactcaattgaacaaagacacaaagcttgagaaaacaaaaactcagagaagttaggtgccttttccaaggtcacaaaattagtatgtgatagaacccaggttcaaattcagagttattcagagcttcaagaggctgggaatattgtcttttatttactgctgagcttctggaacagcaagtggcacatagtaggcacaccttttattcctctctcatcctgttctctactcattaagctgtccactctcttttttgaccttagcacattcctaatgctctaaccttctcagcctctttttttaaagtgtcagagccctataaaatattgttaataaataattttaacataaaaagaggtacagatttacagatgtacatgcagtataaaatgataacctcaagcatacctttctccaaagaaaaatgttgcaaaactaaacacagttggctgagcttgagttgcattactgcatacttaggacgtgccagcacataacaaacgtttaaggaaagtgattacaagaagaaaagttaatattttagacaagttgattcagtttttcttgggttgtatgatgttagaagttgactactgtctcaaattggagcctgtaggccactggtgttttataggcacttgattggagaactaatgctttaaccacaccagaataattgcattctgcaaattaaatgcaatgccatatgctgccaatcccccctgcgtgtcccccggcattatcttctttctcgaccaccactgatgagcatctaattgcccttcaaggccttattcagatggcccttattgtagctgtttctgatctttttagactcatttggcccctcacttaagattccatggcatctgatacatacctctaatataacacactgttatggttacccttgttcgtctgtcttccccaccactctgcaagtgtctccatgcttgacgttttgtgcatgtctgtgttgctcacattgtacacattgcattgtattcaggagacatttaaaagcagccttttgaatttaagttaaggtacttcaattggaagtacctctatgtcctgtggagttaattcaaagtatttctatatcttgtggagttaactcacccaaggacacttaatggtgatgttataaagaggaataaactctaagacctaattcctttaacactgaagcttcaaggcagagtgcaacttttaattctgcttcttggaacaagaggagagagcagtgggtttgtttgctttttccaactcagaaataacactaggtaaggaagggatttatagaggcatgatgtggacctcgaatgaatggcttagtgaactgacccaggaagttgatgtagacttacattttgttcattaaaatcaagcagttgccagcactttgggaggccaaggtgggtgggtcacgaggtcaggagtttgagaccaacctggccaagatggtgaaaccctttctctactaaaaatacaaaaattagccaggtgcggtggcgggcacctgtaatcccagctacttgggaggctgaggcaggagaatcacttgaacccgggaggcggaagttgcagtgagctaagatcatgaccctgcactccagcctgggcgacaaagcaagactccgtcaaagaaaaaaaaaaaaaaatcaagcaatgatgatttcttcctggaaaaaggaacaaaatgtaagccttaaatcatcgttgttctcttcaatgcaatcccatcttatattactaaactttttgttaaaatagaagtaaatttaatttttgtttagtcaattttcttttgaatatttactagtctttaaaatatatatgtattttttaataagaaaacatctttaaaattagctttggaaattttagagtatgttatgaacttgatgtttctaaaatagatattcatagtaatatatttatgaaagtttgctgatatgttcatcctatagatgagtttcgaccaggtataagatataattttttcctgtatggatgcagaaatcaaggatatcaattattacgctccatgattggatatatagaagaattgggtaagttaaatgggtacttatttataagagctcaaggcaacatgagaaattataaattggcaacaatggtatgattgaattctaaaaataagatgtataattgaaggaaggtaaaataatttgataaattaaaaagtatttgattactacttttttctcctcctcctctttttttttttttttttttttttttttgagagagggtcttactctgtcacccaggctggagtgcagtggtgagatcatggctctcttcagcctcaacctcctgggctcaggtgatcctcccacctcagcctcctgggtagctgggactacaggtgcatgccaccatgctcagctaatttttttttttttttgtagagatgaggtttcattatgttgcccaggctggtctcaaaattcctgggctcaaatgatcctcccacctcagcctcctaaagtgctgggattacaggcatcagccactgcactgggcctgcttactctgaaatcatttgttgaatgtttacatttcacaattttactcgtcctcaggaaaattaaatctgaacttggatgtcaaaaatatttaattagtacttttacaagtttaaaaaactattaacttcttcaggactatcaataaagatgtgaaatacaaatgaagtctatctgaatagccactgaaagattttgcatagattgcttccctagatatgtgtttgtctaaaagggatattgtaagttctacctttgttcctaaaaatatttttgtctatggttattagtatgtaagcttcacaaaaaaagcgtttgtgatcatctctctctgaaagtttatgattaaataaagttttaattccaagttgaattatttttgaggctagaaagctcaggaaacattactgtattactctgtattcatacactcccctttagcaattgactttttccttttacagctcccattgttgcaccaaattttactgttgaggatacttctgcagattcgatattagtaaaatgggaagacattcctgtggaagaacttagaggctttttaagaggatatttgttttactttggaaaaggagaaagagacacatctaagatgagggttttagaatcaggtgagtaaattgatagcacaaggaaagtgtttcttagaagtttctcattaaccacaacagaaaaaaaaggaaagtcctgctcagtagtttagtactggttttcaaaactatctgaaagatagagaaatgaaaaggcagtaattctatgaatataagagttttaagattttagtgtgcaataatgacatgtatagtctttcagaaatcatttaaatcatttattctgaagccgttgattataagcctcataggacagaaaccatctcttattagagctgtacataatccataacaaggcatctcatgaagtttacttccaaaaagaaatcttttacttacagcagtggaggagaaaaactcaggaatccaaagagttagcttcagatcctcagttgtaatttgacaaaaaaccattggcctattagcgtcttagccatgcccttgataagctggaaaacttaattgacttgattggggatgtattaaaaagtacagacaatccttggaaatcggcaagtgtacatccaaagactttagagaattctcagatttacaaatacaaaattgtacagatttctggcttttcctttcattatgtttctgctgagaatcagatatttcttattcatagctgcataacacaagcatatcatcttttcagtttgagagctttcatgtccctggatgacctcgcctcagaaagaaatcattttaattatttaatgcctgtctgagaaatagagaactccaccacggtatggcagtgctggccgagcactgtctcagtcactccctagaacacctgcagaaagtgtgtgcctccccttcggtccccaagttctgcatttcctgaaccttcatgattgctggtgaatgagggacatcctgaatatcaaattccacaaacatccagagcctagtgtgacttgcctcacatgcttggaaattttacacttgaaccagttaaaattctagcatctggatttccagtgagacatggtagatgggtcactaaagttagcataaagaaggggaaacacccccaaactctaataaagccacaaggagagaacagaagaggcaaaacaacactgaaaaagaagattcagaaatttgtgggtggaagtggggcaaatgacttaaatgagtggaagattgtgaaatctgtgtgggcagtcaggcattgttgagaaggaacttctccagtacctgccagaccaggccttggaggctgagtggtgaggatcaatctggtctgaacggaggggtcgattgaagaacgttccttagaactgaagggcctaactacaagcagatccccttctccgctgtttcacttaccatggtttcgctttctgccatttcagttacccctggcaaaaagcagtctgaaaatagatgagttcagtacaataagatactttaagaaagagagagaccatatttacgtaatttttattacagtatattgttataattattctctgaggaaaatgggcggactactgtatatagagccaaagaattcattaaatacacagcaaaataaatagaaaaaagatctatgccaaggtatgtcattatgaattttccaagcagctaatgtgaaagaaatgatcagagacaagcaggtcatgtgcaagcaatcaggaataataatggcaatagacagcccagcaacactccagatactagaagtctcttcaaaatactgaatgaaaattattttcaacctaaaattcgatactccaccagtctgtcaaccaacgtgagagagaaatgcagatattttgtacatgcgaggctgcaaacatttactttccccatgttgcttttctcaagaagctactagaagagtgcatcctaatgaggaaatgaagtgaggccggtccaggaagccacaggggagagagagcagggagctccaggagggcctcagccctgaaggcatccagtctagtgcaggaggcaagggatgggtggaggggagggcagagaagatgtggacctgggattttgttgtgtttgaccacgtggaaaatctgagtgtacattggaggatatgggaagaattattgactggtatgtagaaaatcaagcaaatgagggaaaaagcagttataacaatgggaaaacaagataggaaacatgatgacaccaagcaatgtgtcttagcagtaactcatatttatataatcatagtaatccaaacactgaattcatcaaaagttccgatgtttctatacgaatgatgtggtgggggaaagggtgatggtagcgtaaaagagctctatctttatctgcccttataaagtatgtgtagataaggtctaatagttaaaagtcacatctctctaagtttgctactttggaatatagagataaatacccaaagaaacttgattacatggcttttacagtggttgtagggggcgaggggaggagctggtagagaactgtcactttttgttagtaaccatttagtactatttaattttttaacctgttatcctgcattattctggttaaatttttaaaaataaaatagtagttcaaatgattcctcactcttccttttgaagttataacccaaaggatttctcattagtcttatttgagagtccccatcacactgatcctttttctaagtggtttggagtcatctctattgatctgcaggtttgcttcatcccatctttcactctcactcatgggaaggctcagcctaagtggcttttggttgtggtggttttcatgcttttagtagcagaaatgggactattattgattgcctgctgtgtgccaggcattatgctacagaatgtgtgtgaaaacttcaaacagcttaagtcatgatattctatttcatcagtagaaaaactccacttgagagtggtttaaataaggggcccatacgacacagctaatgactggcgtgggggtagagcttgaacaaggtagtggcagctccagagtccttggctgggatggcctcagctagacccacttagaagggcagttggtgagacaggtgtgggtaaccatgcatttgaaacgggttagagattagtgctaacatacttcattttaaaaataggtcgttctgacataaaagttaagaatattactgacatatcccagaagacactgagaattgctgatcttcaaggtaaaacaagttaccacctggtcttgcgagcctatacagatggtggagtgggcccggagaagagtatgtatgtggtgacaaaggaaaattgtaagtttcaggttgctgttgaggtgctttccatcctgcatgcgtagtgttctagtgattcttggtttatgtaggaacccctccccgccctttctaaaaaacattcacattttgttgcagtttttggctggtagagggaagggttaaaaagctgtaagattacttcatgtttattcttgtcagttatttgaagttatttccaaatgagtacctaagaaattaatgaatttgggatacatctgaagtctagaggtctaaagtcatattgaatttatctaacggtcaacatttaaaaatattttgctccagctgttatgtgatttctaacatatctagggaaaagtgaaggagatattcttaaaaaaattttttgtaaagcacaacactcaaatttgagagaagagtgatggccttgactatctttctgcggtaaagaacttcacttcgatcataggcttatcctctacccctgagttggagttcacacacagctcttatataaagagccatgaggatatggttctataaagcagtgattctcaacggagagtgattttgtcacctaagagatacttggcactgtctcgtgtcatttttggttgtcataactgggggatactgctggtatctagcggtgagaggccatggatgctgttaaacttccagtagtgcaaggactgtctcccctgatcctctagtgaagatctgtctggcctaaaatgtcacaagtatcaagattgagaaaccctacttggaagagtttaagtatttgtataaaaattatcacaatacctgaaagtttgattttaatagtttttcagtgtccctgcagcagttaattttgtttttttcctaaataatttaccaacctaaataccttctaacatacatctattctgtacttcacactaaaaatggcgattttaatatttgcaatactctcgtttcagctgtgggattaattattgccattctcatcccagtggcagtggctgtcattgttggagtggtgacaagtatcctttgctatcggaaacgagaatggtaatagttctgcatttactcttgctgttttcttcttaaaggcatgattataagatttgtaagattagtttatgtattaaataagtgtatcttttttgttgtaataagttagttaaaaaatgttttaattagaattaatgttggatttaatattaagaacatgacatattatttaaaggtcttaatagagtcaatgtgtaaattttttctactatttttcctaataatttaaagtcatagcagttactattataaaaaatatttataggctgaaatatggcaatagctatctacaagattaagcataatttaatgattaagatctcacttgccctggtgacctatttagaaaatctggtcattttaatcatttgctcatttattcaacaaatatgaatgacctcttccatgtgaagggggatatcatatcgtggtgcacaaaacaagccatggctcttatagacttggagcacagtgtgggaagagggacagtaaaccataggcatccagcaagtgtgtgcttgcagagtgtgagtgggtgctaggaagactgaaccaggtaccctgaggagaccagcagggggctacgtcctgcgagctggtcggccatggcccgtcacggctggtctgcggtacagttccaaagggtaaggagagggaaaagaatgttacagacagataattatttctttgagggccctgaaattggaaagagtcaaaccttcagagaaagtgggaggagctgtgtgcctggtgaaacaggaatgagtgacatgaggtgaggtcagcgggagctccgtgggagagagggccatgtgcatggtcacctggcaagagctgtcctggctgggtatggagccagtggctgcattcatgcttagaccagtcctcaccgaccttaaaaatgccatcatttatgacaagagaacatattttagcaatcctggcttataaatcaaaatagtaatagttgtagaactatagaatagtctattttggtaaccatattctcattaccaaaattcacatttttaaaacaactattaggccgggtgcagtggctcacgcctgtaatcccaacactctgggaggccaaggcaggcagatcacaaggtcaggagatcgagaccatcctggccaacatggtgaaaccctgtctctactaaaaatacaaaaaattagctgagcatagtggcacgtgcctgtaatcccagctacttaggaggctaggaggctgaggcaggagaatcacttgaaccagggagttggaggttgcagtgagtcaagattgcaccactgcaccccaccctagcaacagtgcaagactctgtctcaaaaaaaccaaaaaaacaaaaaaaacccaactattaaagtaccaaaaaaagaaaaaaaagacaaaataagaagggagtttagaagttacagcgtttcaaactcacattaacaaagttattttttctgtaggaatttcaagtaatacagttctttttagtagctataaatataaaaatatgataggacactgagcaaatctcatttttggttgcgtttagttttcggtcaagattaatagcctttttcttagcacagcctgcagtgtactcgtgacacgtggctatcacttttatgaccacctcggtaaaggcaaatctcatttttggctgcatttagtttttggtcaagattaatagcctttttcttagcacagcctgcagtgtactcatgacatgtagttatcacctttatgaccacctttttaaccacctcagtaaagcagtgccatgggatcacagctgttcttacatagtccagatcctttggactagatggcacagccacaattttaattacttgctttccattttcatgagatacatgggtattatagttccagaaatggaattctgtttatggttttcaagttggaacctctcagtgcattgtatagacagctgtagtgaatgatcacactaaagatcttccattttaatctcagatgtgcattaaaggattcataaatacttcaaaataagcctaatgatttattaatttattatctaataatcttaaaactattaaatttactgtaataattttttatttaaaggattaaagaaaccttctaccctgatattccaaatccagaaaactgtaaagcattacagtttcaaaagagtgtctgtgaggtaatcttttattttcttatatttatctttgatgtgctggcttctttttttaatcttttgtgaaaagtttttaacatgcaaatgtcattttaattaaaaagtattgggaaaattatatactttaaaacatctcagtttctaaaattattaattttaaattatacagtgctcttttttctcccacaagtattaataacaaggaaaatactgatacggaagaaaaaagtggctgtgctgttgtgtgaaatacagagtagtagagacacctgtttacaagcagattggggaaaaatgtgtccctttttataggaggagcattgcaatggcatttagtgctatttttaatcactgtgtttaaatttatttctagggaagcagtgctcttaaaacattggaaatgaatccttgtaccccaaataatgttgaggttctggaaactcgatcagcatttcctaaaatagaagatacagaaataatttccccagtagctgagcgtcctgaagatcgctctgatgcagagcctgaaaaccatgtggttgtgtcctattgtccacccatcattgaggaagaaataccaaacccagccgcagatgaagctggagggactgcacaggttatttacattgatgttcagtcgatgtatcagcctcaagcaaaaccagaagaagaacaagaaaatgaccctgtaggaggggcaggctataagccacagatgcacctccccattaattctactgtggaagatatagctgcagaagaggacttagataaaactgcgggttacagacctcaggccaatgtaaatacatggaatttagtgtctccagactctcctagatccatagacagcaacagtgagattgtctcatttggaagtccatgctccattaattcccgacaatttttgattcctcctaaagatgaagactctcctaaatctaatggaggagggtggtcctttacaaacttttttcagaacaaaccaaacgattaacagtgtcaccgtgtcacttcagtcagccatctcaataagctcttactgctagtgttgctacatcagcactgggcattcttggagggatcctgtgaagtattgttaggaggtgaacttcactacatgttaagttacactgaaagtgttcatgtgcttttaatgtagtctaaaagccaaagtatagtgactcagaatcctcaatccacaaaactcaagattgggagctctttgtgatcaagccaaagaattctcatgtactctaccttcaagaagcatttcaaggctaatacctacttgtacgtacatgtaaaacaaatcccgccgcaactgttttctgttctgttgtttgtggttttctcatgtgtatacttggtggaattgtaagtggatttgcaggccagggagaaaatgtccaagtaacaggtgaagtttatttgcctgacgtttactcctttctagatgaaaaccaagcacagattttaaaacttctaagattattctcctctatccacagcattcacaaaaattaatataatttttaatgtagtgacagcgatttagtgttttgtttgataaagtatgcttatttctgtgcctactgtataatggttatcaaacagttgtctcaggggtacaaactttgaaaacaagtgtgacactgaccagcccaaatcataatcatgttttcttgctgtgataggttttgcaagccttttcattattttttagcttttatgcttgcttccattatttcagttggttgccctaatatttaaaatttacacttctaagactagagacccacattttttaaaaatcattttattttgtgatacagtgacagctttatatgagcaaattcaatattattcataagcatgtaattccagtgacttactatgtgagatgactactaagcaatatctagcagcgttagctgtccatatagttctgattggatttcgttcctcctgaggagaccatgccgttgagcttggctacccaggcagtggtgatctttgacaccttctggtggatgttcctcccactcatgagtcttttcatcatgccacattatctgatccagtcctcacatttttaaatataaaactaaagagagaatgcttcttacaggaacagttacccaagggctgtttcttagtaactgtcataaactgatctgaatccatgggcatacctgtgttgcaggtgcagcaattgcttggtgagctgtgcagaattgattgccttcagcacagcatcctctgcccacccttgtttctcataagcgatgtctggagtgattgtggttcttggaaaagcagaaggaaaaactaaaaagtgtatcttgtattttccctgccctcaggttgcctatgtattttaccttttcatatttaaggcaaaagtacttgaaaattttaagtgtccgaataagatatgtcttttttgtttgttttttttggttgtttgtttgttttttatcatctgagattctgtaatgtatttgcaaataatggatcaattaattttttttgaagctcatattgtatctttttaaaaaccatgttgtggaaaaaagccagagtgacaagtgacaaaatctatttaggttctctgtgtatgaatcctgattttaactgctaggattcagctaaatttctgagctttatgatctgtggaaatttggaatgaaatgcaattcattttgtacatacatagtatattaaaactatataatagttcatagaaatgttcagtaatgaaaaatatatccaatcagagccatccctaaagagtgttctcttgtcttcctttgtatcctctttggctccttcccttagcttccaccccagacatcagacctggggctgccttctctccctgccaaagcttgctgttagcattgtctgcttgccctcaactcctgccttgttccctgttgaaatgtatcaatcccgtactttatctctccaggacaaggataagtgtggctacagtaaaagtttattgctctaaacggcgctaacctgagataatgagaaaaggccagaagagattgtttgatctctgtctgtcaatatatatgcatttcaactgtgaccatctggatccagggccctttctaacctatataacgactcatttgtttggttaatgatgaatatcactggggctcttaagtcctttcgttctatccaagacttcattgtttttttctgtatgaaaaaagtgcagaatatcactcacctttcccctacttttggatcccctacacgaggatcactagcttaatgagaagcagagtaacgctattaagtctgggcaagctccttataagttgctgtgtgcttaaaagaatgtgatttatgtctggggccaaagcagttttccttcttttccctcattgaattcaagacagctagacccttgtgtagatcccaggatattacctctactccccccaacctgtgtgtgtagggagagtaacaacacgggaagaggggagggaagttggaaggagattggtcacatgttcagttgtctgagatactggtaaatgtgcgctgtttgtcaatgaaggttgcatgcctgcatttacaaggtggtctcatactgattgtgctctgtccagttagattcgtggcttctcccttggaagctacaattaaggactagttagaagcagaggctagatgtgttctctccagcccttactaactgggaaaataattgagaaatccctcttttcctcagtgaaagcccagtcattggttagaaaaatctaattgtcaaactagcattatgttccatcatatctgtgggatagtaattcatgtaagacacatttttacctctcttacaagtcaattcacttacaagccagtttcaaatcaagcttcccttgcgaggaatggagatcattatggggcttattatgactacatttcttttatgagtgaccattttaaataattaatattttatttaatattaaattattaaagacttagctagacttttaacattagatgaaccttgtgaatcatatattgcatagattagcacatgtatgcaatctaggtcatcaatttgttgaatttatacagccctagatttgagattgtggccctgagtatctggatagttgagttgtgtgtttatgtgcttatatgatagaggtgctttgttcctgcagcttagaaacagaagcagccattcactgagaagcttaagagaggaagtatcaacctcattttccaaaccagcattactttcaccgctcgtggatctgaaagattacatttagaacatttagtactattacactctcagaaactgtggtaaaaagtcacattttcaaaacttcatgcatattgtattcttgttggaaataagtcctatagtttcttaattgtcttcatgccgtccatatttaacaaacattgcaagtcctttttatatttgggtaattatttgtaatttagtgaaggagactaggggatgttttcttccaaagggaatttaaaatcaattttatggtattttgaaagtaaaatactccttaacgtgtcaatatttttaaaatgttatctcgaagttttctattgctcaggtatataatctaataaaattttttgtttgctctaaggttatttttgctattctctattttgaattatgttaaaatttgtgtgcattttatgaaatgccttttttcttattttgaaagtgtaaaattgggcatctcagagtaaaatgtgggattattagctacaaagactaggcacatcgtgaa

SEQ ID NO: 15953 - DNA, 105050 bp, Human
aatgaaaggaaaggaaattgtcctatatgcatttgctgtggattcatggattggctttctgtgatagagaaagcttgtttgtatctttggggtcttaaacgtgcatgggaaataccattctaacacactgcttgcttctaaggtaagactataggaaacacaggaaagttgccccattgagtgacatttaagacgttttctaaaaatagatggacagtgtctagcaacatcaaatatatgatgcaattatgctttgtgggtttttcatattttaatgtgatttcaatatgttataactatttttatatgtatttgtcaaatgtgtgttatttctataactctttagaattttgaaccacctccaacatttaaaattacagctggagcaatagtttttgatgagcactgtgtggtcataatgttactcaacatacatattatgagaggcagaactgagctgcagtttagtagagaggcgtgaggcaaaagtgaatggatagtcttagtatttaagcagcacttaatccaccagaagtaattatatcataatagcttctgcaattaaataatcaccaaaaactaaaaaaaaaaaaaatacccaaggtgataaagaatttggaaattaaattaaagaaatcagaagacagctaatggtcagaccgaatgtgtaacagccttcctgttccaagaactttgaattggagccaaacaatctattaaatagccaggacattggcttagcattacataatacatgtgggaatttatcaggtccgttgtcagacaccagctaaaataaacagggaaattctgagcagtgtgtaaagttgttgcattcattgacctaaaacgaagtagaataattggagctgttgcttgaaaaacccattgtggaatgctttcttgttaactttcacatttcagagcaattaacttccgttgtgttcaaatattttcagatgtaatttaaaaccaagtaaagtatgtacttttaatattctgggtttcttgggcttatctcatgttattgatgatcatttctctaattttaattcctgacccagagatctccagtatgtaatgtgaagcttctgcaattttgtatcttactccacaaagacatgatatgtctgtttctaaatatttaaatttaaaggaaggatggcttgttataaaaaatatggttataaattgaagaataatcttaattttgcaccatttattttgtgtcaatgcttatcttttttgattcttgttatctgagatgtagtttaagggctttcaaaaagaaaagatctcactgctgatagatgcttgtaatctaagattaaatattccatattatttttaaggtgttctcacagcaataatttttttaaagtaagattaaaggatttagatttaaattagttgacatttacatatatcaaatagcactttcataatcgtccatcctatttgcataacgagggacgttatcacctctgctgtcaaaacaggagattgttttcccttcagaaatgaattagctgccctacttagcatacacaggtacataaaggttcattaactctctgatttaggtaatttttcataacgggtgaaattgtcacctaatttcattaaaaagattaggaaactttttacaaaaaaaaatacatttcaagtgttagtctttaaaaaagcatagtttgcatcatttaaatgacttgttaaattacttatgagatcattttaattgttaaaaaataaaactacttgatctgctcctgtctgtgatataccatatatttttaacaaaaaagttatttttattcattttattgctttagctccatatagtttatttccttgataaaattagaatatgatagttcttatgaaactgacttgctgttagagtggtatttaatttttcttttttgttcagcaggaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgagtggagtaaactttttttgtatcattatttattaattatattttctccacatatgttaagggtacagaaaatatcttgaatctgtaaatatctattaagagaagtttgggttaattaaatgtgaccagttaaagtgctgatagtctcttatatataaaggagaaaaaaatcactttatctgtcagaaacatagtttacacatttgtcattattcactttttacttcaacacaaatttgaaatgggaagtgtagttgtgtgacatgaatagcttgataattaagagttaatcagcataacattgctacattgcacgcatcatcaaacaaagatattcttatattcatgggaactagaccttttgtggtcattcacttaaaggtttataatataggataaatatcctgtatgaaaatggctttcattttattcatagtaaatgagattttgaaacacatccaaacattttaacattgtgctgacaacaacaacaaagaaaacacccacacaagatattaataacttaaaacatataggcaaggactatcggttaattcataccattttaaatctgaatttgataaacatagaggcagatggtgttataatttttttctagaatgccaatgataatgtctgtgtgatacaattaatctgttgtgaagactttacacattcaaatgctcagtttggcattaaagacttgtatatcatgaatgcctgcaatttgactctatttttcttcacactaggggagagtggatttagttaggctatgtaaggacagctgggtagtttgtataacgttaaatatcaaataatggtcctgggagaaattatagtactgctgggtcccaaccatctcatatggatcatggaacctgcagagaagacgtttctggactgtggaagagaagagtgttttgcctacttttcggttacactgaagaaggctacacagtagccctggggacaaccaccagactgtaatttccccacaaatgtagacactcatgtcctctattgtcctgttttgtcttcttggacatacaaataggactagaactgattgattcatttttttaaatgtaatgttgtttcatgtgtaaactataatgaataggaattaattatttcttgcatcaaagtcagtacgccattaaaaagtagagaaacttttaggttttcaagtttatactcctctaaattattatatattttcaggtacacacaacttgaactatttttggctgcatgtttagctagagggtgaataatactaagatttatggtggattcctttagtgttttcatgcacatcgtttcttgctgtggatcaagccaaagagcaatcattgtgtcaatagaaaaccgctattttttaattggcctatagcttgaaattgaaattaagactgaaatattgaatgtcatgtaacactgtttggaccttgttatttggaccagaacctattttgagtatagtcaaaaacatatgaattagcatttgcactttattaccaataccagataatttttaggtttatgatattcattatatcttcttttgcttgcaaagttagaagaaaatttttgcaggttgaattcatgagcttttattatgctttattagaaaaaacagggatacaagattttttaatttctatttttaattatgggtacataatagttgtatataatatggaatacatgtgatgttttgatacaggtatacaatgtgcagtgatcaaaatcagggtaattgaggtatacctacctcaagcatttatcatttctttgtattaggaacattccaattctactcttttaattactttcaaatatatgataaattcttgttaactgtagtcaccctatgtactaccaaattctagatcttattcattttacctatttttgtatccattaaacatccccactttatcccctccccactccatgcccagctacccttcccagcctatagtaaccatcagtctactctctatctcagtgagttcaatttttaaaaaaaaaaagtttagctcccacacgagtgagaacatgcaaaatgtgtccttctgtgcctggcttatttcacttaacataatgtcctccagttagtttcactcatgttgtaacaaatgacaggatttctagggatacaataattttaaagccgggagtggtagttcatgcttgtaatcccaacactttgagatgcagatcactggagcccaggagttcaagaccagcctgggcaacataaggagatgcaatctcttattttaaaaagttaaaaaaaaattaactgggtgtggtagtggcatgcacctgtgttcccaaccacttggggaccactaggacccgagatgtcaaaactgcagtgagccgtgatcatgttactactacacttcaacctgggcaacagagtgagaccctgtctcaaaaaaacaaaaaacaaacaaacaaagaatcttaatgtcgcacttttgagctaataattgaatatcttttctttttttatatatagttgcagctacagtggctgttaccctcatccaggttagaagtcataataactttagaagaagaaaacttatttaaattcagcttagtttgacttatcatttttttaaattctgaagacagatttcttgattttattctttagaatttagggtatatttattcttttctccagtctttagatacagtaggcctgtaagttcaatacttttaaacagaattagtaaacttgaaatccaccatgttttaatatatatttcagtgattattttagaggctgttgacaatttcaaacatcttacatataaatgcttgtcttgtgcacctctcacctactatgagagcagttgtaagagtcatttgggaaagagcctaaattatgtaggtcacttctaataaacaaaaccagcaaatccgaaacagcatatcatactgtgtagaggcacccgtaacctgggctttctttcaactgtgtattcacatgttgcaaagaaaaatgctttgccctctttgaagctgccccactgtagactgtccagtagaacctcatgcaatggctcactgtcatcttttcttaaaagttgtcaaagactgctctgccattgcacttgtttatttagctatacacagaataagttatgttttttccagaaaaagaaatactgacttcaagtgtgaaatgaaatattacagcactgatgttataagttgtatatcattaagaaataaaactgttgtgaaatagaatggctgtttaaattgaattttacctttactttagctgtctttcataatggaagtagggaacagctcaaattcagaaacatcaatacatgaaatagtttaggtgagaataaaaattgacagctcaaattcagaaacatcaatacgtaaaatagtttaggtgagaataaaaattgacagcttttttatttaaaaaaattttttggcatttccaagtttacaaaaactatttctttcttagtttcaagcttagacaacatggatttcttaagcaagtatgtaaaaataacattatgaattgttaatttatcttacagaaattttcagacaacctaataaaagtagttaccaattatgtgccaagaactatatatatatatataattacaaataatttttattaataagtcccattttatggctgaataattcatttatctgtgaaatcaacaaatattactagactgcagtgtacctaacaccaagtattcagtggtgaacaagaatctcatccagcttatcctctgctttaggggttcagcgagctttcctgtaaaggaccacatagcaaatatttttagccttgtgagccatatagtttttgtctcaactactcagctctgccctagtagtctgaaagccgtatgcagtatgtaaatgaacctgtgtggctgtgctccaataaagctttactgacaaaaacagggcgtttggatttcacttgtaggctacagtttatggacccctgattgagttaaacagacatgaaatataaaaatatataacaaaaatttcacttatatgtgctatgaaagaataataggaggtactttatttacatcagggttggagaaaggcctgaggaagtgctaaaagatgagctaaaagatgattcagagttaggcaggtgacagcattccagaagcagtatttgcaaagttccttaagagaggaaagagcttgactgaggagctgaaggaagatcagtgggacttaagcctggtgtatgactgtagagaaatgagagaaaagattggatgttagacaggacccagatatcgcaaagctttgaaggtcctgttaagttctaaataactggctcaagattgtacagttaaaactgggaagtgaccaagatctgagcccggatctctcatattcaacacgaaacaaattatgctttttaaaattatgtcatgatgcatctagtgtaatataataactaagagcatggttttgtgtcattacttttcccaattatactgcatccagtataatcaaatggctaagaggcatagtttttagagacacacaaacttcgttcttgtcccagttctgccacttactagctatgtgaccctctagcaagttacttagaccctctgagcttcagcagtaccctcatcactagagtgaggatgaaaaaaagttagtacctttctcattaggtctttaagacaattaaatgaagcaataaatgtaaagcacccaccaaataataagtgctcaataaatttacctattagctattcctattaagactcaggctctttgaaccattagctattatagttaatgtgatttctatcaaaacaactcttgtactgtgtagcacaataaagaatgttacctaaaccttcatttcatgagggttttattttaaaagggtattgaggagatggatggaaaagtggaacaggtagagcaggagcacaaaggagccttcagaagccaacaaggggctagagaatgataccagagcaggagtgagctgatgcagagaggatagtttgtggacaggaaggaaagatcacacaggacgtttgcagaggatttatgacaaggatggggagaagtcgtttcctaaatgttatgcttgtgggacctgttttcaaatatatgttactgaccaaattatttttaactactcctcaccatttttatcactaccagcttctagcttatgctaacactacagtttcagtctctccgtcggcattttttttttacccttgaaatacctccatcagttaggcagtcttaccctctttcacatggtaccaatttttaatcatgctcctgaaacagatttttttctgtgacacttttattgtattttacagtaacatatatatgcaaaggtttaaaaagttcaacaacaaactggtttttatgaacagatggttttgggggtgcttgtttcatttcttttgtgtttaaaattttttaaattaacaaataattgtacgtattcatagggtgcacagtgatgttttaatatgtataatgtatagtgatcaaatcagggtagttagcatatccatcatctcaaacatttatcatttctttgtcttggaaacctccaatatcctccttctagctatttcaaactgtaagatatattaactgtagtcatcctttggtgggatagaacacttgaatgcatttgtcttatttagctgtaattttgggtcctttaacagtttttaaatgaatattgtccttatatgactctttctacaaacaatatatttagaaatctgttatattaggaagaaagatatataaaaattaggcatgcttagcctaaacctatttacttgtatgtttgtatttgaaaatttcagctttcctactttgaaaggataggagaggtaagcccaaatttatttgtgcaacttgttataaaaagacatttaaatatttgtcagataacacagttagggcttaaaatagtaagttaagaaagaaatatatttaaatgccttaagttttcttttctttcatcagatctggcacactaatagtttttgccagcaaacaaaacttcatgtaattatcagtgcaataactggagcacaaactaaagacaatttgcaacattctgttaatagaacaggagaatccccttatgactaaaagaattcagagttcatagctgttacattttctaactttccctcttcttatgtccccatctcagtctcttcatatgaattataaattatataagatgaactaggaaaaaagctggaaaaatgtgttcagtgtagatgcagcttctgacagtttctacatactgatgtgttttcaaactaaatctggtctattcgacactaaactgaaaaataaaaagagatgtatagattccctcaagtgactctttaaaaagaaaaaattttactccttactttttcctggttttcatcaagttaattacagttctaaatttgggagttacatcttaataacctaatagaaaatttgttgaaagagagatacattcactctttaaatgtgagtaactggataattgagaaatacaaattaattgcttcaaaaaaataatttttcggtgaattccaaaccataagttggagaatagatggaagatgcagtctccactgctaaatgcactttttttggccacctccacaaacagaatttccagacttgtgagtttttctttaaatactgtagaagaattatacttgttaatcaagaagtatctggaatctctttcagacctagtgaaaaaaagctcaatcagtgaaaaattattgattttcctatcttttaatccaaaataagcctgcaaatacctcataataatgatgatgatgattgttttttcttagtatcatttcttaacagatgcctgcctccccaacacttgtattaaaaattatactaaacttatttcatataaataaaataagggtgtgtcatagtaatattttaggacatcatacccatcagaattgaattatagggtctattgccacatattggggatgccttcttaaaagctcctcatgcatataagttaaatcattcttttattaatcttaaaattaccaagggaaaagtttttattcaaagatttggaattgctggtgattgaagagttgaaaaagaaaaccagaagggaaaatgacctaaataatacttgtaagagtttccaaattaaaaaaaaaaaaaaaaaaaaaaaaagcagtaggcagaatgctcagatgtatgtttaacagctgtggcctcaggccattcatttccattttatcccttagcaatttgaaaagaattcacaaataatctccccaccatgtagtaggatcacagcaacagtgtgccacacatattactatttatcctgttcggtgcatgatattttatatttatgtcagctagatctactcctttactgccagaaagatattgctccaactcccgtcaatctcattcattcactttcctttggtaggaaatctgagagaggccaacattttcataaggaaaagaataattgtcacttctagaattctgtcactcttctttgaacttgagggcctcaagggtttttattgtttccagttctaatttgtatatctcatataatttctacttaaaactgtaatttaaaaagaatctgatgcttttatttattgtatctcattttgtgaagaaagttgatactgaatggcccctttcacctctgggaatgcatgcacacaccactctgtctgctacaagtcacctttagctttgcaaatgcacaaactgtgtgacattgtattactgagaaaccaacactaaaaatattaacattataaatagactacatacaccgagaagtttcttccaaactgtagattaaaagacatgatgctaattgtttcaaaagccatgtcctctgcagtctgcacttctttaacatttagttcaaaatgaaactacttcaaaaattattagggtatttttaaagtttgcatcccaatgtattcttgttgaaggtagtttggaaacttattttttctgaggataatggctttggcaaaaattttaaaaaattaagtaaatgacatcattaaggaaaaaaattaaaaattgataatatgtaatgtgtatttgtgtttcttttgaaatatgttggaccattaataagaattagagaaccagtctaaatgtttggaaatttgacttttaattttaaattggaacagtttaactaaagaaatcactaacatttaaataacatttcaacaaatgtaactgtttggaaactataacggagacagccttctgtcttgcaaggattgatttggaaggccctgggggagaaaatattggagttaggaggtaaaacctaggctattgtggaaaggaagaagttacactcttcctgttatgacaggaaaatgtagacaaatgtgcttcctgagcatttgctcagcagggaatgaagtatcctttgacctttcccttaggtacatttggctttgttgaactagtaaacatgtttttgcccccaaaatattaatctggtttatttgattcttctcagattcaaattatatctcttatgtagatgagatacagagaaacaaaggtatttattttatgactgcatctacagattggatttagaatgaaaattagccctttaacaaaccaggcagacttgagcagcccatataaaaaatgtgaagcctgctgtgttagtcttctcttttcaaaaggcaaaacattcctaggccttaaaatgggccacagtaaaatctcttatatcctgatcaagttaacaattttcggtcatccttcttccttttcctcatgcagacaaatgcatcagaattcagctgtcacaaattttaaaactcaaacttttatgagtttgttaataaacactcgtttcattaatgtgcattcgattatttaatttagatctaactgtgatttattattttccctccaatgcataagatttggagttttattttgggatttgggatgttgacttagggtgaggggttggtagagttctaaattccacactctaagccccttattttaatccttttatcatgttcagaattttaggaactactgcttgaaaatcctttggaaatactactgtatttcagcgaaacggaggctcaatttgcttgaggctaacgaggacaatagtcccctttgcggcagaacacactgctgtctcatcctcgcaagttatgctggagggttacaagcacgtggtagcagtctgcttaaaagagtccctcgctgctctttaaagagcctttcatttacgatggcaggccccgtcattgtataaaggaacgcttgtctagaacacaagtctgcagaggcactgcttcctcccaccgagagtaatcatcgggcctaaagctcgcgagcctttctaatgacagactgaattaaacaaaataaaactgaagaagaatactttagaacatttgtgccattacttactgtcaggaacaagggaggtggagaaagagcatttaggagggcatttccctttttcccaattaaagattgtcgttgcagactcttgactccagccctaaccctttaaacacataggaagacctgtggctcctggattacagagtgtattgtatctgtgaactgtccatctgtcactcattagtcattctgtttcctcaactgggaggaaactgagagattatctaggtggggggatgaggtggagtagccgacctgaaatattttcacataatgagggttatatttatcatgactcttatttggagggaaaaaaaatgatcaaacctcaaacctttgaaaatagaattagctgggtatacgaatcccaaacacatcctaaaacaaagaaactactatttatgagttaaagaatggtgaaaataaaaaaataaaaaattatccattcattgagcactgtaaggttcaattaagattaggctaaaaatattgtgtttggtggaaagaagtatttgggacccatagatcagatttttgttgcttcccttagtgatatgtctgaggcaatttgcagttgggcctcaattattattatagatgtgagtagctgctgtttctaaaggtccttttctttcagaactctttcctgcaaggtgcaagaacagttaccacagttaaaatggcaggaaagttcttctgaggtgactttatgaatggggctgggcctgggagggtgagggagggggcaggcgtgtggagtggagaaagattatgaaatgccctttccatttcacagtagtcaaactaatttccctaccctgtaggaaatgatacaggactccttctctgtttttagaacttgttatttacattgcctgtgtaaatcagagggccacctttttttattctagctgtaagcagacctgtatttactaccaaccaaaattcttcccattttctgaaattaaaataaacatccataaatatagaactagtttgtgcccactagtgcatgcatgtggttctcagtggctgtagtgggaatggccggagcgtctgagggcagagttggctgcagagtctatacaaaagtagctttgatttactgtcagaacctagaaaccaactggctctcaatttagtgttcttagtattattttttgactttaacctagaaagcagtccttacgttaattaaaatgttatgcattactgtgcttgcacttatcagaatttctgatggttcttaatgtaacattacaaatgacagtgcctgcatactgctcaataaacagttgactgggtccatattgagctgaacttcagcccctaaaatccatagttatctaaaagagggaaggaacactaactaacagaaagaaagatgcactttgtgtgaagagggttggttttctagtccatccaggaacaagtctggggaccttggataaggctattcatgtctttgtttacggtattcatctgaaaaatagggatgataaactgtgctaaagaataagttcaaagagatactgtcgaatgtagggagataattaattataaaatcgttgaacttcttagaaaaaattatcaaataagcaacactgttatctaaaaaataatataagaaatctgatatgcttcacttgcaccaaccaacccacacacaaaatttgaccaagtccagttttttctcctgattaattttaccaaatgtaagtttctactgtaagttaaaatgacaaaaaaataaaataaaacaagtatgtgaaatttccctctctcagtagcaaacttcttgttaacatagtctgagcatccatagaaatttattttcagctattcattttggattacaaaaaacactataattcctctgtccatatatctattcattctatcaacatttatttatttagccaagtattattattggttgtcaggttacaagaatgagcaaaagatggcccaggtactcgagaaaaactaggatatagctgagagagacactctaatctagacctaagtaaataatggtaacacaagctgacaggtcctaggagaccagtcttttacagtatgtttcaaggagcgactaagcctggtgcatcagagaagatactacttgctttgtaaagtgtttcacagttaacaagttatttacactggtattatatcccttacttgacctctcacaaaactctatatgatgcctgttattatctccactttccaggtgaggaaactggggttccggtaagttaagcaattttacgcaagggcacacagctcataaaaggcagagctgggacttggttttcaatttttatgtttttctttctacattgtactgccccagtcatgatgcatgtatcctgtttctttaaaatgtctttaataatgtgaatttgctgttttatcaatctggataattatttttctgtgcattttcagtacatcatttaatgttgtctactcaaattctttacagtcttttgtgtctcgtctagctacaaaaaaagttattttatttcttgaaatatggaaattagaggcgataatgtatgggtgggattgagtaactaaaacataggagattctgtagggtgcatgcttggtgaaccatattgccatttgctcttaactcaaagccctatgatacttaggcatagattaagaacatctaaaaattagaataaatattttaaaggtctctagtccaacttcctgcttaattcaggagccccttctacaccttccttgatatgcagctctatgtgaacatattcagaaatgagctgcttcctgcttggtgggaagttctcatcactagattttcccttgttttgaatctctttctaattttcaacaatgcttactaattttgcctcttcgcatggacatatgcttcagaccttagaaaatgtttagcatttcacttttaattctatttttttctgagttatacattccagattctttcaatggttcctcatgccagattgttctcagaccctacatcagtctgtttaccatcctgtagatgctctaattttgtcagtgctttcttaaaatgtcaccctcagaactgaatatgctaccaaagatggttctgacaaacaaaaagatcagtaggataattaattaccactatagaacgctaaaactttagatcctttcccaaaattccttaattatccccaacctgaacttttgtaattgttttttaaaaatatgaatgtggactttaaaattaccttcatttgattcatcttgattgtgacccagctttctaaaggctgtagaaggcgctatggatatagactcttatcacctactgggtttgctcaagcacccagatttacgttgcatgcagatctgataagcctgccttcctatatacccatctaaaccaatgacaaaaatgtctcctgggatgggaaaagtactgaattctatggcactttactagagactttttgataaacttaacattgatcaattaagtcggcctcattaattatagttcatcagccatatttaaatcagctaaattactaccatccagtctcaaattgtgcatgaggatttcatcacttttccaaatgcttattctttgaaaatctgaactcatcagaaagttcagtacatttttgcgaacaaactcagtcatcctgaacccatggatcctccccattctttctgtatcctgtgattgtaaaattaaatttttatcttcagacttttttgtctttcatcttttttatccaggcaagggataaaaaagaaaaaaacttttctctgaattttttgaagtatatttttcttgaagtctacagcatatttacatatatatttttctccagacatcatttaccttctttattataaattccaagatagtgtaattactttatcttaagatttgtgtcactaataagctaaacattgtagtaaaataaaggtatatgtgtccaaaatctctatttttgagagattaaattatttaaaaggcaagtaaaaaagcatctactctaacataaaattataccgaaacattcagacttcaaaatggagtatttccattccataatccattcgttcagcaaaggttcattgagtggccactggtcagagtctgtgagaggcctgagggatggtctttggggaattcaaatctggcagaagggaaaactcatatacaaccaactttgtaatactggagtaagtctcataataaagatttgtaaaaagtgctggaggactacaatgagaaaggaatgagttttatctgaatgtgacaaggaaagcatcaaagaaagaagttggcatttaaactaacccttacagcgtgatgggtgcatccagtggccaggtggaaaaggagagatggaagtaataccacaatcagctttcaccaagtcaagattagaaataaccagtaaggtagatttcatttcgtactcatcttgactgaatttacatctactattatttttctagctcagtccagagaaaaagttagtctgaaaaaaaaactgaattcacccaactctaaataaaaatacgaattcagattattagatatgactgaaaatataactctgttggccaagtcatgcattttgttccaaataaagaaaattccttttaaacgttatggaattaaatgacttttttttgtccagccacaaggaactgatatgaacaagggagatattattttatgtaatggaagccacagtacctagcacaaatgcctgacatagagaatattcaataaatattgcttagcataatgtttgacatgcggaaaatgctccataaaacttggccaaattatttttatattttttgtgaatagactttcttaaatttttagtaactgatttgtatggtgctatatttaatgaatgtttcttttctcaatttcaacttctaatttctgtttttccttcgcacctaataggttctagagccattatcaacataagatgtatggtatctgtccttactctaggatttaaaagtcagggccactataaaacttaacataccatcatcacatttggggctatttaaagattcaaaaatataaaggaaaaacataaaataaaaaacatacagagtagttctgctttctatgctatatcacacattaagtctctttaatttgataacatgttgacttatgtaaatactggaaaagagagactctttgcctaactactgtaaaaacctctttctgcctcacctaaggttccaaacatgttatttaaaaagaaatatggacttgtccccattacaaactattatcaagttaagaaaaatgtaaccatcacaaggcattatttaagtataaaagcgcagaattgaaatctttgttattgagtggcatattttaaatgaagagttatattccagatctctttagaaagcctaatgcttaaaaataattttatctaactatgaacaatgagaaaaagcattataaaatacattttgagaatgctatgaagaatatgaacataatgcagaattaaatttagagcaattaagagtagattttgaagatattttcttacgtgctttaatacagtcatcatttcagtttgcagttttaaattgcagaagaagctatatgcactgacttctttgatgggtattattaaataagtattcattatccagcagcctatttggttacacaaaaattgaggagcactaaaagtaaacacaaatagtgacattaatgatatttctgtactgaaatgtactttgattatgagtgttgtaacgtgcaaaattctgaggtctgagtacaacagaaaccatactgtattgagacattccacatatagcttgtggtcatgaagtctgattaaaagtggttttagatatatgaaagtagtctaggtcagtgccttctgtattgaacgtattctgtagcctatttcactaagtaaaatgccaatatgcaggtacattttcatatcaaaattggatctaaaagaaatattaaaagacatttagtgcagctctgtgtaattaatgattatgtttctttattcattccaaaaagatggttttcagcccatccttaatatcaattatgactcatctgcataaaacagaataaaagtttctaaagtagtatgataatcagatatgaaaataaaacactagctatattttttcagaagtactttagaaagacaatcaataaagatgaaatagaaggtgaaaaacactgacaattacaagaaagaagaattatccaagttgaaatgtaaataacgtaactgagtaaatattgactagttgatatgggctagtaaatatctaaatgccttattttccaaacgatggtcactacagctttatctttctatcagtcataataacatcttcaaatagccataactggtagactcttcaagtcaccaagacaagtatattttgctagttcttcttttttggttaagtcaactaagaaatttgggggaactaatatttattgagcacctactctaagcattatactcaatactatacacacattattggatacaatcctcacaacagccttaagagtaggtataaatctctgttttacaaatgtgaaaaatcaaactcaaagaactttatttaaagtgaggcgaggcacggtggcttatgcctgtaatcctagcactttgaaaggcttaagcgggaggatcgcttgagctcagaagtttgagaacagcctgggtaacatagggaaacctcgtttctagtaaaaataaatacaaacaaagataaagccagaacatgttggtgcacgcctgtagtaccagctactccggaggttgaggcgggaggatggtttgaccctggaaagtggaggctgcagttagctattctagtaccgctacactccagcctaggagacggggagaccctgtctcaaaaaacaaacaaacaaaagagaagttgttaagtgaatttcgcatgactagcaaattcggcattcaaattcagagttctctaaatacaaaccctatgttctttgctttctaccatactaccttcaatgtcatatgataaaatagtgtaattattattaagtaaggaatatatgtattgttaaaacattttgcatatgagttgttaaaaaaatttcatgggaaaatttatcacatatatacatacatcaattgtatctttctgaagatttcacatagtagcttcccctatcaatttttataccatggatttttaccatgtgcccacacatgtctactggtctaagcactggggataaagtagtgagcaaaataaaaacggcatatacccttgtggagcatgcgctgtagtggaagagaggttaaacagatcacacaggaaaatataaacagttttgtattttttattttgcatattttatatacaaaatatattttgcatatttttgtatatatttggtatatttttgtgtatattttgtatatttgaaaatataaaatgtgattgtaacatgaaggaaaaataaaaggtgataagtaaaacaataattaacaaaatgtggaggaatgaggagactgggaggtcaggctttctgtctgctagtccacagtccttgtcaacataaatctatttagttgtgggggagggtggggagtgggagaaggtggcaggccaggattcagagttctctctgaggtttctagtttggatgactgagtttatggtgagatggggattccaaaaggggctgcagattctagactgaagataatgaggttgaactttggaaggtttgagaatccaggatgtttagacaggtgtggaactggaggacatgcattgggtgtctggagacaaagagaaagatgaagggtaggaatatgcaattaggaattacacacaaatctgtgataaaatgagctggcctctctgcaaggtgggttggatttgaaggtatgaaaaaagtttaaatgattcattctgaaaacagtagcttaattaagtaaattagcttttcccagaatatgtgcctcaaaaacctagttctgaagagtgatagtaagtgctcctcaaaataaataaatatgcaaagaaacaaacgatatgtcagcaataggttcgaaaagcaagttaaacaaagtttaaaaggtttcatagcctttcatataccaatgtgcctctttttccaaacatattaggccactgaacttttttcttaaggagtattttataggaacagtactctacagaatgaatacctgttgggaaacaggtattcattctgtagatgggaaacactggaccatataaaggtttataagagactccgtctccaaaaaaaaaaaaaaaaaaaaaaaaaaagaatgttcacgccttttcagtagccagactggagcaacaagctgaagttcaattaaaagagagttgaaattgggaagagtgaaatgtatttttgcatttggtaggattggcaggtaggaagttttcaaagccagggagagggagctgttgtaggcagctcatcaggaaaaagacagtaggaagagtgaggctttgcagtttgagttaaattgaggaaggaatgattccaggcagggagatcatcgaggacaggaagctgctaggctgtccaaaattgaagtgataaggacatcagtgatagagttgcctgggaaatagtgtgaacctgagaaatattttgaggaaaggaattatgggtcttggtaatagattagattaaaagaagaaaatggtggcattaacaatacagtttctgacctgagagaagaagaaagatacacagaagaatgaaaccaaaaccctaagcatatgatggctaacggacttcccagtgccctgttgggtttctagaaaacagaatacaacatcgtctgagatcacagtcatatcccttcaagtgttttcaattaaatgacatgagactagacaattttaagacttgtttgaacacagatctaaaatgctaagttcctaatgtcatgtccactcttcaaatagtcaaaaacaagctccaaactaattattaattgggaaatatgctaaccatgctgaaattaatttttttttaaatcttaacttgctcaaagaaacatgaccagttccctggtcaccttcattaaaataccctacattaaatcttgcatttagagtctcacattcagcagcaagctagaaatcacacattttcaaatgataagcagaaattaatattagatttatttgctttctttctgaatgtgttagtgcccagggctctgacaactacacaccattgttttgtgaaggaaaagaaaaaagaaaagaaaaaaaccacacatgcatgaatattttttaaaaaatcttggctgctttcttttttctaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggaggtgagagagcatgcgtggtgagccccaagcctccgcaagcaggggagtttggacctccccctgccacacacacatacacacatcatgttctttttcttaagatgttcatagtcccatagatagacccaggattattatctatcgcaactcttactccaccttttctctccccttcaaaagttagagtgatgtgatgatagagaccatgtaagatctggtctttgctagaaatcaagtaccagtgtcaaactatttgcttcatctttggcaagtggtcattgtccacagctgtgtatcaggacaccatggttgggaactcttgccagggaatagctcatccatattttagacacttctgatcatttattttaggtatataatagtttcccggcatcatcaaagaaaaaacgtatttaaaaatgaactcaccccaaccttacactttcagtttttcgatttatgtctcttctttgtaactcattattctgaatgctttcttgctggaagagtaaaggcaattattctcctagaaatgttttttcctaaaaattatatcattatatatatcaatgaaaactgttaatatacatggaatcagaaatcagatgaaaatgaatttctaaatgttagctcagtgtttaatcaatgtcagatttaaaaaattgttttattgtgcccaaaataaataagcatgatgctgaaagtcaaaaatgttttagatgtgttagcataagtaacataccatacagttttggctggaacattttttttcccattttattttattttattttatttttattatacattaagttttagggtacatgtgcacattgtgcaggttagttacattggctggaacattttaaaccttttcagcatcgatcctatttaaatactttgtagtacccttcatgagcaatgattaagactacaaaacaaaggaagaggtataataaggatggttcccatctgcctattttcttaatctatttgtctactctggcttccctagattgtgcctgctttctcagaatgaaaagaaaattaataagtgtttcaaaagtatgtactcaagagccagtttgccagagtacacgtcattcttgccattgcttagactggttccacattgtaaaaaaatgtagtgctaatcctgatcaaatgaatatgcctcccacatccatctcccttttacctgttacaattgtctaagactaattctcatttctttgtttttatttgaaagtttttcaaaagtattgagctgattattatattttatttttgccttaacgaggccaaggaaataatttcagagaaacaaaagtgaatgataaatagacctagggtgatatgtgcttaaaatactatgcattattttagtttttcattgataatttgaattgtgtgcttgccttgatcttgaaatttaggatcactgataaaatttacctatgcatttcagatagttttttatttgcatataaatatgaaagtacaaaaatatgaaggtgaacactgcttgtgtgtgtgcactaatacttatgtaaaataaattcagaaaacaaaacaactatttactaaaaactccatctcattactaaaaccattataacaaaagtcagggtaacaaaagaatttgagttggaatttatcattacactggaactgctagtccttaatgtcatgtgaaatgctgtagatccataatgagccaattggaaaatatgttgacttctaaaatttgctttcttaaaggagtttaaaacctagaacattcatcttctgagggtttttcttaggaatatattatatgacttgaaggcaacttaaaacttcatatattggccaggtgtggtggctcacacctataatgccaacactttgggaggcctaggtgggcagattgcctgagctcaggagtttgagagcagcctgggtaacatggcaaaactccgtctctgcaaaaaaaatacaaaaattagccaggcatggtggcacacatgtgtggtcccagctacctggggggctgaagggggaagatggcttgagcctgagaggtcaaggcctcagtgagcctagattgtgcctctgcactccagcctgagtgacagagcaagaccctgtctgtttaacaacaacaacaacaaaaaaacccacttcatatattgtatgaaaacttcatattttttgataggtggatatttgaaagtcagacttctttaaatgccacaaaaacagcactgggttaagagtcattgtttttcatttgaatccttgtcttgcacttttgtgcagtgtggtgagttgggtacctctctgggctgacgttttctcatctcaaaaatgaaggcattggatttgaaagtgcttttgcaagattataatttttaaaaaagcaatacttgtaaaacaggagtaaagaaccagttccattttcttgttaacatcaatagattaaatctctgaatctctcaaaaagacacttcgaggcttttgggccaaatctagagattggatggctcaattatttggatgaacataacatgtaagtctaacacattgtgggtccgtcctgttcaactccctgaattatgcattcttcacatatttggcttttccacattttagtaataacagagatcatggaaaaagaagtaagatgggaccgctaagcttgataaaatttacatcatcttcacatggaatatttttcaaagtgctgcatcactgaaattaggatacttgagacacttggtgaagagggaatctggattggaagttgcatttataaaaagttccccaagtaggccaggcacggtgactcacacctgtaatcccagtactttgggaggccaaggcaggcgcatcatgaggtcaggagatcaagatcatcggggctaacatggtgaaaccccgtctctactaaaaatccaaaaaattagccgagcgtggtggagggggcctgtagtcccagttactcgagaggcaggagaatggcctgaacacgggagggagagcttgcagcaagccgagatcgcgccactgcactctggcgcaggcgacagggtgagactccgtctcaaaaaaaaaaaaaaaagttcccaagtaattcttagacacactaaatttgaaaacctctgcagcactagtacataaattgtgctggaggcaaagacctatgatacatcagggatttgaattcgttcttagaatggatctaccataaagtcaaaagttaagattgtttactgctcctgggtaaaattttaaatcctatttattttaatttaatggaatacatttaactgaataagtttaatgaggagcataatatgtttcatgaagggtcattagttttatatttcccatttggaccattacccctcttccttaaccctctaaaaacagtttactcacaagaagaaaaggtatcgggagagatagaaataatataatttccagcctttacacagaaatacaaatttctgggccataccagagtagtgctacagggtcataggaaattgtgcagtgcgtgggtgttgaaaaagattccttcttttagcaaaaaagctctgcgtaattatcatgtctttgcttgataattagcactactccaacaatggcacaaagactcacaaaggcttaacagacagactgagatcagtttttttatgattatattataatgcagcttgaatatctgtttagatacaatatataaatatgccagatttagtaaatgtgttaaatttttaatccattggttaaaaaaacaaaaacagttattgtattaaaagcacttcctttgaaggaagtccattttacttaactctgtgacaagtatactgggatatttacccaaaacgctagcttgtcagactgttgaaattcagttcggatggcattaaggaactgcccccttcactgcttgttcactagctccactcctcgttctcttagctgtctaagacagcaaaccctaccagtttatgttgggctctgttcctggaagaagatgtggttgttgagtacttcaggatgatctgaagatgcagatcccacaggacatgcttacagcccattgcttcatttagcaatgatttagcaagctccactcatgctcagcactgtggaagagactctgaaacagcaggagacaggcattcttgttaaggatgtaaaacatatatgcaaaaaatcagcttgggaacaattggacggcaaaggaacaataacctcattaatgcagtataagctgctgaaatgaaggtgtaggctaaacaattcaacagaactcattcagccaggtcatgtgtttttccagagcattccaagtgatccttggagtgacaggactcccagacaggttacctccatatccagcacgttttgtaaccacaaaatccttatgggagtatcacttagcacccagccaggaaggaatctctcatcccctcagtgaactcagtgattctaatgagctactcattcagtctgggcccacagtccagtgattaagtgtggaaggggaataaaacacaaggccctttgctgctctctaggaaattcagagatggatgtaactcctgcagaagaaacctttgattcacaactgtctcagtagaggattattggtttttctttttagaggaagaacatgtgtgtctctctctctgtgtgtgtgtgtgtgtgtgtgtgtgtgtgtgtgtgtgtgtgagagagagagagagagagagaaggaaagggacatagggagatggagagaagatgagagatgagagattatatttacctgatattttattattttggaaattttatttgctgtcacctgaatcctgacttctgttttgatttagagacatctaagaacagttgctgcagcaaaatgttttctgcacagtaataattaaggcctaaattgggatgggaaaagccttaaaatagtttataacttgtatagcttcacaatggtgatgaaagttatcaacgagctaagtgctcttacatagtttagtgaaaatactaaatacaatttttgttgaaaagcaaatgcagcaaatagcgaaattggacttctttacaaactcagtatcacaaaatttggaaatggatgtaaatgtgaaaatatgtctactttacttgaccattcattatatctaattagcttctaattttatacttataaaaatatagatgtaaagccactgtagccagactgcctctctagattcctcctctctgggcagagcatctctgaaagaaaggaagcagccccagtcaggggcttatagataaaactcccatctccctgggacagagcacctaggggaaggggcagctgtgggcgcagcttcagcagacttaaatgttctggcctgctggctctaaagagagcagcggatctcccagcacagtacttgagctctgctgagggacagactgcttcctcaagtgggtccctgaccccccgtgcctcctgactaggagacacttcccagcaggggtcgacagacacctcatacgagagagctccggctggcaactggtgggtgccactctgggacgaagcttccagaggaaggaacaggcagcaatctttgctgttctccagcctctgctggtgttaacccaggcaaatggtctgaagtagacctccagcaaactccagcagacctgcagcagaggtgcctgactgttaaaaggaaaactaacaaacagaaaggaatagcatcaacatcaacaaaaaggatgtctgcaccaaaaccccatccaaaggtcaccagcatcaaagaccaaaggtagataaatccatgaagatgaggaaaaaccagtgcaaaaaggctgaaaattccaaaaaccagaatgcctcttctcctccaaaggatcacaactcctctccagcaagggaacataactggatggagaatgagtttgacaaattgacagaaataggcttcagaaggtgggtaataacaaactcctccgagctaaaggagcatgttctaactcaatgcaaggaagctaagaaacttgaaaaaaggttaagggaattgctaactagaataaccagtttagagaagaacataaatgacctgatagaactgaaaaacacagcacaagaactttgttaagcatacacgagtatcaatacccaaatcgatcaagcggaagaaaggatataagagattgaaaatcaaatttaatgaaataaagcatgaagacaagattagagaaaaaagaatgaaaaggaatgaacaaagcctccaagaaatatggggctatgtggaaagacaaaacctacatttgattggtgtacctaaaagtgatggggagaatggaaccaagttggaaaacacttcaggatattatccaggagaacttccccaacctagcaagacaggccaacattcaaattcagtaaatacagagaacaccacaagatactcctcaaaaagagcaaccccaagacacaatcagattcaccaaggttggaatgaaggaaaaaatattaagggcagccagagagaaaggtcgagctacccacaaagggaagcccatcagtctaacagcagatctctctacagaaaccctacaagccagaagagaatgggggccaatattcaacattcttaaagaaaagaattttcaacccagaatttcatatccagccaaactaagcttcataagtgaaggagaaataaaatcctttacagacaagcgaatactgagagattttgtcaccactaggcctgccttacaagggctcctaaaggaagcactaaatatggaaaggaaaaactggtaacagccactgcaaaaacatatcaaattgtaaagaccattgacactatgaagaaactgcatcaactaacgggcaaaataaccagctggcatgataatgacaggatcaacttcacacataacaatattaaccttaaatgtaaatgggctaaatgccccaattaaaagacacagactggcaaattggatagagtcaagacccatctgtgtgctgtattcaggagacccatgtcgcgtacaaagacacacataggctcaaaataaagggatggatgaatatttaccaagcaaatggaaagcaaaaaaaaaaaaaaaaaaaaaaaaaaaggcaagggttgcaatcctagtctgtgataaaacagactttaaaccaacaaagataaaaaaagactcaagaagggcattacataatggtaaagggatcaatgcaacaagaagagctaactatcttaaatatataggcacccaatacaggagcacccagattcataaagcaagtccttaaagacctaaaaagagacttagattcccacacaataatagtcggagactttaacaccccactgtcaatattagacagaacagcgagacagaaaattaacaaggatattcagggcttgaactcagctctggaccaagctgacttaatagacatctacagaactctctaccccagatcaacgttggacttcagcattcttctcagcaccatatcacacttatcctaaaactgacataattggaagtaaaacactcttcagcaaatgcaaaagaatgcaaatcataacaaacagtctctcagaccacaatgcaatcaaattagaactcaggattaaaaaactcactcaaaaccacacaactacagggaacctgaagaacctgctcctgaatgactactgggtaaataatgaaattaaggcagaaataagtaagttctttgaaaccaatgagaacaaagacatagtgtaccagaatctcagagacacaactaaagcagtgtttagaggaggtgaatttatagcactgaatgcctacaggacaaagtgagaaagatctaaaattgacaccctaacatcacaattaaaagaactagagaagcaagaacaaacaaaagctggcagaagacaagaaataactaagagccgaactgaaggagatagagacacgaaaaacccttcaaaaaatcagtgaatctaggagctgattttttgaaaagattagcaaaatagactgctagccagacttaataaaaaagaagagagagaagaatcagatgcagtaaaaaatgataaagaagatattaccactgatcacacagaaatacaaactaccattaaagaatactataaacacctctatgcaaataaactagaaaatctaaaagaaatgaataaattcctggacacacacaccctcccaagacaaaaccaggaagaagtcaaatactgaatagaccaataacaagtgctgaaattgaggcagtaattaataggctaccaaccaaaagaagtccaggaccagatggattcatagctgaattctaccagaggtacaaagaggagctggtaccattccttctgaaactattccaaataataaaaaaagagggactcctccctaacccattttatgaggccagcatcatcctgatgccaaaaccaggcagagacacaacaaaaaaagaaaatttcagaccaatatccctgatgaacatcgatgcaaaaatcctcaataaaatactggcaaaccgaatccagcagcacatcaaaagcttatccaccatgatcaagtcagcttcatccctgggatgcaaggctggatcaacatgcaccaatcaaaaaatgtaatccatcacataaacagaaacaatgacaaaaaccacaccattatctcaatagatgcagaaaagggcgtcgataaaattcaacactccttcctgctaaaaactcgcaataaactaggtattgatggaatgtatctcaaaataataagagctatttatgacaaacccacagccaatatcatactgagtgggcaaaagctggaagcattccctttgaaaactgcacaagacagggaggccctctctcaccactcctattcaacatagtattggaagttctggccagggcaatcaggcaagagaaagaaataaagggtatttaaataggaaaagaagaagtcaacttgcctctgtttgcaggtgacatgattgcatatttagaaaaccccattgtctcaccccaaaatctccttaagctgataagcaaattcagcaaagtctcaggatacaaaatgaatgtgcaaaaatcacaagcattcctatacaccaataacagataaacagagaaatcatgagtgaactcccattcataattgctacaaagataataaaatacctaggattacaacttacaagagatgggaaggacctcttcaaggagaactgcacaccactgcccaaagaaataagagaggacacaaacaaacggaaaaacactccatgctcacggataggaagaatctatatcgtgaaaatggccatactgcccaaagtaatttatagattcagtgctatccccatcaagctaccattgactttcttcatagaattagaaaaaaactactttaaatttcatatggaaccaaaaaagagcccgtatagccaagacaatgctaagcaaaaagaccaaagctgaaggcatcacgctacctgacttcaaactataccacaaggctaaagcaaccaaaacagcataatactggtaccaaaacagttatacagaccaatggaacagaacagaggcctcagaaataatgccacacatctacaactatcttatctttgacaaacctgacaaaaacaagtaatggagaaacgattctctatttaataaatggtgttgggaaaactggctagccatatgtaaaaagctgaaactggaccccttccttacaccttatacaaaaaaataactgtagatggattaaagacttaaacgtaaggcctaaaaccataaaaaccctggaagaaaacctaggcaataccattcaggccataggcatgggcaaagacttcatgactaaaacaccaaaagcaatggcaacaaaagccaaaattgacaaatgggacctaattaaactaaagagcttctgcacagcagaagaaacgatcatcagagtgaacaggcaacccaaagaatggaagaaaatttgtgcaatctatccctctgacaaagggctaatatccagaatctataaggagcttaaacagatttacaggaaaaaaacaaccccatcaaaaagtgggcaaaggatatgaacagacacctctcaaaagaagacgttcatgcaaccaacaagcatatgaaaaaaagctaatcatcactggtcattagagaaatgcaaatcaaaagcacaatgagataacatctcacaccagttagaatggtgatcattaaaaagtcaggaaacaacagatgctggaaagggtgtggagaaataggaacacttttacactgttggtgggactgtaaactagttcaaccattgtggaagacagtgtggcgattcctcagggatctagaaccagaaataccatttgacccagccataccatttctgggtatatacccaaaggagtataaatcatgatgctataaagacacatgcacatgtatgtttattgcggcactattcacaatagcaaagacttggaaccaacccaaatgtccatcaatgatagactggataaagaaaatgtggcacatatacgccatggaatactatgcagccataaaaaaggatgagttcatgtcctttgcagggacctgggtgaagctggaaaccatcattctcagcaaactaacacaggaacagaaaaccaaacaccacatgtgctcactcataagtgggagttgaacaatgagaacacatggactcagggaggggaatatcacacagcagggcctgtcgtggggtggggggctaggggagggatagcattaggagaaatacctaatgtagatgacggttttatgggcgcagcaaaccaccatggcacgtgtatacttatgtaacaagtctgcatgttctgcacacgtatcccagaacttaaagtaaataaatatatatgtacaaaattatttttatgtgctatatagatacatattatacaaggatacttttcttaagagaaaaaaacagattcacttacctaatcatttgcagattttccttctttcagtcattgattgaacaaaaatttgttgaattcctgctctgtgttatatgctatgaaatgcctggagatacagatataaccaaggtccctcaaggactctcagtccttaagttggctcacaaggccatgcatgatctgatccatgtatttctcttactcttcagcctcactttttgcaatttccctgccattaacctgcccttacaacccccatcctatactcaagccacatcgtacatacgtacattcctcaacctctccaagctctgttttgtcttaaaattccttactggatctctacttggctgttacttatccttcactcaagtcaggtcccaattacactttggaaagtcatccttgaagcccccataacttaggttaggtgcttcccctgtattacagtcatcatgtgttctatctttcccatcagagcactgttgaagttgttatccaattgcctgtcccacactagattctaaactcccaaagggcaagggactgtacacgttttgctcaccatcatattcccagtgcttaacatgaggtctagagaaagttacctcctcagaatatatttatagaataaacaaacaggaaagacagacatataatcaagtgattatcatgtggcataacgttgcacatttaaagtatgaaaaaatgtttttacagttccaatgaaacaattcattaaattttgatagagtttatcaaagcacaatttaaaaacactcaagtaatctaggtccatactctccaatatagtagccaataggctcatgagactatttacatttaaatgaattaaaattaaataaaatgtccaattcagttcctcagttgcattagtcatgtttcaagcattcagtagtcatgtgtggctagtggctactgaattaaacagggaagatatagaacagaatgcattgatcatcacagaaagctctatgagacagcactggtctagactgaaatatgaagagggagatatttaaacaaattgtgttttcaaattaataccaaaattaattcttcaatataaaatttgaggagtcacttcggaagtgagtaactgtgtaccttgtgattttggaattcagagcataaatgttcacttcgagagactctgatctggaactaaacactcaccataaaactaaaagcacactttacccctaacctataaccacagagtcaatcagtaaacttatgatctggtcagaaagcacttgcaagttgtccaggctgacagggaacattaactgtgtgagctgggtgaagtatactgtatttttttttaacttgaagcttgtgaatggaaagatgatagttctgtcttattactatttttaatttacttgaagcaacattggaccagtatttacctatataattagtaaattaatttctccagaaaagtatttttcattataaaaaaatttagagaaatagtattcttgagatacattacaaatccttcttagatttactataaaacataattgatatagatcttactgctagtgactaagtaagtctaccctcccctctgttaagccaagcatataattgcttttcaatacatggtattgaaaaattaacaaagtattagtattttccataaagatttaaaccttctatgttgtggcttctgagggaaaaggggaaaaagattttgttatttaaaaagttttttattttcctgaattttaatataattttgtttatatatctttaaaagacttttattagtacctgtaaataatatttttacttgttccccaaagtcttaaagaagaaatgagtctaaaattttttaaatgtattcatatttctcataactataccacaatgatttgtatagatcaaatttgaagagccatttcttttttaaaaataatcttcttgcttaatttacatgttttataaacacgaagagctgcttcacatctcatttattaagaaaataatcattgttgaacaaatagtaatgtgaggcaataaaactgagcttcctctagtctctgttattacacagctctaatagtttgcaagcattagtatgaacacagtgagcagataattacttaataatagtagaagcagaaaagacagggttcaaaatatagacttttatcagtaatataatttctttatcaatattaatcattaccattttgtcatcattattattttacatgaaccttcctgaactagagcaaaacaaagatctcatgtgatctctcttcacctgactcccaccatacctggaaatgaaaagagaaaaatatatagcctggatgataattgtcaatttttaatgatatttacaaatttcatggcatatggaacttggtggtaagcagcatatttgaaccaaatgttacattctagccattgatatcatctaagtaaaactaacattggctctaaaaggtgccgaataagaatcaaagtgtagaatattcttacttcctcaggaaaagttactgaatatatagtcatgaaatattcaaaagtaaagttctaagaatgattctgaggcttgcctagaagcagaattctaagatgatggctcttttcattaaggagtgtttattttaatttcttcaccccactgttggttttggggggtttgtttttgttttgtctaattacaaatccctctcctttccctgaagggcatgacgaagctttgttcatctctgtacctccagctgccagctcaatgcctagcatattgtggacattcaatatatatcaacttactgatgatcattagcataaataaaatttttaaatatacaattttttctttggtgagatccgatgtgttctaataataaaagtgagaatctttcaagtcagctagagtgagtaaatgttgttttgcatcaaaaataaataaataattaaattacaaggcacaggaaaccaagtaaaagtattgcttgtggtgctggtggaaaggaaaggacttccagaccaaggtacagtattttgattactggagaagagagaagaaacctgttagtgctttggccagtattgggtcaaatgaaatgcctgtggcccagtgtgaatcaccagagtatcttgctaaaatgctgattctaactcagtgggtatagggcagggcccaggatccctttatttctgaccaggtgatgctgatgctgctggagtagaaaggatctagatttccttttccaaacatgtatttccttcttcatggaatttggaagtgtgtctgtagactatttcctctttgtaattttatggagggttagaatcatgctataaaacaggttcttacaactgaaattctgtgaaactaattcttgaaaggaagtgtcttaggtttttctggaagtgtgatacattcataaaaggcacatcactacccagtgaggtgggactctggcacatttcactccttagtgtgtgcccatcactttgtactggctgcctggagcacacagttaaggaagatgctgagtccaagtccagacattcaggaagtgtgatgtgattggttaggggcatgtgccttgggtgcagagagatagtagtacccataactttttcattattttcttggtcaaaataatcaataggacattctgggaaaagacttaatcaaagtcagtcattaaaaggactgtaattaggtaaatgctgcatatgtgtacaacagattaagtaaatagattatattattggaaatataccccattttatagctatttggcatattatccagtcatgtctcaatggtgtttagtgtattctgcactactctgaaatttaaccacctggaagaagttatgaataagaaaaaaaattctctgtcaattatttctaaaggtcatagagttaatgactagctggaaggttaattagattctgaaaacctcttcatatcaattaaatctcttatctttatgttttagtaaataaactgaataactatttagagctactgttctagggtaagaaacgttgtaaacagtaaaactacacaatgggtgtttgggttttttcctcacattaaaaaaaaaaatagttatagcaggcatggtggctcacacctgtaatcccagcactttgggaggctgagacaggaggattacttgagcctaggagttcaagaccagcctgggcaacatacagagactccaactctacaaaaataaaaataaattagctggatgtggtggtgcatacctgtactcctagctacgcaggagactgaggtcagagaatcacctgagcatgagaggttgaggctccagtgagctgtgatcatgccactgtaccccagcctgagtgacagagcaagactctatctcaaaaaaaaaaaaagtattacaaaaaagtagatatatgaattaataatagtaacttattttaataatagtaacttattttataatttctgaattactttatttttcaaaaataaaagtgtgcatattactatttaatcataaacaagttccatcactatgatgtcaaggaggaaaccatttcatagaaaaatagaccaaagttaccctatgcatgagctactactaatctaaagccaacttcactctcagttatttcaataggacataagtttattgattgactctgtggttagttccagaaacccaacccctttgaaagttactgtacacatttgtaaataaatggtatatttagcacctatactatgacaattataaactcatttgtgtcatgtaaattttctttggataatataaccagacttcagatgaaaagacatagatctgcattaatctgtaaggtagcctagccacatgtggctatacaaatataaatataatttaaattacataaaattaaaagttcagcttttcagtctcactatccacatttcaagcaagatgtgactagtggctcccaaatataattgtccattatgaaagaaaccctctgttggacagtaaatgacgaaactggtgcatctagtgttctctttcattcaaataactggcatgggctggccgaggtggctcatgcctgtaatcccagcactttgggaggccgaggcaggcggatcatttgaagtcaggagttcaagaccagcctggcctacatggtgaaacctcatctctactaaaaatacaaaaaaaaaaaaaattagccaggcgtgatggcacacgcttgtaatcccagctactcgggaggatgaagcaggagaattgcttgagcccgggaggcggaggttgcagtaaactgagattgtgccactgcactccagcactccagcctgggtgacagagcgagacacagtctctaaataaataaataaataaataaataaataaataaataaacaaacaaacaaactggcatgatggttaatagatacagcccaataaaggatatgtaaactggagaggttgcacctggctacttcaccttccattcctgcagcaggcatttatgacatgcccactgtgcgtcagtcaggacctgagccagggcagagaaatccaaccaggaaagttgaatcactcagttggcatttactccaaggaacagaatatttgttaaagtctatgtgattttgtggagaaagacgagaaaatggagggatcactgaagctggaattgccctgaggaagaagagaaaatggaaaaggcacaggaaaaatgagtagtaagaacgtagaaataagctaggtcccttgtgaacttttccaacaggaaagaaaagatcatgcgtgcacacggtttcttctgatttttcttaattagtatgtgcggaattttatcttcatccagactccatgattggttttccttaactgtagttgttctgaattaatttcatgtgggggaaaaataaagctacaaagtgatttttctaaagaatattgttgaagcattgttatgagagttcatctttcaaattttacttctaggatataggactttaaaagctccacaaatttgaaggaaagatggagattaaaaattcagttccagttacagcaacatcacacactctcattctctaacggagggcgagttatgtaaccttgctgggctttaggttcctcatgagttaatgctgtctaccctgagctccttacggggctgtcatgaggattgcaggttataacagctgtcagagcccattgtcaacccttaagttttaaaaaattagttttattttcaaagtcaagagaaaaagttcagagaagaaaaaatgctaaccaaaagaaagacaaaaattcttaatttacgactgcatagtttatgctaataagtgtattatttataagtaaatattgaatgattatataaataactgtagcattttacataaattaagaagatctaacaaaggtcaacgaattgattttttttttcttttccacaagtatttattaagtgtatgtgcaaagtatggtgttcacggccctccagggccagtagcagtccatggtggacagaatatacacagtatttgttctctcattcagtagatattgatggacatgaagatcatttgctaagcattctgccagttactggtgatgcatctgtgattatgatacccaattatctgaaccataataagatatagacaaagtacagtgggctaacagaggagaaggaaagcagttacaactgtgagcacctgaaaaatcttactgtagatttcagatgaaggcatggccttgaataagtagaataatttgatatgctaagccaatctgagaaccatttttcccatttaaactaaaagtgagactaataaatgtagtgatatatggacattaaatgcatatatgtatatatatacacacatatatgtagtatgtatatgtagcagcctttattttttgttttctgttagcactggattttttaatgtatggtttttctataaacagatggttataatttctagagaaattccatagaacacaaatgttagaaaaatgcagtgaatttcattgcctttaagcttaataaaaggttcaaccttaaagttgcatcccacatcgttagtttaactttacagatgagatttttttttcccctctctaaattctaaaacatgatacatctggctgagaggctggaaaattgttacatgcctgtgcaacattcttacaacctaatcagttcttcaacttttctcgcagtttaatcattggagaatgttctttgtttttgtagtcactgtttcacatagtaacagcttgttgtattttggtctgtttgccagagggtaggtttatttttaaaaccctgaactctgaatttttctttatttttccaagattgaaagcagctgaaatgcctggagttacaggttgaaggctgcttcacaatatgtggaggaagcttctttccctcctccctttgtgtgtgtgtgctttttttttaatttttccctaacaaatgtcttctaactggtagttgtctaaaaatagaaaactgcttaactaaaaatagcctggctctcagtcgtgccaaggaaaatggagaggaataggcgtggaatagaaggctgagtaatccagttctattcattcagagaaacctttgagaatgcgggcgatgataaagtgccctcaaaaaaccacaggcccgactctctcttcagacttctaggtgccaataaacattttagccccaggatacttttttttttttcctcataggttgtaaacattttctgaaagacaaggctttgtttcagggaacctgacaaactgccataaataactaactttcctaaggtcttaaaaattcatatttgtaagatgtattttaaaagagaatcttaaatgaaagtattgtaaaataatgtacgtcgtgtaataattaacagaggaaactctgttataataaaaaccacttactgcttgcaattaaactcaaaactttaaggagtttcacagcaagaaaattattcctgtgactcattgtaccttaagagagcagctgactcattttagtttagctccctgagacatgaaattctcttgttcagtctgtatccccttaacatgccaacatttagtctctttcttaaaattattattttcactcaagcagatttttacttttaatctttaaaatgatgtagaaactactttgaaaaatagcatttctggagtaggatggcttttagtttcaacaaatggaattctgagtaagtcataaaaaaatacgtgtgtgtgtgtgtgtgtgtgtgtgtgtgtgtgtgtgtgtatgccagttttgcaatgggaatgctttttttttctattttgttttgcttaagtaatctgtaaaccaggtcaaacatagcaacagggtgtggaaatgtcagcacagttcatagggttatacgagtctgagcattgttatgttcagttcctgtaatgctgctggtgataagactcttgagacaaaagacgataattgatggaaagaggcttaaatcattgctagaagaatcaaggtccttgtatctgtgtacatcgactcttctggtctccttccgtcttgtaaagcattttgtcgtcttgcatgttggccccctactgctctttgtaatggatgcagaccacaagtgattcctttatgcagcatacagggtgtaattgtgtctgtgtggtgtattagtaattaccaagctgaattcccatattgtatctttactgcaggcatggaaaaataggacatacaaccctgcgaaaccattttcaacctagatagtgagccacttagagctgtattccagggacaaagccttttacatgaatactttttaaacaaaattttcattgttgagtcatttgtaccatgcaggataaattcagtttgggaaattattacctttgatattatattattcatttctgactcttcagcaaagtctgtaatatggaaaatattggttctttttaactgctgaaataaaaaatatttttagatgtaatagtgatatgagctatggtaactatgctaggctatcatacagaaagagtactacgtgaattactacatataatagattctgtaacatttataaacatgaaataatatagttattttagtagcattttatcttaaacagttatatgttatacataatttatcaatattggctcaagcattgttaaacttcagaaaaagctgacaaaaaattttgttacagtaaacagatataaattattaatttctttgctataaaatttgcatccatcctttatgtattatgtagctgatattgatttgactacctccaaatcattgtggatttgaaatgtctacagtattatctgtaatagaaagccaaaataatgcaagcagcttggcttaaacaaaagaaagtatgcttattctatgcatcaaatgcttataatgacagttaagaaatattaaatagaagtgcaaagaaattaatacagcaatttcattatcgattttcaatgcagttagacttatattgcaaattattcattaaagcattcaagatttttgttatatttttaccttcatttctgaaagtggccttccagtatgtatatcttaaaaatttgcttccacttttatatgtagattttgttttattcaagcaataattattaaattcttaggatatacagaactttatattgatgccaggagaaatacaagtttggaagacattgtctgtgacctcacaaaacttacagtccaattaaggtagaaaatacatgtgggaatcaactggacaaaacaacgtaatgagaactatggggtatttagagggaggcaacatagcacagtgttgaggagcatcagttctggagatagactgcctgagttctatatgtccttgggcaaattacttagactgtctgttttattttttattttattttattttttttgagatggagtttcactcttgttgcccaggctggagtgcaatggcgtgatctcagctcaccgcaacctccacctcccgggttcaagcaattcttcctcagcctcccgagtagctaggattacaggcatgtgccaccacgcccagctaaattttttttgtatttttagtagagacagggtttctccatgttggtcaggctggtcttgaactctcgacttcaggtgatccgccagcctcggcctcccaaagtgctgggattacaggcgtgaaccactgcacccggccaactctctgtttcttaatcccatcgtctgtaaatagaggttaataatactatcttctgcttagctgttatgagaattaaatggataaacatttataaaatgcttagaacagggtctgacacttggtaaggtttacaataatgataacgacgacaatgatggcagtgccgctcctgataccatgtcatcaagcaataagtggtagaaagaagtttaaaaggtcaggacaggcagccatgattggtagtcctttttaggctcaaacaagtcaaattcagaaagatggatatcaattgatgaaaaacgtgggcaaactttcaaaaaaccaagtatgcaaagagtcacaagaaaaaagaaacaagggcatgaaaagtattagcttgatatgaagagaatattcacataaataaaaagatataagaaagatggcaatgaaaatgggaagaagagacagggaaatcaagcactctaaatatttgatgtggaattaaatgtgatacaattggcatcagaaagacactccgtggtctcgagcagtaaattagcataatgacaattcttgagagaggttccgctggaaaagacagaaacagttgtgaaaagtggaagtgccaaaatattttacgttttgtaagtatgtatatgtgtgtgtgctaaaaagcctgaaagctttcaccaaacttatatttttatttcataggacaagttgcttcagaaatattcatataattttagtttgcactaataaggtgcacatgcatttctgtgactgaggactatttatcacatacagtgtattaaaaaagcaaattatagaggcctcaggaggttttttgttgtgtttgttgttttcgttttgcttgtttttatttttttttttttgagatgatttcatgcccattgcccaggcttcaatgcagtggcacagccttggcttactgcaacctccaactcctgggctcaagtgattctcctgcctcagcctcccaagtggctgggaccacaggcacataccaccacacccaacgaatttttgtattttttgtagagacaggattttgccatgttgcccaggctgttcgaattcctgggctcaagtgatcctcccacctcagcctctcaagtgcttggattacaggagtgagccactgtgcctggcctaggaggtttattttaaactatataagcttctttacagtaaattgaaacataaatcaaaatcttataaatttagaagttcctaatgaagtagtgcactttttaatttttagacagagtctcgctaggttgcctgggctcttctcaaactcctgggatcaaaagatcctccttcctcagaacatgtgcagttttttgttttgttttgttttgtttttgacagagtctcactctgttgcccaggctggagtacaatggcacgatctcggctcactgcaacctccacctcctgggctcaagcaattctcctgcctcagtctcccgagtagctgggactacaggcatgtgccaccacacctggctaatttttgtatttttagtagatacggggtttcaccatgttggccaggctgggtcttgaactcctgacctcaagtggtccgcttgcctcggcttcccaaagtgctgagattacaggtgtgagccaccacacccagccaggacatgtgcacttttaatgatcacctaaacaggtcaggattctgaatacaatactgtcaaatatgaaaactctccccttacactttcacatccatataataaaagccctgccctttcataaaaaagacagtgtggtgctggaggagggacagacacacattttagcgtcagacaaacctggtttctgccactttcataaactctgtgatcttgggcaacattctgaatttccaccaagcttcagcttctgaagcagtaaaaaagggataataaaactcacttttggtcttcctgtaagaattaacttatgtacatatatagccattagcacatgatgctcatacaactggtatttattttcctgctgttcctttttgcatatgtaaatttaggcaaaaattttaaactttcacttgtatatacacacgcatactttggacactgaaatcttcagtgtatttggtgcttacatttaaataaaatgtcacattttataaattatcatataatgtatgtatatttcttgtgtaataacgtgatgaaattcttcagaaataaggtcctcactacacagatttttaaactagggaaagggtagaaaaaggaaaaaaactaggagtcaaaagtaattctattaagtccagtcaaaatagagttaaaagaaaaaaaaagtggaactctgccaaatagaggggcttgcccaagttctcttagtgaactctggtagatagcattaggatataatttatttcctggtgtcccctttgaactactttgtatccaagaagaggagttagacaatgagagagaaagtgaaagaacgagagagatgtagggagaaagagaagggggtaggttgattgagatttcaagacaatggaagtaattagcaaggataacacaagtgtccctatgctgccagtttctcttctgacacaaaaataaataattgatttcattgaagtattagtcagtcaacaatgcttagtgtgatgatattgttaacagtgaaatatatatgttgtgcattgcttctagggtgaaacttaagtatctttgccctggctcccgcagtattttcatggcagtgaggatacatactcttggaaatgagccaggaacactctaatgtattacacatgtggcttaataccaggtgaacaggtattttaaatattctaatcacatacccacaatgtatatcgctactgggaaaaggatatcatttttaaccactggtgtttgttctgagccatacctttttcacactctgaagattttcaagacgaactgtgatttggggagggatggccatctcagtcaactttaactgataggaggtacaacaaatttatagttctgaactctgcacctggagtctggctaccgaaatcaaaccacttgctgaccagcataaaaataaataggaaaatatttcagtgttttccacaattgcgtttgtacaaatacaagagattttatttatattaaagaaaactgtagtttttcgttttttcttttttctttttcttttttttttcgagatggattctcactctatcatccaggctagagtgcaatgatgcaatgtcagctcactgcaacctccacctcttaagttcaaacgattctcctgcctcagcctcccaagtagctgggattacaggctcctgccaccatgcccagctaatttttttgtatttttagtagagagggggtttcaccatcttggccaggctggtctcaaactcctgacctcaagtgacccacccgccttggcctcccaaagtgctgggattataggcgtgagacatgagacactgtgcctggcctgcaaattcttatattatgattaggggaagaaatttgttttccattagaaaccaccattaagtttgcaagcattgtaacataaaaaaaaaaaaaaacctcactttgctgaggcctaaatttctatattgaaatattactttctgggggaaaaagataaaatctacccaaaagtacatctaacgagaaataattctgaagattctttcagatgttctgcttcatgctgtacacacacacacacacacacacacacaaacctacacaaacctacatatattcacatatacatgcagttaatgtgagactggcagtttccagcacaaaatacatagcttccatttcactgtgcacaagttcctgtgtcagatcaacaaaactttcattgatttctatctatctgcttggcttcgacaataatgtaatgcaatcggggagggagagtttctaacttctcccagccacctgccttaacctcatgcttcattcatctcggtatagactggattcctttgacaattagtcgatagtgtacattacctcatggaagcagactttgaactatgttttgcttccttttaatggtactgtttcccctcatcttttaacagtgatcttttaaaaagaagtgtgattctgttcagaatgatggtgatggctgtttgagacattttaaaactattaggtggttaatatgtggttaatattatttattcaacagaaaatggactttaagcgcatgtgaaaagcaaagcatcataattgtaaacttcttttaaaagttatacaactttatttagtttcaattttccaaaagtccagtttcccatctgagagacatgggtattggcccggctgtgggaaacctccagagaaaacaggggagctccgctactgcggaagcagagtcagtgactgtgggtggcattttctccgctgagtcaggtcctgccagccctaccccaggcttctaccaacagtgcagattttctggcaagatgcaaaacccaagtgtttgtggttcttgaagctcttctgcagtttctccttttccttggtactttgggaaattttcactttagaagatcacatcttactgtgtcttccttgtaactgttgaaaaaattgggaagtttaagtcatttattttatttttcctctcatctggcctataaagtaacttggtgttatgtgcatgtttttcaacaaacaggaaagggaagagattatatacccatgattttgaaaataatttttatacagcatacaagatttctcgatgatccctcgctttgcccagggagaaacaatagtttctccataaaagcatacatttttctcttttccccaatctattccctcaacccaagagaaaatgtagtcttgtagttaccagcctttgcatcccccatctgctcaagcaaattgaagagaagaggcaagtggttggcttctgcatctgaagaatataggtgccaaaataataaagtggacctttttgttagtcacagagacttgaggttcttgctagtattactctaatcattgtaataaacctgtgcttcattttatgcagataggtacagtctgtatattattgggaaggacttccttcctaggcttaggaatgttaggagttgaaacatttagcagccgggcgtggtggctcacgcttgtaatcccagcactttgagaggctgaggcgggtggatcacaaggtcaagagatcgagaccatcctggctaacacggtgaaaccccgtctctactaaaaatacaaaaacaaaattagccgggcgtggtggcgggcatctgtagtcccagctactcaggaggctgaggtgggagaatggcgtgaacctgggaggcggagcttgcagtgagccaagattgtgccacagcactccagcctgggtgacaaagggagactccatctcaaaaaaaaaaaaaaaaaaaaaaagaaaagaaaaatttagcaccctttcttttccttggggcttcaacaacctacacttcattttaactagatagatagtacctacatattggtgaagggctttcccatctattctagatagtacctacatattggtgaagggccttcccatctattcagttgatattatagcaaaatagtaggaaaaacattttagataatattttttatcagaaaatgaattccgttacaaacacatccctttatgaaaaaataagatttgtcagtcatttcaccaatttcagctgagagtaagtgttcaaaggatacacagatacacaggcatggtttaggcaatccttattgttaaacaaccttgcagacgcagaataatttgatagctaagagagaaaattctggagctcattcatgggttcatagacttggttccaccactcactaactttgtaaacttcagcaagttcttgggccactgtgtgcctctttttttcatctgtagattggcagtcattgtggaagagtagcttgtgaggattaaaaaaagacccatgcaaagccacgggctcagtccctggcacatgtacatgcttggtaaatggtaggtgttattgctgaggaatggattcaattaaaatattaagaaaattaatattttgatagtgatggaagactggtttaatttcctcttcatgccatagaagaggaaatgttgtttttataattacctaatgaagaatctggaagaaatgattttgcaaatgatacccttaagctcatcactgaactaacaaaataactgagatttcataagttatggaaattgaaatacctaatttaaaaagtcaagtttgcagtacatttccatggataatgcctgaagttattgaagccatcatgactacaaaatcaggcagccaggaggccaggtctacagagtctgttcagagaaggctgtctggggccacaggacagagtgcgccgtggggctggcagcatgcacttggccttgttgagttagacaacaggtgccgagccactgccaggtgtggatatcaggatgaacaaaattgctgatggcctgtcataaagctttatgttagatcataaagtgctgagcccatatgatgagagatgagttcacatagcaagggatcacttgaagtgttcacttgattttcccctccctgtctttcacacgatcttcaaattctctctttttcactcattttcattccttccctctctccctccctccctttctttcctctcccccttccagtatttttctatctatttataacctctgtctctcattcttggtattcttatttttaaacattttctaagtagaatgacggttactggaggccggaaggggttgaggttaccagaggctggaagaggttgatgagggcgggaatgaggagttgttgatcaaagggtacagatagacagagggaataggttttgagagctactgcacagcagggtggctatggtcaataataatgtatttatatttcaaaataactaagagaataaatttcaaatgtctcaccataaaaaataagagaggtgatagatatgttaattagttagatttaatcatgccacattgtatacacataacaaaatggcacattataccatataaatatatacaagtattgtttgtcaatttaaaataatattactaataatttttttaattatggggaaaagttcatcataacagttaacaaattgattaatgaaatttatcttaacaattttatgaacaccaaagcatcatcaaaataaaagtagaagaggcatttgatgaaattcagtttctattaataaaaattcttaatggactaggaatagaaatttccttaagtttatgaaatatatcaacaaaaagggttcatagtaagtgtataatggtgaaacatttggctcattccttttaaagttataaatgagataaatatgctcccatctctgctttaagtcatactgagggcctagtcaatggaacaaaatgagataaaaaaataaaatgtatataaatcacacacacaaaaatactctctatacccttccatttttcagttctcagtgtcactctagcttttatagcatcatgtgaaatccaaggtgacaatgcacacctaagaatattatcatctgcataatatatgcagtcatgggaaatgagattttgtgaagtaataattggtccatgattctggactgtcgattcatatatggatagcattcagagaataaggaaaataaattgagatgaatttgattttaattattaatttaatttggaaacataaattttgaaaaaaattaacctgataataaagtaacttagtctatataggccttgattagcatgcagtatcagtaatagtacactttgcaaaatatttcttatgaattatattttatttgtaagtatttaacctagaaagaaggatctatttgccataatgcaatgtatgttaggaattttcagattgtatttattcatgactcgtgtcctctccgagcaattacactcaattcataattgcctacactagtgaaaaaggatccttcacattaataccataaaacagcaggaactgcaatgtgagtccaggcacagcaacccccaataacaaatgagccaggaaactagcaggcaagtcccagtggaaagttgagcagaggaccctaactctgaaatgctactggcacttttgatgtcggtcctagaaatactctgattatttttctggtactagctggaaataattatattgttaggtaagcaaataaaggccctctaattagcaaacttgaaatttacattaaattatgaaattcccagggcccagtactctgccaggtactaaggataccccgacacaaggcacagacctgccctcaaggagcgcagccttgtgtggaacagaggcaggcacacagtggcattgcagcatgcagaactacgacaggactgcaggaaagacgagtttaaataaagaaagccactggaatgatgtcagtgtgtttgcagcagaagccttgagaaactgcctcagaattttgaagcacatttatttttaagcacctgaagctcttatcaaacagtcctatcaaactttctttcatcagacacctacccaagtcaactgaacgtaaaatccaccacttattataaattcacatattaggtgagtggtaatgagataacagctacagaggataaatggattcaattctctccatctctacaagtaatctataatgtgacaggagagataaaaggtagaaacttactttgggaggccgaggcgggcagatcacgaggtcaggagatcgagaccatgctggctaacacggtgaaaccccgtctctactaaaaatacaaaaaattaacctggcgtggtggcgggcgcctgtagtcccagctactcgggaagctgaggcgggagaatggcctgaacctggaaggcggagcttgcagtgagccgagatcgccccactgcactccagcctgggcgacagagcgagaaaaaaaaaaaaaagaggtagaaacttatttgcagaaaagaaacaattatttgcattttaagtttactgctgtgagttttggagatttagtctgtgagactttcttaatgcatgatgtagttgttggtagatagaggtttgttctctgaccatttgacaacatcctgaaactctaacaacttctacctccaggtcaactgttgaacctgcaaggagccttttccccagatctctgacttccagtcggcctttctgcctcttgttcactagagagtacatcctggtttcctgtccttatgctaagtctgatgaaaccccaggatgtctgtctgctggcttaactggccctggatcagcaactgtcccctgaccagcaaccatctacccattatacctttcactgcctctgttaagcagaaggtttgccagtatatgaaccaatacagtgaaaacactaatattgcattagccaagtcccaggagagattttacatggaaagggagaagtaatatacaagtaagactagagaccaagactgctcaccttttacagacctggcaaacctgactaaaacgcgagagaggtttggttttcaagggggaacatttggattcctagccactagcttttgcttagtctgcctgagcctctccattgtatatcatcaggctgtccttaccattagtcccctgtaggacacctatccagaaaagttaaccaatttgtagcaacattctactgtcagatatcctactagttgccaaggatggaaagtcgtcaggagacttcctgtctgcaagaatcttataatctagaaaatgatataaaagcagaaaacagatagcaacaatatgaaataactgttcattatatagttctaaggaagaataaaagagacattaattctattaactctctcttccacgtgattttttccttttataatttaagtttatgtacgaggatgggggatggtggggttgaggggcagatgttgctaagggtagaatcagtgtatatgtacagtatgtatacaaacctaataagtgccctctatgtgtttttagatttcattgtaattccattttaaataagaacttctgttgctacagccttgaattccattattctttcatcgacaataacaacatttattgagtgtcatccatgtgctgggaacattcaagatgctgtggatacagaggtgaaaaagacaaagattctgctctcatagaacttcgttctaacacactgaaactcttctctccccaggcagccacaggcggctgtgacttacgtattgtgttcccacaatcccagtgacgctctgcactcctgatacttcacttttctctaatcagaacaatatgggtattgagcagtatgtgttaacagttgtcaatggcagtctctgggatggcatatcacaagctcaggcaaaaccctcaattagcatctaagtgtgtttgttcttcacagggcatattaactggggagatagactataagagaccctccctgctcattgctgtcagatcactatagaataaccaaaaccaaagtgaaaattttcaagagtgaatgacttatagccactccttgaagagcaggctggtttattaggaagagggagaaatcaattttaaaaagatttgaatgtcacgtattatgtgggaagaagttgaggataccataaatgaaatctgtgttcacaatccagaattggtccttgaaaaatctctctgcctgctatttaagaaattgaagaatagaaataacttgcagtatttttggtgctgtcccaaattgaaaactgttattggtgatgttggtcctgtgacttaagacatgacaaccacaacatagagaatgttccccatcaggacaagggccagcccaggagaaaagtgggccagggtcaagcccattagatgtctttacctctcttaagcctggctgtcaactgaacgtaaattccaccactttaggttgggagacaaggaattaaaggaaacagctcaatctttatcttgggagttcctgactgtctcagaaatgaggaatttgatatcttaagttctcaggtatgattaaaatagtcatgacataagtcaatcagttgccaacctcaagactttattttgcaatgccttatggaaagttctgtgtatactctgcttttctgataagctggtaataaactggagatcccaactgacagatattctgtaaagtacatcaagggtaatgccttgtttcggaggggagacgtagaaatagagaagagaatgcacaaaggtgtctattgcagtaagttttgttctcaacatgtttgtgtcttcctggcagtaacagagcagcagcagccacagatggcttggaagcccatcatgccccagactctgagcaggtctaaacacagagaaatcccaccatttgtgaaccagttacaatagtctgtgtcacctcctccattccctcagctcccacagggatgtcctgtgccgcaatcttgaagtcattccagatattgctttaacctaccagaacttgtactccttacattttgaggtaataatcttattaaaacaaataaatagtactgtcactctacaagaccacccaactcatttgaattagtgtctgtcactgttagaaagtatgactgtcaagtttgtttgcttattcatttatccagtgaaccataactgagaatcttggttgagtccacacatattacccaagccctgtgttagggaccagagatgcccatttttcacagaactcactacctggtggtgaagcagacatgttaaaaaataaattacagtataacataccacatataaaaaagaggtcaaggactgtacaggtacagaaaagggagttcctgagtgccttctacaagcgttaggaaaaagcttcaccaagtaagtgagggcattaggtaatagggtgtcctaggacaattaaggtttgtgtaactgagaggaggagtaaataaggatattctaggaaggatggaatggcgtatatcaaagcagtgtttctaaaggattgagctgacttgccaaatgacatgaaatttcccccttggccaaaacccagcgatatagtttggctgtatcctgacccaaatctcaccttgaattgttacagtccccacatgtcatgggagggacccagtgggaagtaattaaatcttggggatggatcattcccatgctggtctcatgatagtgaataagtcttatgagatgtgatggttttataaatgggggttcccccgcacaagctctcttgcctgccgccatgtaggacatgcctttgcttctcctctgccttctgccatgattctgaggcctccccagccatgtgaaactgtgaagccattaaacctatttttctttataaattactcagtcttggtatgtctttattagcagtgtgagaacaagctaatacacacagtaggctggagaaaagaggaaatgagcctagaggcaggtggagggttttcaaggagaacagccatccaattagatgtgcattttaattagaccctgccagaagtatgaaggaagattgactggaaggtgggagtccaaaaacaaacagacaaaacacagaagaccaaatagaaagaataacgataggtgagtcaagaaattacggaatcaagggtgatttctgagttttcagcttgaacaagtacattgtgacatttgctaggaagggaaagatgggagagaaatggatgaaggggtaggctggaatccagaaaataaatgggaaaagaaatgatatagtagaagagatcgtgggaaatcctgtagaaatgaggaaatgtggtgactcaaaagatagctcagaagtgactggtgaatgcaaagatgtaggatataagctactcgcatttcaaatgactaatcacgcatagactcaaattgaataaaaaggcatttacaactaggaaataaaaataatgatttgacttattttgatgacccaggataacatctacatcttttgttaaaataagtcattaatggtttatgaaagatgctccaacatgttatttgtaaagcatcagtgcctcaagatacagcctttttgtccctgtaaccaacccatttgcaagtaaaatgccatagtctaaaatgtttagtatgtgaagttacaattattatacattttatactttcaaaaaacctgttctctgatcttatattaatttactcctttcctctctcaacctttgtttaatttatagttctgtcttgtcttttccttcctcatttaagaaatcactaacattgcccattcttcaaaacaacctacaacttgattctttgcattccagcctttcttttcttaacttgcattataaagattattaggataggctggacacagtggcccatgcccataatcctagcactttaggaggcttaggtgggtggattacatgaggtcaagagttcaagaccagcctggacaacattgtgagaccccatctctaccaaaaactacaaaaattagccagacttgatggcacacacctgtaattccagctacttgggagactgaagtgggaagatcacttgaacccaggaggcagaggttgcagtgagctgagatcatgccgctgcactccagcctgggtgacagagcaagactctgtctaacaacaacaacaactatagctatagatatagatatataggattaactgcatatcctatcatgcatttcaattattatatattaaatgttctctctttagtatttcacttcacatctctgctggattgaggatctcagggagtgttttacagctaacgtgtgccagacttccccatctcagtcccattctaggccaactcatgatgcatgccctgtccgggttccaatagaggtttggcggaagaatccttacaaacaccaaatccttgatctgtcctgaggaagcctgaatcatctgattggccccagaatcaccctgattttccatgaattccctcaggcaaatgttggcccagaataagaccaatgtaaaagcccaggagaatagtggagcagtagactagcatccaagaatgggggaaaatgatgaactttgcccaagaatttgaaagcatgcttaattcagatttatagtatctgactcacattcacaaatttccctgtgctctttcctacaaaggttttgtttttcctttgctaacctttaccttctgcctaaaatatcactcccttttttctctttccatgctgaaaattctgtgccctctttcagctacacttttgatcactgagattatatgcttatgactttctggcattaaaagatttcactgactgctcagtttttctgagggtgtctatttagactagtacccctaaattttaagcgttcaataatgtaaaatttgtgagttataatgtttcatacatagtacaaatcacacctacattgcactgctttctaacttaaaaactgtacatttcaaaaagtagtaaatttgggagttattaagagggaataaaaacattgagttttaacgtagtgtgaaatggtagtaataaatggaaaaaaaagagattgcagttgcaaaatactgcactgagactaatcttcctccctctaacatttgaacattcttttctgttctgttcatctattcatttcagtttgtcatgaatgctgcaaatatctagtaagttccgaccacttgccaggccttgtgctaagttctggtgatacgagatgacaaataaactattcctaacctctagtagctcatagtagcaggaagaaaaacacatacataaacaaatcatctttatcaaatgtccagaaaaatcatcttagcatccagaggaccactggcagcacctgacatatagtagcagttagtaaatatgtatcaaggggtctggaccctactacagcctttgcctccagccagccagacagccttggtcaagtcaagaaacctccacatacattaacattgaagtggaaatgtgtgttccattcattcatctagcatttattgagcaactacagtaggtcagactgctctctggtgaaactccaaagtgaataaagcaaagtgctttgttaaggacctctcaatctagcagaggggaaaaagcacataaaggatcaataatgtatgattaagactatagtgggaaaatgtgtagaataaaatgagtgcctgaatgaaggagaaactgattcagcctgagcgatcagaaagtctaaagagaggagacaatgtgtcagctgctctttgaaggaggaacagatattggtgggctcattcctgaaggagagcccagcttgagaagggatgcagaaggaaaggcatgcagcgtttgcaccattattcctcacccactgtgggcatgaggaagggccggatgatgcttggcggtctcatccagactagagtatcaataattagcaccatttgaatgtttatgtcaaataatttgtggcccttaagacagagttggtggatgtttccttgtgttcaatacatgaaaaggctttcaaatctttaattagtgtgtcttttatttccattatttgaagatgaaaatgattcagtcaaaaaaatttcagctccaatattaagattatcttttgaggaagcatataaaaataaaaacaatgacaatatccaaccccatccaccccttccccagtagaagttgatatctggctagaatgagcattaataaataacctagagaaatacagtattgtacagttttatattttcaactttttattaaaatttttaccacaagtgaataatttttgttaaaatctaactttttgtactctgtattggatatgatttgcttgcctaattaaagtctacctgctgattatactagatttaatatattaatgtgtcttcatttctagaataagaacaaagaaaagggactatggtactacagggagagatagtatagacaatgcttacagttttattaaaacctgtggagaaatttcttggcatctaatcttccctcagcctaaggcaaaaaccatacaatgttataagtcaggtcagagctttttagttttaaatttggctgctttcctaacacataagcgtacaaaacagtatctggcacatggtaggttttcaataattgtttgccgaataaattttaaatgaagtaaggcactgggcacagtcctcaaagcacctctctgtagatactaaagggtcaggaaacagcagcagcgtgagtaccagcacaccaatatggaaacactttcaggaaatattcttagaaactcaatttataggcagtattcatttcaactgcacttcctattcctacatgaatttactactttctaaagattattcagcttgttaagagtagatacttatcttcataaagctgtgaacgacaagcaaaaaaatgattcaggatcagaggaaaggaaactaccttttctaagttgatgcttttttttcttggtttttgtgtgaacatgacattgatgcaactaatagtaataattcctgcatgtgttcttgacacatcaaccctctgaagtaaagatcacactacctatgcaacaaagtgtgattacttggatttttaacaaaggttaataggagtaatttgggggtttctccaggtttctctgcatgtagaatgggcaggcacaggaaaaggatgatgatgaaaatatacattcttgaggactgagactgcagacatgtaaagaaattgagtggttgaaagcttttagtctgtgatggtggttctctgaaaaaaagctgaattttacttaaatagcattaatataaaaatacagcttcatataatcgaaaaaggtcaataatttacttatttctttttactaacgagataatttttgaaagaataaaaggaaaaaattttttaaataacaaaatagtatttaagaagggaaaaatcagttttaatcactgcataagaaaaggattttctagttgataacgtaatgcctaaaacaagaaatgagagctccatgtagcattctttttcatttatattcctttcagtaacgaaatagaatctgttcccctaatgaaattctatttcattagaatttttgaagcacctgtcacctatcatcatcagtttgtacgtatttcaagtttttccgatgagcaaatggaataatgcagggtccatatgtccacatgtctgggaggaaagattccacgtggtttttggattacctgtctggactctttctcccatttattgcttggaatatgtcaccttctgtcaatctaattactcctctaggaaacggctgttctcagctcacagtatgacaatcgctgtcttgtgaaaatatcccagaagcctctgtagttgatggatctacctcaacagtgtcactctgacgtggaaagctgacttcagtatacaggcttgctcaagatttacttgagttctctgaggaaagagtttcttcagatacgtaaggagagaagctggtggttttaggagatctcttgccttatcttgacatacatgaataaatcttttcaaaacgtagtcagtcagctgagagacagtatatacatttaggacttccagcccctgtaaaagaatgacaattgaagtacctacattacctgaccagtgacacttgtaaaagatcagagaagctttcaaaggccaacagcagagattttgattttgctagaaaagggcccgaaggaataatgcttatttatccatttagtcagccctttcgttcatatcgactattcattactgtgataaagacagacttggctgaatctaacagaaattcttttgttatcattaaacagctgtagatttttaatataataaagataaaactgctcttatagttccacattcacactatgatattcaagtttgtgccatcacttccattttcagagctttataattccaccataatcatttgttcttggcagaaatgtgttatacaagcactcagctgaggataatatttttgaacatttttttcaatgttctttctggttatgtgattatgggaatttggaactcaatattaatttgctcttcagctttgtgtttgtatatctcaaaatgctcttttttaaataacacaatttaacttgaatcattacttagattcgggtgatattcatagcaagataatgcagtcagatacaagaagaatgtattgggagaaaatgagccacatttttccttctcatcactgccatttcctttgtgactccatgccacctgccttgtttgtttaatagtttatataattcttcaggtacaaagtgagccactgacctaattggtttttttcattcataaactgatgtgttttattgaccaatatgcattccaactcttgactaaaatttgacatctaagaaaatcaatattttagctctattttcatacttgaaattttccctcagcctaattttttaaaatttctacttctttttttttttttttttttttttgagatggagtctcactctgttgcccaggctgaagtgcagtggtgtgatctcggctcactgcaatctctggctcccgggttcaagtgattttcctgtgtcagcctcccaagtagctgcaattacaggcgtgcgccaccatgcctggcttattttttgtatttttggtagagacaggtttcaccatgctggccaggcttggctcaaactcctgacctcgtgatcggcctgcctcggcctcccaaagtgctgggattacaggcgagagccaccacgcctggacaatttctacttcatttatttcagtgtccagtgtactaactatagttacatatgagtgagagagatctagtctgcactcatcacttcacacgggtgggaaaacgggcaggggaaagtcaggccccacactgtctccaggcaggaggcaaatactcgttgactgaccttggaccatcatgcttggccatatgggtttgagacctggcataggtttacctaatctcttcatggaagacttgtgagagataatgggttaatatttgtggagatctttcaacaaagtgtaattgatgtttgaatttttataaaccaaacacaatatctaccccctgaaagctttgtgagaatatttagcacacatgtatgtgccagatggattgtaatgacagttgataggcctctcctcacccttgcattctgttgtcagaaatctgcatatcaaaacaactataatttttacaataagatttattggttaaaagatttgggtgcacactgaaaaatctactgcctggataagactataaattaacattatggaaggctttaaattaaaggtttatataagaaaattattggcagggtgccatggctcatgcctgtaatcccagcattttgggaagctgaggcaggagcatcccttgagtctaggagttcaagagcagcctggacaacataatgagaccctgattctacaaaaataatttttaaccaggtgtggtggcacacacctgtagtaccaactgcccaggaggctgagttggaaggattgtctgggcctacaatgtggaggctgcagtaagctatgaccacgccacactgcattccagcctgggcaacagagcaagactctgactcaaaaaaaaaaaaaagaaagaaagaatatttttaacatgtcttatagataacttttgaaaaatatcaaataatattttcttgatctgacatatttttctctatacaaatgaattctaatgaaaaatatgtggaatataatgcaaaaacaatcagaaagtattcttaaaagctcaaagatatgcagagatcaaagcagaaacacatcataatacaatagttatcagccagaagaatgtttttgtggttgagataataagaaaagagtatgaagcacaggaagttaagttagtaaataaaattattattctaatgtattgtgatgttctttatagtattactgtagaaagtctctaaaagtacttgttatgagtgaaaaatgatgcctgtagatccaagataaggggacaggtggccccaccaattataaattccccaagattgtaaatgtatattttatcatgctgtgtcaaaatattcattttaatattcaaacattttaccacataataagctgtaaccatatgtttatttgttatattataccactataacattaataaatatttacagagccactgtgtatcccagatatattagaaatcatagctttcttgattttttattttaagtgaaaatattcagtgcctcagaaactaattttaaataatgttacatttgttacacattgataagagccaaggagtttagatttttaagactgacacccccctttttaactcatgttgttttatttattttccccaattgcatgaattaaagatggggtgttatctcagctttgaattccttagcttgatgtcacagcttttgctttatttgtatgtgaattctgtctttaataaagatgagctctgctgaactttccattaatgagagacacttaggtatgcatctctttataacggatcttggtggtaccaggaaaattcagaaatgttgctagtctattaataattaacatgacaaactatgattaatcagaagttttatgatctctaaaaacataacattatctctgtaaatcgaattgtatacaattaagttgacaaccgttagtaaaaaaaaataataataataaagcaggccaggttgtggtggctcagcctgtaatcccagcactttgggaggctgaggcaggcagatcacatgaggcaaggaatttgagaccaacctggccaacatggagaaacccattccctactaaatatacagaaattagctgggcatggtgatgtacccagccactcaggaggctgaggcaggagaatcacttgaacccagaaggcagaggttgtagtgagccaagatcactccactatactccagcctgggcgacagagcaaaatcctgtctcaaatttaaaaaaccaagtaaaactcaagactcctaacttatactttttctgttacaatgttacattagtatttattcttctgtgacagctgagactagaccagacccacatccaggagacaggaggttcaagatgaggcactgactttttactttcatgtgtcagtctcagggtgattcctactcagctgaaaaactaggaggaacccttgctagtttggtagttattgacttggttacctgttttcagtgttcttcgtcttccttactcagctcagctgttttcacttttctttccacctgtgtttaggaagagaccttctcagtattataaattttgataagattttcacatatatagaaccctaacaaacaaaagtagttctccatataagcacagcgtctgagcattcttcaccgatgcttggtggggatattagctgtgttctcttacaccctttagctgtcaagtacatcagaagtggaggctgtggggacaggacaccactaatgccaaccattagtttaaattcacacttggatctgtttccaacatttctgcttttgtcatcatcacaggttcggaaatcattgtgtaatgtcctgatttctgatttttctgtgggaagagagtgttgcaatttgccaccttaattgtattctgctgtaattgtctctcactagatatttgaagcacgtaagaattctgtatcatgaaacttgagtccttataccctctgttcattgactgaatttagttgcaagaggaatctttcgcttttatttttttaaactgctgatgagcactcgattgaaatgactcagctttcatctgtggtttctcttccctaatagaataaagcatatgtaataacctgaaatactggacagcttgaacttctttaatgcccctgaatgtctcttacagcctttgtctaggtttgaactttccaaattatgtatttcagacgttgagaaagaagggccttaatggctgtgacagcccagaccccgatgcggacgattccgtaggtcacagccctgagtctgaggacaagtacaggaaaattaacgaagatattgatctaatgatcagcaggcaaagattgtgtgtaagtactcagaacacccttcattttttttactcttgatatttctctgaacctggcaggcattgaacaagaaagaaaacaaaggctgtgaaagccccgatcccgactcctcttatgcactcaccccacgcactgaagaaaaatacaaaaaaattaatgaagaatttgataatatgatcaagagtcataaaattcctgtaagtaccaaaggtagatggctggtctgctgataactgctgcagtaacataccttaaccctctcagtgatggctttctctaagactcttcggaaagtcaaacagataaatagccatctcatcccacgggcagctcatttagaaagcaaaccctaaaggatgctgagattatgtaatctaacagagttgccatcgaaaagttcattctgaggtagaacagttcacagcaggaagagaaagatttatgagacacaccgtaaatttacacaatcttttaaacacacagtccatgcaaatcacaatacatgagtaaaacactggaacctccttccaagcaagtttgagaattgctataaaatacatagattatacattgtttgctaagagcagatactcaagtgggtcagcaattctttcatgtaaactgacaatcatcacctaaataaaagctgatttctgaataaaacttcagcccctctccctatacatgaaattcaacaacagcactgaagggttaaagctaatgctcgctgcagggaacagactgcatgaaacctaatggtaagatttcaacatgtttgtgtgctggggtgattttaaagctttatcagaatattatccgctttgccaccaacattttccatgctttaacatttggctaatttttgttttaaccaaatgaaaaaaattctaacagtcaatcatatgccttgccagatatttaagagaaataactgcatgtattattttgttgtccacatatataggaggaaagtacatactttttattagattctgtcatcaatcaaataatgttaattttgtggcttaaaggggtgaaacccaaggctcacataccttctaaataactaatgttagtgtctgaaccttaattgtatacaagctcctcagtaggcaatcagttccttttgaaaaaagttcattttttgtaagttagcaaaacagcctaaacctgagaaatgagagagactgaagtgaaaatatgttttggtgattacaagtgcagatatgtggggacaaagttcgaggccaaattcacaactgcactcacaagataaattaatactttaccatagtagctgcacactcaaacctgaattgaattaaattgaacactttaaaacttatttacaaaatgtgtgcatattaaaatttctatccttataaatacctatctgcttcttttgttaaatgaaatgtcagcagtagaacttttgttgaatcagaattattaatacactgtatcatgaaggaaagctaagtgctgtaaattcttaagggtttcataaaactgactattatatgcgcacattcatagtgggcactttatgaaatggagtatttagtattatatgtagccatgcatacttgttatgtccagaattattaaataataaaatatccattggtattttattttgcctagaagaaaaaaagaagcggctcatttgggccaatttttatttttatttatttatttttatttttgagacggagtttcactcttgttgcccaggctggagtgcaatggcacgatctccactcaccgcaacctctgcttcccaggttcaagcaattctcctgcctcagcctcccgaatagctaggattacaagcatgtgccaccactcccggctaattttgtatttttagcagagatggaatttctccatgttggtcaggctggtctcaaactcctgaccttaggtgatccacccgcctgggcctcccaaggtgctgggattacaggcgtgagccactgcgccacgccatttgggccaatttttagttcttatgatctgagtttatcttgctatataatacattggtgtggagcagctgtgcattaaggtttgtaagtgtaggatgttaaggcggagtaccttaggtgtgtcagatagtaagaatcccctgcacagttggaataaagacagatgtatgcagtactgctgatcactcaatggaagcgatcatataggtggagttttaacccctaaagttctggaagaatgcacattggatcttgtttctcatactttagggagagagacatgtaatacacacctgtattccctcacaggatttcagcctgttacgtaaagagttcaagatcaagatacgtgatttcttaaggggtgcagtggtgtgtggtaggggctgaaaaaccacattagagtttacgggcagagctgtgagaaggagccacccagctccgagctatgccacagagtctccatctctttagtaagtgcttcagtcttcacgatgaaaagcccagtttttgcacatcgctctgagttgctggaagtcaattttgttgaaagtttccacagctgctaaaacatttacagcagggcaaggacactctgccctttgtatgtagagagtgtctccacctctttaaaaacattacaagactgtttttctatttcgaagacccagtttgaagagtttcccttttaaaacagaaaatttaatattgcagtcacctgttagcatattgtaatttatgcccatattcctcaattacataaaataattcatgggtgatttggaactgtgtcgagcagcatttcctcatgctgggttcgccatggttcatgctgggcttcacagcaagagaaaacacctccgtctgaggaaccagcagaagttaggaaaggggctgaatgaatgagaggcgggtgcaagttggttgagagtaaaagggaagggaggaagtggaaagaaacagtatgtattttcttcaaaataatgggctgtgaagagagagaaataatgttgtatgtaggatcaagggaggagttaaaatgaaagcgcttgagattatttacatgcagaggagaagtgcttggaggaaggaaaagattgaacatacaggtacaatggagatagaatggcaaagcctctcaaggaagggaaggaggatgggacctaaacaagaaggtgttacagatggagccaggtgtagctaaggtggtagctgggtagaattacgctgagtaggtgaccatataatgacctctattttattttatttttattttttattttttgagacggggtctcaccccgtgcctcaggatggagtgcaacggcgtgatcctggctcccctcaacctccgcctcccatgttcaagtgattctcctgccttagcctcccaagtagctgggactacaggtgcctgccaccaggtctggctagtttttgtatttttagtagagatggagtttcaccatgttggccaggctgttctggaactcctgacctcaagtgatccgcccgtctcggcctcccaaagtgctggtatcacaggtgtgagcctccatgcctggctattttgttttttaatgtatttagtttagcttctgtagttaattagggaagggggaagcaggtgattgaaaaaggaccgagaagttagacatcatgaggaataggagttggagagggaatgaacaagtccatgatagacttgtcaggcagccttgagggaatttagataaccagcattggtactcacaagtcatcagagttgtatgattttttttttcctctactacagcccagcagctggtaatggttaatcaaaatttaaaggtgtcattagtggcaaaaaaagggtggggggaagattcagttcaatcactcacattaaataaaagagggcccattaactaaaaatattttactttaactattttatttgatttttttattggacttttccttgtggtaagtttgggaaaatagtgggttttggatgagagttcagatacttttctgattatgactcactacagtaaccgtgatcactttgttcagggatagaaactaaaagttttttagctgtcatgtctgtgtccttcaaagctgggaccggcttcatgggccctcgacttggccctgttctcatagggctgcacttggttaaatactctgctgtcattgtcttgaagttcttaatacttttttaaaaagggcccccacattttcattttgcactgggccctgcaaattacatagccagttctgctgacagcatttcatttaatcaccccaaattctctctttcttcctatcttgagtgtttgtaaaaggtggagcctggccctgaagtctttgcaagtttggtgtttttaactactttttggctttcattttttagacaaaaaaaaaaattgtttaaatgtagatgctttcaagtttcctaattttgaaaagtcaaggagaaaaagaataatgccaatttcttagaaatatttatatgtgattatagcatttgcattccctaaaatgtttagagcagcttcatctcttcatagatacaaccatttcatgccttagataagaaaatcaaggtcaagggagattaaatgacctgcctggttagatggcaatttattacataacctggactgtaactgagattcctgatagaaaggctagtgtttattctgattctctaaaatatcttctcagtgtgctcatttttaagcttataatttgctttcaaaattattatagatagttcctttaactcagaaacagaaaatctaataccgtatgttctcacttagaagtgggagctaaacaatgggtacacatggacataaagatggaaataatagacactggggactccaaaaggggggaaggtagcagggcggggtgaagtttgaaaaattagctcttaggtacaatgttcactatttgggtaatgggtacactagaaatccagtccccaccagtatgcaatatatccatgtaacaaacatgcacatgtatctaaaataaaattaaattttaaaaaattattataggtagttcttgatacaggtaaagcaaaagattaatagaatacaaatgatcttggtatattttatgaattttgaaattttcaactatactctgataccataattatatttgactgcttagccaatcacaaagtagttttataataatcattatcatccagttgtttctgatccagaattctagaagctgaagaattaattcttggggataatagtcagaggaaggaaggagtagaatgactttcactgacctgcttgtttggatggttctgaactcattacataattattaataatcctctttattttggatgtgcatataatcacccaagggtgaggggatatgggctttgctctctaatgagacacaaccaacattctatagcatattcagggaagatatagttttatagcagatccttagatacctattaacagttaaacatttataagtagtaacagtgaattcaaattaaaacatttgtagcccagagatggctttaaatacaaactctaagcaaatatggaaaaggggagtctttaagatttattttttcctaaaacctgagacactccagtgtagatactcacccacatttcatgagaacccatttagtttattatttacatggtccaaagataataaactgctaatatctagcccttattcacttaacagaatgatttctgactacagtattttatttctatccaaaaacttatactgtgttgcatagtgtttggtagcaaaagcaacagactcagtcactagttagatgactttgggtcacttacttaacttaccaatttgaaaaggaaagaattatatctatggtcaagggatgtttaaaaggttaaatcatatcatgtatgtcaactatacagcacagtgcctgctcaataagtaatatacagtaaatagaagctttacttttgtgtcagtagagtgtcttcctaaaaattctcctttgaagaaaaatattaagttcgtataataagaagtagagtaggctctgcattgcctcacagcaaaagggcactatttaaccaacatcataaatgattttataaccaaggagaaagaagagcaggagaaagagatcaggatatgggcaaggggcaggacaaattgcaggattaaatagggtggtcagcgtgggcttccaagagaaggccagattttgagcagagacttgaaggaggtgatgcagttcgtcatggaaatgaggcagggaggcagaaggtgttaggcgatgagataacggaggttggcaaaagctagagcttaatagggcctgtggacccttggaagaaaaaaattctcatcttgagtttttattctaagatgagagccctcacagggttttgagcagaggagtgttggcatgacttaagcttttaaagggtcaatctaatttctggtttgaaaatataaaggatggcaaggaccggagcaggtaaatctgttaggacgtgactgcagttatctaggcaagagatggcactgcttgagccagtgtaatagtcacaccctccagtcattttgatacccaaagatagtccaacagatttccaaaatgctccctaaggagacagtcccacccctgtagagtaccagtgttctagatctagagagttactattatggcccaaggttgcagcaggaaacagatggcaaactctaaagggtaattgaagacagtttgttaaaaggactgtttacagatgggtagagttaaggaaaacctgagagaataatgaagtacattagggcttgcaacctagaagctgttcctatctctagatctgaaagagtaagtggaggggaaaagtaccagatcacagcaagatctatgtgtataggagagaacaactcaaaaagagatggggtcttcgctagagaaacgcagcctcagccagcctgtggcccagcaaggatgatgccactataaaaaaataccctgactttgctcccctcctgctctctgtgctgttgctggtgcctcccccactgaccagtgggaagccagagggcaggagagcctggttgatgcagtctggagggtcagctcctgggcacacagtacagtgaaggggctagagggtgggtctggatggagcaagtggagaatatacctagtagaatcactttactttgttttcttgggtatgctagagcaatccttatttggccttttaatgaagaaatacaatattttattcatgctatagacttcgactttacagcatatgctgattttttgttgttaaaagggggctggacatgtaaggctaaattcattatttgatgtcttatcaaacatttatattccattatgtcatgatgtctatccaaaaattatttcccctgtttactgtagataaatcctaataaagactgaccatattacttatatcacttgaacatttttatttccctctaaaacaatgacagattgggccagatgtggtagctcacacctataatcccagtactttgggaggccgaggtgggcggatcacctgcgctcaggagttcaagaccagcctgggcaacatggcaaaaccccatctctactaaaaatacaaaaaaatagctgggcgtggtggcacatgccaaccactacttgggaggcagaggcagcagaatcacttgaaccagataggcagaggttgcagtgagcagagatggcaccactgcactccagcctaagcaacagagtgagactgtgtctaaaaataataatataataataaaagtaaatatgaaataaaatacaaatgaaaaatcaaagatgtgtgaaagaaaagagttttgaatgtaaagcatttgctgttgtcaagattgacatgtccagaacatggaagaaaagaaaaatgggaaattaataataagggagcataaacataaacaaagaaaagtattgtgatcatcaccaagataaacagagaaatattacacagaaagatgtatgatgcaggccagccaaccaaacagtaacagaaagtggatgtcagcactaagggcaaacaatagtaaaaacaaaatgggaccaaaaaaaacaaccaactgagcctcaagcacatatgcatttaaatttgcacaataacttattgagaacccccaagggaatgccttaatgccttctataaatcctattccatatatatgtccattttatattaagaatgccatatgctttgataccatatgagttctctggcattatattcaaagagtatttttactcgtaatgcttaaaaaaaagtagctacaattatgttcctatgttcatctagttagtacagcagaaacataaacatgattttgcttaaattgacaaaataattactcaaaaatcaatcattgaaacctggattaatctaattagacatccacacagcttcagttcactaaatatttgccaactttcacaattgagatacaggtcttgccatttgtcagtggcggtacacaccaaaatatgaagcatagtgttttctgaattaccacttcaaaatgtgaattattgaatgatacatgctctgttgaatcttgtatgttaaaatgcctattatctttagagttacttttaaaacatagactttaaaaaatgataattaaggtatatgtgctatgcacatgcttggagatgattttctatcattaaacttctacataaatatgcttcaataagcaattaaatcaaaggcttcggtttgcattttaatcctttttctctgtgaagtcatcacaatcaggcacctttgatcttgcagtcatttctggcaccagattcagatatcacaaatgaacaattactacttaatagaatggaatccaaagacaatggagtctaatgaaatggggctttgttttaaacaaaagtgaaacgttttttaatggttgcaaagaaggagttctaagcacatttaagaaatcaatttatgatctgaacgtcttgagggctcttcttaatggtcttctagacacaaagtagtttggaatgtagaatttttcttggaaaaataagggctgtctgtcttgaagagcttctgttattaattcttttcttttacctttgttttgttttctgttcctgcaggctgttccacctcccaacttcgagatgccagtctccatcccagtgtccagccacaacagtttggtgtacagcaaccctgtcagctcactgggaaaccccaacctattgccactggctcacccttctctgcagaggaatagtatgtctcctggtgtaacacatcgacctccaagtgcaggtaacacaggtatgtcctcataaggatgtaatgctaacaaatagttggaaggaaccattttcggcaaagccaacactgctttatctacgagatgttttctggttttccacttactctccttcatggcttaccatccacccccgagctaggtctcctgcatgatagagcctaaattctttagtatgtttttcgaaatctttcataatctgccgtttatctttttcattctgtcacctatctcctcctgtggctatattttaaccacatactctcaaacaggatgtcagatatcctttctccacacttttacttctgctcgtcctccctgcctaaaatgccattttccctcttcctcctggccaagctaccacttctgtgaaaccttcccctgtgttctgtgatagtatttatcccatttagttatttattatttgggtcaatttttttttatttatacagtaacttatcccacaaaggacttaggcagaaaggaaatatgataagatagcatcatttgtaagacatgtgaaataaaaacaaagctgaatcagaaatgaagttaattaaacacatgtacacctgccacaaatttgtctctgcacttttacttgctgttgttcaattcacagtgtccaagagaaaaataaattatttctcagaaaaagttcatccattcttagtacttagaacaatcaaaatacattatgatgaattgtatttaatatatgtctattttgatactggatttaaagaacatttaagggaagaatgttctcttgatttgctaaactaacagtaggaaccaagtcaatgcgtattgaatataacaaaattattcctttatgtttccagaagcagcatcaaaaataattgtatttctaagtcacatacagcaaaccattatatatttgcatttcatatttttaaaagtactctataggaaatttttaatgtatcctacatacacatagctgtatgaaaatagtttattcatggaggaattttcctgtagaatacttatatatctgccttacaattaaaaccaaacatgtattactatttttgttacagaagctttatatagaaaatacaattaaattcatccaaataaaaaattttaatcttgagtctgggaaatgtatacaaaggacttcattgagccattctcttgacttttgaatatatttgaaaattttcgtatgaattttcagtaaccacatgtattcctttcagatcatactagaatgcagttcactttcctatttgataaactcatgctcatttttttgaatttgatacggtatttccaaaatattatctgattggaaataataaacatttgcttaaactgtaacgaaggccagatgcagtgggtcacgcctgtaatctcaacactttaggaggctgaggtgggaggattgcttgagcccaggaattcaagaccagcctgggcaacatagagaaaccccatctctacaaacattttttttttaaattaactaggtacagtggcttgtgtatgtgttcccggctactcgagaggctggggtgggaggaccacttgagcctgggaggttgaggctgcagtgagccatattactgccactatactccagcctgggcaacagagcaagctctgtctcaaaaaaaaaaaaaaatcgtgtatatatatgtatatatataaacaaacattttcttttaattccaaaacctgaaccaactaataattacagagtatcacttagaggcaattagaaaatctagatgatattctcactattattcttttggctgaatgttgtttttttcaaaactaaaagtaatttttttttttttgagacggagtctcgctgtgttgcccaggctggagtgcagtggcaccatctcggctcactgcaagctctgcctcccaggttcacgccattctcctgcctcagcctcccgagtagctgggaccacaggcacccgccaccacgcccggctaattttttgtatttttagtagagacagggtttcaccgtgttagccaggatggtctctatctcctgacctcgtgatccgcccacctgggcctcccaaagtgctgggattacaggcatgagccaccgcgccaggcccaaaactaaaagtaatttttatgttcaataccttattgaaacatcttgactctcataaataaacattgccaaattttaacatactgtctaaagttagcaatgaataagcatatgtttcttaatctgtggccggtgaaaaatttgttatattgtgtcagtcaataagattttagtagtaaatgtgggtagattcatgaaacgatcaaatttctggacaattaacattgcacaaaattaatggcataaaacatatttacaaagaactaaacatcaaatgtgaggtcatctgagcatatagtagaccttactctttctttcactttctataaaacatctgcttagggaaaacctagacttagaaataataaaaatgcagagaccaaagactggatttttttaaatgtaactttcttagaaaaaagattctgcaaaatgtcagtgattgaatgtatttttaacgtttgagcacagcatggcacaataaaacaaatgtcagccatctgacttgggttgtactttacaagtttatgactattgcaagaggacaaaatactgaggttgctgaaggtaaagtgttttgttctgtgggcctttagcctttctcgttttgatcttcctctttaatccataggtggtctgatgggtggagacctcacgtctggtgcaggcaccagtgcaggtaagcccagactccatactgcagtatgtatcattgttctgagttcttctactaggtgatttgcaggacaaagtcttttgaacaaataaagttaagagatctgtgagaggcatggaaaaatgacaccaagaatttttaaagcacttttctgaagcaggagtggttaaatagtaacttagaagaaaactatttattaactagaaccttccttaataaagcttcaactggtcagcagagaattaagggctctgatccaatcaacttaatcctggataccatccttggacacaagagtacctttagcaaaccatactttttgtgttctctgttaatcatttcacattaaatatgaatcattttccagccaaagaagtattgaacttctatgcatttctaaagaagagtacataaagaaaaggaggggttaagattttaattattcaacaatactgttaataaaataaaatcacattggcattaaaatgagctcttagacaacatgaatataatgcatccccaaaagaccctaaaatatatttcagctaagaacttcttacactgtgaccaataattgtctcagtcacatttctccaggtttccgtgttaatttgtaatattgagattattgagatatcgatgtcattttcaatgcagaggcaagatagcacaatactttcaaatgccaactgcagttcactattggcataacaagtaaccatggtaatttctgcagctggaacatgctatacatttaaaatagtaggaggcaggcatgaatgacacaaggttatgtttgaaatgtcaaaaaaaatcaagtttattgaaatagacatggatagcctaattaaaatattttgccagggtcaagtagaatagcctgctaattataagaaagaagataaagaaaattggtttacaaatacatttttataaatatatctatttgagggtagagtttctctgttctgatgctggctcttcactaattcactgaataatgaagaaaaagtattagacctacacagtgattagcaaacaagatgaataacactagcttcctattttatatatcttttgaaaattaggtcgagccaaattagtgtgtaaactcacgtagtattttgctggacatggaaatgaaattttttccctcaaaaaatactttgtggtttgtagcctcaaaatgagagaaccagatcaaatccagaccaatgtttcttggatccaagtctctaccaaacactatgattagaaagaatggtgaggactgagaattgggtggtcacaaagaccaagatataatataagaaaaatggtttagatgttatgatgttttacccaatatctcactgcaccgatttgcttgccattatggaaacagctagtagtggttctgaaagtcattaaaagtagtaaaaaagggccgggcggcggtggctcacgcctgtaatcccagcactttgggagcccgaggcgggcggatcacgaggtcaggagatcgagaccatcccggctaaaacggtgaaaccccgtctctactaaaaatacaaaaaaattagccgggcgtagtggcgggcgccgtagtcccagctacttgggaggctgaggcaggagaatggcgtgaaacccgggaggacagaagccttgcacagtagagcccgaagatccctgccactgcactccagcctgggcgacagagcgagactccgtctcaaaaaaaaaaaaaaaaaaaaaaaaaaaaaaaaagtagtaaaaaaaaaaaaaatgtggaggaaaacatggcctactcagctttgatggaagtggcttgttactgcttaatagctagaatgctttggaatcctatattgaaaataaaaagtgtttggttgttcaattattctgtcattgtcaattcccagacagttggctaagtttaatgatcctctagggatagagaagactctcaatcctgtaggcataaaagtttgacacacgtaggatatagtaacattgaactaacaaaatcttatgcacttagcaaattcatcctcttacctcaggacctctaccataggtatgagaatcttctaattcagaaatagaagaaaaccaaaagaaagatactgaattactccaccctggtgataataaatattatatcttgattgcatattatagctacgagcatgtagttttcacagtttctatatagctgtgaaagtgttacccatattttaaaaatagaggaagaagccctttctaactctggtcccaaggaacacctgttgcagatgccacttagtctcaagcttagctgtcatgtcctactcataaactcagccatcttccccttctttctcatgccaaccagtatcatatgtcaggctgaatatatccgtgctgatgtcagagaatcacataacaccagaggaaaacaaggccagccagaatgttgctacattttcagagaagaaaaccaaagcaaaaaggccaaaatatagcttccaaattttgcatattgtcattgaaattcaaggtttcagataaagtttgaaactcttgaggccaagtggcgagactgcaattacgttactttttagcagctgcagtttttttctgaatcaagtcatctcactttgtaaaaaaaaaaaaaagtgagagggagggagagtctcatgaggcaaggaagtaaattgaacatttattttgtgcctataaatactaaaagaccaaaaaggtaagcatgctttttttcagctcagttttatcataaagtgtagcatctttcccatccagtgcctgagccatccttttctcatcataccatcatccagtaagtttctagaacatcctaattcatctccctgctttatattgcatcctgcttcagtctccccaggactgcttgttctttcttaaaaccttaagctaactgtaggtcatcattcacatgccaaaaatccagccatggcttctctttcaaaattaacagtgaatatcttatccctaggcccattcctactctccagccttaaccttcttcccttctgccactgctatcaagaacccggccctccagctctactaacagtagacatctaaactgctcttactgtgcactctacaaaaagcatcattctcataatagtcgtttaaattaagtgttcacattatgccctttctacagattaggaaactgaggcacagggaaattaagtaattgcacaaggaagagcccaggtagtcaggtcccatactgtgtgtttgtatgtgtgtgttttgagacagtgtcttgctctgtcacccaggttggagtgcagtggcacgatctaggctcactgcagcctcaatctcctggtctcaagcagtccacctccctcagcctactgagtagctgggaccacaggcatgcaccaccatgcctggctaattttttaattttttttccttatagagatggggtcttgctatggttttcaggctggtcttgaactcctggattcaagcaatcctctctccttggcttcccaaagtgctaggattacaggcgtgagcctctgcacccggcctcagtgtgtgctcttaattgctacactgtgccgccacttggcaatgtcacggccgcttactcttacctatgcaatcctagcatgcctttccttcttctgcttcatgctattgagcactctttgtcatcccacagaattcagttcagccatttgagaaaagcctttcctgactctaacagacaagttatgcacctctttcctgtgcttacatagtagcctgtaccaacattacatttctcattgcattatgattgcaacatctgggcacatctctctaggacgctcagctctgtggaggcaaactctttctcattcagtttgtatgcccagtttaacacctaagcgttagcacacagcagatacttggtaaatgtttgttagctgagtaagggaaaaatagatcttctagccatgaagttttaatagtgttgatgtaaaccagaaggaacatttcaaataaattatgtaattttcaataaaaaaagatatacccttgatctgtaactcacaaaaataatgtattcttctgaaacagtatacaacgaatgtttaattaaccatttgattaaatggctgagtaccctgggccaataaagcaaagtttcattaactcctctaatattcttaacggaaaacctgaagagctgacatatagtagtaaatgaaatgtgggttggtatctcagaccatcacaaatcacctcttaatacaacttcttatcatcacttaacttgaaatactttcaaagatgaagacaaagggtaataaagaagtagcaggatggagttgtactcttggtataagagaaatatacagcaagtcattataatacattagttagtaacagtgacttttctaaggtttcagttgatggttattcatccactacttaattctttcctcttaacaacctaaatgaaaagtcactgcttttaaaataacattttgtcataactctataaaacttttttttttgagacggagtcttgttctgtcacccaggctggagtgcagtggtgtgatctcaggtcactgcaacctccgcctcctgggttcaagcaactctcctgcctcagcctcctgagtagctgggactacaggtgcacgctgccatgcccagctaatattctgtattttagtagagatggggtttcacccgttgtccaggctggtcacaaactcctgagctcaggcaatccgcccacctcggcctcccaaagtgctgggattacaggcgtgagccaccatgcctgaccacattaaagcttttaacatgctaatctgagtggttattgatgatggtaagatcaagttcggttgttttgtagtcattagatttaatggaaataaccattagcagagcaatgccttgtgttggattattcactatcccgttagtatcctttgttttcactttgataatacgattgccttttattgagtagaaaggaccagtatgctcaaggagttattgattcatagttgagatcaaaaaaagagaaaaaagaaatgaaaaacctttaggaattcctttgaacatttaagataattttacaatctacatagctatttgacagtaaggcaaaggagatttatgtatattggttaataattttaattggcatttattgtaaattagatataattttataaaaaagaaactaacatctgttttcttattttgaatgttaattgttgactattttatgcatttggttatcaagcattgtcacttctggaatgcttaatttatgtcagctaaatacatggagagttgatggtggcagtgtactgccgtggataaatattgagcagtgaataagagatctggtttccagactctggaaagactccatctagcaagaccttaggtcatgactcagcacctttgaacttagtacttactcagattggagataagaaacaaatatttttacaatccatttacacgcaatgttttatgataatataatcataaaattttgcttatgtttttgtaattcatctagcattgaaaaagaaaaaacttagcatattacaaaatagaactaagtggaaagaggaaaggtcagacaatgcttaatttttctgtaccagcaccattgttttgcaagtatttgttttcaagaatacttatcaaaaatttcttggctgactttcttattggccagaaagacttctctgcaattcttacttagtgacttaaaatatcagtgaagtggttaaaaatttagtttaaaaagttggctttaacaagtttgcattttttgttgcccaggaaaacataacttaagattgcaatattcaagaaagggagaaagatacttaattaccctcaaataagaaaactaattgttagtataaagatataatttttatattatttttaaaatattattaagcagcaaatgaaaaaaatctaggttaatagttgggttctgttttgaaagtattgttccattagtttgaattgttctgaattaaaaattctgaattcattagcagttttaccttgggagttcacccaaaacataagtaaataactaacggcattgctttattattattatttatgaaattaagtaacaatgatatttttaacccaaaccaagtttatcaagattaaagaaaaaaaaaaacctagtcctcaaattagatagctacagcatgtggtatgcagctactgccaagaaaatcagtgttcactttccatatacaaaaccaagcaaattatagataaaccattaccttgataccattctctaggggctcatgttgaagtgggaaaggcaggtcaaagacaagacaaatgaaaaatgttacaggttaagtcaggatgttgtaaaatatgccttcgacccctttggtttgacttcattcttaaggagtttgatttccagaggaaaaaaagaaaattttaggttataacttcctagagagtgttttagcagattttagagccctttgtttatcctgatttctgacttcacaaattgtatcctttttattctctatccttctatatctacagtaaagtactgtgaagattggtttctttactcatatcccattgatttaacctaatagtgtgaaggataagaaaaccttggttgtttttaatattaaattcaagccgttaatatttccccctgaaatactagttttattcagaatttgtctttttttctcaaagcagtcttttctctttatacacctattaggttcctcttccctatctttggcatcatgataagattttatttggagataacacagaaaggaaagcttttttcataatcatcagtgatgtgacattgtgcatcagtagagagcagatgctgaaggggggatttggttaaaaaccccctcttttggaaatcagttttttacttaccagggactttctcactcggtgcttcaaggctgtcagccaagagtataatctgctgtttttagacaaacctttgccaatcacttaaattttgcagttacacttacatagtatgtttcagttgaatttcaatccaaagaatatttagtcatgatacagtatcatatttgaaagatcattagctatgttaaacttaagtattataccaagaaccttggataaacagtttaaatttataaccaactgatacgtccaaaaggtgctaagtgttcactgtgtttatttattattgctccatttcaattgttttaactgaactcaaatttaagtttatctattttactagacattatgccttctttttacaatttcttgaccttagagtccacccaccacctccagttattataaagaaccgattatgttgtatttaaagtataaggaggaaaaagccctgctatactaatatagaacattataatatagtagtaagagaaaactaaatctatggccagtttacatattcaaacattataacattaatttacataacaatcaagaaaactgaatctttagttggctctaatattaagcaactcagtgaaaaccgtaaaaccatggaccaaaatttttgcccaaggagtagtttgggaaaagattccagaggcagatattcaaaaaaataaaacaaccaaggaaagtatgtgatatacaaattattttagggatggcactattgcccttgaaaagtctgttaaactcctctttttccggattgttgtaaaaattaaatgagataactgatgcaaggggtctagcacagtttctgccccagagtaagtgcttgttaataaatgtgagctatggttataatcatctacattcttgattttctagcctttctggttataatgtttagcttaatgcagttccagtagtatttatgaaatgtgtggtgaagggagcacaccagtaggcttcacagagatgtccagcacggggctcctatcctcaagggtggaagtaaagcggatgtattaataaatctgaagcagaatgtgagagcagtacagtacagtgcaacacatttcactttgaacgttatgaacttctgatgtgttcgcagcagttgtgtaaatgttaaaaccacaagtaattattctttctcttctgtcatgctctctctaatttatactgtctcaatatttttgtttataaaaatgactgaaagaatgagcgattgtgtcaataatgaagacaccccctcatttttagcaaagagacagccccaaaatctcaagaagtgaacaattaaatgagtcataaatctatcattcatagttaaatggaattttttaaagatagtgtggttcaatagcatttttatggtgcaattaaaaactatcccttcagtaaatcagtacccaaaggagaatgatatttgggttttttttttttttgtactggagacatcagattgtcaatttcttccttatttgcaaatacaaggatgcatgctaaatctcagacatctggcttttgtaatgtagtggtagcaacctgcattttggattcaaatcaaagcctcttccttgctgacagggtgatctcagtcaagtaacggaagcttcttaagcctcagtttcctcatctgtcaaaagctgggatggtgatgcctaaatccgcatgacagttaggacaaatgagaaaatgttcgccaacacaaacctacttgatggactctcaatctttggaaaaacaacttagtaataagtaaaatttctttacctctccctcacaatccagagcttacacagtatgtgctgtacgttaaaagctcattgtctcattgacagactgttaatttcacacacacacacacacacacacacacacacacacacacgcaaaatcgctgaacaaaacacagcccaagaaacgtcaaggacaaataggctagatatgaaattcctgaagctctggtccagcatcaggtgacatggtcaaagagaagagacagctctctttttagaacgtctgatgcccctgaactggtatggccaagaataattcttggctttggtatagtcttggggtatttctctaagaatataccacaaaatgcactgaggtttcagagaagtttcttcatagtttaacattatgcattattatataatttccctaagaaacccccagaaaaagtggagcctttattttgtgtgtaagaatccctaattaggagtctttagcaagataagaatcagaaatctgatttgccccctttctacattaagcatattgaaattttcatcatacccagatttctgacccctgaatgttttgtggttgccttttctcttagagctattcaatgtaaaatatctttttttctcaaaaaaataaaaataaaaacaaaactgattttgatacacaacagctgaataactcacagttcctagcatatgtaacaaggtttcaggcattcaggctaggactgcagtctagaagatcatatttttccactaatttttttttcaactgtcacttccagtagagtaggggattgtatgagcaagtttatgatacacaatttaaagtaattttctataaaaagatgtatgttcatttgaggcacaaaacaatatcctgatattggaaactaacttttaatcttaaaactttaaaaactaaaatataaaattaattgatgatagtgagcattattatgtatgtgacatttcctgtctaacaacccagtatgctgtaactgttttcaaaattgctttattttttttttaaagtgagtaaaacattttgttgaagtaaaagcagcaaattgatacttcagaggtccagctgtgtgttcagcttaatgttttcctgtggcaatttgcttcaaatccctcaaaatcagatactattaacaaattactaaacaaaattatttttatacatttatatattagaagttatttcccgggtaacaactaatcgcagatactaaaaaatactggacatttcactgtaacattgggtgtttctgatagaagctggtctcttaaattgacagtaagtaagtaagcatcgttaccatttaagtatattacaggggagaagattattgactaaaatattacaaaatctacttttaaaagcatatttaatcatccactcaaaatagcacactaaaagttaaacagctactctggtgttcagtgtagctaaactcagtatttcctacttgtaaatatttatttatccagaaagagaccagaaatatggtttgaacatcaccattctgtgcctctttatgagaattcagtgtcttctgaaccagaactactatttactatgcccaagttgaccttacaacatgtccctcaaacttgcacatcacctctggcttaggacaaccttgactgtcctgtccctagttgtgtcctctcttcatttgtatccccataatttgcaaatgagactcgacatagaaaggctttcactatctcagagcatgactggttctgaaggagcagtgtagtgttgtacttcagggcatggactctggacatactgcttgggttcaaatcatagcttcaccagttgatagctgtttgacattgagcaaattcctggacctctcttttcttcggttttctcatttctcatttttcatagggatactattagtatcccacagggttgttcttgtgaagattaaaagtgctttatatccatgtacaatatctagcacttacatagcagttacaagtgcctggtactcttctgagcagttaatgtgtatgcttaatgttgtgttgttggtaaataatactatacactgtgttagcgattgctaatattgttggatggtaagattgtcaatgactgcctcagatgagtacctgagagcctctcattcagattactttcatgcttctctcacactagggaaatacttctattgagaaaactaaggctctgtagggttgagagaactcttaacagaaacattttgagtagaacctagattactctgccttatcttttttttgtccccaactcctggatgcctgtaaacctttctctctgcgctgcctcattcagacatcatttctcatgtattctagagcaaggcgttctaactagcttctctaacagcagtccaacccccttttgtctctcctttccactgccatcattgttcctttcctaacacaaatttaataaagctaacaactaagaagctatcttaggcactcattttctagagtataaaatttggtaaaagcttagtataaagcctacagtgtaaagttaacataatcttagaggttcatgttagccaagccttctttttcaacttcggaaaactttctgctcttcaagatccattgtttcatcttcagaggaatgcccctccttctaaactctgagatctctctgtcctgcattccttctctccgcaaagcctctctctgaaccatctgataaattcctgttcactcttaatagccaccctgccaccattcttttccctaggataccatgcagcttatcttttggtgaaaagttctgtatgagtaaattagtattgagatttaccttgatataacgacaacctgtggcaacaaatactcgtcagtgtggaagaaaatatcagagacttcaacttttcattttcattagggaaaatgtctgacttgtttaattctaccacttgcagttagctaaggtaatgtgctgtgaaatgattaacaggtgcaacaggtagaaaagacgctttaattaactctctataaacaaatttagtaggtgggcacttacatgatttcctggctttcatatatatggtagataagcagtttgtctcaatagtgtacttggtcatcaatttgcaatcattatctaaaatataaaattttctcaagtagcataaagagaagagacccttgatgtttcaatttaacaagttactcattacattttcagttctcacctcattgtccctcaataacttaccttttagtgcctttcctgaataattcttaatttttctagcatattctatatatctatttgtgaagcacctgaaacatataaagaactagtactctgtgtattatcgctgccactaattgcagcagaggggagtgaattcagtgtgggctgaagttgtctgaaaggcatcatgaaagagttggaactttagttgatccttaaaagataaatttgaattaaacaggagagccaatactgccagttattgaactgctagagcaaagatttgcatatattccgaggaccataaggcaggctgtgaccattggaaattaggtttcatagatagagtgtgtcaactgtagacagttctgagagccaggcagggcactgactcaactgtgttaagcactcatgtatgaaaaaggaacatgatggaagtagcagttcagaaagacttccttgagtgggttggttagcatcacacaaatgcacaaaagtttgcatacagctttaaggaactcctctgaaggcctgaaactcctcttaaggcctggtgaagaacccctcaagtagagaccagaggcccagatggagagttgctgaaatatttattcaaatggtgatggaagccaaagctaagatggtggcagtggaagtagagacaggcatttctgaagaaaaatgaataagatttggtatctcattggatatggagatggaaggaggagaggggataatagaagatgacagtttggtagattaaaaaatggttatgccaatggcagaattagccatggtccatagtgactaattctgtttatgcttattagtcttatatgcttgtattcataattcaaagtcctagaaaagaaaaagaaacaagtgaagaaaactcaaaatgcctaaacatccaaataaaagaaagtttcagaactttgagctcaaagagagctacatgttcaagtgagctctgtgagacaaggcaaaatgccttcctcataatatcttaagccaggaatatgttctttgaatttacgacttcttaaaataggagtcaataaaaaaaatgcagcaagtgtttgcaagttaactggggagaaaaatgtttttctcctaacaccacattcaagttctatgtattgacactaatatgagtatatacaaacttgtaaccagaagaggtagattctctaatcctttatgtaagttaactcatatatgcttaaatttgttatttttatgtaaaacaatatttttaatcaaatgaaactataaaacaaactgactctaaagttggtctgtacttcattttcttataatctataatcaggaaatccattcactcctgctttataatttttgtgcctttaagtggtcagaggaatgtgacatctgcatacagtcacgtctaaattgataattgtccaggcagagggtaattttaaaacatagcatgaaaaaaggttgaatccatatattagaaggttgttgagaggtggtgtttcccacctcccggacccctgaatttaaatgcgaccattctctttggtgaatttatcttaaggtgggacaacaggctcaacacaggccgcagcattctgagtgaggaggaggctgcggtttcccagccggtttaaatgcaggctcttcttagcagtaaaccacacgcatgtattcatcattgattttcaaatcataggtttctatatcactggtttaggatccacagtcttgcattcctgaatctatattatgtccaaagaataacaatttggtggctggaaacagaaatggttattatacggctccaaaatgctagctggcacaatatgctaaaaacagcagaaattcactagcaaaaagcagaatttatttgttcttaaaaataacttgatgctctaaaaatatgaatttaagaagtgtcatcatggttcaaaatattttacatttcagtatgtaaacaccttaaaatatgtgactaatcttctaaaatggcgtaatttccaaataacaggaaatattccaagagaaaaatagaaggcttttaaaatcaatttttttagttttgaggtatttactgaatgaaaagctacaatgtatatttacttttttttcccctactgctgccctgaatcactgtttaaaatgtgggcaaaaagacataggctttgttggaatttctcagagagtttactgtagaaaatgctaaaaaaaaaaaaaaaaaaaaaaaaaaaaaaaacaaacttttctcaaggcctccgtgaagcatttccattttcgcacactggcccagtgcttgtcatatcacaggacaacacatttcacgaagcggttttacttccttttagcaaaataactcctccatgcaaaccagtatcggcatctaccgagctggggttttagtttcttctgatctattcaagcttcattgcactgcttaacagacttttttctcccccttcttttgaaattacccagctaattttccatttgattgtttatataaaccagatctcacacaggcttaatagataagtgacatatgtcttcagtgtgtccatctgaccttcagctgacagcaaagtatagagcagaattgaccttgatgttcttattctctttttatcccgtagaatctattaattcaaactaagttcataacatattcacaataatgattcaggatgacatattaaatataaaactcctctaagcactccattttgtcaagctttttttttttaagtgaacatactctcttttgtttgtttttttcttctagtgagaggaagtaaatgcattgttttatgtaacagcttttgccatggaatactgttcgaatttactgtaaagaaaatttgggggtttgtcatatttatctagctttagagaatttggctaatattccagaagttttcttatagaagggaattgatattcagattcaaccaacatttcttaagtgagtcctgtcacttaacacacgttttggggatgtccagtttgctttatttttgtttttttgccccaggaactgggataattttattcataatccaattgacagacttaatcttgtagttatttgttatatattcagcctgtttattcatgcataaaatgagacaggtaaatgaatgggatatgaagaacaaatctgctttatacagtgtgcctcaaatatattttgcttctaaagatgttcccataaatatctcctgaaatatacctttgctctgccttcccagttcctcatggcctctatctcaggccatcaaagtagtctccagactggtccacactagcaggccttactaattcctgagtataccaatgccagtagatctttctgaccacttagaggtctgtgtcatacctctactctgaaactttcatttccaccatataaacccaaggacttttagcctggaatttgagatctccacagcccaacccctgcatccctccagagcctctgacacccctctcttttcacgggtccccttctaaacaggttcctctcagtgccccttaccatgctctttaaactcctacctcagccctttcctactgcccagtcacaagcctaacatatcttcctatggcctttctttaaggccctcatcaattcctgcctcttctgtgaatcttttattggatcacctcttctctcccgggaactcaataacacttaatctggattactctgcaggcacctcaccctacgctgccttgtattggtctttatgttttccatgagtatgtattggattaccacaaagagatttcagagcttttcaagcctggggccttgtctttgcatcctcactgggtagcacacaatctcactcatgcaggggtaatagatacttgtgttttgtaatgatggcaataacaatgaggtttaactgtctcctttagaaagcttcagaaaacaactgtctagtttctagcaaggattgttgaatcaggtagctgagttctcttattctcccttcagaggcagtggaggaaatcagcagatgtctttctgagtccactgtcatgccagctctgctggcatttgtaatcaactcctccctagctctcttggtcatattttgaaatatgaaaaacgcagaccttgggatacccacttttctgttagtaggatactgaacatcagagacctaagaaaaccctttcagtcttccagttcaatggctattcctgtgccttggtgaatcagcactttagcggaggcatcatcacttcatttcagctccagggaaggagtcttgctttctgaagttctgtgtgaggaggaaagcaagggttgtacactgaacttagtaaggagggcaaagcagatggaagaaaaaccatagagagaattcactcagagaaaagcggaactgaacagcaaaatgtgtaagcggcttcccctcctcctgcctgtcctagaaattacagtcttgctggtatgccctttcttcatttaaggacacacagacacacaaaataaaacccaaaccagtgaactgaaagagtgagtcacgccagccaggcctccgccaagctagtcaattaaagtgcaagaccagttctgtgcttttcttagaccctgaactactgtctgactttcttcctgaatatttttgataggaaaaaaagtatatgctgacttctgagcaagttgatgtatattggctctcttctcataaaaagtttttaatcttccttcagaggactattgaatacttaattgggttacttgtcccatggaggtcaaatcagtcatcctatggttttgcaatgtacgtcttaccattaagcttttgtttttattctcatgttgtgtattcttcggaaacgtatttgacctagatttcttcctaaatgctttattgttttttgttaacagggaacgggtatggcaatccccgaaactcaccaggtctgctggtctcacctggtaacttgaacaagaatatgcaagcaaaatctcctcccccaatgaatttaggaatgaataaccgtaaaccagatctccgagttcttattccaccaggcagcaagaatacgatgccatcagtggtaatacaaaactacattttaaataaatattgataatgttttgtatatgttttgctgtttttatatttgtctaacttgatgaattacttaacattctcccagaaaattaacataacagtgccattgacagagccttgcttgtatttagctattatttctggtaactggtttgcatttcccttttccgtgtaaaaaaaatatatatatatatctggtgaacttcactaggctgatgttctaggataagaaaaacattttcttttaaggctttcaatttatagttggaaaaaaatcagacactaccatcggtcaatctctacgtcccataagcagagtaataataggtaatgaggtactttataacatagtatttttacaatatttatgtcctcaacatgctgacaatgagaaagtactttccacaatttctaaatgaactttctcctgttaattagcaaatcctttcttagatgtattgcaatgattatatctaatacatcgcatgcctacacactgcctcaattcatctttccatacatttacttcatgaaaatagctatctctcaaaagcaaattaaaatcctaggcattttaggaacaaaggttatattttacatcaaaaaagaattgtagcacctctaagaaagataaataaataagaaattttaaatagagattatatccccagaccctgtcatttttctttcttctgggtctgcatgcctaagatgaagataatgttatgggaccaaattcaacaacaaagagacttacatcagtgttctacaaattagctttgcttaagagcaagaacgtttaaaaccaagattcggtagacaaatttagatcattctgcaaacacatttatttcttttttctttctctgctctgtggcaagcttcagggtaaaacagtcctgtgagctgattagtttattatggcacagtgcagattaattttgaatatcaaccaaaaacatcacataatatgcaacattcccttcagaaaaaaactgggtctaataaatataacctcctacagggctacagccaagcagtgtgggccgtgcatggcaggccatctctatcaacagatttattccaggtcccttaaaactgatgctgtcccagggaatctgtgatgggtcagttaggtccctctctggcagccaggtgtgtagctccccttcctccagcaagtgaggtttcaaagcacagtctttttttttccttcaaaatgaagtgatgaaataatgaacattgagacactgacctgggctgaaaaccgggtagattgtcttcacatttgagacaaacagctcattaagggaaacaaagaatgtctttgtaaggagttatctttggagtctgggttttaaaactgtttaaactgttgtgtctatcggaagatgcttttccttttgttgaaaagattttgcccaattataaatatttacggacactaattaataaaactccttccgcatgctctcagtctgaggatgtcgacctgcttttggtaagtggtgagagcgcttccctcaaatggcatgtgcaaagctacttttaggtagaggtggtagctttgataaaattggaagatattggaagttaccacagtatgtcaacattgattatgtttaaataccattaatttctggcatcactcacaggtgaaaagaatgtcaggttttttttttgtttcaatattttttctgttttcaatattttaggacaatttatagtaaaattcaaacaaaaatattctttcattacataaaactaaaatatttcttcttctgggaattaaagtctcatgattttaagtttatgtggtggatcttttatctctttactgtaatgagttaaatattcgcattagctgctttgccatctagtttgagggaagtttagaagaatctgaacaaagtggtcacagcaccacctgctggtcaaaatataacatgagcccctactcatttgctctctgctgtatgtagaactgaacataaaaactaccatggttgattttaatttttttttaatttgcatttgaatgaaaactgaaacaatggaagtacagtatacatatttcatcagttttcaacatagtctgtttttacccataataaagctatggtacttgttactagttcagttgcctaggagatactgatgtaatgggttactatggcaacagctggtctcttgaaggattgtaaatgatagggttggcagagttcatagagacacatgttaaatgattaatttcatgagatttgtaccaagttatctctttatgtggaaaactaatactgaaatctaatatttttaacttttaaaaaaattcatcagtaatgtctttttatttattttaaaagaatcaaaggataaataactcccagtcggctcagtcattggctaccccagtggtttccgtagcaactcctactttaccaggacaaggaatgggaggatatccatcagccatttcaacaacatatggtaccggtgagtagctttgtcatgtgcaattagtacactaaatactttttattgaaaatcaagatgaaaaagttatcttttactctattaggaagctttatttagggcctgcgccgtccacagcactgcagcattacccattcttcactaagacaaagtgaatatccacatttttctttcttaactgactgaaagttttatttatgcaacctgagttcaaaatagaaacacactttcaagaaaattgagctgtttctttgatgtaataaaaagctcactttctcaggattgtttaacatttctacatcatcaaatatgtacatacctttatactagattgtagttctaataaactagaattgcggactatgctacttcagagcattcgtggaatacttatttttggtttatagtatattccttttaaattagaattatcgctgatgctttatctcccctcccctcaaaattaaaaatatctataataacgataatcctaatagaatattttggaaattgaaaatgtttattctatttaccatttgataatttctaaatttaatattttcccttgttgttttattctttaatctagagtactctctgagtagtgcagacctgtcatctctgtctgggtttaacaccgccagcgctcttcaccttggttcagtaactggctggcaacagcaacacctacataacatgccaccatctgccctcagtcagttggggtaagcaatattattttttataatataattttagaatgtattttgaaaaacaaatgacagtctctaaatatgtgcttcaatatcccattaacgggtataaaactctactttattgaaatccaagtgtaattttcagatcaatacttttcaagtagcttaaatcttatatacctgttttttaagaggacagcgagctctgtaataatgaggtaaattctttccttattgttttaggctacatttgtttccacttctatcagtgatataatttttatttagttttcacacagttcatttgggacataagaaggcatttatagtataagcttagatatttgagaatttttcttttttcacataaaccatatggtttatgctaatgttaacctaatacacataggaacaactagtcaattgatacacaggcttcatgtatttataatgtactcatagtatagttgtatacttatagatattttaagaaatatatgtatataatactaactagtacatataatactaattacctaaatttggatataaaaataatttttgttttatgtagtcagaggatgtatctttctgcccccttgtggtagttttcagatatgtctttatcatagaaatgactcttgtcatttatctatggaaacgttcaaacctttaaaaagctctgaattcacaatcacactatttcatataaaacaaatcatttttttaaaaaagcttaaaacgttaactgaaagcctgactgtaaatttaataagtccaaaattgcaattaatcttcaaaagaaaataccaggaggatataaaatatttaaagataacaagcttttatattttaaaaatattctgtctgcctagcccacttttacttttctgcttagccatttgttatcgttaatcacttagctgtattagttaactagttatatatccatatgtctaaggagacagagagaataaaacactgattagtataaaagtcactgatttataccacaactttgtgtctcttatgtttgctggtgccctctctccccccacccactagctttcacatgatagtgatttagcatatattagtgatctgattatgaaatattcacccgtacactgtttgcttatgttcatcctacccgctaatcactgtcattgaaaatctaacctttcatttaaatagtaagataaattcacgtgatactgttggtcagctttcttgaaagatagttaactttgaagatacattacatattgatcagcgcagagttttatctttttaggacacttaaattttctctggaatgttaactattcaagtagacattaactgtgggaacttcttcaggtaattatcaccaagcacataattccatccaggcaactaaaaaatatgtacatgtatacatattttgtacaaagtatcaactgctatggcttagcagggaatccactgaacatgattcttgtcaaaaataaacataactgcttatttcccatttttttcacaaaattcatccattatagggctagatttccctaaaagttatcaatgtcaaaagccatattattttctctgaatgtggcttttttttgttttcaatagtacctgataatttatatttttacatataaacacatatttatttacatattttagctgtactacaattttaaaactcttttctattacaaggaagaatctaattctctgctgcctctaatagaggtttcagaaaatgagaaaggagggacagccttagacagaaaggaactgaattacaacagccaaaggttaagcattttgttcagctcccggttcctttcaacacttaatttcgttgtgcttaatttgactcttagttttctctgtgagttttaattgcacttaatcacttcccttacccctcaaatcaatggaatgacccttccagtccttccactgttggcccttctctctctctgcttcacacacactcttttctccctctcacaatcacacacagagtagctttttgaaaggaggttccttcacatggactacctcatattcacacgattaaatgttaaactgtttttttaaaaaatcccaagctgcaatacttatgtaaagtaattcacatgagcatccttaattctttacagtgtaaatcaatttaaaaagaattgatacattttccaggccaaagttgtcgcagagatttgtgttgcgggctcacattcttttggctagagacaatgttcatagcagagtggaatatatttcagctccaccaaagtagatattcccagcagcccaagatggttaccacaattctttctcaaaattgcaaaaccataaacagagttcttcatattttgtccatggaaaaaaagttcattttgtcctttggagctttaagtcttcaaagctatacttttaaaacctagtatctgattttatctaaccaagctaagtaagcaacacaaatttatttgctatagggagagagatggctgacagaggaacttgccatcaagagttaatgaaagtcctttgaatactaatatttgatttagtgtaacactaagttttagtgtttttctaaaccaccacctataaaaagggcagcctgttttctggaagcatttccatacgtcaactttgttgatgtgggtgttcagtacatactgagagagataactctgagtagagatgacttataaaaggttaggttaaatatagtttgatagtctaatttccaggcggaggcagtaaaaattttgaataaaactatcccgtcatgtttgatttctgaacaattatgggaaagggtaggagttttcccaattcaaaagcatctgtaatagatgaaaatttgcatagaggacttgatatgggtaacttgcatatctggcttctatctccccacccacctctttatcacccacccacacatatgcagtatttcacaattatcagggtctataattattcgtgtctatattttgttctcaagtagaccaacatgcttatatctgaacctagcatatatgcagttaagttattttaatgctacttttttcttttcaagaaaatacttctttgttaacagagactagccattctattttatatcctatgtcacagtataatgaagctgaatctaagatatcacttgcattttactactgtggatttagtccccagaactactcaaaatgcttcatgtatgttttcagtgtcaaatgaaattccaccaaaagataaatttaagctagtctgtttgtaggaagggataaccaataattgttacatctttcatggggaagatacacagctaaacctatacaggccagttaacataggaagatgatgcaaagaggtgaataatgcagcttccaaaaactgtattaaagaaacagaattttggttatattatttttcccttaccttgtctagattaactgcttagactgtccaactcaccaattttttcttctaattttctatgtcaccctccctgtgaagacataatctgtatgtcaaagagcaagcaaaagtatttattgacatatcactttttattttcagactcctaattcatattcattattaaatagttgtgtgattcatagcagaagcatttaattaaattttagtgaaatggtctttcttagagccaggaaaattctttattccagaaatcaaaagacgatttcctcaaacatcagaatgaatcactaagtaactttgaaccaagataaaatagtctaccattatgaatccttttgaaatacaggtgttccctctccccattttaacaaggcttatttaattaaaacttttggaaaattagtaaactgatagactataaattaataagctacaaataaatagctccaaatataaacaggtgtttgaaaattatatacagtcagtgtagtttcttgatataaatgctaacactgctttgattatataagatcataaaagctagagaaagacacgcttattaaggaaacaaataattctcctttatattattctctacattagctcatctatttattaataggagaaggaaagtaattctttgccagtaggtggtgcttttgtacaaaacatcactcaaagataaactcgtttctgactaattttatatcactatacatcttgagtttgtattgcatctcccaaaaagccagccccaagttacttcactttttttctgaaatatatactttttctctcagtggtcataatgacattgttagtgccaactaattctctccactggaaagcagcataattacatacattagtaagtaggcttgctttcctttgtttaaaatgggtgtgtctgtatggataattcttcacttggattcttcctcagtaaaagagagtaccatgctcttttgacaatatagtcaagtaatcctgactctagctctggaagtcagtgtaattagtgtaagaagagtaaaagcatcttaaaattgatgcgagcaatgccactatggtttatcctgatcaaagtcattgtgattgctaatctacacttaagggcttaatagttttttcctctagaattccaagtttctaaattttcccagattttggaaaaaggaaaaattattctctctgggaatatatgaggattaaggattataaacacagtaaaatcacactacatccttcttggcaacaagctttccttaggcaacaccagattcatcaactaatgccaatgataaataagaggagtggtagcctaagaaccgcacgcatcagggagtgactaacattaataaaattgaggtcattgtggaacacaaagtattttcatctcatgtaactgcaaaaggatgaagaaagtcaaattatcagttttaatggagtagaaagtcttaagtgtttgaaaaccaacgtttaaactttctgcagataattttcaatttccctccccctttccattttttccacctccaaagctttttaccagatacagttattgtgcagcatttgagttctagtcatttaaaatttaactcccttcactttctctgaagactatgtgattccatctgtatgtgcttattaattggaggcaaatatttatattgataataagcttttaaaaataatattcaaacacaagcattagtaaatcaaggaagtctaattccagagctaaacactgtatctaaatgcttagaaatttaatttttagaactagtctagggatagagtccatgaacacagaaaatgctttttccattgtgtcttaaacctttctgaaatggtaacctatatgtttagggagcctctcggagactagagatataattcatgaggcctggaccagttaaatgctgtaattactaccgggcaaatcaacaaaggcatcctaaatcgccctgagaaggcgatgcccttatgtgcttccaagcacgttttcttcactctgggcatgctctggtgtctatgcgagtctttaagctgatgtttgatttaattgtgagttcctggggcctccaggcctccttcatctgtaactgggtttcctttcctcctacagagcttgcactagcactcatttatctcagagttcaaatctctccctgccttctactcaaagcctcaacatcaagtcagaacctgtttctcctcctagagaccgtaccaccaccccttcgagatacccacaacacacgcgccacgaggcggggagatctcctgttgacagcttgagcagctgtagcagttcgtacgacgggagcgaccgagaggatcaccggaacgaattccactcccccattggactcaccagaccttcgccggacgaaagggaaagtccctcagtcaagcgcatgcgactttctgaaggatgggcaacatgatcagattattacttactagtttttttttttttcttgcagtgtgtgtgtgtgctataccttaatggggaaggggggtcgatatgcattatatgtgccgtgtgtggaaaaaaaaaaagtcaggtactctgttttgtaaaagtacttttaaattgcctcagtgatacagtataaagataaacagaaatgctgagataagcttagcacttgagttgtacaacagaacacttgtacaaaatagattttaaggctaacttcttttcactgttgtgctcctttgcaaaatgtatgttacaatagatagtgtcatgttgcaggttcaacgttatttacatgtaaatagacaaaaggaaacatttgccaaaagcggcagatctttactgaaagagagagcagctgttatgcaacatatagaaaaatgtatagatgcttggacagacccggtaatgggtggccattggtaaatgttaggaacacaccaggtcacctgacatcccaagaatgctcacaaacctgcaggcatatcattggcgtatggcactcattaaaaaggatcagagaccattaaaagaggaccatacctattaaaaaaaaatgtggagttggagggctaacatatttaattaaataaataaataaatctgggtctgcatctcttattaaataaaaatataaaaatatgtacattacattttgcttattttcatataaaaggtaagacagagtttgcaaagcatttgtggctttttgtagtttacttaagccaaaatgtgtttttttccccttgatagcttcgctaatattttaaacagtcctgtaaaaaaccaaaaaggactttttgtatagaaagcactaccctaagccatgaagaactccatgctttgctaaccaagataactgttttctctttgtagaagttttgtttttgaaatgtgtatttctaattatataaaatattaagaatcttttaaaaaaatctgtgaaattaacatgcttgtgtatagctttctaatatatataatattatggtaatagcagaagttttgttatcttaatagcgggaggggggtatatttgtgcagttgcacatttgagtaactattttctttctgttttcttttactctgcttacattttataagtttaaggtcagctgtcaaaaggataacctgtggggttagaacatatcacattgcaacaccctaaattgtttttaatacattagcaatctattgggtcaactgacatccattgtatatactagtttctttcatgctatttttattttgttttttgcatttttatcaaatgcagggcccctttctgatctcaccatttcaccatgcatcttggaattcagtaagtgcatatcctaacttgcccatattctaaatcatctggttggttttcagcctagaatttgatacgctttttagaaatatgcccagaatagaaaagctatgttggggcacatgtcctgcaaatatggccctagaaacaagtgatatggaatttacttggtgaataagttataaattcccacagaagaaaaatgtgaaagactgggtgctagacaagaaggaagcaggtaaagggatagttgctttgtcatccgtttttaattattttaactgacccttgacaatcttgtcagcaatataggactgttgaacaatcccggtgtgtcaggacccccaaatgtcacttctgcataaagcatgtatgtcatctattttttcttcaataaagagatttaatagccatttcaagaaatcccataaagaacctctctatgtccctttttttaatttaaaaaaatgactcttgtctaatattcgtctataagggattaattttcagaccctttaataagtgagtgccataagaaagtcaatatatattgtttaaaagatatttcagtctaggaaagattttccttctcttggaatgtgaagatctgtcgattcatctccaatcatatgcattgacatacacagcaaagaagatataggcagtaatatcaacactgctatatcatgtgtaggacatttcttatccattttttctcttttacttgcatagttgctatgtgtttctcattgtaaaagg

SEQ ID NO: 15954 - DNA, 54576 bp, Human
  misc_feature (1)...(54576): n = A,T,C or G
ccatactcatagtcatatagttatttagtgaaagagctaggattaggactcctaattcctagattagtattctgtattctacagtaaaagagatatttactccatataggcaaacagtattcgtactgaagcatcttactatgatagttttcctataaaatttgttagttacaacttttagtttgggtttccctctccttgctgtaccaccatcttctccatcctgattacttcaagaaattgcactatagttgaacttttcttgagctcttggaattctggatcaaatttaacaagataacctttaaagaaaagtgaaaattactcaatgtatacagaaaaataataataacaacccaaaccagaataaggagacatgacctcacatcagtacaagggatcaaggaaaaagttagcaactcagtatgagtgaataatgtgatgtggttgctaaaaatgaatatagtaacattataaattaatagtggagtaattccacgtcatttataaacaattttcactccaatatgtagaataactttcatgatgggctttattagagggtagtgaattctttgtagattgaaaaaccatttggacattgtctagtctgtgaagatgtttcgggcattcagttagtggttagatttaaggaatttctccttctaaaattctaattacagttccccaaacacatttatactttcatgtattaactctagaatgtatgctctctgaggggagggatttttgtctctgattcactgatgtattaccattgcctagaatagtgtctggcattagtaggcattcagaaaatgtttgttgagtaaatgaatgtttctatgtttatagttttccctcttccttgacattcttgccctgatagattgccttgtaaaatttgattcatctttatgagctcagttcatatgtcatccctgtttcacagaggatttatgcctttctggagtctcttaggcaaaattgtttccttctgtatttccatagcaccttgctaattctgcattctgttacactgtctaaaattaataattgtgtaaacctcttctacaagagattaactccttttgggcagtgacacaatgataatgctattcatttttatagtttttttttttaagcctactcccttggatatagtaacattcagtgagtgtttgattttagtttgattaggtatttaatgagtgaggaccaaattgtgagaagtaaatccacatgtagttagaccatttttctccataatagtggaatgagtaacactattgtatcttaaatcagaggaatatagaataaaataaagttcaaaacatagtaaaagggggatgtcttttatattgaaagtagaagttgatgttcactttttacgggctcagaatgtcttactgaagaggtagcatttgagatagttccttcccagattggttaggtatttatctaacaagtagaaagcaaaaagtggaaagtacattctaagaacaaaaagtacaagctacagtggtgggagattggcaaataggaagttatgtgtgaccatggtataggaaccaaaaaacaattggtagtatgagacaggaaatgtagacttgagtcctgtggtaaacgacttcagttgcagaatgagaaatttgtaggcagtagagaggtgttttttttttgtttggtttttcttaatgtagggcacagctgctgttgaaactgatgtatccagattagagtggtggagtaggacataattatattagttgggctgttgtttaagaaaagtcgataagagggcctgagttagggtaatggcaacaagaaaagattaagagaggtttggaaagatatttactgaacagaaacatctttttttatataaacataaataaggatagtgtggggatatgtttgcagatacgattttcatgaattttaataaaaattgattaatagttaattatataaaatactgtcttaatgtcttccctttagggccgggaagaagatccacatgaaggaaaaatgtgagtttgtgttaattattaaaatgaaaaaaaaaatctatattgtaaatttactaattggaaaactttggccaaaaaaattgttttttaaggttttggactgacttaacttttaaatttggcttagggaactgatttctaaatattttcttaaggatctagtgataaagtcttgtttttaaataaaaggtagctgataactaaatataactctttttatcaccacactgaagactttgaataaacactacatttataacattatgaatgtcacaatttggcacattttaaaattattcatagtatttcttggttattcatagtatttcttgttttatagccacatcttttatccccccaaaataacggttcttcacaattttaataagattcagcaaggtctttttttttcataatcttcagactgattttatgtatatgtaagttttcttttgaagatctgaaccattaatcccaattctctcttactcacattttaatagactattcatctcctaatatcttttcagtacaacattttttcttatctttcagcatttagggatggaacttgaggcttgcctcaagtgtttgctttttctgttttctaaccattagaatataaaaacattcaactgactactccatttgcagtcaccttgtttaatgcttcacccttctgtaagtggaatatgtaagatatattctgagttcatttttattgtttcttgtagctacaaaatagattccattagtgagactgtaccctgctgtttgtattagtttgaagtctcctctctacctatatcaggagtttcaaattcttttttgttattttttctttttttttttttttgagacagagtcttgctctgttgcccaggctggagtgcaatggcacgatctctgctcactgcaacccctgcctcctggattcaaacgattctctgccttagtctcctgagtagctgggaccaccggcgcacaacaccatgctaggctggttattgtacctttagtagagatgcggttttgccatgttggccaggcttgtcttgaactcctgacctcaagtaatctaccagcctcggcctcccaaagtgctggaattacaggcatgagccactgtgcccagctaggagttgcaaattctaattaatgcttggaagaatcagacagacaatgtaagcaagtgaagcgggtcaagtatatatattcccagttttctttagacacaataatcttgatctttcttattttccctcgttgctagagatcaaggtacatggaactgtgtccctactgtcaaaaaacaacactgtacgtgtggtaataaatggcaactaatattcactcacggtgttagggaaaactgtgggaagtagaaaactagaaagtgtttgcctattgtaaggtaatcactttgtctagttgtctagttgatatgtgtaggaatgtgagtctagtgttgttagatccttctgattttcaaaaaaagaccataaatctaggtttttttattttagataatagcaatggaattttaaatttaaaaatataggttaaatgctagtaaacatttaaagctacatcagttttctcatagtataaaatataaatcccactttcactcggaagtctttttatctgatagcattgtcattcttccatttttcttaactttatgtaatttcttaattggggcataacttaaatttgcattgttggtttattttatgtgtatgtttgttccctttaatttcctaatatagggactgtcgcagtactttaaattctttaaagtgtcctcagtaacatctacaagtaacctttgagattaaatagatggtataactttggttgaatttctttccagctccctatttacatgatatgggcaccaagtcctgatgactttatctcttaaagtatttcttaaatgtttaccgccttctcaaatcttaaataactacattctagttcaggactttttaaatctcctgccaggatttgatataacagtaacctccaagttgatctcccttgactctttagcctcatcaaatccttttttccagtagctggaataatctacctagattgaatcacattatccttaactgccagcaggtatatgaaaaaatgctcaccattcattactaatcatcagataaatgcaaatcaaaactacaatgagatttcatttcaccccagttataatggcttttatccaaaagataggctataatgaatgctagtgaggatgtggagaaaagggaagccttgtaccctgttggtgggaatgtaaatgagtgcagttactatagagcacagcatggaagttcttcaaaaaattaaaaataaagctaccatatgatccggcaatcccactgctgggtatatatccaaaagaaaggaaatcagtgtatcaaagagacagctgcactcctatgtttcagcaccattcacaatagccgagatgtttaatcaacctaagtgttcatcagtggatgaatggataaagaaaatatagtacatatacacaatggaatactattcagccataaacaagaatgaaatcctgtcattcacagcaacatgaatggaactggcaaataccatgttaagtgaaataagccaggcacagaaagacaaataccatgtgttctcactcatatgggtgcaaaatattagaaaattaactcagggagatagatagtagaatgatggttaccaaaaggtgggaagggtagcagggaaggggggatacaatatggctgattaataggtacaaaaatacatctagatagaatgaataagatctaatttactggatatttaaaaataactaaaagagtggaatttgaatatgcctaatacaaagaaatgattatatgtgcttgaggtgatggataccccatttatcctgacttgatcattaaacattatatgcttgtatcaaaacatcactggtaccccataaaaataaacaaaatagttgtatacattacccataaaaacagaaaaaataaaaattaaaaaattgaatcttatactgattctccacctttaccttagcagagcctaaaaaatgatctgttatctggttattttgtcgtttactactcctagcacttatcatctgtagtttcctaatctccagcatgtaggtcttcaaattcataatacttttttctttattgttttagagataggttcttgccattgcccaagccggagtgcagtagtgctatcatagttcacctcaaactcctgggctcaagtgatcttcctgcctgagcctcccgagtagctgagactacaggtgtgtaccaccacacctggcaaatgttgtaatttttttttttttttttttttgtaaagatgaggtcttactatgctgcccagactggtctcaaacgcctggcctcaagtgatcctcccaccttggccttccaaagtgttgggattacaggtgtgagccattgctcctagctatttttctttatacctttgctcaagctgcttcctaggccagaattcttccattcatacttagctcattcatcacttccccctagaaaatcttcctttattttcctctctacacactcaacagtattggtacccttctctgttactcccaaaatgcctttggcaatacctatcactgtgcttattatagtttctacattgtttctatagttagggtctcactatgttgccaggctggtcttggactcttgggctcaagagatcctcctgccttggcctccgaaagtactgggattacaggtgtgatcccagttcccacgcctggcctaggagtaggaactttataagagcagggactcatctttttatcactgttgcaaaccatgtggttgaaatatataaattttatatgggaataaatgtctgaaaaatgaaacgaaaactctttagaaagagatattgccactttggcttcagactgtgtgcttatgctaaataatcttgttcatctgtaaaccctatcacttttttacccttctttttttgaatttttttcaaactgtagaagtagaggattagccttggaggtcaggtcatgtagttgactgtcctccagaatataaaaatcctgctctagcatttgtagtaagtggtcatttagcctatacttgaatgcagtatagaacctcactacttgtagtctgaactgttttagttgttgtattcttgctttatattattcaaaatttacacagggagcaccaggagatctgaatcagtgagttaatgcttggaatggtgttaaagaaaagtttaccttttcattcatgtgaaaatttaaaaattcagttatattttcatacttcaccagtaataattgtatggatcatttaaaacaatgtgaatgacctctgaacctgtcacactggacttttgagcacttatatattttagtcgtatatttactttctagcttgctctttattattaaaaatacttgtagaccctaagaagatcccacaaagtagtagataggtgatcgggaattgtcagcctggcattaagatgtgttaatcagcaagatagataataggcctttaggtaaataagaggtgattttatgtactttgatgactagtaattactttttaaatcagatatatccttttatttgaaggtaaaatttaaatacttaggttattgtatgctctatgtcttgactatgatgccttttataataatttctaaaggcttaatttaagaatacagaatataaaatacatagcaacctagtttgataggctgttagctcaaatagagttgagaacactaagtccttcttttctttcagttcttgatggtgctatccactcattcttatcacccaatcttatattctgactttcagcaaagtaagagtcaatatcttgattttatttgaggagagaatttatcagatgttataggaaaattcagaaatgaattcattaattttttcagggaagttctggagtaggctctatctgtactactcctccttccccttaccccacaaaaagaaaaaaaagacctataacagtctgttattatcaggattaaaaattgttgccatttttgtattggtaatgaaaattgtagtttatatttgatagtttctagttttactatctttagttgaaattaagtataatatgtatataaaatgtattaaaatgtaataagaatgagatgatttgattaattgcatttattttatcactttgaattaaacttactatattggttgtttaattttgatcatatgataacagcaaaaaggactttatttatatatctaatttattctctttttaagatggttccatgggaagatttccaaacaggaagcttataatttactaatgacaggtacttacatatttacttgcttttctaatgtctatttaaagagaataaaaaagtgaacaaaccatttatcatgtgttttgcctttagcattcagttagtgtttatgcatgttataatttcgtgtccagtactaagaagctggtgtttttatttatattttaaacatacatgtgttataaaatttagtcaagtgtgtttttcttttaccccaggcccctgtccacttcctcagaagtaacactaggtgacagttttttttcccatatgtttctagaagttttctgtgtctctgtgaatctttctcacccctacacatacacagacaggaacatgcaacacacttttttcatgttagatatatattgggagatgattctgtatctgcagataaaaactttcattactctcttttatggatttaaacttttcattatataaataccataattaactagtcttcagtagaacgatattgtattgtttttattcttttgctgttcagctacagcagacattcttgtatttatctttgtatacttgtggaattatatgattgagctttatttagtatgtattaattttaacatttcccaaaactgttatgcttataaatacaaagtaaaaattgacttgtattgtggttttaaccatcctgtcattgtttattcttactaaatatttaaggctgaattaatttaaataccgagcatttctttggcaaaccacatcttataaagatttcagacaagtttaagctttagtatgtaatttaaaagtttcagttcttcaaaaatgttgactattcaatagtttctatatttggtgaaatagattcttgtggtgataaccctaattatagaggtaatctgaattgttttaatccataaagcactgcattttaaattaatactttattcttttgaaagatttgagatagtttttgaagtactcaattttattgtgaagctgtaggttaagtaggttcaaaaaataagttaaaaaagattatgataatgctatatgatagtaatagagaagaaattttaaactaaaatgacattctgtcagctatttcagtgtggaaccaaaaatatgtagtttagtgaatttattgaattttggatatgtttcttttttggaacttgtaccaccaagtacttgaggtacttttgttttaagtcatacaaggttgaaaaggagctaaacttaatttccttaatacattagtttgcattttctttgtgtcatgtgctcttttgaggatctggtgggattttctctcctgagaagtacaaataagcacttgcatgcacagtcttgcatgaaattcctatcatattctagaagaaatttagagagtatcttggattcttgtcagtaagatttgttgtatcaacttagaaacactttcattttagcccatattatacaatcaatttctgtaatttttatgtttacttatgtattaagccttgaagattcagtttaaggagatttatttttttctttttactgaacatgaagttacttcataagtgccttgattggatgattggaactattagtaatttacccctcaaattatatctaataatctaagcattcattgtgctttcctaaaaacaatcaagtcctgatcttttctggatcatttgaacttaaatggagaaaaggcagagcatctatgtattatgagtcactgccaatcaaagatatcagaaatacttctctaaaattaatgtcatatttaatatatgataatttgcttctataattcctttcaggagcatacctattgaataaaatatagtgtatgtgtattgatttttgataatgtatacacatatttcagttgttttgaatctacctttataaaaagcttttggtactattttattacagttattactttttaatttttttttttttaagatgcaggatcttgctgtgttgtccaggctggtatcaaactcctgggctcaagtgatcctcctggatagctgggattatatgcatgtaccactgtgcctagcacagtcattactgtttaatgattaattgaaaacattgattaagcacagagtattcttaagcaaactggtcttcactttttagaatcttcttattacgaagatttacatacagaatttagcagttttagccagtattccctaactatgcttaggttccttccaaattaggacaggtgtagatattactgaccagaagttactgctgcaaaatttctgctctctatttttatgtattaaagctggtaagatacaccagagagatagcagacaagcaatgtggatggttgtgaatcataaaccagaaaatttgaaagaaattatcttaaaaaaaaaacaagttcctggtgaaaatttacatatgtttatgactttgaatgcactttgtaataatactacttaacatcttttcttttttatttgataattagggaaaaactaacagcttaattcttacagttggtcaagtctgcagttttcttgtgaggccctcagataatactcctggcgattattcactttatttccggaccaatgaaaatattcagcgatttaaaatatgtccaacgccaaacaatcagtttatgatgggaggccggtattataacaggtaaatcataattttttagctatcttttacttttcgcaaaaatagttgaaatcttgataatacagtattcagagtcaaaattatataaaagtttctaacttctaaaaattataagaccttcaatataatttcatagtagtcatgcccaagaattctttagacagtgtcaaatatgaatacaaattagtaacttatactttgtttccttccaaaacaatttttgtgattttaaaaattagacataagctgtttgcaacaaatttactaaatccatgtgttatctgtaggaggagcaaaatatcttaggaaaagaaaatatatcaacattattttatcagtgagatactttagtaggaaaaaaaaagtttctaaagatacctgagacttattatacagatgttatcatgtaactgagttcttctcaagttgacatttcttacatgtgattgttggtttttacttctcactttcaaagtaaactcattgtttgtcccaaaactcagaatgaattatagttacttgattaggaaaataagttaatagaagaaaccatatgatagaatgtcagcaatttttcagtcaaatagaaaataatcttcatttgtgaacgtaaaggttttcctataactaataactctctatttcctatttcagaggctggcataatcttgttctaaaatgcttatatttgcctagtttaacccctcagtaccacagcagtattctctatctgaattagaatttgtcaaactagacatttgagtgaatagagattctgtagcttgtttatctgaaaaaaaccaaaaaacaaaaacaagttcttctagttgcttgctggaagctcagttgactgttaaaagacatcaaatgtaagatgtgagtctaggcagctgtacccttttgcctacctcatatacaggttgcttgagtactttatacatgacaatctgagttctagatgtcctcactgaaaatacagctagctgcaatttgagttctttaagaatgtaatttttcccaattccagttttctggagatttagaacatacaaaataatgcactgaaaatatatcatcttcttaactgaataaatgtccatattgagatcctttttaaagataaaataatttacatgaatttatttttttgaagttcgttttgttactaacttaaacttccttatgatacatcacacaaaactggaaattcttcctacatactggaggaagtcggtaaaacatgtaaaggtagtcgcttttggttgctgaacaccatgatggaacatgaaaaaagaagtattttaagtagatttctgtccaaattattgcaatattatgttttcaaaatgaggattaaaaaaaaaaagttaaatgtatgttaatttagtggccttgaccattcccccagaactttgatttttataatttttcttccctgtgaatttgtttataaattcatcttattgtttctagttttaacattaaacttctttaaaaagccccaaattatgtgaatcaggtgctgtgaaaatgaaggattttgtaattgttttggaaatatatatttcatttcagcattaatgttagtaatgtcagaaataattcctaggaagataaatctttgtgcttattgtttattgttagatctaaatgtataaagaaagatttttcaataaatctgtcgaacacagccatactctgctgtcccatctccccattaactaaacatgagaccttgataaagagggatagtagttatgtctttcatttagaaactgttaagacataactttaatgttcctatattcagagttttaaaaaaaaaaagcagaagaggcatttaatagcaaatttaattcagcagccatttatcgacttatctactttgtgaaatatactgtacaaattctgtgtaaatacattaaagaaaaagatatagtttcttcattattagtgctcaggtttattagaaaagaaagtatggtatgcagaatgtgataaattcaggggatatataaatgcatgggaatcaataaatgagagttcagtggggggtgagaaggaagacaatggattttggctagaccttgaggagacaatattaacatttatctagacttcaagaagaagagtgcacatggttttatgtgctaaatgcattacaaaaattaaaatacagaacacagtgtctctagaaactcacgtttatttcaaaagtaagtttacattgaatatgctttagttttctgagatgtaaatctgtctgatttcatggctggaacttatatgaatgtctagaaaattctggtttatctcccctgactgtttatttcggtgtttctgcgtagagtataaatggaagagtaatttttaaaaaaactcttaagtctagctcattggtaaaaacctatctgattggttgccacacacttttaaatttgctcctggacaatctgaactgtacttccccatggtttcctgttctctcagtttatgaaaaacaattatattgtaacattgaggtgctacagtggattgattgtattttacagttactgagcccaaaaacctttgatgtttactgattttcatagatttggtgctttttgctttaaaacacatagtcatctctttagtggaatctagctatcttcaaatatatttcctgattttcatttttcttttaacaattttggatttatatggtattagatttttttattaaaaacataaaatcttgcttgttcttttaataatgcttttatttatctcattttcaccacacccctctgtggcttgtgttaaatgctgcttctggtattaagttcattcatacactactagttaacttttcaggtccttttgttttggtttttaacattacttatatttggtttaaattaactttgtagtatagggaagataacatacttgaagatacacacacacacacatatatattctaattatatatatatagaaggttaaacaaaatctgtctggagaagtgtttcctaggtggctcaaaagttcccatttgtccagtatattaaaggaaggtttaaaattccaagatttccatattcaggacaatagaatgatcttactgattatagagaaacaactttatatttaaaaaaatacgtggttcactaaaatttatattaaaatacagtatgtcattttatttttttgtaatattttcccaatatttcccaatttgtagcacttttaatcaaaataataagcttttctccctatagtgataatcctacatgtaagattagctgggggtttttttcttctttttgcctgcttttcatgtgttttatgacctgtttctgatataaaaccagtatgtgtaaatgtgataataaaaattcttaatttacctgaactctgcttcctaaataaatgccatgtttctgtgaattcttcattcttagtatctcatatatactcttgggggtgaaaaaaaaggtagacttttaatcatttcctcatttatggtgactctttgaatatggtattgttgacctggctgcccacttgatgggtatggaaaatcagaatctgggccatgtattctggcctgtaaatctatattgagaacattgttttttctaaaataatatgaatgttatgatcatttattctattaatgtatttgtgttatgtgctttgaaaaaaatttgctaattagataatccttggcaagaaagtttacacatatttttaaagattttgcagttttatgagacagattaatactagaaatttttattttaacagcattggggacatcatagatcactatcgaaaagaacagattgttgaaggatattatcttaaggaacctgtaccaatgcaggtcagtgttgcatttcttattgcaataattagcattttattttaaaatgcattttggtggtatgtttttgcacacatttgtacaattcaaattggatacaacttaaaactacagattatttagatttttttagaaagtcaactgtaagaatcttttagtttttatctatgttgattttaggtaatcaggaacaacctagtggctttttgagattagaagcagtcgtggaggaaggtaagttgcagtaggtccaggagtgagttttttggaggcaaaagtagagacagcagggataaaccacagccaggattattaaagcctggggagtaataaaaggataaaaatacgatagaagaatagcaaaaatggttacactttgtttatttgcctgtagttttacggtgagaggatttgagaatgtctgtatactctgagtgaaaactgtatagtagtaaagaggagagtgaagttgtatggggagatgggtggtggcaatgtcttacagacagggtcctagacaaaagtgaatagaatctagaacataaaaggaaagattggccttgagcaagagagcctgttaaatgttagttgcttaacgcttagggtgattagcttctgtttcttcctcattgcactttctgaagtatatggtagggaaatggtatacaggggttagaaaaaggtgcttcaaaagacggattaataattttcctaagtggaaaatggaggtactgttattctagggacataaaggattattaagggttttgggtacccagctgcaattgtacagtgatttgtagtgtgcctagtttcttgatgtttcctcctaacaaattcatttcacatggctatagctactacttattgcagttaattggtggggggtggggtgggaggtgaggaatcattaatctgaagctaaagataaattcaagaatcataatcttgtcacattttaacatacaggcacacttcattttattgtgcattgccttattatgtttcaaagatagttttttttacaaattgaaggtttgtggcaagaaggacgtctattgcgactgtttttccaaagcaggtgctcatttgtgtcttagtgtcacattttggtaattcttaaaatgtttcaaactttttcactattatatgttatgttgatctgtgatcagtgatctttaatgttactattgcaattgttttggggtgccatgaactgcatctgaagaagactgcaagcttaatcgataaatgtagtgtatgttctgactgcttcattgactggctggttctgtttctcttcctctccttggggcttcctatttctgcagacacaacactattaaaattgggccaattaataaccctacagtggcctctaaatggtcaagtgaaaggaaaagtcacatgtctctcacattaagtcaaaagctagaaatgattaagcttagggaggcatggtgaaagccaaaataggctgaaagctaggtctcttgcaccaaacagcaaagttgtgaatgcaaaggaagagttgttgaaggaaattgaaagtgctactccattgaacacatgaatgattaataaagtgaaacacccttattgctgatatagagaaaatttgagtggtctggattgaagattaaaccagggataacattcccttaagccaaagcctatccaaagcaaggccctaactctcttctattctgtgaaggctgatagaggtgaggaagctccagaagaaaagttggaagctaccagagattgattcataagatttaaggaaagatgctatctccataacataaaagtgtacggtgaagcaaagaaactgtagcaagttacccagaacatctagctagttttccagaagataactagcaagttatccagaagataagtattgaaggtgctaaacaacagattttcagtgtaaagaaaacatccttctatctgaaaatattatctaggactttcatggcaagagttaatgcttggcttcgaagcttcaaaggtcaggctgactgactcttttcaggggctaatgcagctggtgactttaggttgaaaccaattatcgttgactattctgaaaatcctaggagcatcagaattatgccaaatctactgtgcctgtgctctgtcaatggaactacaaagcctgcatgatagcccatctgtttacagcatggtttactgaatattttaaggccactgttgaaacctactgctcagaacaaacaattcctttgaaaatgttactgatcactgacaatgcacctctacaatcaagagctcagatagagatgtacaaggagattgttgttttcatgccagctaacacagcttatattctgcagcccatggatcaaggagtaattttgactttcaaatccttagttaagaaataatttcataatgttatgtttgcaaaaaatagtgacttatggatctgggcaaggtacattgaaaaccctttggaaaggatttatcattctagaggccattaagaacatttgtgattcatgggcagaggccaaaataacaacattaacagaagtttggaagaagctgattccaactcttttggataactttgaggggctcaagactacaagatgactttgaggaggaggtagctgcagatgtggtacaagtagcaggagaactaaatttggaagtggagcttgaagatgtgactgaattactccacttttgtgatgaaactggagcgaaagaggagttgcttgttacggatgagaaaagaaagtggtctcttgagatagaatctactcctgtgaagatcctgtgatcgctactgaaatgaaaacaaataatttagaatattctataaacttaacttgataaagcagcaagagggtttgggaggaatgcttccagttttgaaagaagttcaactgtgggtaaaatggtatcaaacagcattatagggaatttcttttgtgaaagaagagtcaattgatgcagcagacttcatttttaagaaattgccacaaccaccccaacctttggcaaccactgccctaatcacttagcagacatcagtatcaaggcaagacccttcaccagcgtaaagattatgactcactgacgtcctagatgattgttatttttttttttttttctccctccggagtcagggtcttgcgctgtggctgaggctggagtacagtggttcaactgtagctcactgcaaccttgagctcctgggctcaagcaatcctcctgcctcaggctccccagtagctaggactgcaggtgtacaccaccgtgcctagctaatattttttgtagagatagagtcttgctctgttgcccaggctagtcttgaattccaaggcagaagccttggtctcccaaaatgctgggattacagttgtgagccactttggttgccccaacagtttttagtaataaaatatttttaaattaacacgtgtacattgttagacataatgctattacacacttagtagactacagtatagttgtaaacataacttatacgtgcactgcgaaaccaaaaaattcatatggctggctttattgtggtggtctggagccaaatctgaaatacctccaaggtatgcctatattttccttcattcccgcatgctttcctagtagaatttaaggtctatgagaacagagatttttgtttgcattgttttttcccagtgcttagaacagtacctgacattagatattcaataaatattgattgaatgaatgattctctgctttccagcaagaaatacctactttacccttgcctgtattgttactaaggtcttacactttaatgtgctccttcctatcaccatgtcagtcttcctctctgcctatctaaatactattttaacatccatcttgtttcactttttgagtaattttttttttattaccgcagagtaattggaagagaagttagccagaacatataacatacacacacatatataaatatatatatgttttatatatgtgtattttttaaataacatgggtgagtgctttttagaccatggctaggatcttttttcaggatcagaggtgcctttgcctccagatgacggatcctgccatatagttccattgctgtatcctcaattctaattccccttggctctttgagttagtgattttaattttatttgaccccaaattaaatcatacatttccccatactgaatttgtacttagaattttctaatttaagttttgatcaagaccatcctggctaacacggtgaaaccctgtctctactaaaaatacaaaaaattagctgggtgtggtgacatgcccctgtagtcccagctactctggaggctgaggcaggagaatcgcttgaacctgggaggtggaggttgcagtgagccgagattgcaccactgcactccagactgggagacagaacgagattccatctcaaaaaaaaagaaaaacaaatagtatgtggcatctaataaacttgcagtatgtgttataagactgctttaagaattacttgagatatgtaatgtgccttgctcttgtgttagttttataactgaacaaacctccaattggttttgcagaagtgcctataatgctttgaatacttcagaaataattgatgctgattataaagcaatttgattgattgctacacagaaactattaagtgctatttgtagtctattattttggagcatggggtgatgaaaagttggttttagtagaagtttggggaataataaaactcactcattcttcaagcagggttttaactattagtacaaaagcaatactatctttttactaatcgccaaattgattagttagcaaatcacctcatcttccaatgaggtgaccctgtgtacccacactcaggctaagatgctggcaaaggctaagaaacagcagagtcctagctagctttgcttacttcctggaactgttaacactttttgaggcaagcattagacaaaaagggtccttttgagacaatataccccataataaaaatgccttacatttttgagcactatattttaagcactgttttttatacatattcattcatttaattttctcaacaactttaccaaggtgacactacaatgatgcctatttcaaagataaggcaactgagagctgagaggttaataacttaaatcatcctcaattcttctctttttttcttcctgtactttatatctaacctgtcaggaagatcatactgactctgtcttcaaagtatgtctagaatatgaccaccaccagaatctgccttcatctcctagtttctagctttgtccccttatgctgcatgctgcgcagcagtcactgggatccatttaaaatgtcagatcgtgttactcctctgttttaatacttgaaaatgttctccatttctttcagaataaaagccaaagtccttagaatggcatacaagacccaacagtggcagtccattaattttctgaactcgtctcttcctactatcctcctgccactctttttcactcatacttgcttctgtattattatttgtaaataagccagactctttccttccttaggatctttgctgtagctgttcactgtgtccaaaattgttttctcttggatatccactagcctcactcttacatctttcaagtttttgctcaaaatttagcaaattagcaaatgacactttacctagacaccttaattaacactgcaacttgctcaaccctgcggagcacttaccttctaacatgtagtacaatttatttatttatgtttatttttaatctttccctggttagaatacaagttccatgaggataggggtctttgatttgttcactgatgtatctcaagaactacaacagtgcctgagactcaacatttattgaattaatatattaaatggcgttttcctacattaagtgacaaagctaggatctgcaagttaagtctgtcttcaggagcttacacatgtaacttctagggaagagcttggttcaatggctgttagactctaaccaatcagattactgaatttcccttgggaggaatgtaaaaaatctaagaactatctctcaggctgagaaaaggaacacgtagagaagcctttctcctctcattgactaggacttgaaaagtgatgttgtgtttttgcccatagcatcttctagtgtattggaatcttttaggatttgtgggctagtccccactttaatatgatttttaaaagatctatatagattccaagatctatataaaatcttggaatcaagtatttaaatccaaatattagtgtggttacatgtcttaaatgacagactccaagaatgttccattctgcagctaatactaagtgccatcaccattgaactaaagatttgataaatacaaatctgtattaccaggaaagtaaagtcatcactatttgtaacatcatggtccagtgtacccttttaatttttttatattcctaagtcattttacaaataattcgcatcaccaagattaagggtataatccaaaaacaacttcattggaaaatgtagtaagaatttaaatgtagcgtacccaaatttttgttccatgttttcatgtctagaaaggtttacgtacctgaaatggacagtcttttcaatgcaactaacagttcttcacccttcgtgcacagacctggaacacagccatcttgtaaactctgattccagatttgaaatcagatacttgtctaataagttctatttgtaattactttggttcttcttgcattgtatctatcatatcaattccagattttaagtacatcactactggaatctagcttattctttcttgtttttgtattatcaaaatgcagtttttttttttttttttgagatggaatttcgctcttttttgctcaggcttggagtggaatggcatgatctcagctcactgcaacctccgcctcctgggttcaagcgattctcctccctcagcctcccatgtagctggaattacaggcacgcgccaccacgcccagctaatttcatatttttagtagagacagggtttcaccatgtcggccaggctgggcgaactcctgacttcagatgatgtgcccgcctcggcctcctaaagtactgggattaaaggcgtgagcaaaatgcagtacttttgaaaactctgatggctcataattttgttggagagtacagtgtccattgctccataattgtaaaatatttttgtttagattttaaaacaccagttaacattgatgtttataagagtgatcaatccagtgaattttacaatttctatatgtttactttcagtaattttttatacaaaggccctttaatatttgcccattcacaaatcatattaagtaaattttgatgtacatacaaaaatttagtctcatttctttttagcaaaacaggataatagaagtaatatggttcactcagtgattgagtttgagaaaattcaagtatatcatcatctgaaaaatcacagtctgaggtttatcaaaatcaattctgccatcatgataagagtctagagtgctgctgtttctttgcattcgttttctgatttttctaattgtcaaacatcttcctggatcagtttttttctctttatcatttatgagcagaaaataaagagttctgaatattttaagtatgttcaatcaaagctaaaaagacagcaaagatggccttttatgtttttacaaaagatgccgcaatactttgcaacacagttacacacacacatacacacacacccagagtgatgcagtagagattatttatttcagttatatcatcctctaggccagcggttggcaaaagttttctgtaaagggttttgcagttcatttagtgtgtccactaaagtctgtctttttatctggaagcaaccacagacagcatgttagggaatgagcatggctgtgttccagtaaaactttatgtataaaaaacaggtggtggactggatttagcatgcgtgccacagtttgtcagccctgctgtaagcaattcattcttctattttcttattattttagtaattttgtagcattaacttgggaataattctgagtaatgatgaaatagttcctaggatgatgaaacagcataatgtttcaagatagaggattatgaaaatcccacagcataacttagatttataagaggattgaatggatccatgaagtttgtaagatggactaaaagtcataaaatatgaatccttgcaaaatagtaagaactactcaaaaaggaaaccaaaaaactaaaactgagtccaattgaccttaatagtaaaattgaagattcatttattctggaaagatcatgataaaggcatcctgatataattcttttcctcaggagatttagcaattaatgtaagttctgctataatgtaacatatgcattcctaaaaatcatagcattatgcaaaattaggcaatcaaaaccacagggcttttgagaaaagtgaggttaggggtgttaacacttagaaatttcatcagggatacattaagaaagaacctaatataaatatgttgcttagttttatacatttttttttaagaaatatgtacatcctacaataaatatggcaatttaccttgaaaaaagaggtacattacatgaggaaatggccattggtagagttgaagcatgggaatgttgcagagtggcagaggaggattatctgaaatcatggttataacaccagctgtggatggatgggtgtggcatgtgacacacttagtggattgagggaactgttaggtatttgaagtgtgtatgttttgttcattctcatgtcttagttcacctggtacggttgtctgtattcacctagcatttctcacagacacaattgtgcataggcaaacatgaatttgctttatgcttacattggttcctaatctaccagttatgctgggacaagtttatgtttttaaaacatgatttgctgtaaaatataactgactgtattcgaaaatagcttattaggtatccatggaaacagacaacttattagttgttcttgggattggcaaggaaacctttctgtgaactttgttgtcggtgttcttcgaaattataaggaagcatttctgagaatttctttggaaagcaaaagatcatttatgtgttatgtgtatctagattttagtattttaagcgctttggcttttaattggtacttttatagatttttacttcatttccatcaagaatgtatgaaataattttaatgttttttaaaattcaggatcaagaacaagtactcaatgacacagtggatggcaaggaaatctataataccatccgtcgtaaaacaaaggatgccttttataaaaacattgttaagaaaggttatcttctgaaaaagggtaagttcagacttttatcattaacccatttgatagagacgttgtaaatatggagctccgaacttattgtgatatatatttaataagttttgacatgagttattagtaattgacacttgtttagagcccatatataagcattcttcaaaatttagagtgtaggtatattaaaagtctacattttcaaccagaatgtttcttctacccatggtttctttttttctttctttctttcttttttttttttgaggaactccttatggcacatggcacattcataatattgatattttacagatttacctcaatttgacataacgacattttggggaattgtgggtgggggtgtgctttataaagtggaagaattttttccttaagactgttaaagaattattccaaaacaagaattctgacaatttcatcatgatgaaatctctgaagatatagttaaggtattctcagcatttactctgtgattaaaacaagtaatataacaaaaggcatttttgtacagatttgttataggcattttctcattatgtaagaattggcatattacataagctttggaataaaaattgattgattcatatttttagaaacactaattttaataatatgtaggatttcacaattgtttggctaagagaaaacaatttttttttttaaacaggcaaaggaaaacgttggaaaaatttatattttatcttagagggtagtgatgcccaacttatttattttgaaagcgaaaaacgagctaccaaaccaaaaggattaatagatctcagtgtatgttctgtctatgtcgttcatgatagtctctttggcaggtaagagactggtttcctatttttctttcggaattgtcttaataataaaatagtacaaacaaagcaaaccaattttgagagccctaaaatcatcttctaaaagtagcagatgcactttctaggtaatttttgccttccttgcttaattgtagactaatatatacataaagtctacttcattgtgttgcacagaaatctttggcatgacatttcctgtagtaaagcatgttttgtccctgccccaacaagcaatcttttgagtgacttactttgagtctttgtcacctttcctctgattttttcacatggtttaactcagtgtacccaagagtactaggtgcactcaattctgctattaactctataagcaagttcttaagaaagttaatgttaaaaaataatcttaaaattgtcttgataggaaaaatgtatttgaaattaaaaaaaattcttatgttgacttcttggttttgaaacaatgaatataaatgtataagctgaatcctaaacatcagaagacaaatccagctcttgattacatctagatttttttctcaagaacaatggcctttacctttcaccattagtattatcagtaatccatcccagtctttttagatgtacttaccatttttattacctattgttatgattagtaagagaaaagacagttaaatgtttcaacagcttgtttttctgccgcaggatggcatttctgtgaggcaaatctacgttttatcctgttgaaatatttctcttctttaagagaaatacctgtaaaatatatagccttgtcatttcttttttcagtgtgtttaggagatcacattagtgttacttgtgattttgacagttttttaaaatgatcaaataggtttgggaaatgctgattgaacaaatagttttacttatagcaaggctttttgtagctttagctagtgtttatattgtgaatctgtaaaatagtatgaattacttcataaattcattttacgaagatacccttttttttcccctgaatactcactgatacctcataaagagttgttccaaaaaacacaaagattgcgtgaggacaggatttcttgagatttttctgcccctctttaacaacctgagaatcttaaccttcaaatgtggttgattcaggcctctgtcttttctttttagttctactctgcacccttcttgtgggttgaatccttcctcaaaccagttccctacatggtagcaaggtagcaaacagcaccagagaaagggctgtaagcattcactcccataattattaaaaaatcttgaaaacattctgttgagccacctctcaaccaatttttagttctgggttactgaggtagcaaaaggaatgggattatcctgatagaatgaggagacccttttgtgcctagatctgttgctggaaatgatctcacccaaatagtgaggctgctctacttaccatatgtatgggtgaaatggatgttggagaggcaacactattcactactaaatgtagtttattatcgtgaaaacagttaaaaacagtaaaagtagaatattttgggaacaattttattgagatcagtaatatgaaataggtggctcttgattcttggaggatgggtatgaattcagttggatagttgagcagagcttcctaaccagtgttccattaatcagtataggtgtcccctgagatactagtggttgtaaaatcctattgtagtagagatatttaacaaatgttttatatttcaaaaattataacactcgaaatcatatgatccctgtataaactgttctaattcattattttattggggcaaaagaattgatgcataacacttggagacagagagctctttatagtggctatacctcagtacttcctactttcttgttcaatcatccaggtactctgaatattactttattcacagcttcattatgaagctaccttttatgttcaagcagaaatgtctcattttgtttcttaccttttttcgattaacagagaagttaaaattgttttaattatcgtaaaatatataaggaggttcttgaaaagaacataatgaatttgatatatttttcatttttactactttataattagccttaatgtacagatgttaatttttcccaccataagggcaatttagtgactaacactggaaagtcattagactcataagataaaaaataattttaaaaaaatgtaactcacttactaggacctgaaagaaatacatttaattgctaaatttttttttaatactttgaaacaaagaaggtcctatggaaatgctagttaagtttatgactgatgatgaggcttcacgataggaacatttaaagattttatgtcaagattatatatatgtttgtctgtagacctgaattccatattaaataatataatgaaatggaggctgtaataaaatctaagctgcttcagttgcatgtgttttcagttttaggtgagaaatggaatcaaaatacctactgttggatgctgaagtatgttacctgtccaaaagaaaagttttgataaaagtttatgattataggagaaaaacttttggtgaatgattctcattttgcagatttactgaagaatcagtaaacttcgtcaaattatatgtacaatacaaaaagatatgtgtcttgacagtttatggatttaaggcagaaattcaaccttggaaaaatgaggttaaaaatgattcactaatgatacttacaactgcaattagatgaatcttaaggaagtattaagatgaatattgcaatatctgtaagattgaagaaaagctttagcattattttgatatagtttatatgaacagatgcagttagattggaagtctgttggcacaatcaaaagaaaggtccacattacacttgatggtaaaagagaaagaattgccagagtaaaaagaaggatcagatccttgaagcacaagttgaagattgtgaatgattcctattctggttagtaacaagaaaggagtttctgtctggtagggggaaagcaataaatatacatttaccacttgctgtaaggttgtagcttgcttcttgtacagtttcttgttgaaggtgacttaaagaatttgaagacattagaaaaagtctttgtaatgaattatatttaatgataccaggtctgaaacctagtatgaaaaagttatgttcatgagaactaaactcaagtctctcatttagaaaacagatttttcttttaagactgggcgcagtggctcacgcctgtaatcccagcacttcgggagcccaaggtgggctgatcgcttaagctcaggggttggagaccagcctgggcctacatggcaaaccccgtctctttaaaaaattaaaaaattagccaggtgtggtgatgcacacctgtggtcctacctactcaggagagtgaggtatgaggattgtctgagcccaggctcacaactgccaggatgttgcagtgagctgactgtaccactacacccatggcagagtgaggcccggtctcaaacaaaactaaaccaaaaacaacaacaaaaatttttttttcaaagtatgctactttattattaactattttttttaaagtgccttcctgtgaaatagagaagcacttagtgagaaagactgaatgccaaggcaaatagcattaacaaagtacatttcaaggaaatgagaagacatctgtaccatataataggacaagtagaaaaataggttgataaattatgtattaccataggatgcaaataccagaggacaaaaggggaaattataaatgaatgttaatatctttttctttattatcaaattaatgccaggcattgaacatttcctgctttgtgtacacatagaacctgatatgctgacctttagcatttagaagaagactaatgtgaaagttaacagccaccttgtgcagtaggtgattagtgcgcatgctcagcctgatgctgaacgaatgttggatggcaatgctgttttcttgcatggctttagttgcacagctgtgcaatttttccagattattttcaatattaagagatctctaagcactccatttccttgtattaaacttctaacttttaatactgcattacttagaaagatgtcttagtgacacaaagttattctagtgactatccatgtggtaattaatttttacaccatcttttcatagctggatctcactgtggtatttattgctttacatttatttatgaaaatgttttgctggatattaaattcaagattggcagttattttgccattttaaagatggttttctgccttccaacattttcgttgtcattcaaattgtttctgttttagaggtaatgtatctttgtcttttctcttagaggtaatgtatctcacacaactttctctggatgctttgagatttttccttatatttttagtgggaaaactaaaatgtaccaactataaattaaaaaaaaaattatccttaggtttgtagtgcttcatcaatctgagacctgatgttctttgtcagttttagaaaactcttggttagtatctgtttaaatgtttagtatctaatttaaacagttgttctgccacattcctttttcttcttggagtctggttaaaaaaaaagttgcactatttcccatgctgttttctgtttttcatcctttttcctctgtaccaacctatatattttcttctgatctttcagttcactaatcttccattctgcagttaaatccactttttcaggacttcattttattacatttttttcaatttagaatttccatttttttaaagatacagtttctggcaaaattcttgttacctattttcttaaacattttaattataattacttgaaagtcttgtctgtcttcagtatctgcattatatgtatgtctttctggtttttcatcttaacttttagccatttaatcctgatgcctgtagtgtctacttagtttgactaagtggtagacattgtacatgaaaaactatggaaactaatgttattgcgtccagaaagaattgttcttacggatggtatagggttagtacatcttgtaaaggctgttctatttctggtttgcccttatcatgaaggcacagcccttcaggggtctcaatggaaagcctgaaattcattcttttttctcctagcactatcaaactactggatttgtagttaattttttagccttttaggaactattttctgcttagcgtctcagctacacagccagcttaggaactggcaactgccttgaacggaaaagatgtggagaatgtcgggttaattatagtatgatcttggctcctcaaatcttagctgctttggttgttctccagtgctttcaaacagttgtttttctgttttgtattactattttaagttttatccaactagggtggttagtctgatacaggcaacatttaggattagaagtttccaattcctattttccatgattacttttaagacattctcaaagcatgaaaatatagtctttatctttaataagtgttaagcttgtcctctgtgtatttttgctatggcctcctaacattagcatgatataaaatctttaaagcaggaaacagaagtaacatttattgagttccaaaaacatgcaggcccttaataaagattttaccaatattttcaagtctagttggaaagatagcacatttccaaaatgatataaattattacctaatattgtacttacatatcaaatgatttgaaataatactaaaggaagacaagaacatttgttgtacacaactgttcacttaaactctagaacaagcatatgtatgaagagatgatgtttccattttaacaggtgaagaaaaatgatcagtttagaaaaatttgaaaatacagaatcacctacaatctccttagagataattacttagaacatttttggtctaagaacatttctagtctttttccagtgcatataaagcttttcaaattagctgtgtgcagttctagcagttcagcttcaatctgtttgtaactttatttctaatgtattttacaattaattgaaatttctttagtttacactttgaaatactgataacattttaatagtgctgacataaagttttctaaaatatatatagctgacttttttttagtaatgatctggtacaatggagtattatttctttaagaattataattttatgttaattatttattgtgagtgttttggaagctggtataaatattttgctactttttattaagcttcctaataatttttgtttttattttaaaggccaaactgttttcagatagtagttcagcactttagtgaagaacattacatcttttactttgcaggagaaactccagaacaagcagaggtaagattactgtttctcaaactacagtatacttttatgttagcccatgttttcttattaactggaatagaaaatgatcgcattcaagataaagtgacagaacgcctgaaatctaatcatctcttattttaaggaatgagatttcatatgtaaaaagttttctgaaagaaatgcaaaaacaaacacagtgaagggttattaggaatgaaaactccattttaaattgacctttaaatactctatgatgttgaggccaactgagaatgctcatttaaaatcctctctgcataaaggttataggtcatctcagtataatccaaaggtaagccagttaaccagttagttttgctaacaagcattattcttcactggttgaactccatgtctgaaaataaaagtcagtcaacacaaggaaagatattttaggaatctattctctaagccaagtcgagatataatgtctactttagattagctattaatccatgtgcagtgtccttcttatagcgtctattaagtaattgtgtgaagaaataatattttttaaaaaacactctttaaaaaatattttgcaacaaagggagaacccacctctataacaaaagtaaaaaattagctaggtgttctggcttatgcctgtagtcccagccactgggtagaatgaggcaggaagattgcattagcacaggagtttgagttacagtgagtaagatcgagacactgtaagccagcctaggcaacaaactgagacactgtctcttaaaaaatttttttgctttctttgaaccctaatatttctggagtatatggttgtattttatacaaatacagctaaatttctgcttatattctaacgaaggaacttaaaggtggttaagaagtgaaagtggctttgttggaaatataatttgccaaccctagatatgaggaagatgctcttaaaactagatcctagcgtgagactcacagaataaacctgaatgagcttacaactgaacgtcatatttcacatctttatcaaatatctcatttaatgctcatttcacatgtaatgcacataaaattttacggctatgtatccctaatttttagatgagaaaggtagtgctcaaaacattttggtaacttacatgatttttttaaatgttagaaattgagttagaaatttaaacttcagtatcctattttctaagtattttaccatggtccctctttctgaataaaatgtcacataccataatgacatttcagcatgttttgcaagcctaacatagaacattttttaatgtatttatacataatatttctgtatttccataaatggtatttccagtttttgttgatttattgggctgtgggggtctctggttattctcttctatttcaaaaagctatggtaactgatttggttttaatttgctgtaatataaagacagtctctagatattaataaagttcagcttcattgaaatagccaacaaactaaagacataattgaataaagcaatagtacacagctttccagaaatatgtaaaaaccaaagtgaatatttagatttgtttttaataaaccttagttctctccttttccccaaagcactagataaacattttaaaaatatggctgcaatttgatttgaatattaggctaaaatgatttttaaaatctaatgttatatttgagaagcttaaaaataacccaaatccccttatacatttctacctgtatcatggtctaaagtatagattaatatgcttgtcatgggatcggtcatcacattatcagttggttttacaatcagcactctccccctctcacaaagtgtatcaagttaaattccacctaagcttgcctcaagtataacagcttaattatacagttaatttccccaaggtagtatctgtttgggagaaatagtttctttaatgtaaatttgattttttggctaattaatggccactcgatgtgtttcatacataaattcaaacaaagatttatacagaattacaattgttttggttgttttattattgttattgttatgttattgttattttattattggttattgttatgaagtacagtatagtctgagaatagaaatggcagtctagagaaggaaaaaattgttgaatttgaaaaaaaaaaacctaactgatgatttggaagccaaataaactagtgtatatttctttgaagtgctgtttttctttgcaggattggatgaaaggtctgcaggcattttgcaatttacggaaaagtagtccagggacatccaataaacgccttcgtcaggtgaagcttaattttcttggatttttaattgtcacattttgctctaacactttgctctttttattttatttttatctgaactgttttggacatcatatggggttaagccatgctgccacttgcttcagtagcaggaaaacgttacttctttatgaaagagaatgttctttcttagtccatgccaactgttaaaaacataagaaagattattcttccactttaaataacaacactaaaccaacacagcagaaacggttctgttgggcacttaattttccttcaaaaacttattttggcctctttcaaaaaagtagaacattgaaaagatcatcagatttatagcactaatcccaataaacttttttgggattttcattttgaagaacagcttttaaaacctactgcttaactcttaggaaatatttaatcttatttgaaactgtaacatgccctatactttgagatttgtggagagttaagctaggctttctcttttttttgcctttacaagggtaactttataacctccatttcttggcttttttctttttagtaatccctgtataattggaagaagttaggcaaattttgacattctcaaggtttaaagaaagtttagtacaatatttatttactaaccaaagtgtctcctgttctctttgtgcgaatatctgataagctgagtgattaacatactgttctactgggagtggataatggttgatatttaggtgactaaatagtccctgtaacccaaagtctggctcttccccagggaaatttaagtatacacacaatcgccatgtcttcataacattgtaacattttgtaagctatcaaaaatcagattggatttttgctaataagagcaagttgtattttgtgtgaaacttgagccattaaaatgacatttgcaggtttaatataatcatagctaacatctctcaagcactttttatgtatcagtgggcagtgtgatttagtgatttacatatactgtcagccctttctattcatgggttctgcatcagtggactctaccaaccatgggtcgaaaaaatacaataaaaagatacagtataacaactatgtacatagcattcacattgtattaggtattacaagtaatctagagatgatttacggcatacaggggggcatgcatagattttatgcagatactatgtcattttctatacgggacttgagcatcttgggcttcgttagctgccaggacagagaggtggagggtcttggaatcagtcccccacagatactgagggataactagtttgtaatacttattacaacctgtagtgtagactttatacttacatattagaaagatgaggcttagagggacggatttgtgcaaggccacacaagtagtatatggcaagagagaaagagaacctgatactagaaggtggatggtctaagttttggcatccaaactaacaaataacttagtttctttaggtttgtatcctttcctgtaaaataagaaggtaaagtcagtgttttaaaaatttttagctgtggaactcttttatagaaatagaatcttccagataagtattatataacatacgggattttaatttgagtagtgacagttgtttacttatattaataaagaattttcttcttaacttcattttctctttatcattgttttatggtagaaaaggtgtatttcattatttctccaggaatatactgggagaaataacttgtaaaataaaattgcattgtttttatcttttaggtgggaagaattattttaaatgtctgaatgttttaagtatgtcatatacaaatatataaccaaagctcacattttctgaaaaaaaaggggaaaataagtcattatttttggctttgtatcttagagtaattgcttttgaaatgtagtgcaattctagaaatctggggtaatatatatatatatatttttttttttttaggtcagcagccttgttttacatattgaagaagcccataaactcccagtaaaacattttactaatccatattgtaacatctacctgaatagtgtccaagtagcaaaaactcatgcaagggaagggcaaaacccagtatggtcagaagagtttgtctttgagtaagtcttattttatcattacattaatcattttcttttaccatattgcatttctttctgtttttttggtctctgtatctaaaccatcagaacaaggtaccatatccaggtgttctaatagcatatatatatatatatattttttttttttttttctgttgtttgttcacctttatttgtgaagtgctatgcccttggtttttccacttagttattaacatgaattagcaagtcaaaaaacatttactaacccacaaatacaaaacatttactagggtttccagtacttatttgaatgaattattagtttaggaggttaaagatggtaggaaaagtgtgtaatctgcgtgtcttctgtataccaaataataaaatatgttgtgaatctggttttaggtctagcacactgtttttttttttaaagcagaaatagggggtttatttgatactagaactaaagaaataaggtagtttgatgccaaaacattttgttaattctttttctccttgctcctttagtgatcttcctcctgacatcaatagatttgaaataactcttagtaataaaacaaagaaaagcaaagatcctgatatctgtaagttgatacagaaactttctaaaatagaaaaagcatgttttatatactttcaaaattcacaatgaaagtcttaaaatagaaattaaaaaaacagaaatgcaagtagtataatttgagatagtttctttctgtacttcttaaagtattgattatcaagaaagaatatacctaagatagaaaaagaccaatatggttcaactgtacacactgttaagcaattaagattaaaatatttagccaccctcctttctccaatgaataggaagaataaggaaatgattacagtggtctttttgtagggcttgccctcatcccttctttctactttttaggtttttcctgcttttttttttcttttgagatggagtcttgctcttgttgctcaggctgcagtgcagtggtgtgatctcggctcactgcaacctccgcctcccaggttcaagcaattctcctgcctcagcctcctgagtatctgggactacaggcgcccgccaccatacctggctaagttttgtatttttagtagagacggggtttcagcatgttggccaggctggtttcaaactcctgacctcaggtgatctgccggcctcggcctcccaaaatgctgggattacattaccatataagtaaaaaagtattctatttaaaaatttcccttaaacttgaatgtcatttattctatttaaaaatttcccttaaacttgaatatgtcacttattcacttctggtagtcaaaggctcccagttcctgtcctcagcagcacagctccttccatcctgctgctaaaacagttgacagtgagatttaccagttcacatcagggtgaattaggttaataccttcttaaaactcaggcttagggaaggaagtgatatgtattaacagatcaaagcctgaatatttctctataaaatgtttattctgtagttttttgtagtaattttagttttccattacttttacgataaaatccaaaccccatagtaatgacacagaacgaaggccataccttatatttgaagtgctcttttttcttttttcactacttttcttcttagctacacctctagatctcgtccgctcaagggttacctgtttaaagtggagttttcacctccacaggctgaattagatattatttctctgtactcgaatagcattcaccactgttaacagcacttaccagtgctgaaacataattgatttcttgccttcttgactaaactgacctctatgcaactcaaagaacacatctcaatcatctctgtactctctacctatcagagtttagtgcaccgtagacactcagtaaataaacaactaaatattgaatttgtgatgttactgaaaactcctttaatgaaaagcatttaacaccatagggaagactgaacaccaggaaaatttacttgcatgactaattatcgtgttctctttttaaacaataattgcttgtttttcttcccaagtatttatgcgctgccagttgagccgattacagaaagggcatgccacagatgaatggtttctgctcagctcccatataccattaaaaggtattgaaccagggtccctgcgtgttcgagcacgatactctatggaaaaaatcatgccagaagaagagtacagtgaatttaaagaggtattaaattatttatcagtcttgtttttgttggaattaacagaaacatttaacatttaataaaagatccattaaggtaaacatagtaattcatagcttagtagcacaatgatgccagagattttaaaccttgttttatactgtaattttggtagaaataagtagactacgaattcattctattttaaataaatttattcaatgggacatcattttaaatataagaacttgtgaaagaacatatttcttgttagtctcatggagcatgcttataatgctacgtactttaaacaatcttttaaaatgtcattttagcttatactgcaaaaggaacttcatgtagtctatgctttatcacatgtatgtggacaagaccgaacactactggccagcatcctactgaggatttttcttcacgaaaagcttgaatcgttgttgttatgcacactaaatgacagagaaataagcatggaaggtatggtatggccatgttagtgtgatacaagaaactgggtttagattttatatcaaggatatatggactctatctctgaatatactaaattgttaaattatattgcaaaataagttattctgttttccctccttaaaaattgcagttggatgtcagttctgattatgttggttactatgggaagctgatatttctaatgtaggttttggcagataagtactagaagccacaagaaggtggtatctgtgtctacatcaatggcttgactgtttggcatatttatctgtattctcttgttttttattttcttttgagatggcatctcagtcgcccaggctgcagtgcagtggcgcagtctcggctcactgcaacctctacctctcaggttcaagcgattctcctgcctcagcctcctaagtagctgggactacaggcatatgccaccacacccagctaattttttattttatttttttagtagagacgggttttcaccatgttggccaggctggtcttgaactcctgacttcaggtgatccgcctgcctcaagcctcccaaagtgccggggttacaggtcttgtttaatttttacttcttcattacacagaagctgggtgtcagctgcattttatttctaacttttatagataggtagttcccaagctgctggacacagtgcttttaatggcttacaaaataatccaccctccccctggcccacacacaccaccaagcactttgattcattaacagttcttgcttctaggttccccaaataaatagtaaagtttagaactattttcctcctcatcacaaaatatagatttgtcaaggaatagataaaatggtggtccttattttacacttgagtttatcttttctgacagcatttgtatttcattaaaattttactgaaactcagtagacatattttaagctaataaattaatctatactgggattttgtgttatatccttaattgtaaataaaccctaaaatttcaaagcatggggtcaatgggcagcaaagctgatttatggtcctaattttatcattagctgtctaattgatcttaagtcatataacaattctgagtcttcatttttccatatgaacatggcagtgttaatcccttctgttcatgatctaatgaggtaatacatatgaaagtcttacagagttaagtctgtagaagtataggatgtcattgtaattagtactttcaacgctgcacgcaaaaagcacatttaagtggctattcctgttgaggtaaaatgaattcacttaatttccaatttggtcacattaggtcagtcctttacaaataatcttctaatgtaaatatttgtgtagatgaagccactaccctatttcgagccacaacacttgcaagcaccttgatggagcagtatatgaaagccactgctacacagtttgttcatcatgctttgaaagactctattttaaagataatggaaagcaagcagtcttgtgaggtaagaatttaatgttttaataagtatttttgcaaagaacatattttaataggtaataatttgtagccaattacattttaaggaaaatatattaaatttctaaaattattcctcatagcagttacacctgtctgtaatacatttataaaaatgttctgcaaaatggacttcttaaaaaagatgtactttattttgggattaaaaaccatcaagttgcaccagaaattcatgaaaatactttgtcatttcctctactgtactaataatctatatactacttacagaaagcgtgcataagataaattgaaggttttgttagtgactcattatataacctatgtagcacttcattacatcttggtttgttcttgaaggtttttttgcgaggggagaattatgagataacctcaactaaaacaaaaaaatctttttaggattattaaagtttcagtataaattcataatacactattaagacagtaagtggaatctcacacacatattctctcattttaatggtaaagcaactacaaagaaataatatatattagatctgatataaaaatcagtttaaggaattgtttttgacaatggacactgggacctagcaaatgttaatcctgcacgaaggtgtcgattcatactaataacttgaagggaagaaattagtgatttaatgttggaaatgtggggtaatgccatagttggcctaacataaggatgacacagaagtgcagcaggtaggtagggagtctctggactttagagataggctacggaattccgacttccatagataaatgtactctgctgacactagatcagaagggttacaggaaaagttctgagaaaggtttgtgattctgcctaaggcatttgatatttttattagccattaaataagcctcattcagaaaagcttttaatcagctttttttcccctcaaataaatagaattgactaagcactgtttgcttttcagttggctaattgggaataaatggtaacagacctaccaggaggagttccatagagaaaactacttaaaaactcccattatacaaagaaaaaagatcaatacacacagagataccgaaaaatagacaacctcgaaaactataactacttgttttcctctattcatttgcatttgtcattgccaacatgcatttatattgatttattccttcttttagttaagtccatcaaagttagaaaaaaatgaagatgtgaacactaatttaacacacctattgaacatactttcagagcttgtggagaaaatattcatggcttcagaaatacttccaccgtaagtggtgaaattttcatttgacaagaaattgtgtatctatgtcttcagaaatttctatttctaaaacgtgaaagcttttctgttgtcctaatattattatactctgaaaaagtcatggttaatctttatgagatgaattgtatttaaagaaaatagctgtcttaataaaaccacccattattttcgtacaagccaatatgtctggtttgtactgtagtagcttggggagtgaatagaggtttatagtttcagatttgagattgtaaaagatatcttgtctatccatttagtctatacttgatagactaatcactctgttaatatgcttgtcggcctccagtattagtgaactcacttgttcaggtagaagttaacttaagtctaaatcttgctccccagaatttgcagctggttggttctctatatctgaaagtaaatgtcaggaagttgactgaataaattgatgataaacttagtggataaagttttccttaccccttgctaaatgcctcattacctgtggcaaaatacttttttgggtaaaaggccagttttattgaactgtggtatatttgggtaaattaagcttttggctgctaggagatcagtgttttcacttgctttctgtgttgagatgattgtgttattttggcaggacattgagatatatttatgggtgtttacagaaatctgttcagcataagtggcctacaaataccaccatgagaacaagagttgttaggtaaggctcatcaattgatttgttaaatcacatactaataggtggataattgtgaaaaattgaggaataacaatatacaattcaatgcttttttctttggcttttatgtcaaagccctgttgcatattttctaagtccagatggctcctaaactgaaagttactgtgagatttagctgccgtttgcattttctaaaaacatgaacattcatttatagtcaagtattggggatttttaaacccttacaagatgaggctaaaagttatataacaaaatctgtagctaacttcatatagtattcttcatacatacacacacattgattggcagtgagagagaagggcagtaattgaccgatttagatattaattggtttgttacaatctgtgactctgagctaatcagaaccagaacatgtagttctgaagctgtgtttcagtctgctcattgtaccataattaggaagaactgctttggcaaatcatggaatttgggagcttatataaagggacttcattatcattattctataggaagaactgctttggcaaatcatggaatttgggagcttacgtaaggttacttcattatcattattctaacttatttttccaatgaagaagcagatctgtctggagaggttaagttgaactaaggttttatagaaagctggtggctaaggcagaactaaaggtaactttctaagacccaatctgatatccttgagtcttattgtaggcttttgcttttgttaagcatactccaactaataccccaactaattccaggcaaatggaagtttaatgcgaaagcgtcatggaatacagcagttttctaataatataatttgttatttagaatatacactgtcatgtcatgctatatgtaaaataattaggcaaccattaacaccattattacacagtttgttttgaaaatgtgttaatcctgcctccaacctaaattttgtcaaggggcttctatttctttttttggggggcaggtaatatttctcttggttatgatatgacataatatttaagaactacagattctgtttttcttggcattagtggtgattgggaggaatagaaaagaattacaagcataatattccagcacagttacgtgtgagatgtaaattaaaactgttctataaatttgtaagtttcaaacaagtataactgttaagcaaacacagcaggaaattgtaaactgtttcgtgcaagagggtgttttagggcatttttgccaaggttaggtttcaggctcatagacctactatgtataattatcacaatattttcaagtaaagtttacaagattctttaaatttgggaagtccaaaattaaagacttaattgttatttttttgagacagggtcttgctctgttgcccatgctggagtgcagtggtgtgatttcggcttactgcaacccccgcctcccaggttcaagtgagattcttgtgcttcatccacccaagtagctggattacaggcatgcaccaccatacctggctatttttgtatttttagtagagatggggttagaccatgttggccaggctggtcttgaactcctggcctcaggtggtacacccacctcggcctcccaaagtgttggatttacaagggcatgagccaccatgcccagccaatatattagaatttctataaatgctgtttgagaagtaacatctttactttctaagagtccaaaaattagcaaacaggtacatgttcaaaggtaaatgctaagaaattgggtaatccactctaacagagaacagagattgtatctattaatctatagaaggaattgcgtaactcattattttgggaataatgcttgtctttacatggattatgtctatcaatctgtagaaggaattgcataattcattattttaggaataatgcttgtctttacatggggcaagtaagaggttaattattagtgtggattcttcttaaaagaaattagaaattatctacatgacaacatatcctccctannnnnnnnnnnnnnnnnnnnccaaagtaaaattagcagataaaatcatatatgacagctgttagtataatttttgcttttgctattgttttataatttgacaactttttaaaactttagaattcctaatgtcttgtcttaaaagtttttccaggctgggcatggtggctcaagcctgtaatctcaacatgtttagaccaagacaggaggattgcttgaggccaggaatttgaaattgtcctgggcaccgtagcgagactctgctttctacaaaaataattaaaaaaaaaaaaaaattgccaggtatggtgatgtgcacctgtagtcctaactactctaagcctgaggcaagagaattgtttgatcccaggggttcaaggttgcagtgagctgtgattgtgggccactgcactccagcctgggtgacagaacaaaaccctatctcagagaaaacaaagaaaaaaggaaccaagaaaacctttccagtgttctattatagacattttcttgatcataagtcactttttctctagtgcaatggattcttatttttatgtgaatcatcaacaaaatcaatgcaaccaacttaggctgttctgtttaaataaattaagaaatgagggtgtgtgaagttctaaaattgtacagaactatgcttatataaaaagtttatttctactcctgtggtatttcagaaattcttaagattcctgaggatactactttctctaagtatcaaatgaccactagcctggaataataaatagtaagcaagacagtaaatactacagataaacaacattttcccaaagttaatccacattctaaattgggaaaagtgagtaatacattcaagaagcagatatatatattcttaaaatacgatgctttggcttactgttttcttaaagctttctgtgtctgggctttcttttattggtttagagtgaattttatgggttctatgagtactaaaaattctgtttatatatattgttttaatgtaacacattatataggtgttttctaaaaaaaaaaaaaaaaaatttccctcccattcaggtggttttgtttttcttcgactcatctgtcctgccatcctgaatccacggatgttcaatatcatctcaggtaatcagcttttgatacattttgaaattcaaaatattagaattaacagtttcatactatttaagaatactcttaaatcttttttttttttttgatcatccaattctagtcatggcatatatgaagtattccaaagcacccttccttccttgtgcttgtgcttcttgggcttttttctttttgtttcttttcttccatctcatatctggtctgagatggcatgattacacacattccaccttttttctacccctatttgtgtctcaaacctttataataagtgacttcttgtagtctgcagcttggctttttcaagttgggaagagctttgcttagcccattgctagactgctgccagctagatcttcaagatcaaattaaatgatatgtacagttggaatagtattctgtgagtacttatgaagaaagcagtcctggttcctcccgttagagatttttaaagtcaccagttatatagtgtaaattggccattttaaacttcagtaaacctgatccagttttattacccatatatccattttgagatgactttcaggtgttaaaagcttctttcaaagaaaggataacagggatatttgtgactttgaatgtaataatgaaccattataaacagtaggaactggaaccatttttaccttaataatctgaagctcaaaattgtactaaaaatgttttggaatgtcttaatttttacttctatatagccatcacatctctgtaattatcttttattgctactaaagtggttaaatctataaattattaatattaagggtttgaaattcttttggagagatttatctggatgttcgcctcagacaacaccatctaaaactaggcagtcaggtagattatttatgggattttactgttaaataattaagttccagagcttatatttaatagacaccaatacttttcatttacatcctactatctgtgttccacagggaagtgcttcctgacttacctttaaaatattttaaaagtttattaaatttcatgtttttctcctcaaaataaagcagaggtcctagactttatcttgcttcttgagctttaagcgaattatttggactgcaaataatgttgggagcagggaattgctcagattgctaacctgagtaggttgaaattagctttgtgaactgtcataaaagatgtgaggagtgacaatcttttttagtgataaaggtaaagctttgaggtcctttgaaatagtatcaaccgttggaaactgctgagttttgtagtacccttttcgcaagcctagaagcactgataagcatattcactttttctcttttaattcaagttcttttgaattttatggatcataaatttttcaaaaaacatttttccaaaaacattctgagttccgaatggaagaatgggtagtagtttaacagtaaagaaatattaaagtgctaaatttataatggtttagctggaagtgctgttggacttggtgtcattagctgtgcccaattctgttacagattctccatctcctattgctgcaagaacactgatattagtggctaaatctgtgcagaacttagcaaatcttgtggaatttggagctaaggtaaaaacattttgatactttaaaatgtaatttatgaatgcaagtttgacatgataaaaccataaattgtggcttaagtaaatttttagcagtgaaatttttagcgatgaaagattatttttgttggtatgtttgtttttaaagtagcttgtttaaattttacattttaatagtggaactttaaaaaacacaaatttagccattatagaaaacgaatttttcaaggtccagtgtactcaaattctcccacttttaaacataatcaatgagtacattttaatacaaaaagtcatttaaaaatttatttcacaaacattcactgtaaatgttaaaactcaagattttatttttttaaacacctacacttaattgtactatctaaggataatgactgatattcagttgggatcatatcatgcctcctgcttttgtcacctaatacgtgacagacttcttgccatatgtggaaatagataactctttcactattcttaataatggatatttagatggcttccatttgtccctgttattgttgtaacatatattcttgcatacatttcctttcatacttactcaattattagctgaactttggagtaaaatcactaagtaaatacgttttaggcttttgctatgtgttacaagatttcctgtcagcaatttaagatacttttattgctcctcacagccttgccagaactcattgggtactatacttttttcttttttgccaattggataggcataatattttgtgtttcattattttattactgttagagagactttcatgtctttatctttggaattgcctattgaggtccttatctcattgagtttcttactgattttaaaagagtgtgttaatcttaacattttccctatttatagcatggttttaagtagtcaggattttagtacgatgagcagttaactacgtgtatggcctaggttttgaattcatctgaatctttgaggcaggttacaaataagatattttcctattgcagtctttattatattgtattttaattccctgtaatctctgctggattcaaacctatgatttggggccatgtttgagtgaatttatatataaacaatttgtgtctgccaggctatgtgttacgatttgtgcttgggtccagaattttctttcattaaaaatacccatactcctcagtatagccatttgcttatatactagaaggaaaatactgtcattatatgatttaattaattcttgtgaatgtgttgctgctgctacacctaatttataagaagtattgctacatgtatgggttttgctatattaatttggtgcaatagtaattgcagtttttgctgttaactgtaattacttttgcaccaacctaatagatcaaacagtggtttgtttctggtgcatataacagaagcattttatttttcaggagccctacatggaaggtgtcaatccattcatcaaaagcaacaaacatcgtatgatcatgtttttagatgaacttggggtatgtatatagttttcaggtactttttttaagacttctagttgatatagctgagttaacccatttaagcagcaatctttagaaagattttctatccaaaactaaaaagacaaaaagcctgcaaatttttgtctgccttcctaaacaaaaaacatatttttgtttgtaattaaaaccatttattcttacactaaatagtttacaccaaagcatacattattgtggcttttagactacttccatcattttttagggtctgtcttgcttttcatatccttttaaagctatcacatctgactgccatgacattctgttgcctccttagcttttttactttgctgctactatgtggggcgtgaagcaagacgatgacacagttctgaccaggttaaataagtagactgaaaagtcttcttttctaggaataaaagacgtggattcggtgttacacttcattcagtgtgaatatctgtgcctcatttgggccttgttaataaaataaattgtgattacaaaattacgaatgagggtattttataatttctaggaccctgcctttcttaatcaagttaaattttcatgattgaacagattttcaggtactgagtcagttttaaactaaacttattagtaattcagttcatatacagagaaaccaggaaggtgcatgtacatgtgaatagagccaggtgtaaggcatggcattagggagtgctaggattggagattgaggtgtccatgttctgtcttaatgtattcagattcagttaaaaagaccaccacaatttgtggcaaacaaatcaggaatgccgttgagtcactagtttgcaacctcaggtataaaaactagtgtatgaaaaattatggcatagctccatatttatagtgaaatttatagtgaaatggacaaaaatgctaaaagtccatcatgcttctatatgtgaactgggatatagttggtcaatcattggaaaatatttttactataatgtttaaggaactgtgtgagaagttatgccacacaatctaagatttcatactgcttagaatccaaatataatactaccatatttcttcaccacctgtataataagccaaatttatttttgaagacccacctcaattattatctccttcaggaagcttttgctgaaccccaaacatgaataaaataacttttgttttacctcctaagcatcccctgtgtatctgtgatatataattctgtgttgctatgattactttattctaaagtcctttctactggagtcagttctctgaaggcaaatatggagtctttcatcgctataaacctttaatcactgaatgtattctgagtaactgtgtttctctgtcccatagataacattgttttgcagtttttagcaatgtaaagcaaatactgtcaccattttactggtaatccaagcccttgttaaatgttattccaaggcttaaaataacactggcatttagtgtcgataataaagtacaggttgagtatccctaatctgaaatctgaaatgctaaaaaatccaaaacttgttgagcaccaacaggaaatgctatttggaaaatctccaattttggatttttggattggggatgctcaactggcaagtatactgcaaatattccaaaatccgaaacacttctggtctcaagcattttgggtgatattcaacctatactataaactttcattatagtgactaagttactttatgaaccttatctgaaagtaccataattaacactgattattcccacacattagcaagtattctgagcatagtccacagataattgcaaacctgacaggttctcattgcattttcatagtgcagttcctacttatatgcattatcaacttagacaaactacaggagcttaataatgaaatttcatctaggaattttaagtttaggctgcatttaatccagattagcagttaacctacactatttggcatatgttctagattttttcagatacaaagctaattgttaggaagccacaccccccaccccttatttttagaatagcaataatattgtacacatctgtcatgctacggaaaaaaatggaatctggctttcatgtgaatacaaaggttacaaagtctatattttaccatcattaatactgaatattatatttcaataagaatctttagaattttaagagaaatttgagtattaaaaaaattatctaatatacccaattagaatcttttcacatgagactacagagaaagatttgtatttgtaacaaaaaattagctgggcatggtggcaggtgcctgtaatcccagctacttgggaggctgaggcaggagaatcgcttgaacccgggaggcggaggttgcagtgagccgagatcatgccattgcatttcagcctgggcaacaagagcgaaactctgtctcaaaaaaaacaaaaaaaaagaagatttgtatttctaaatgcaattttacgattcccttaaagaatgtacctgaacttccggacactacagagcattctagaacggacctgtcccgtgatttagcagcattgcatgagatttgcgtggctcattcagatgaacttcgaacgctcagtaatgagcgtggtgcacagcaggtaggctttcgccagccttcattaacaatgatgtttcaaagataacacttagagagttaataaatagctgaattctggttaacatttttatcttgttacattaaatttttgagactctgcatcatattacaaaagatctcagcagacagaaataacgggccccgactaaaatgatgtacatttaatactgaaaaacatcaggttttgctcttgagtctgaatgttaattctactggaaaacagtgtaataacactttggtagcatgtgtgaaaatggctagttagtaagtcaatattgattttatttttttttctttcagtttctgtcttgtcttttctctgtcacatacagatatagtgcatggccaaagtgattctcaaactgtgaaacaaatgattattatttgggatgtttgtcaaatttcacatccagaggttctgaagtgtggccttgaaagctgcacgtctaacaaactcttagaggaatttataggtattccgatgcaagtgaaccatggcctacactttgagaaacagtagactacattgatagacttctatctgccatctgcaccaaacagatacagataaggatgtattcaaagaccagaccagaatttgaagggacttaataccaggtcaattaagatattggagatatagaacaaaatgagttacactttgaatgtcctcagctgacataagggctactgagaggaagtgaccacagggacagttttgactagtttctaatgtagtttcaggagatagtgaatgctgtcaccgcactggctaaccatttggcagggattttgtagaagggattaaagcattgagtttggtgactgagttctctacaacctgagattctagaatcctcaagtcctgtttctccccgcccctccccccgcagctttcaaaactaataatatgacttgacttgccttagatattaaataaaaaaagccttttttaaaagagagataaactgcttctgacaacatgtgatagtgtgatagttctggcctaaaaaataggagcatgccaaacacaaacaaatttctgttcactttagggtataaaaattctcttagttatgaccagaaatactcagccaatgactgaataatagagacttatgttttgaggggaattgtggtaatattttatgcatccttttgctttgatacagtttttttcaaatccaggttcccatcctgaaattgctgaccgagctttcatttattttcataccatttttcctctgtctagcacgtattgaaaaagcttctggctataacagaactgcttcaacaaaaacaaaaccagtatacaaaaaccaatgatgtcaggtagcagccttcgccccagtgttctgcatggattcagcatgtccaacatggtaattcacttcagtttaatgtctcctttgctcttgccaaaaaatagcacacttttccacattccagtgatgtgtgagctatgcaaacaaaatccaagattctgctggtgaataactatgccagcaaccttgtaagctatctgtgcaggatatttgcactatttccacatggaatcaatctttaacaacctctgagccttggtgtacagaccacctttcacaaaacgaaatgctatgactgtatcttgatatctcgaactttcaaaatatattttcagtacacccagttgccaaagttttgctgtctcttagagaaagaactatgaaatcaactgacaagaaacacattcttattgacaattgtgtataactggattgcagactgttcttactgtaactacttcctgattaggaatatgaccatttgactgttcaatgattatttgtatttacagtttccagagtttgtcattataataggaacaatctttgctgtatacttttaaaaaatactctgctatttctcttgctggaactgttgaaagaaaatatatagaatgatctattgctcatcagctttattttttaaacatacgacttattttgttgaaattgtcaaagactgtatttagatctcataatgctttgttaaatgtttacaagtaaatagtttgaattcagtaaatattattggttgttgtattgatcaatgcatgttacccattcaaccattttatagactaccaatttcttttatgttaactagaatgcttttgttaaaagttatttgttcattatttgtgctacccctttgattatgcagacaacctcatcagctgcctaacttatccatctttgaacttctgactacttgttgtatctgctggatatttagttcaactgtatagttttatttacttctgtatgtgtatttttgtgaagtattcacaaaggttaagttaaaataaaaccaagggatatcttgcataattgattacttctgtctaaaagagctaagcatttaatttatttattttcttcctccttcaggggcagtttaaaccttagcatcagagcaaggcccagggagaagctgaagctttagattagtatttttgctaatggcctcttttgaaaaggattttataaatgcaataattccttccctctcataattgtgcagggcagatagataggacatatggaacatacgtggcagaatgacattggtaatcaaagtgagtgagacaggaacccaaggaggtgttcccacagtaaggaaagccctagattccaagagcaacactttatgctattcctctaatgtataaaatacaggaaaaaaaaatgctaagggcttaaaagatgtctgcttagtagttccaagctacaaaaggcagttatttctatgggggctgctaacctatgtggcttcaatcaccgtttaacactgataccaaaaatctcaacatgtcccatgctccttttccttgaaatcagctcaattcattccattctctcccttcttggctcttttatcaaattactctcctttccaccccttctgttttttagctggacttggaccaacatagtatcccaggtggtctccttccttggttacatgatagaagacagggaggatatggattagtcaagatatttttgctgtgcactttggctcccatttatcacacctcaatctttagccatactaacctgtcattcctcagtctgaaatccttctcccttttatttaaaatcacaaacctgacttaccctgcttcttatattttaacatcatttgtctctcaagttgaaatggaaacttgttacttacctttgtaggccctctagtaactagcttgtcagtgttgaaataaaatctctcacactttaacgtttttaatggggctgggtgggaaaattttcagtgataagtgtggaccttgctctgatgccaaagtttggcgatctgaaagggaaaatgagacaaattgtgaacatcttgtaattctgtctagagcctagcagcaatatatttaactaggactgcgatggaggatttataacttttggcttcttccactctgcttttgtaaaaatctcacatcacgaattttattcctttcactctggaatgagaaaaaaaaaaaacccacaaaactcaagcctacagtgtaaagaattattgttagagagatgaatatgcatatagtaagtattgccttaaaatagatgtaactataatggtacctacctttctggaaagtacagcctgggatgtactgagactgaggaggtgtgtgtatttgtgcaatttaattagattcaggacacttgaattactcggaattccttcaagccagttttcctgaaaaaaatctggcttggtaaacagacgtccacagtttggttccaattataatagttaacacttactgaatactagtgtatgcaggtactattctaattaatcctatgaagagtaggcatttttatcttccccattttcagtgtgggaaactggcacttagaggtttaataacttaccaaggtcacatagtgaaatacagctggccatgattcatatgtaagtaatttgctgtaatagtctgtgctttcatatttttatattgactcatttcaatttgaattacatttctctaacatatttaatctgcaaaattcctagtaactgttataatctacttacacggattcacttataggatctaataggttaattataaggctgtggtgatgtgtgcctgtagtcccaattactcagaaaactgaggcagaggatcactagagcctaggagtctgagacagcctgggcaacatagcaagaccttacatcaaaacaaaattaaaaaacaaccacaactgaatatacaatttgctgctacctacttatctatactagcgtaagagtttgatgtagacagctattcaaaatcatatatctggttttttttaaaaaccca

SEQ ID NO: 15955 - DNA, 54576 bp, Human; identical to SEQ ID NO: 15954
  misc_feature (1)...(54576): n = A,T,C or G

SEQ ID NO: 15956 - DNA, 85675 bp, Human; identical to SEQ ID NO: 12333

SEQ ID NO: 15957 - DNA, 35916 bp, Human
tttgatcaagaaccaccagggcagtgagcatttggctaatcaatttaggactcaggttggaaactattgatagggaaaagttgtttatcttatttaaaaatgtttggtgttcatccactttttcagtacatgcctgcaagattctataaagggccacaatatcctccggggtaaatgtttccaatttttcaccttgaagttgatttataatgagttctagtgtcacacaacctgaactgtgcagtgtaatcagactttccccaagaatacaaagattgcgaacttccatgccaccttttctgagacgattttggcattctgccaccaggttcagcaacaggctactttgaggatccacatgcaacagaatcagagcttgcaaagcagtcactaaactagtgtttgacagctgtgagggctccttttcaaactgaaagcataaagcttgaaagatgctattctccagtatttcttttggcagcccttgatcaccatcctttttttccacttcacaaattcgttgtaaagctcctgctgccatagtgtcaggcagggtttccatcgtgcttataaaacttagcacttcttctgatgaagtcaagttgctcagtctcctgtaaaacatctgactctcctcatttttaacattttgttcaagcctgtcgcagtcagatacttgagagaacactggtccaccgagtggatgaaggtcatttccatttttcgaatgaaactttttacaatgggcatgatggaatctgaccccgaaaggctcaggttgtcgtgaacacaaccaagggcacagacgctccttgactaccttgtgaacatgatttagaggtttattttttaaagcagccagagctctatgcatctgaaaatcagataaacgataaaggttcttcctcaaggtgattaatgccataccatcagattctcaatttgataactaaattaaaaaatttaaaaacacatggttaaatacattgagaacatgattgacccaacatcaatgtttatgaaactacaaacgagtatctggaaaaaaaaaaaaaaaaaaaaggatggttaacatataaacaccagaggggcaaagtctctgcatcctagagttagaagagtggctgacattgaacaataacaatcgctattacttgctaaacactgttgtaggtattctattaacttacacagattcagtacttttactatcattttacacgaggaagaagttgaagcacaaagttactttgcccagtttatgcaggtggttaagtggcagagctagggttcaaactcaggcaatgtagctcttaagggtggcccttaaatgttggttgaaggaagaaattgcatttggatagaaatcaaagaacaggtaaagtgggcaaaattaggcgaggttagagcaaggcaagggtaaaaacgcgctggaaaggccctaagctgttggtttcccctcggtgtcgggagaaggttagtgttgaaggaaagggtctactttgtcaatggaaacaaggtaggaaaagaaaaagcaaaacatagatcaatgaagggagaaggtggggcggccagtccagatctaaagacggtgcggggggatttggcaacacgtgtgtgcaagacagacagacgggaggccccgcggcgcgttttcctaggaatgaaagggacccgcggggcgagcacccccaaactcggcgccccggggacctgcgctgagacacgggccgggcggcgcagcctgaggagaaagccggccaggtctttgacacccagccggaccaactgcgcggagaccccgcgttgacacctaccgcgctctgccgggcaatcactccgggtggtcgcggaagcgcctgggcgtcgtgggcctccgtagcaaacgcggggcgggagcacgactcagggcggcgcaatgtgattggcccaggtccccttcggagctttctattggtcctgggtaccgagcatgggcgctgcgtcagtgcgcgctggcgcaaggttggtggaagtcgcgttgtgcaggttcgtgcccggctggcgcggcgtgggtaagctgcctgtcggctacggttcccggattccggccgctcgccctgcactaatctcctgggagaggcggcccggggcgggggtgggcagccggcttgcgcccgtggttcccacgcccttcggcctccgggggtcgccgcgggcgcgggctggggctcggacttggcctttggcctttggctttggtgtccccgggagcgtgtccttgggctcggcgtcggcctctgccgcgggaggcccctgggcggcgtggggtctctcctcatgttctgcctttggttctaggcgctttccaggcctagggaaaccgcactcggggacgcggggaactggggaacatgccgggttggggcggcgcgctccggggaacccgggacgttccgagcgcccacccggcgggacgcggccgtgagttctgcccgcggccgtgagctctgcccaccgcctccgcgccgcttccggggctgctggggcccgggcctccgctgagagtcgtgggaaggtggtgccggattgtggggcagtagcagggatgaggggttgattgatcctgggaagccctcaggatgtgtgtttcatgggaagtgatagaaattttagctgtagtaaggttttcattatcgtttccaccgttttctgtgagctgtcaatgtgtagtgttttcatattgtttattcactcattcagataacttatcgagtaccagtttcatgccaggtgccgttctgggcggttcattcaccgaaagccaagcttttggtttgggtttcagtttaaatctgtctctgcaaattgacagcccaccaattttagccgttagatgagtatggaaaaaaatctgtgagtgtcgtttgttttactactgcttatctcttgcggaaaaacgtgttagtaaaatgtttaagtggattggaaatattttttcgttatatgcacccgtttgtatatatgcccatacactcacatatttttgatttgcattaaataatgaaggagagtatgtgcttcagttacctttagtactatgattagtttgtttagcgttaggatcaaataagaaccaagaatcctatcattttaatatagtttttacttttatctttttttaaaaagaggaaaccaaaagctatttaagactgttgtgaatgatactgtggctcaagttttgttcaggttcttggcttgtgccacatcgtttttcaggtaggtggtaatactctcatttttaggataaaggagctgtggtacggatcatttggggagcttgtctacagggttgcacttaggaaacacagattcaagcccaagtagtttcgagccgatcatctgatttctgagccatggaattagagtttcattcgtacactctccttaatttgatgaattcttatttaggctcatttgagattagtgctgaaaacaaatttagaaaaggccatttcatattatgtgtgggtattgttgcattgtttcttaaagattgagggagaattaatatctttaggttgttactgcttcattaaaaagaggatcttttttcccccatttttcagtttcactgttacatgccttgaagtgatgaggaggtttctgttactatatgctacacagcagggacaggcaaaggccatcgcagaagaaatatgtgagcaagctgtggtacatggattttctgcagatcttcactgtattagtgaatccgataaggttagagccgttacagtggattttaccgttttgtgctttgaagaattttggttgggaagtgatatttatgaaacaaaaggacactaataccaccacatagtctttgttttttaacagaaatgtgtttgttcaatggtatagtaagatatcaccagcatttttttaatatagaagtgtgtagttgaattagactaaatggtctcaaaaattgaaacaagtaacaactccttaactgtaaatgacagaagtagcatatgctgtgtctgtttcacagggtggctgtgagaacaagtgagatgtgtgtttgcctgctcaggtgtgctttccacctcttgaatctcagtgtcccacttttttccccaaaagaaaggccttgccgtgcgtgttagagttcctcctgatgaaggaccgcctagattcttttgtgaaatagaatttaaagtagtagtgtaaggatctggaaaaaactcggctgcttcttcagggactagttgtttatgttcagtctctgcagaagttcctaccttagggtatatgcaactttaccatcttgtgttcttttatttagtttgctgcctccagattatactatttcagacaattcaggcgataacagttggcaggggctttataccacaagatgatttgccagccgctaagcagttaaaattcacttcaacatttcagagactgtcctgccagtgctctctcacccaagtgcacaaccctctctggcctttcctaaaactccagttcagaacactagactgtgtgcagctcaagtgaattataaacccagctcacggaaggagactcacctagttcctttatgcagccctgccacggtaactctggacaccagagaaaagggagcttcctggaggagactgccagtcagcagactctgtcattctacagtaacttaagttcagattgcagtgccacatgatgaagtatctgaatctgttactttggacaaaaccaaagccatcagtatcataaaactagtcctgatttggccccttgtggttgacctcagtaagttgatcagcaggtgttttggcagtcagatgaatggtgaattttttttttaacaccaagatagtcatgctatttatcctccctggctgatggtttcgtctagctgttcataatctaatatccttcctatttcacatagtccttttcaaggtactgacattacttatacaaactctgtatgtagagtttaacacacaacttacatagagtcttggaagcattaaatacttcggtaaaaagttaagttgttacctcttttatcagtgtgaaaaataaggtgaattatttggagccaaattcgatggtgttcatgggcagtaaagcttgtggagtcttacaagtaagacaaggaagtgttctatttgaaatacttaaatttacacgagagtaagaataaagaaacttgatttgtaagagtttatagctcagcttatagctaatgatattctcagagttaagacagtgaaatgctctatatgaaatatttaaacttacatgagaataagaataaacttgatttgtaagagtttgtagctcgcttatagctaatgatattctcagctctctggaaacctgagggaatgagcggttcttgatagccaggtccctgatttagaaggggtaacacttttaatttcccagttttaaaatgccctgttatccctctgccttagtgtcacatgcagtacacatggctggttttatattttgctgaagatttcagagctgttgtgtttttattgctgtttttctttaccacagtattctacttgttgcttccttgtcttggcattctaatcctgagtgcttatgtatcagttctctttatttctgagtctccccatccccattttaacacctctttccttgcttttttttactttcttatgaaaagacgtttccacccagttagctgctgttcctccttggcagctcatcacagtgcctaggtgcctcatcttggctcttagcagtgctgatttgccttgcagatttgagctcatgttaatgtttggcccatgactcagtggcaaagagttgactatatcctatttcctctgatttttctaaaaatgaaagactgggactagatggaaacctgggatgggtactgtctgtgcctgtccctgcctttcgtacacaacatgaagagaaagacgtgttaatcccccccaacctcttgatgagcatcaacaaaacagacgcatggtttccttgaatgacatcctgcattaggcaaattgattaagctgagagcgcctagtcactggactggtcgtctcaaaaaaactggcaaggaagaagattgaaatacaagacaggaaactaagctgattgctttgctgctgagttaaatcaaaaatgcatgtagtgttaggtccctgacttgatatccttgttttgtagtatgacctaaaaaccgaaacagctcctcttgttgttgtggtttctaccacgggcaccggagacccacccgacacagcccgcaagtttgttaaggaaatacagaaccaaacactgccggttgatttctttgctcacctgcggtatgggttactgggtaatggactctctcttctgatcttactatagtatactattgatatctctggtatctgaattatctttcagaactatgaagtgtgatcatataggttttgtctttcttatgtaaatattatgtatatgtatatataaatgtatgtaatgtgctaccttttctgaatcttccccagactttaccccagagccacacctctgcagaacctcttgagtagcattttaattaaggatgcacctcagatgcagccatgaaacattttcagaatagcagtggctgggcctcatcctaaacctactgaaacagtccttgaagaagcaacccctcatgccattcctccatttagaaaagcagaacaaaacaaaacactcccaatgattttgataacttctctaagaacgattctcccagaatgaatgattttcatttcccagctacacatcaggattagctaggggagtttttactaaattatatgacttaggcccacctccagtgattctgatgtaattattccaaggtagggccctggcatcgttatttttaaaagctcccaggtgattctaacatatgtatcccaggttaagaaaaactgacttaggactctgtgaaccatagtttaaaaatgttaaaggatcaaaagaaccagatcagcacaatatgataccagaggggaattgagggtctgcattcctgacttgtgacctatgttgttttatctttgaggattattttttggagagggtatctagcaaggatgggttgagtataataaataactgattagaaatttgagattgtaaccctggcaatgatctgtcatatataacatgttcaagagagtatttcacagtatttataattttttttttaccttaagtttttatactttctgtattttcaaagagagaacacatacttgtttgaaaatccagaaaagacagaaacagaagcctgtcccactgttcgagtcaatgttaggcctaagcgtggaaccactcatttctcacccttttgtagagaaagaacatggagatgcctgcacaactgagggatttaagcttttttttttttttttttttttacaccatgagacatagaagcaattcttgatttccccaacacagaaacataccacattgttaattgtggttatttatatggctggtgtacctttctttctatatcaggagtcagtaaactctataaaggtccagatagtaaatattttaggctttgcaggcctactcaacgctgctgttatgaataatatgtacacaagtggacttgactgtcttttaataaaactttatttacaaagaaaggcagtgcatggtatttgtcccagaagctatggttggctgacccctgctcagtatcagaaaaaatgtacagatgacagatattgtggttttgcaacctgtctgatccttgttttaagatttctatatttttacacatagtcatggagatgaaaatgtgaagtcttttctttcaacagcggccaataagtattttgtttcattatatctgctacttttatattgtaaaatagaagaaaactgcctacatgcatagaattactcaaggaaaataaaatgtgaagctctgcattattactccatccataagagcatgaaatagtattattttagatattttatttacctagtctttgtgtccttaaatttaaactttattgtgcattaattatgtatttgggttctctaggtctcggtgattcagaatacacctacttttgcaatggggggaagataattgataaacgacttcaagagcttggagcccggcatttctatgacactggacatgcagatgactgtgtagggtaagggcagtgttctctgtttactccaataagccctctatacatgatggaagttgatttgtaaaacatgtcagcttttcacttaacactgaaattttcctcatgttttacttttgttcgcttttttagctttaggatccaagagggtcagccagagattgatttacctattttgctgattttcttttgtgtccatctcatccttgtcagtatatgctaacggcaagagttagaaaaggtgctccagtacagttatctttattttaaacagtgtaggtatttgcagaaatcagcttgttctttaggaactttaatcgtgcatgtgcttctctctgccatgcacgtggagcctttggattgggctctttacatggagggagcctggtgagccacacttcgctgttagagaacacaggtctgtgggccttcgctgcaggctgcattgcttggcgtgctcttaccgtctgaacggccatttgccaccatgccaatcagacgtttacagacgcatactttatcttttcattacttttatttttgtttttacaagtcagtatttcacccattgtgccacctttcaaatcatcctgatgtgtttattcagtggtcctacagatattgtcctataacttacttagccttcaactattttagccagataacagcacacacccttaatttttttctagtaggtccatgtgttaatttaattttcactcactatgttactgaataatctgtttatgagaaaattacaaattcagcaaatgtcttgcttttcggcatactgtatttctgctgaactcacccctgtgcccacttcttccgtctttcccttcagctctgatgccatgggttttttccatatcgccagcacacatattcttcctgattgtgacaaagctttgtgacatttccttgggaattcactttagctctgtacctttatattgagcttttttcttttgccagaagctcattgacattaaatgctcagtcttgtatgagctgtgtttaactgttaatgtaatgcttgtgtcatccattaggcccatcactcatccatatttcacttctcttcaaaggctttcattttctctgttgatttattggtgtaagtattaaaatgcttgactgtatatttcagtagactatagtgcttagattttcaacctaactaccttacttgaatttttcctttttctgaaatgaagatattttcaagacattcttgcttgatgtgccaccacactaaatggggttacgaatgcacacttgagtccaatacctgggttcaaatccttgatcccccacttactgactgagatcttggttgaattagttaagctttttgttccttggtttttgcctctgtgcaatagataacagtaatctatttactgtgtaagcttcgtaggagggtcaaacggattaatacatgtcgtcctcttagaagagtgcctgtcgtcatgtagtaaacactcagtgaacgttagttctcctcctggttgtgcacactatcaccttaatatttctgagttgtgagagtgatattttacatgtagctgttattgttgaactgtagttttataaacttgttttcacaaaggctcctcagggcagctctaatgtgtaaccacattttgagtagtgtaccacatgagcacctcccgagcacagtgaaatgacaacctgagtcataatgacacacgggcctgaaatctgcctcctcttggtattcatttcgctttaggaattagaatttaattgatcctcctttgagctgtgattaaaagtggtgttatttccacagccctgccacagtcttatccactgactctacttaaacttctctgttcagggaatggctgttgttatgataatttgttagtagtaggtggactgccacatttaaaaaatctatttatgatgaattcaactttcccaaaggagggttgctttttttttctcctgttgtcagcctccctgggaattttactaaaataaaaaaataaataaaggctttaactatttatttagtccaaggacttggcattaatccatagtgatttcttggtgatattttaatctgtaggaaacagatcagtagatcagtaaattggctaggcaaaaaaaaaaaaaaaaaaggtgcatttgatggatggaatgagcatttgcagcattatggtagccttggattttggttaagttctgttagcattagtatgcctatttaaaattatatcttcttaaaataaagtttaccaattctggaatattaggaggaattctattcctgtcatcctattactagaatatcttcctatccctcttcatttcttttacctttatacatactcatgttttcagctacggtgctaatgaacacataatatatcctgcttgttaaaacttaatcatgaagtattttttgtattccgaatggtcttcatagtgtttctaacaagtgcatactttgccaaatggacagactgtcattatcctgttctgtgttcagatggagaacttaggcatttgttttgtttttcgtttgtttttactgtccagtttagaacttgtggttgagccgtggattgctggactctggccagccctcagaaagcattttaggtcaagcagaggacaagaggagataagtggcgcactcccggtggcatcacctgcatcctcgaggacagaccttgtgaagtcagagctgctacacattgaatctcaagtcgagcttctgagattcgatgattcaggaagaaaggattctgaggttttgaagcaaaatgcagtgaacagcaaccaatccaatgttgtaattgaagactttgagtcctcacttacccgttcggtacccccactctcacaagcctctctgaatattcctggtttacccccagaatatttacaggtacatctgcaggagtctcttggccaggtaaggaagtttttctttatgctatagatgctatttaatcatggatgtttgctttgggcttttaaattattattacattagaagagaggtcaacaaactatggcttactggcccaatgtggcccagagcctttcttttgtaaatagattttactggaacacagccatgcctattcatttaggtagtgtctatgacagcttttgagctgcaatagcagagttagtggttaccacaggggcctgcaatgcctaaggcatttggccccttccagtaaaagttttcccacccaggtattacaaaaggtcttgtattattacttctgtatttgaagaagtagataagaactcagtttcatcattattttggagaactaacaacttggtttctcattttagatgagtcaaacagagatgagttgtgtgggcagtgagttgagtatcacattgcataatagctaatttctccccacaggcagtgtatggtaccctgaagtttttctaacctgcttaaaataagtttccagagcaggcagtctttgaatgcagggctaagccctctttctgttgagtggctgtttggagttccacatggacttttcttacaaaaaccacacccttactgcagctattaccagttttaatttcttgttttttttaatgaagacagatttagacatttaagaaataatttggatgcagcatctttcttgtatattagcactgtttgtaaacacctggtatgatagcaattttttttagcatcttttataatgtctttctaaagctttcatgtaagtatgattttgtgtataaacaactatgggctattgtttttgcacttgtacttcattattttgtgaattgtttaagtgagataattgcagtaagtgtatctcagtctggtttgggaacagacacaacttatgcctggactggtgggagcagagtgcagtgttgcaccacagacaggatcagttcatggcagcggggatagagattaatcattaatctgactaggagttttaaattagccggaagatctgttaagagtttatgggttttttccgggaggcggaggttgcagtgagccaagattgcgccactgcactccagcctgagcgacagagtaagactccgtctcaaaaaaaaaaaaaaaaaaaaaaagtttctgggttttttcttaatagaaagtgtcattaaataggcttgagttgttaataatgtagttaaaagatttaacaaatctgaagtacttaagagagacaatataaatatgaaataatatactgagagagtaaagaattgggaaaaaaagaatgttttgtagggcatcctcttgggaccattgccttgaggcacagaggggttggaagcaggattgggcacagtgagaagctgagctgcgatgcagtctcaacaaaggcctcagtcagctcctctccatatggtacctttctgccatgtggaagtattacctctaataaccagagggtcttctgggttgtgtggtagagcggcaggacctgttaacgagcactgtcacttggatctgctgtagagccctctcctgctctgggccccacgcaaagctggtggccttttctgtcacctggtatttgggtctcagcagtcctcccaggtatggaatgtgctacccacagatcctgaagagacttagcagtggttctgcttctctctagaagtgaggtacaaggtgcactagtgtggccttcacttgggaggggatgtcctgacgtgcaccaaactgttagaaccctaaaaattgtgctggcactgcaggccctttaattgcatagggcatgggtcttaccaaagaccgcactgtcctggccactcctcgttgctcattcagtctgatagcacgatgcccctgatagagtaggctagtgtggtgctttgcaggtgttccacatttattcagactcttataacagcaggcaggacttatgatagccctggggcataattgtaaatttatacattgttccagcgcaaagtgaactgtttctgatcctctttagtgatagggttgggaaggagcactttgactaaatcattgtccgtgtacctgaggccatgctagtctactttgttaaggaaaaccagcttgcacggaggttacagtggacctgtttcttgtttgagtttccagtagttcagtgtcatcccccaggatttgtgtggtttttgcagtggtcaaactggtgaattaaatggagatacgatagagaccatcccctgtgtcctccagctttttaaggatgtcatttctctcaggatgctattttgtttctcttgttctatcttggtgtttagggaggaggatggcgtcaaattcagagacttcttcttggccctccccatgatgatagatcttaacgtcataggccaataattcggtgttgccctgtgccagctgctgagtggccactggaggtcctgggccaggacgccatttaccgcctggcccccatgtgccttgctgtcatagatgagctatgctgatgctttgggtccctgggtaacaacattcatttgaaccccctcttaacagaccctggaatgtttgcacattccccttagcccagtgtacatttcccctttgggagaaggactgcagaagccattgtcaagtacagtttctatagtgtctcacagtccctcctcctagggacctcttctctcctacagtcagtgggttgcaggtctggaaacagggcaaaggatcgtttttattggagcagcggcctacagctccttttacatgcctccttgatttcttttcattgtaaggattgatccagtgcctttgtgggctgcccattttttacatctgtgttctgccctcctcaatttaggacctcagctgtgttgtgtgcattctctcctagctcctgtgggggcatagtgctctgtcgtatactttcttaggggttagtcccttaccttccttagctagcccagtgctttagtggccgagtgtgtcgcaacaaccccagttattggtctagcaaccagaagaggggatggggtgtggtagtgggggtacaggcatgtgctgtgggcagaggtccttacaccatccagatgcgagaagggagttcttactcttcatgggagggactggccacatctgcaggctcaaagagttcaagggaatctgggtaggaagatttttaagggaatctgggtagtcaagatttttaaggcgttctgggtagtcaagatttttaagggaatctgagtattcaagattttttttcccagttagtccttggctttctctgccttcactgtcatgggctgcatgagatgactgtgtctttctaagctcctgaggatgtcccctggcttagttctattttagttttacttagttcttaattggtgatttgtcctttaagctttttgcattttttttcaagtgcgagtgaattttagcagtagccccccaagtcccaccagtcttctcttctgctgtttctctctagttctcaagcacctgatggatcttgcaaggtgatgcatttgcttccactggcactccctgctacttacggttgcattgttgctgtgtgccagtgccgtctgtctgctctctcactggtgtggtgttctcattgtcaaacaggcagatgatccagctctagactccattttagcatctttcccaggctaccctggcactgactgtcacaggctggttcccaggagtcaaacaatgagatgtttttagggcatcctcttgacagcatcatctttgggcatggagggatggaagcaggattgggcacagtgagaagctgagctgctgtgcagtctcagcaaaggcctcagccaatcccacagggttctctggagctggtgggtcttcagagttgtcctgagttggaacgaagaggctggacctttgtagtctttgatgagacattggatgtgggttgcctctgaaaggaggtgtgggcaggggtaaggtgtgacctaagaatgctgaagtgtttctttcaggtggcagaggtagtcattgtcagcactgccatagcctttgcagaaggcagtcttcttaggggtacatctcagtacccccacattatggctcccagacacccagaactgaccttcatcccagctttcccatatagccacttatccacagttaattgactagtactgttaaaatattttgtttttaaacttaggaatatagaaaaggagtagggagtattataaagaactgggattttttgcagttttccaagacctactgtgtccagtacaggagctgctggccacatatagctactcaaatttaaattaatgaacatttgttaagattaataattagtttcttagtgacactacctgtatttcaccagccatatttcagcagccatatgaacagcattgccccacactagggggttcctgtgaccatctacacacatgttgcattcttaaacatctgtcacattcttcaagatctctccttcctgaaacatttgcagacattctgtttcccttgacgtagtttattaggaaaactactagatctttacatgaacatgccagtatttttattttctatttgtatttcagaaattctaatgtctaatagataaagcgtttgagatagaattgagcttctcttctgaaaagctagctccatatatctgccctcattcatttaccttggaaatgaatactgagtagccaggaagttttgtaagcccctgtggatcttgcgtagtcactaattgaaagaagggtataattgaaaattgcacttacgttttgtcacatttgtttttcaaggaggaaagccaagtatctgtgacttcagcagatccagtttttcaagtgccaatttcaaaggcagttcaacttactacgaatgatgccataaaaaccactctgctggtagaattggacatttcagtaagttgcaaaatttatttctcagcacagtaatattgtcaggatgtgcagaaagagttgtgtggtgcttggttatatatgctgagtggtgtgctgcttggttacatatgctgagttgtgtgcggcttggttacatgtgctgagttgtgtggtgcttggttacatatgctgagttgtgtggtgcttggttacatatgctgagttgtgtggtgcttggttacatatgctgagttgtgtggtgcttggttacatatgctgagttgtgtggtgcttggttatgtatgctgagttgtgtggtgcttggttatacatgctcagaagaatgagaggtctctgacaggacatcttgccattttattcctgacccatcatttttttctctcttctattttcacacctattttctttccacttcagggaaggactagggaagaatggctggaggagattcagcctgagaggaagatgctggcttactcaataagccatgaaagaataatgggatcagaacagcattttatatataagaggcccaggaaaggaagctgtccactaaggtcagccaggaagttagaaatagagcctaaggtcaaacgaggtggctctcgcctataatcccagcactttgggaggctgaaggcggtcacttgaacccaggagttcctgggtaacatggcaagaccttgtctctacaaaaaaatacaataagtagctgggcatggtggtgtgtaccgatggtcccagctacttgggaggctgaggtgggaggactgcttgagcctgggaggttgagactacagtgggctgtaattgtgccactgcactccagcctgggtgacagagtgagaccctgcctcaatttttttaaaaaaagaaaagaaatagaacccagacaggcaggttagggttaattcctcagagcagtggttttgatttcttgagaatctggaaaaaattatggactctcccgaaaaatgattacacttgtcccttagtatcttcgaaggatttgtcccaggacccctttcagatacccaaatcctcaaagctcaagtcccttatgtaaaatgttacagtatttgtatataatctatgcacatcctcccctacactttaagtcatctgtagattacttacagtatctaacaccacgtaagtagttgctatactgtatttttaagtttacattatttttattgttattttttattgtttttttccgtcccaaatattttccattcaggtttggttgattctgagggtggagaacctgaggatatggagggccaactgtatatagaaacatttacgtacagttttagtctgagatgtgcctcgatgcaccccctccatgggcccccttcctaccctccacaccctgctggaatccattgaccttaggttaagaaactgactgataatcctaaaataagtgtttgagtacctcttcaaagtcatttagctcaaccgtttattttatgaaagtcttgagaggttaagtgggttattctttcagaaaagcaagggcacattaaggctgttggtgtagatttaatcaaacttcctaacagaaaaaaatacaatgtgtcaaaactagatggttttgcatccataaatattaatactatgtacaccaaaatattttttattctggtattttacatttttgtcataaagaggcaagggttggtctgtgcttagtccagtctctctcccttgctggcaagaaatgtgagcttgtgtcattgtgagaggctcctccccagagccctggcctgcatctgtatcactctggggcttagaggcaatgggcctagtaatagacttgacttgggaagtggtgactttttcagcccatgtttgctcacaaccagtatcgagccagatagtgtaatgttttatacttaaggaaataaagtaccctttcctgtcccctaaaggaaaagagtaaagtaaggagaagaaaattgaaaaccaatgcatttgaccataattagtttcttttggtcataatgtatgttttcgtgtgtgtgtgcatgtatgtttttgtaagagggatttttatatttacatgggttattgaaaacaccataggaccttactttgtagagaacaaggaaggtctgacttccattctttaagtatgataaaaggcaaaacactgggtaactaccagatttcgttttaatagtaactgctaataatgaaagtatgtttatttggttagttgggcttattttttaaaacaattgtgtgtttttttttttgaaattctattttctgagttcacatattaaaatcataatattgaaaactatatttttgttaccctacagcttaaactatgtaacacgtataatgtatttttttttttttcattttggctcttctctagaatacagacttttcctatcagcctggagatgccttcagcgtgatctgccctaacagtgattctgaggtacaaagcctactccaaagactgcagcttgaagataaaagagagcactgcgtccttttgaaaataaaggcagacacaaagaagaaaggtaacagccctgatgctgtgacgttggggtgttgtgggccagtggactggagctgatggtgagagtgtggctctaaggttcagggtcctgtgtgttggccgcacagatgcctggggctcagctgcgcatcaaggtctgggaacacaggcatacgctggtattggtagtttcttaactttcatgttaattgcactgaataagaagataatggatgttctaattattggacatttgtggacatgaaaactgagtgtaaatgtagtttttgagaagcattggcctaggttatttttaaaaattcttttcctattatgtttacttctcatagtatgtttgtttttgctcatttattatataaaataattgctttttccataattaagagaagttatttatttttcaaaatataaatatattatttacttagaatcttgaagtagtcctaaattgattttttgagaagaataatgctaatggagtactgctgtctttttagctttcatttccttaattttaaataattttcctttcttttatttggcctatcttgaatttatagtcttcttatgtttttgtaaggtggagttttttactgtattcattttggggaatttttttggctgaataaacattgccacaagtcatgttgcactttgatgcgctgtaaagtactacagtaattgtgttttggggagtgtgtaaaacattttattcttcatcttctatgtcatgaacccctttcccgtctttacctgaaaaggagctaccttaccccagcatatacctgcgggatgttctctccagttcatttttacctggtgtcttgaaatccgagcaattcctaaaaaggtatttttttctgtcttcttcaggtaactattttaaaatatgcttagctttatttaggattgattaaacaaatttagaatatgccctttgcagtcttaaaaaatgtgatcttgatagcatgtttttaatattagttcccaagggtgtgtgctatcatcgtaactatcatctatgaatctttttatgttgtatttgcatttaaatttttgttttctattgaaatgagggcttaaatagggctttttcttagtctaaatagggctttttctttgtcttacttttactagttattaactacgtagcacattccacagtgatggaggtgactgcagttgaccttgtgttacccagctacacattgctgctccttctttaattggtgacagaaagctaatgagagcgtaggattccccccaaccaccacttgccacttcctacagttgttaagatctactttgtgtaatactacataactatttattgctgtaacagaaagcttcaggaaaaatggaagggttttggtaggtaataatcaattattatgtgaacttggaggtagaataatccactagatgtcagtattgtaccaggaactgtttttttaaaactacttgtaactgatttcttctaaccagctcccggaagtggccattaatggataaaatttttcaaatgtgccttgccacacttgtattgtcagtgagcataaagagtgttgtaattaggccgccatctccccagtgtggttttcgtgtcgttttattaatgtgtttattgcatttctagtcttgggtgagtaaagtactttagagagaggctcagctctctaaataaatatatgtatatttatatatatatagatttatatatatatatattccatcttcctttcctggtaatcagctcgagatgtaatttgagtatttagaattaatttactgtaatgaaagcttaccgattaagtcacaattttggttcagctctacccttttaaaatttgtgtaaagtgtgtgtgtatgtctgtatatgtgtatatatatgtgtgtgtatatatgtgtgtgtatgtatatatttgtgtgtgtgtgtgtgcatatatatatatatatatatatatatatatatatatatgggtttttttcaaaaatagtatgctcattggaaaaattctggatacagaaataacccgggaaaccaaagtattttataatcaaaccctctgagttaacacttgaattttgttttcctgaggaaaatatgggtatccatattatatgtgctgttccataacttgcctttttaacttaaatcaagaatctgtatatttcaggatggaaagagttttaatggatactatggatacaccattatttgttgatgtaattatgggcaattgagtcatttttgctttttcactattaaaaaaggcaaacttccttgtactgtattaatttttgaacacttacttgaagtatatttgtaaaacaaattccttggagtagaattgctgttttaaaaatatttacattttaaattgtagtaatgtttgtcaggtttgtcatcttgttctccaaaaacagtgcagtatttcctgttgtagtaccataaagtttttgtagttctaaagtgaaaaaagtatgttaaaggaaaaattgtcactgttttagcttttaatttaggagattgtattggctttagaatttacaaactgttattggtagatgtttttattatcttgccaaagtctttgcagagatttggggcgtccattcagcagtgtttcctgagtcgttgtttttggtcaatgctgagtttggcacttggaggaacacgtgtaatttgttagtgtccaggtattttagacagagattcttcagccaaacctttggaaacctgtgactcctttgggaacagtgattttgtcctccctgttaaggaagtccaggacacaatcatcttgagccatggaatttaaagtagcagtacccattagcatttcacataacatttgatgcagataattactgaagtgctttgttcctaaagagcccttgagaaataagctatgtctgcctgtaattaataacttgtaattgcattgaaataaaaaattcttactagcaagtttgatgttttgttcaggaatttagactttgagaattgagattcagaattttattagttttatttatttatttatattgtggaatttttctaacaggtcaacattaaagcaaatggtaaattaaattccctcctcctgacaatagctcctagtggctttctcattttttcttgggtaattgggtgcatccctaggcagacatttaactgaatattctaatagctctacccacaaattgtgtcacaatttaaggcgggctcctttttgtaggcatttttgcgagcccttgtggactataccagtgacagtgctgaaaagcgcaggctacaggagctgtgcagtaaacaaggggcagccgattatagccgctttgtacgagatgcctgtgcctgcttgttggatctcctcctcgctttcccttcttgccagccaccactcagtctcctgctcggtgagtagtcgctttcacaagcaccttggtggctgttcgtgcactggtaggcgggccacctttctgtagtaaagaaaatttgctgctcttgtcttaccctttgtatcctatgcctaaagaatatatctaaatgaatggtggtgattggtaagtaaacatcttatatcttgtcttcagggtgctgtgacatctgtgtgcccttccagaagtcacagaattccccttccagacttttggttttcttttttttccttccagcagtgtcactatcattttctctcttaatagagtcagttgttactctctttttggctcagaattgagcatcttttctaatttaacttttttcagaaaggttgtttagctaaatgtctaaaaatgagcttcctataaaattttctttttcaaagctaacgaacatcatatttaattgaaagaggctgatgcagtctgtgctgtgtgcagaatgcagaaatgcccccatctgagcaagtccagatcgagggtccttcaagagcaaaaggggactgtgtcgtaccagtgcaaatcaacatactcatggtactgccaggcagagaaccatcatcccatttcagatgaagagtaacccatttttttgcccagagtgactcttctagtcctcatactccaacagaagagacctcagcattgtccctgagcagtcgatgtcctaggacctctctgtggctctcaggaagggattgaaaatgcttgctaggggtgaagactaagcgctttataggacttcaaagcctttattactttcttgtgcttgtaactttgtcatctcctttcccatagtggtaagtagttatgcctttaacatttgcatttttctttggtgacaccaaaatgtatattgtcctttttactcttgggccagcaagatccttttcgatgcccagtacaattaaaggcacccttctttgcaagtcagggcctgatttctcctcctttttcttagtgttttttccacttaggacctccccaaaatggtaagaccgtgttgctgaatgaggctgctcttctcaccatcctgtcctcaggctggccctctcaccctcttcagtgaagtcttcgagaaccatcagcaggaataggatgacagaacacagggtggggagttctaagtagtattagaaagttctcttatcgtatactaatttatttcaattcttttcgtagattttttgttaccttttagaatgttagaatgtttgtaacaataccacattacgtagttatataaaaaaattaaagtcattgggacttataaaaaattatattattttctaattaagaacaattaaaatatctaaagcttgatattaagttgaacaccctactaaaccttattttgatgtttaaaactctacgccattatacatagaccttttcatattttcaattaagtaactgctaaaaataaaacataccaaaacataaaacatttcaaagtttattagtggatagttcaatatttaaatacagattatttaacctgcttttgaaagaatacctacgtattttgaaatcactgattttttttgataaatttttaaaaaccaaacactttaattattttaaatgtaagatggaaaatatttcaagcctaagcattttcagtaattcttgaaagagtagcctttaatctttttgggatcatgactttattttaaatctgaaaactggctgggcacctccctgcagaaaactgcacatatacctagtaagggtttgctgagctcctcacctctgaagccaacttatggacccattcctagaagcctttgcttttaaaattcgcctttgggtagaaatactgatttaagagtaagaaaatgcatcttatctggtttttaactttaggagttgaaagaaaaaatagtaatattttacttgaacacaaagttcaagtgcttaactatgatttaaaactagaacatgatttgagtattctaaataagacatggaatttttttttttttttttttttttaggtaaggttattttcagtagtagtgaattaataattgcttgtttttatttttttctagaacatcttcctaaacttcaacccagaccatattcgtgtgcaaggtactactatttattcacgtaatatatagcattgtttctccaaaatcttagactcaggcttccagatcattagagtttactaatttattcagtgaaaacttacctgctttatggaagacagtaccaggcataataaagcagaagaagaatcatagagctcctgtcctctgggacttcatagaatttaacatcttgggtggcttcccatggcccagtactatgtttccccacttaggagtctcaggctcctccacatgcttcctgtgtccgtgtgcccagccaccttcactgagtggcagccggaggcaggggagacagaaaagttccactataaaacatttgatgagtccgggcgtggtgactcactcctgtaatcccagcactttgggaggccgaggcgggcggatcatgaggtcaggagatcaagaccatcctggctaacacggtgaaaccccgtctctactaaaaatacaaaaaattagccgggcgtggtggcaggcgcctgtagtcccagctacttgggaggctgaggtgggagaatggcgtgaacccgggaggcggagcttgcagtgagccaagatcgagccactgcactccagcctgggcgacagtgataccctgtctcaaaaaaataaaaaaaaagaatatttgatgagcactggcttataggattctccctgtggccttcattccattgcacagcctctaccgttttcccgtctggctctctgttttgcctttcagtaataatacaagaaggtgcaccattcttttggttgaaaagggaattaagaatgaactcaagttctttcgcattatttaccgtgtaatgtgaaaagaaatctacttttgtagggatgtcttttaaagatgtttttactttgaatttttagttttctcctttctgggtgtatacttcagtcactttcaagttttatgatcttaccagtagataatgtatggatatttgttagaatttatccccatttcttcacatctttataataaatattgagtgaatgaatcctttacatgaagatccttagggcatattagattttataaatatcatctagtcctagtgcaagcaaataaaattggaaactttcttgaataacaaaatgtagggtgtgagagtgtgaaggttgggggcagtttttaattacgtaataatggctttcctctgtgaggatttggaaggtagattagagcctataaggaaatatttctaaactgaataaaaggattggtttgacccatatgtgtagtagtactgatatcgagttcaaaacttgtctgtgtatctttgcagctcaagtttatttcacccaggaaagctccattttgtcttcaacattgtggaatttctgtctactgccacaacagaggttctgcggaagggagtatgtacaggctggctggccttgttggttgcttcagttcttcagccaaacatacatgcatcccatgaagacagcgggaaagccctggctcctaaggtaagaaattagtaccttaacctcagcattgttaactcatactctttgtttcattagaaaaaacagtgttgtctcacccacatcattcattactatcataagaaaatttatgctgttcttgaattttaaaatctctattgcaagagcagaaaactgtttacttccatgtactctttaactagtgtgtgtattttctgaatgtataaagcatgaattttatatagtacggtctttgcttgtcctattcatggaaaagaagaccttttatgttgatattcttggtacattggcctggggaggggtggagaactgtctaggaagtatttaaggggggtgatgagagacagtctcattttatgtttaagatgtatactgcctctcaaataagtagttttacattgggagtctgagggcaactaaagattaattttatattgtccaattttggctagtagggtccccgcatccctgtttttctgcttttgttatctgtggtgtctgacatctgaacttgtgccattattgagaagacatatggctgtaaatacttttacaacacctaggagtaaaaggttatgtgattttctcaacagattgtggacactttacacttggactcagtgacatctttttatgttttgatacggcactcagcagaatttcgagaccacgtgtgtaggcaacagtttaaagttgtccacaagaatggttgaaataaagcaacatttcaggctttatcatgaagtcctctttcttcatagtaatgaagaaatcagtgattcacttggagtgttgtcttaggagaagtttggtttctttattagagttgaaaggttcatagacctcaatagtggggattaggacttcttgggatatacttgagaggataagggatgattgctgcttgaaattgccgtttaacttgatgtttttccagtctgctgcctggaacagagagatgctttattgtgttctctatacatcatgtattcattatacatcaaaatattaggaaccttacagaaactttcttttttgagaagaaatattatagtactgatatacaagtatatgtcacttggtgattgtataaagatagcagatgatctccagaacattaaaaacaatgtgtgtccatcatgtatcgtaaacactaaacatgggtgcctttcacctactcctcctttcctccctccctctcttcgtccttccttccccattttaacagatttttattaactatccaatctatatgcagtagaagtgcagatatgaaggatataatttaaaactatctgaaattacctgtgcttgtgttgtgttttattacaaattatacagaatgttgacttttgcaagacctatcacccaccctgccctactatggcggatagtacagttattcacagattaaccctgccactgatgttcagcctggctgtgtgaacagaaggacatctgccacatctaagcaggagcactaagcctgtgggcgtggtgtagcttggctctcttcttcctatctgccatgatattctctccacatagaccctcaagtgaagcagtcccacagccttcgaggaagagagccccagaacgtagaaagtgtgctgttgtcacaggatctttgtacatgtgtttttcttttctgccaggaatatgctctggcatggctaactcccttgattcagatcgtggtcaaaggtctcattgtagacatgggccttctttgacattggtgtttgaattagcagctcactgccacacccatcatttccttatcctgtgtaattttgcttcctaagacattgggaagtcattacccatcattctgtggatatatgtgataatgtgtatgtttattttcttttccttccactagaatgtaagttccgtaaagacaggggcgttgttttgttcatttctgtatccttaatgcctgtcatggtgaatactttcagtaaatctgttaaatgaatgaagcaaagaaggctaatgtaatgttaactagtttcattcccaagtaagagcagtaatgagacacagctttgccattccttcatttaaaaggtatggtgttcaggctcgtcattacttcctacagtcgtccttgagttaaaagttaaaatgtatacagttacaccaccatgcaaggtggaggggaatcctgtcattcttaaatcttggtatcagtatgacttttgcatatgacagtgaaactggaagtgaaacatactcagattgattcagaaatatcttttgaaattttaacaaaaagattttgataattatatgatttgtttagttataacaaaaataattctgggtaatattggacccagaatagcaaatacagcaccattatctggaatatttggagcagcccctcaatttctttttaaggtgcctgacttttatttaaaatttttcaacctcatcgtgatgctaatctttattgtcttcatatttagggtacatttctccataatatatactattgtctgcccaccagaaagcagatcttatccatagaccaagaaacatgatttgattatctatttagagttctacctcaaagacaccatgcctatcattttttacaacattttttatttgaatagaaaagaaaaatttgcaagacaaacttctttctgtagtgacaaatgtgctcatggtttcaataaaatctgatgccactatttagtgatgtttctttgatgggaattttccctttctgatttgtttagcaaagatcatcttgattatatactcttgcctaggttttctttcatacttaccacatttgatgtaatatttcagatatccatctctcctcgaacaacaaattctttccacttaccagatgacccctcaatccccatcataatggtgggtccaggaaccggcatagccccgtttattgggttcctacaacataggtatgttctttttttggctaatgggaaaatgtattcctgagtaaccgtttttgtttctttagtcattttgaggataattggactttgtaaaatttttatttaaaaaattattattcaatgtgcgataacataatttgtcaccatgggaaaagtaaacacaatgttgtagagattgtgctttgtactagaacttccttttttactgtggcacttttagttttttcttttctcagctacactggtttgtagcatatgtggttggggacaaatattgggcataccttcgtactgtgatgatatacagctgttgtatctatcccttaattggatacaattggtagtgacagagatccaattttagtaaaagtttcaacattaaactcaaacatcagtaattttcaacagaatgttaataagtttaacttcatatcagaacagaagtatttgatatgaaataagtaaaataaaattgtacttctgtttatatttgtgaagtaatgagcaagtcttagatactatttgtcagatagtagagtcctgtccttcggacagttattttatttcgttttaattttttccttaagcaaaagcataatcacagatgtctctgtctcatcagtgtgttcaccatttcgtagacactttacacattctgcctttaacagccctgagccacttttccatagtacaagttcatttattcataaaattgctattaatgttattgaatgtagagctctctctagatctcacagtgtgatactttgaattgtcctcattttgtgtatgtcggatgtagctgcctctccacacacttgcctagtgtggcatctgctcgagtggccatgacagcctgtggagagtaaaatgctaattaaatgactgaatgttcaaatgcagagatggattttacaaatccgtctgagtttgttggtggtagttcctaatgaaagagattggttttacatattctttatatcacacacctaaactttttttttttccacttagagagaaactccaagaacaacacccagatggaaattttggagcaatgtggttgttttttggctgcaggcataaggatagggattatctattcaggtattgtacaattccagtattgtactcaaccactgagtgtacaattctaattctcagactttttcagcttgacaaccttttagtgatccattatatattatatttcagaaaagagctcagacatttccttaagcatgggatcttaactcatctaaaggtttccttctcaagagatgctcctgttggggaggaggaagccccagcaaagtatgtgcaagacaacatccagcttcatggccagcaggtggcgagaatcctcctccaggagaacggccatatttatgtgtgtgggtgagtcattatcgtgcctaagtcgggtaggagagggccatcagtgatgtctgtagaagaaaaaaaggaccgagaagccaataatctagatatgtagggataagacatttgattcttaagtacaggaatagaaataacagttctgaaatgattttgacatatttaatagcccagaggttgttattatcagggaaatagtggtgaaagttaatgcttgcattgtacattcttggtaccatttacttacctgtttttagcctctgaaaattacactcatgttactacattaatcatgtgacttgaaatctccagattgattttgttatatataagaataggtgatttgtgctgttgtgaactattgataagtaagaaagaaaaagtatgatttttgatgctgagaatgtggatactaggattctttttctgctaggcataattcttggtgataaagttgaaacgttctgtgttactgaatttgatctactttctgaggcaagatctgttacaggaacccataattgccatagaaaaattgtttaacgcttatttgcttattttgataagactcaaaaaatttctgctagttaaaaaggagttttgaagtaagaaattcactttttcatccaaacacattcctaggatttaacacattctctaagtcaggttcttttttttttcaactgtaatgtagaagacaaaatactggcatcgtgacccagaacatatggataaagataattgaaacaagtttcatgaaacaaagcaacgttttctgtttagtttttataacacattctgatcatttctcttccattttatttagtttgctttaaaagctagctttggctactaagttaatttcatgtcctttcaatagattttgactcctaattgaaaaacattgctttaggtcaataaagggcagaaattctagacattgttttggtttacattttccttcgcttttaatgaagtatttaatctgcattttgtttggcgaggacagtgtcatcggtggtcaaatacaggctggagttttagagatgcacctctaaatagtagaggcagagttcattgtacagatcacagatatctggtcattgagaacttggagaatatcttaaatgtccagactcctaaaacattattccagaaatagctcctcccaatcactggtgctttacttgtcacatttgtgaaatgcacttggaagcattaatagcagtggtcagagggctcagaaggaaaccctggggcacttgaacattgatcgtccgtcagggaagcaggaacaaagtagacagaaggaacagccactgaagaagcaaaattgtcccaaagccaagagggtgctgtttcagagagggagcctgtactgctgatgagtcaaatgagaagacagcggagcaggatcttggggtataagttccctgagaatagtggagaggagagcctcttgagacaggtgagacagacacctctcaagaaatttcactgtgaggggccaggacatgttcagttcctaacatagtagagtcttgtctgacacttcgcttcattcagcaaacacctgagtgctggctaagtgcttggggcatattcagatgtcgatagatacgaggatatgttagtttttctgttgaggaatacctgagactaaagaaaagagatttaatgggctcacggtttaggctgtagaggaaacatggtgccggcacctgcttctggtgaagaccccaggaagcttccactctgacagaaggcaaagggggagcaggcacctcacacggcaagagagggagcaagaggcagggggaggtgccacacactcaaatagccagatctctcaggaactcagagggagaactcactcattacagcgagcatagcatcaagccattcatgaggcatctgcccccatgacccagacgcctcccaccaagccccacttctaacactgggaaccacattttaacataaagatttggagagggcacacatccaaactggatcagaggataagtgagttacacttcctaccctcaaacaacttactccctggtgagaaagctacatataaacagacgtttctaacgtcggaagtgttccagagaggactgcaagagcacccaggaggggtaccgcccccttcttgtaaattgaagagttaagatgtagaagcacttcaaaaggacctggcacatagtaagtcctcaataaaggtgtctgttactaactgtatgtgtataaagacctagaagtgtgcgagagatctggttcccttcaggagcacgagtctactgtgtgctttgagagtggagggcagggaatgaggggtgagccagcaggtgggtcggagccaggcaggacctcagatgcttctctgacacctaggaaatccttggcctactgtcgggacctggagcctgtggaggattgggagctgtagaaccgtgtggtcagctctgtctcctagaacggtcactgtaggcaaaggcctggcctgggcatgagtgaggctgggagatctgtgtgagatgttctgagaagacggagggaagaactatggtggtacagtcaaaaggaattagacttgtgaattaaggaggatttactaaaaatgcctgtttgtaagcagtcatcttattattttcttttctagagatgcaaagaatatggccaaggatgtacatgatgcccttgtgcaaataataagcaaagaggttggagttgaaaaactagaagcaatgaaaaccctggccactttaaaagaagaaaaacgctaccttcaggatatttggtcataaaaccagaaattaaagaaagaggattaagcttttttgactgaaagtactaaaagtcagctttactagtgccaaacctttaaattttcaaaagaaaattttctttcaacatttcttgaaggacatggagtggagattggatcatttaacaatataacaaaacttcctgatttgattttacgtatcttctatctacgcccttcctgtgcctgtgactctccccaaattgccctgttgccttgagctcttctgagctaaggcagccttcagtccctatcagcgcctcctttacttcccagagaacttcacagagactctgtccttccatgcaaaggcttcctgaaatagggagactgactgagtagctcattcttgtgacttacagtgccaacatttaaaaaagtatgaaaatgatttatttttatatgatgtatacccataaagaatgctcatattaatgtacttaaattacacatgtagagcatatctgttatatgtttatgtaactatcaaatggttatttgttactaaagctatatttctgataaaaaatattttaggataattgcctacagagggatttatttttatgatgctggaaatatgaaatgtattttaaaatttcactctggcatatgatttatctatcaccattacttttttttaagtcacaatttcagaattttgggacatttgcattcaatttacaggtaccagtacgtacatattttaatagaaagatacaacctttttattttcactccttttatttctgctgcttggcacatttttgagttttcccacattatttgtctccatgataccactcaagcagtgtgctggacctaaaatactgactttagttagtatccttggatttttagattcccagtgtctaattccctgttataatttgcacaaacaaaacaaaatgttatgataatctttctccactgttctaatatatattgtatttttatttgatagcttgggatttaaaacatctctgttgaaggcttttgatccttttgagaaataaagatctgaaagaaatggcataatcttaaaacttggtaagtttttgtggctgtgtaatctcttcattattatatattttataatagaaaccaatctaaaaatatgggataggaaaatatactaagcaagtactatgtaacatacataattacatgtgtaagttgtatgtatcagccaagatacacttaaggtgaaaacattaaaagagacaaaaatattccttattaataagatacaacaatcaagaacttgtgtccacctaccaatactgtctataattacatgacccaaaacttttatctataaaaagaaactgacaaatagtcaatcataacttggtgttggaaactgacctaagccaatttgcttatacacagcatccaagttatgtctagaaactgctggattatctaagttttaggtgggtatcgttcagctgctccccgcagacttacgagctagtgatagtgaaaatacatttcatgataaatgctgctgtacatacagatatgtatttattatctatttactagttatttttattatttattattatctatgatttattagtaatcaggcacaaaacagctctactatcctagtttctaagcctaatgaagttccagctgtctctttaggcactccaccacatctcgcaggaagagtttactcaaggtgcgtcacaacgtggatgtgactactccaggggcaaaattttgtccttactgtgaaccatcctctaacctagtgactggacatgctatttcagagttaagcctcaggcatcaccctagggccttgctagataaagtctttcaccttgcttatgtaggagtagggagtagttagcagtgagggaccttttctaacctgctattctaacaagccactgtagcgctcattatttttaatagccagtcttcatactgatcagtgataaaattaacaaaagagcttgtagtaggcagttctgcaatgtgacatttctgattagaatgctcactgcatctagagggttcctttctgtgcttcagacttatacagtgtttgtggattattctaaagtgagttacactgttgtactgaaacaatcattctattgagtcataaactaccggaaaaaaaaagaatttggatttcactgcaaactatatgacatatatgctacacccaacaaactgggcacccatgttgatttcaaatacacttgaaccattttaaaacattgaccatgaactaagccataaaggaaaactcagcaaattacatgaaataaagcgttgttcactgactctaataaaaaaccaactgcaaaaaaacccacaaaggccacagtgaaacattttaaacacatgcagatgattcatagcttaaattattaaatgtgcacatggaattcaggcgaaacaatacccagggggaggattcatctatttcacaaagtactgtgcacccagtgaccaaaatagttaaaacaccattgttttcagggagctttacattgaggagagacataaaataaaaaatccgtgaattgcatggggtctgagaaggtgataaaggctatggaggatgacaagtcagagtaaatgggatgtgtggcctgcagtcttgtagggttggtgtgacttcatactcagggagtctctgaaggtaaacacttgaaaaagacaaaagagccagccatcatgagtatcttgtggagggaagagtcagaacgaaggccctgagatagaatggttacaggaaatgtgtcttaatccagaccccaggagagagtttttggatctcacacaagaaagagtttgggacgaatccataaagtgaaaacaagtttattagagaagtaaagaaacaaaagaatggcaactacagagggcagctccaagggctgctggttggctatttttgcggctatttcttgataatatgctagggtggattattcatgagttttcccaagaagacggggggatttccccagaactgagggttcctcccacttgtagaccttatagggtaacttctgga

SEQ ID NO: 15958 - DNA, 10541 bp, Human
cctatgttactcaggctggtttccaattcctgggctcaagcgatcctcccgccttggtctcccaaagtggtgggattacaggcgtaagcctccgcacccggctatttttactttaaaatactaagtcagtgacggaagcttccgcacattctcgtggctcacttttctcttcctggggaaaaaaggcaggaggtatttccgagagagccacccatgtaggaagcgtgcctttgggcgatcagggagctgagcaaccgaaaaacctcccctccaaggaggcggcaggccagggcctggaccagctgccctggagccccccacagagcacggactaccgcgtgggcgcggagggcagggagaatgggaggtggatttctttttattttttgtttttctgaattttcccaatttctctgcagtggattggtgatacttctatagtccgagtgggggaggagggagcaaacatgttaccctaaaaagaaaaaataaatttcccaaatgtaaacggtgcggggacgtgggggtgggcgtcccagtactcccagggcactgggggcgggctggggactgggttggcggcggctgggcctcgaggcgctaagttattctggtctctcggcgcctccgcagctggcgagctttttataaacaggacgagtcaccccccgccacacacacacgctccagccccgcctactgggaggggtggggggagaatctaggggatcaggactctcctgggggccacacacccctggagggtttgaaagctggagtagggggagcaggagacccaaagtgggggctggggtttcgggctcctcctccctccccaaattctgacttccttccctaaagatttggaggaataaaagatggaccatcttagctcccaaaaggctccattctctgagttttgctttcccaggatggagggagggggtctcccagcccccgggtctttgaatccgagctttgaagagctggaggcttcggctcgtgccctccctgtttcccggggcatttaccgcaggctttaaggggtttccgggacaggtcgcttctctgtccctgctaaaccttttcttcgaattttcttcttgatgacggggcgcagggaggggagggggttcccagagagtccatcagccccttcctccttttctgggaatggtggggaggggaggctctcttgacctctacttctttcttttcaaacctcagaaacgggggaggggtggagtctttactagcccctccctcagtgggggggtcttacgcctcgggaatgggacaggggtccctcttgactcctgtttattctttggtatttattttgaaccccatatatgtgagggtataaaacatctcttgggcctcgatttttcttttctgcaattgggagtcaggggcatttaacaggggtcacagcaccttggactagacggtggcctcaagagtcccctacctggggtgggtgcgggcgggtaagggaaccgcccctcgaagaccggggctcagccaaggcctcagcctctcggcccttcaatctcccagatgccaccattggacaagaggagggcgtagacaatctctgattggctacttcgcccgtcgctcgagagcttaagccagtgagagaacgctgaggggccccgcctccccgaggcggacaggaggcggacgagaggcggagtcggcccccgcgccgctcccgcccctactggatgcacacgctaggccccgccccatttgcacgtcaatctgctcaggagccctgccccatctggctctgcgtgcgtcaatgggccacatctctacgcgcggctccgcctccggatggcgtcacggacttatctacatgtgaggctccgcccctccctttgcaggacgtcacggaggactgcaggggcctgagccgctgctgccgccgccgccgcgcagccccacatcaacgcaccggggtcctgtcaccgccaccgccaaaaaagtcaccgccgctagggtcgccgttgcatcggtgcagggcaaggtgagctcctgggcggccgggtgtgctcaggctccgagcacctgcataaccttcatttgactgatgggctgatggaggtgggggacgaggttgactagggttgaatggggggaaggatgcggcggtcgcgaggctgggaatgggtagggcccgggcgccccactcctgcctgatcctcaccactaacccccccaacccccctgctctgcggcggagggggaggggagccgagctccttgcgggaagctgtgcgcgcgggaggcttttgcgtgcgcgtgcgcgtggtgtgcacacgcgtgtgcgcgcctgcctgtgtcagcgggtctgtgtgcacccttgcttgtgtacctggatatgctcgtgtgacgccgtgggggtctgggcctaagtgtgtgagcgttgcacgcgcgtggagaaagacgtgtggaccgcctgtgcaggtatggcccgtgcatacaagcacggggatccgtgtccgtgtgggtgatgtgcacacgcctgcatgggtggaggggcctgtgcgcacgggtggtttgcacatttctataggcgagtcggtgtgcaaacaggtgtctgtgtctttgtcctgtgcacctcagtgcgttcacacactcctgtatgtacggatgagcgtgtttgaggctgtgtgcacgtgagcgtgtgcatgcccctcctgtatcatgtgatgcagcggccttggccggagctctccggcctggaggtttgcggggagcgggggctgcagatgcgcgtcctcgagggaccatgcacgcggtgcacgtggggccgcgcggccgggttctgaggaccatgaaagattgatggggggcggagccagccgcagtcaccccctccgggctcagccctgggtttagggttacagccccacctggggcacctgccccttgaagggggctgctggggtgtccccatcggcaaccctctgagcccctcctctgaaacgcccaggatttcaaggtcacaggctgccctctgctgggggcaccaccaattaatactggggctcctgatgggataagggtgtcctccatacaccggccgttttctggagcccttgccatcttctgcctgggcttgggcacatgaggatggagagagcccccctcacggctctgctacacccggtatccccagatggcatccgccacagactcgcgctatgggcagaaggagtcctcggatcagaacttcgactacatgttcaagattctcatcatcggcaacagcagcgtgggcaagacgtccttcctcttccgctatgctgacgactcgttcacgcctgccttcgtcagcaccgtgggcatcgacttcaaggtcaagaccatctatcgcaacgacaagaggatcaagctgcagatctgggtgggtcccagctggagggctcccgcccggctcggttggattcccgtacttggaaaagcagccccaacctcgtctatctctttcctgactggagtcattcacttacacactgggcatttatcagtaaggtgcccactgtgtaccggggcagaaacagcacctgtgttctcccataagcacctaatcctggtccctcagtttccccatcttcaagttcttccatgtatgaggtttcagctggatcttggtccccattctctttttttgtttgttttttgagacagggtggtcttgctctgtcccctaggctggaatgcagttacgtgatcacggctctctgcagcctcgacttcccaggctcaaaccattcttccacctgagcctcctgagtagctaggaccacgggcttctaccaccacgcctgctgatttttttcttttttgtagagacagggtcgggctatgtctgcccaggctggtcttgaactcctgggctcaagcgatcctcccacctcagcctctcaaagtgctaagattacaggcatgagccaccccacctggccttgttagttttaagagacagagtctcactctgttgcccaggctggatttgaactcgtgggctcaagcaatcctcccgcctcagcttcccaagtagctgggagtacaggcaagtgtcagcttcctttaatttttaaacctacagttaaattctctccatcttcatctggcttgatttttctccttggtccttgtcactctccaatataggatacatttataccgttattttctatttcccacactgagtgtcacttagcaagggaagtgcccatcttgttaacaactgtgtccccagtgtccagttcagggtgtggaaaagatcagtgcccagtccatgtttgtttatttgtttgtttgttttttgagacagagtttttgctctgtcacccaggctggagtgcagtagtgcaatcttggctcactgaaacctctgcctcccgggttcaagcgattctcctgcctcagcctcctgagtagctgggattacaggggctcaccaccaagcccagctaatttttttttgtatttttagtagagatagggtttcgccatgttggccaggctagtcttgaactcctgaccacaagtgatccacctgtcttggcctcccaaggtgctgggattacaagcatgagccaccacgcctggcctctgttttctttctttctttctttctttctttctttctttttttttttttttttgttgttattgttttgagacggagtctcgctcttgtcacccagggtggagtgcaatggcgcgatctcggctcactgcaacctctgtctcctgagttcaagcgattctcctgcctcagcctcctgagtagctgggattacaggtgcatgccaccacgccgagctaatttttgtatttttagtagagacagagtttcaccatgttggccaggctggtctcgaactcctgacctcaggtgatccacctgccttggcctcccaaagtgctgggattacaggcgtgagccaccaccacacccgaccccctgtttgttttttgagacagggtttcactctgtcacccaggctgaactgcagtggcgcgatctcacctcactgcaacctctgcctcctgggctcaagcaaccctctcacctgagcctcctgagtagttgggactacaggtgtgagccaccacaccctgttaatttttgtactttttgtagagatggggtcttgctatgttgctcaggctggtctggaactcctgggttcaagccacctgcccacctcagcctcccatagtgctgggattacaggtgtgagccacagcacctggcacagtacgtttggtgaatgactctgtggaataatggagcactcatatattctgagcactggtgacccaacctgctcttcctgacactttgtgcccctgggcaagctcctgcttctcccagggggctgaactggatgatatcagagctcatttcctcttcgagggccttatgtgcaggtcctctctgaccttcatctcttcctccctaggacacagcagggcaagagcggtaccggaccatcaccaccgcatactaccggggcgctatgggcttcatcctcatgtatgacatcaccaacgaggaatccttcaatgcagtgcaggactggtgagtgtaccccacttgctctttttttttcttttcttttctttgagagagggttttattctgtcacccaggctggagtgcagtggcacgatcagggctcactgcagcctcgacctcctgggctcaagtgatcctcctgcctcagcctcccaagtagctgggactacaggcatataccaccacacctggctaatttttttgtatttttagttgagatggggtttcctcatgttgcccaggctggtcttgaactccttggctcaagtgatctgcccaccttggcctcccaaagtgctgggattacaggcgtgagccatcgcttctggccttccacactcattctggggccattgtctctgagccaaactttcttcaaaaaataataaataaaacgtaggggtcagagaaggatttcagatggaaaagtaaaactataaccatatagaaacaaatatctgcaagtgtagggtggagaatatagagactataaggagagttggcatggccgggcacggtggctcacacctataatcccagcactttgggaggctgaggcaggtggatcacctgaggtcgggagttcgagaccagcctgaccaagatggagaaaccccatctctactaagaatgcaaaaattagccagacgtggtggcgcacacctgtaatcccagctacttgggagcctgaggcaggagaatcgctcgaacccgggaggtggaggttgcagtgagccaagattgccattgcactccagcctgggcaacaagagcaaaactctgtctcaaaaaaaaaaggagagttggcataggttagagattgtaaacatttcaattttctgctcagaagtaataactttaaaaaaaaatttctgggttgggcacagtggctcatgcctataatcccagcaccttgggaggccgaggtgggtagatcttgagctcaggagttcgagtccatcgtggccaacatagtgaaaccctgtctctactaaaagcacaaaaaattaccaggcatggtggctcatgcctatagtcccagctacttaggaggctgaggcaggagaatcacttcaacctgggaggcggagattgcagtgagcctagatcgcgccactgcactccagcctgggtgacagagcaagactctatctcaaaaaaagaaaatttctgggctgggtggctcatgcctgtaattccagtactttgagaagcgaaggcaggcagatactccagcctgggcaacagacccagactctatctcaaaaaaaaccccaaaacacagaaacaataatgggtcagtcgggggctggagtggggtgaaagcggggcacattgggggaaaggatggtggggaggatggaggggcaagcttctgggtctttcttcctcggacaaggacacaggctccacatcagcccgtcagggtggagctgggatcctccaagccctgacctgcccccattggtgcctcctataggtccacccagatcaagacctactcatgggacaatgcccaggtgctgctggtaggaaacaagtgtgacatggaggatgagcgggtggtgtcatcagaacgtggccggcagctagctgaccaccttggtgagtgcccagctgggctggagacccacaagtctagaaaaaggacactaagagaggggagggcacacacccaaggtcttacagctaaagccaggtaattcacactttctgcaaactagccttcatccaggagccatttgagttggatcctgagggatgtgtaggagtttgccatgcagaaagtttaaggatttattctgacactcaccgtccaacgctttgttgggtgttgctgggctcaagaggcatctaggggtgcctcgagggacccctgaggtagagggagggacctggatgggaggagcacatgagaggagccaggcttcctggagtggtgggtagtgaagaagggtctttcaggcagaggaaatagcttgggcaaaggcttgcagtgagaaaggtcctgtgtgttttggtaataatttcacaagactggaacatgagggtcagctggaggaaatgtggccgatcacagagggcctcaaccatgtgctgagaggctgggactctttggagggcaatagggagtcacagagggtgtgtgagcagggggaggtcacagctggatttgagtgtcagagccttccagggccagtgcacggggctgggctggacgctgcagggcatgtcttgccaggtccctaaggacaacgagacacaattttaggaaggaagggcaggaggccaggtgcgctggctcacacctataatcccagcaatttgagaggtgggggtggaggatcacttgagcccaggaggtcgagactgcagtgagctatgatcacgccaccatactccatcctgggcagcagagcaaggccctgtctcaaaaaaaaaaaaaaaaaaaaaaagcaggaaatgcaaagctgacccagttccatgttgcttctctgtgggatttgtcagtaccttcaataagtttcttctctgtgggatttgtcagtaccttcaataagttgcttggcactgggaatctccaggtgttccctttcctcagagaagcatctctgggagttggcatagggcgtggccagggtcctcatccctgccttctctgaccacagggttcgagttctttgaggcaagcgccaaggacaacattaacgtcaagcagacctttgagcgcctggtggatgtcatctgcgagaagatgtccgagtcgttggacacggcggaccctgcggtcacaggcgccaagcagggcccacagctcagtgaccagcaggtgccaccgcaccaggactgcgcctgctgagagccatcccactccctttcccctcttccctgtcttccccaccttcccccaactacccgggcctgacccggcccctaccagccacgggcacaagacccctgctcctgacttagcccgtcacccttatttattattgtagctatttatttatttattgaagatgtcccccaggggcccaggctcccctgcccgccccaagccctgcccctcctgtacatatagccctttccccactcagctgtggtgtctcgtggccccgtgaactcaccgctcaccctcctgaacccccccccccgcctttttttaaaattcacccccatccacagttgtcagttgtgaagaggggccagatgacaccctaaagcaggctgatcgggcaatgggaggtggccaggcctgccagcccctcggctctgccgcggtgggccgaggccgctgttgggggtttccctgtgtggaccatggggatcagagtctggcctgccaggctcctctccccgttttctcttttggtgggggggtgtgctgtgggtattcaccaccctgggaccccccccccccccgcccaccagacctgttctgacctcatgagtgtcaaacgtgccccccagttccttaggagatgtcatgacaacactacacgcacccaataaagcgaatggaccatccatgtgtgtccctgtgagcaccgggtcctgcccaccctggttttgatcatccacagcattttcttttgttatttttatttttcaatataaatagagacagggtcttgctatgttgcccaggctggtctcgaacacctggcctcgagcaatccttccacctcagcctcgggaagggctgagattacaggtgggagccactgcgcccagccagcagtttcagttacattatagagagagtttaatggcatttccacagttcaggaccagggaaagaaacacagaggctgcctggccctatgtgaaacttttgggggccgactccaggcctgagcctgctctgaggggatcagtcatgtccccgccttagtcccaggacctgagggagctctggattggtggcttggcccagagccaggtggatggcagtgttgaggggctggtgcttgagactggttggcagagtgggccctgtgctgaggatgggacatcttggtcacaggtcgcatgaggttcctgctgagaagggctaggggatgatcatccatcttcatgggtgtgttccggttgaggaaactcagtcccagaagtgagcttggaaagggcggctcagcccaatgctccggagctgaagtggtgctgggacgtggctcaagacccgagcttgctgcaggagcccattccccttctgtcagagggggtggtccgccaggagacagtcttgcatctggtccaggaagcagacagttcagtctgctcgggtgtccagggccacacagcctgggggtgtcagaggaactgggctctgtccacacaagacaaggcatctggtcagaagcctggctcatccctccctgtccctctacctgcccttgggccagaggtcagccctgctcaacagacttggcagggaccgggctgaggtcacatcagacagcagagaagggttgggtctttttgtttgtttgagacggagtctcgaactgtcgcccaggctggagtgcagtggcgcgatctcggctcactgcaagcttcgctgcccgggttcaggccattctccggtctcagcttccggagtagctgagactacaggcgcccgccaccacgcccggctaattttttttttttgtatttttagtagagacagggtttcaccatgttagccaggacggtctcgatctcctgacctcgtgatccgcctgcctcggcctcccaaagtgctgggattacaggcgtgagccaccgcgcccggcatgggtcttttttttttgaaacggagtctcgctctgtcacctaggctggagtgcagtggcatgatcttggctcactgcagcctctgcctcctgggttcaagcaattctcctgcctcagcctctcaagtaactggaattacaggtgcgtaccagtaatt

SEQ ID NO: 15959 - DNA, 26115 bp, Human
gcgattctcccgcctcagcctcccaagtagctgggattacaggcggccgccaccacgcccggctaattcttgtatttttagtagagacggggtttcaccatgttggccagactggtcttgaacggatctcaagagacccgtccgcctcggccccccaaagtgctgggattacaggagtgagacaccgcacccggccggatctccccttttccaacggggtttccaggaggatgcctgaccagggtggaaggagaaagaactaggtgcctaacccactctcctggcgagggcaggaggtacgctccagccggcaacaggtgcccgcgtagccgccgcagtgtcacagccccgggggagggacaggtccaccctgcacagcagagagggagcaagaggactgtccgggggttacgtggggacgcgttgagaaacgctggacccagctggagcggccagggcagagggtaggccagaggaggccaccagggagcagcagaggctggcgagaagcgctcaaaagccctttttttttttttttttttttttttggagacggggtcttgctgtgctgcccaggctggagtgctgtgcagttctcgaccacagctcattgcagcctcgaacttccacgctcaagcgatcctcccacttcagcctcctgagtagctgggattacaggcatgtgccaccacgcctcgctaatatttgtatttttcatacagacaagatctcactatgttgctcagggtagtctcgaattctgggactcaaatgatcctcccacttcagcctcccaaagtgctgggattacaggcataagccatcatgcccggcctctgacgctgtttctttcaacccccaggatttcagattccaccagcttatggagaagggaaccaagtttgagatgcgtgattgcccagaaagttggaggctgagctgagacttgaacccagagaccagaacctccagaggtcaaagtcctcctgggtcccccagagaagggccctgagatgacagctcgttggtcctcatggaagcgtgacccccccagtagactttctcccacacccaaccttggtttcctcatctatatgatagggacaagccagactctacctccctggtggtcatggtctccgcttattcgggttcataaccttaaaggcccctcgcaccacctcagtgagccatttatgcctggcacagggccaactctcagtgcatatctgcaaaggaaccaatgaatgaatgaatgaagtgacaaatgaataaaggaataaatgaatgaggcacttatcatgtaccaggctttcgttaccacgtcccatttattcctctgaggcagggtctattttatccttgttacagatggggaaactaaggcccagggaggagcaaagtcttccccaagtatgtacccactcagaacttgagctctgaatgtctcccacccagcttagcccaagagcggggttcagtgatgcccaccccctaaggctctagagaaagggggtaggcccacatgccagtttgggggtggtaaagccaggtaagttttctttatgggtcccctgaaaccctgaaagtgaaccccagtcctgcatgaaagtgagctccccatagctcaaggtattcaagcacaatacggctttgagtgctgaagcaggctgtgcaggcttggatagtgacatgccctctctgagcctcaatttccccacctgtcaacagcagacagtgacagctgtgatcaggggatcacagtgcatggggatgggtgggtgcatggggatggaggggcatttgggagccctccccgataccaccccctgcagccacccagatagcctgtcctggcctgtctgtcccagtccagggctgaaagggtgcgggtcctgcccgcccctaggtctggaggcggagtcgcggtgacccgggagcccaataaatctgcaacccacaatcacgagctgctcccgtaagccccaaggcgacctccagctgtcagcgctgagcacagcgcccagggagagggacagacagccggctgcatgggacagcggaacccagagtgagaggggaggtggcaggacagacagacagcaggggcggacgcagagacagacagcggggacagggaggccgacacggacatcgacagcccatagattcctaacccagggagccccggcccctctcgccgcttcccaccccagacggagcggggacaggctgccgagcatcctcccacccgccctccccgtcctgcctcctcggcccctgccagcttcccccgcttgagcacgcagggcgtccgaggacgcgctgggcctccgcacccgccctcatggaggccgtggagaccggggaacggcccaccttcggagcctgggactacggggtctttgccctcatgctcctggtgtccactggcatcgggctgtgggtcgggctggctcggggcgggcagcgcagcgctgaggacttcttcaccgggggccggcgcctggcggccctgcccgtgggcctgtcgctgtctgccagcttcatgtcggccgtgcaggtgctgggcgtgccgtcggaggcctatcgctatggcctcaagttcctctggatgtgcctgggccagcttctgaactcggtcctcaccgccctgctcttcatgcccgtcttctaccgcctgggcctcaccagcacctacgaggtaccggacagaggcccgggggtaggacctgccccactggcagtgctgggaccccgtgtgggggaggcgctggggctttgggccgctgtacaggaggacgcggatggcacctcggtgctttaacggaaggggcccctaggcagacacgtggggagggttctaggaagaggccccaggcgcccggcgaggggcaggaaggaggaagagagagcctggcgtcctgctccttcggtggaagcgcgcgcggggcggggcccggctcgaccaggtgtgtcctcacgggtggacacacacctgccccccacctgcccgggcgtgcagacccacgtgtgcgcgctagaggggactgctgacggctccggggttcgaaacctggcttcactgctttcttgtatcttgggcaaggggcgtgcctctctgtttgggtttcccagctgtccaatgggcgaattacaggacctccctccaggggagagggtaaagcgattaaaatcgtgaccggggcccggtgcggtggctcacgcctgtaatcccagcactttgggaggccaaagcatgcagatcacctgaggtcaggagttcaagaccagcctggccaacatggcgaaaccccgtctctactaaaaatacaaaaattagccggatgtggtggtgggcacctgtaatcccagctacttgggaggctaagacaggagaattgcttgaacccgggaggttgcagtgagccgatatcgcgtcactgcactccagcctgggcgacagagcgagactcttgtctcaaaggaaaaaaaaatattgtggcagggcgcagtggctcacgcctgtaatcccagcactttgggaggccgaggtgggtggatcacgaggtcaggagttcaagaccagcctggctaacatggtgaaaccccgtctttactaaaaatacaaaaattagccgggcatggtcgcgcgcgcctgtaatcccagctactcaggaggctgaggcagaagaattgcttgaacctgggaggcggaggttgcagtgagccgagatcgtgccagtgcaccctagcctgggcgacagagcgagactccgtcccccctcccccccaaaaaaatcgtgacaggtatatcctaggcggccaacaccattggcccggggcactgtctacactgtgcgcttgcgggccacgtcggtgtctgctgagcggtggctgctccaggagcccgcgcccgtcaggcgcaagtgggagggcgcgtgcacacgcatggaccagtcctccaggtccacggggtacgcacaggcacgggatggcacctgtgcacgggtgtgtgcgtgcggcggggcccccacgtgcaagaatctggcgggcgcggttggcttccggagggaggggcccacctagagagcagaccagggacccgagaggcctcggctcctgggtaaggactgtccaggtgacctcgagtccctccttgcagtacctggagatgcgcttcagccgcgcagtgcggctctgcgggactttgcagtacattgtagccacggtgagtggcctcggccccgccctccgctcagggccccgagagcgtcagccttcactagcccggcccccaccattcaagaccccgcccagaccccgccccccatgctcccgttctgaccccgcccccatcagtcccctcccacaccacagccggcctgaccccgcctgcactctggaagacccggcctatctgccccgcccatattctgggaccacccttctgcctcctctccccatccccaactcgcccagacgccctccctgctcacccgccccacactctgtctacagatgctgtacaccggcatcgtaatctacgcaccggccctcatcctgaaccaaggtgtgactctgggagattagggaagcatgtctgggaagagaaagggagggagaggagaacccaagactaagtttgcgccccgcccaggggcctaacagggggacctctttttgcatagtgaccgggctggacatctgggcgtcgctcctgtccaccggaattatctgcaccttctacacggctgtggtgagtggccctgggaactcactccatacgggggatcgggcccactgtgtctcttgtggggagactctgggcttgcccctttctcctgaggaagcctctgtcccagctgggacccagtgtcctcatctttatagtgaaaaatgatctgaaaagcttattgctgagaatctagaggtatggtagcttcaggcatggctggatccaggcttccacctcttctggcttccagtccagcaggaagtgagctcctgcttcatcctggggctggctgaggtcccagggagggctacctttggctggctcaggtctgaccttgatggcgatattatcatcgtagtgataataatagtaatggcggccgggcgcggtggctcacgtctgtaatcccagcactttgggaagcagaggcaggcggatcacctaaggtcaggagttcgagaccagcctggccaacatgatgaaaccccgtctctactaagaatacaaaaattacctgggcgcagtggcacgcgcctgtaatcctagcctctcaggaggctgaggcaggagaatcgcttgaacccgggaggtggaggttgcggtgcgtggagattgcgccattgcactccagcctgggcgacagagcaagactccatctcaaaaaaatataataataataataataatagtaatggcagcaatcactcactgacactcgtatatgtcaagtcatattccaaatctttttcacttattaacttgtttaattctactgggcacagtggctcatacctgtaatcccagcactttgagaggccaaggtaggaggatcacttgaggccaggggttcgagaccagcctaggcaacatagtgagaccccccccgcccccatctctacaaaaaaatttttttttaaattagtcgggcatggtggcacctgctgtagctccagctactccggaggctgaggcaggaggatcacttgagcctaagagttccagtctgcagtgagctgtgatcacaccactgcactccagcctgggcaaaagacagaaaccttttctttaaaaataaaataactaacttaattcttacaacaacacagtaagaaggtattattattaatcccactttagagaggaggagactgaggcatagaagggcatcagtcctaggcaccactgaaggccaggtcccccatctaaccgcccctctccctctctctgtcccatgctgcagggcggcatgaaggctgtggtctggactgatgtgttccaggtcgtggtgatgctaagtggcttctgggttgtcctggcacgcggtgtcatgcttgtgggcgggccccgccaggtgctcacgctggcccagaaccactcccggatcaacctcatggagtgagtgaaaatgcagaggatactccagcaggatggggctgggaccagtgcggtggctcatgcctgtaatcccagcactttgggaggccgaggcgggcagatcacttgagctcaggagttcaagaccagcctgggcaacatggtgaaaacccatctctacaaaaatacaaaaattagctgggcgtggtggtgcacctgtggtcccaggtagttgagaggctgaggctggaggattgcttgagcccggtaggtggaggctgcagcaagctgagatcacactactgcactccagcctggatgacagagctagaccctgtctcaaaaaaaaaaaaaaaaagaggctgggtgcagtggttcatgcctgtaatcccagcactttgggaggccaaggcggggggatcacctgaggtcaggaatttgagaccagcatgaccgacatcgagaaaccccatctctactaaaaaatacaaaattaggctgggcgcggtggctcacgcctgtaatcccagcactttgggaggccaaggatggcagatcatgaggtcaagagattgagaccatcctggccaacttgatgaaagtccgtctttactaaaaatacaaaaattagctgggcatgctggcaggcgcctgtaatcccagctactcaggaggctgaggcaggagaattgcttgaacccaggaggcagaggttgcagtgagccgagatggcatcactgcactcccgcctggtgacagagagagactccgtcccccccctaaaaaaaaaaaaaattagcagggcgtggtggcgcatgcctgtaattccagctactcggggaggctgaggcaggagaatcgcttgaacccaggaggcggaggctgcggtgagccgagatcacaccattgcactccagcctgggcaacaagagcgaaactccatctttaaaaaaaaaaaaagaggatggggctgggctccctttgtgccgtgggatggtagaaatcagccaatgcctcctgctccaggaggccctcgctgctctcttctcctcccctcagaccagattgggggctaaagcctctctgaactctcagctgggcaaagaaaggtttttaagtgcgtggatagatgattcagtaaacaaatacgtgaattttcaatctggcaaatgcctatgcatatgtcaaacccactccatttattatttatttatttttaatttaattaatttttttttttttgagatggagtctcgctctgtcacccaggctggagtgcaatggcacgatctcagctcactgcaacctccgcctcctgggttgaagtgattctcctgcctcagcctcccaagtagctgggattagaggcacccgccattattcccagctaatttttgtatttttatagagatggggtttcaccatgttggccaggctggccttgaactgtgacctcaggtgatccatccgccttggcctcccaaagtgctgggattacaggcatgagccactgcgcctggccaacaaaacccactccaaatgtcccctataaggtccagaagcgctgtctggggcccttgggagggtgaagtcagcgtgacatctccacgtggctaacttgccctgtccccacccagctttaaccctgacccgaggagccgctatacattctggacttttgtggtgggtggcacgttggtgtggctctccatgtatggcgtgaaccaggcgcaggtgcagcgctacgtggcttgccgcacagagaagcaggccaagctgtgagtgtttcggggagcaaggtcggggtttctgggacatgctgcccccctccaccagcctgaggctatcccctaagcctgaggctgcctcttcccccagggccctgctcatcaaccaggtcggcctgttcctgatcgtgtccagcgctgcctgctgtggcatcgtcatgtttgtgttctacactgactgcgaccctctcctcctggggcgcatctctgccccagaccaggtgagtcccacccaggctcctggttggctctgcactccctcactagcttggtgggattgaggtcgaagagcattcctagcagagggaatggcctgtgcaaaggccaagaagtaggaaagagctgagaggaggccaggtgcggcggctcatgcctgtatcccagcactttgggaggctgaggcgggtggatcacctgaggtcaggagtttgagaccagtctggctaacatggtgaaaccctgtctctactaaaaatataaaaattagctggacgtggtggcacgcacctgtagtcccggctactcaggaggctgaggcaggagaatctcttgaacccgggaggcggaggttgcgatgaagggagatcgcaccactacactccaccttggatgacagagtgagactctgtctcaaaaaaataaaataaaataaaataaagagttcagaggaggatctgcaaggaatgggaaaggtgagtctgggaggcaatggaccgccctcagtaggtgtgagcagacaagggccacattcagatctagagttccagagagttccaaagatcccctgggagatgctcaggaggagatgaaaccatgacccaggccgggcatgttggctcacgcctgtaatcccagcacttttggaggccgagacaggcagatcacttgaggttagaagttcgaaaccaacctggccaacatggtgaaacccccctccactaaaaatacaaaaattacctaggcctggtgatgcatgcctgtaatcccagctactcgggaggctgaggcaggagaatagcttgaacccgggaggtggaggttgcagtgagcagagatcgcgccattgcactccagcctgggtgacagagagagactccatctcaaaaaaaaaaaaaacaaaaaaaaaaaaccaaaacaaggctgggcgcggtggcttacgcctataatctcagcacttttggaggctgaggcaggggtatcacctgaggtcatgagttgaagaccatcctgaccaacatggaaaaaccccgtccctactgaaaaatacaaaattagccgggtgtggtggtgcatgcctgtaatcccagctactcgggaggctgaggcaggagaatagcttaaacctgggaggcggaggttgcggtgagctgagatggcgccattgcactccagcctgggcaacaagagagaaactccgtctcaaacaaaaataaaaacaaaacaaaacaaacccacaaaaacaaaaacaaaaactgtaatccagcgggaactaatcatgttggtgataataataatgacagctctggtctcccatgtcccaagcgtccactctgtgcctcatgctgttcccttcaccagcagttagttctccatctaatctttcttctgagaaaggcagggcagtcacggctccaactttacagatgaggaaattgaggctcggggggaagtcactgcctgaggtcaatgggcaagtcggggggcggtgccaggacccatgcctaggtcacaccccaagtagagttctgaccatggggttcagagttagcagagggtacgggggaccaccccatctgcagtcctccctggaggtcagatccgggactgctggactgtgtaacttcagggagggactgtactctctgcctcacagtcttcatcaataaaatgaggatgacacgggtccctgcttcacagggatcccagggctcagaacacagtggggctcagggacaattctcaggttcatgcagttgatcaacaaatgcacattatagcctgaggaacatagggagaccccatctttacacaatttttttttttttgagccagagtctcactctgttgcccaggctggagtgcagtggcgcaacctcagctcactgcaacctctggctcccaggatcaagccattctcttgcctcagcccccgagtagctgggatgacaggcatgcgccaccatgcccagctaatttttttgtattttttgtaggggtggggttttgccatgttggccaggctggtctcaaactcctgacctcaggtgatccacctgcctcagcctctgaatgtgctgggattacaggcatgagccactgtgcccggcctttctttcttttctttctttttttttttttttgagacagagtttggctctgttgtgcaggctggagtgcaacggcgcgatctccgctcgctgcaacctctacctctcagattcaggcaattcctctgcctcagcctcccaagtagctgggactccaggtgccaaccaccacacccagctaatttatgtattttgggtagagatgaggtttcaccatgttggccaggctggtcttgaacttctgagctcaagtgatccacccgcctcggcctcccgaagtgttgggattacacgcgtgagtcaccctgcccggccagacccctatctttacacaaaaatttaaaaaaattagccaggcatggtggcgcacacctgtggtctcagctactgggggactgaagcaggaagatcgcttgagcccaggagttctaggctgcagtgagccacattcatgggactgcactcccgcctgggcaacagagcaagatcttttctcaaaacaaaacaaaacaaaacaaaaccacagacaaaaactaaatgcatattaaatgccgactctgagccctgtccgtcttgggtgctggggacgtgcagcatcaggacagatagatgccccggtcctcggggtgcagctgtctgggaggctgacccccagttctccccagtacatgcctctgctggtgctggacatcttcgaagatctgcctggagtccccgggcttttcctggcctgtgcttacagtggcaccctcaggtgagcacccctgcttgttcatggagcattatttcagcccctgggagcctccttatcctggcctgccatccctctggggcatggaatgttctggacctgtccatcagtcccagttcctgcttgatccctagaagacagctcaggtaggcgctggcagagagcatgccctgggcacagggaccccaactgcaagggtttaccttcttatcacctgtcagggccacgcctgactctcctctcttcttcttccttctttccttccttcctccccagacaaatatttgttgaacatctactatgtggcaggtactgtttttttttgttttttttccggatggagtcttgctctgtcacccaggctggagtgcagtggtgccatctcggctcactgcaacctccacctcctgggttcaagcaattctcctgcctcagcctcccaagtagctgggattacaggtccacgccaccacagccggctaatttttgtatttttagtagagacggggtttcgccatgttggccaggctggtcttgaactcctgacctcaggtgatctgcatgctttggcctcgcaaagtgctgagattgcaggcatgagccaacgtgctcagcccaggtactgctgttctaaaccctggggcacagccatgaccaagcagtcccctgcttctgccttccaaggccacacactcaggtggtttccactcttccgggacttctggtcacatgccctcactgtcccttttgcaaatctcccacatgtgactgcagtccctctggaaccagaacccacctgtctgtcccacctgcccttggtcacaggtgtccttgctcctgtagggatgtctcaggtcttcggggaggggaggggcaaatatctccttcacctttgcaggactgggttacccccaccgttgccctcaggctgggtgaggtctggcaggccagatggtgtggacggtctctccatatggcctgaggaccccccgctgccttcctcacacagcacagcatccaccagcatcaatgctatggctgcagtcactgtagaagacctcatcaaacctcggctgcggagcctggcacccaggaaactcgtgattatctccaaggggctctgtgagtttcagggagacctgggtgggaggccagggcagtccctccccgttgaccgtgccatcctcatccactacagcactcatctacggatcggcctgtctcaccgtggcagccctgtcctcactgctcggaggaggtgtccttcaggtgagaccccacctgccccctgccctggtctcctgagaggtgggggcacctttccctctttcccattaaactgaggctcagagaggtcacatgtgtcagtggcagaactcacttctatgttttttttttttttgagatggggtctcactgtgttgtcccaggttggtgagcagaggcccgatcatagctcactgcaacctccagctcctgggttcaagccatccttccacctcaatctcccaagtagctggagttacaggtgtgtgccaccatgcctggctaatttttttcttttttcttttttttttttttttgaggtggagtgtcactctgttgcccaggctggagtgcagtggcatgatctcagctcgctgcaacctccaccccctgggttcaaggaattctgcctcagcctccagagtagctgggattacaggtgcatgccaccatgcccgtctaatatttttgtatttttttttcttgagacggagtctcgctctgttgcccaggctggagtgcagtggcaccatcttggctcactgcaagctcagcctcctgggttcacgccattctcctgcctcagcctcccgagtagctgggactacaagcgcccgccaccacgcctgactaattttttgtatttttagtagagatggggtttcaccgtgttagccaggatggtctcgatctcctgacctcgtgatccgccctcctcggcctcccaaagtgctgggattacaggcgtgagccaccgcgcccagcttatatttttgtatttttattagagatgggacttcaccatgttggccagtctggtctcgaactcctgacctcaagtgatccacccgcctctgcctcccaaagtgttgggattacaggtgtgagccaccacgcctggcctggctaattttaaaacttgtttttagagacagggtctcgcttcgtgcctaggcttgtcttgaactcctggcctcaagcaaccacccgcctcagccttccaagtcgctgagattaagaactaagttctatttgatgccagaggccatcaggggacttttttgcagctggctggcttggggtgggggaattgggaagggggaggtggcgacagaaagggcctccctatggaggttgcagtgagccaagatcgcgccactgcactccaacctggacagcaaagtgagactctgtctaaaaaaaaaaaagaagaagaaagggtctccctggcttgagggtgggactgccacccccaagagataatcagtgtctttgcctccaacccaagggagataggcaggaacaaggggggggggtcctctcccctttagggaaactgagacacagaggagtccttgagacccacattggagttcctgaggtctcgctttcccagcgggtaaactgaggcccagagcggtgggagggctccgccctcagccccacttccacctactctcccagggctccttcaccgtcatgggagtcatcagcggccccctgctgggagccttcatcttgggaatgttcctgccggcctgcaacacaccggtgagtgggggcggggcaaggggcggggaggggcggggccggacaggcccctccccttccctgacgccggctctgcccccagggcgtcctcgcgggactaggcgcgggcttggcgctgtcgctgtgggtggccttgggcgccacgctgtacccacccagcgagcagaccatgagggtcctgccatcgtcggctgcccgctgcgtggctctctcagtcaacgcctctggcctcctggacccggctctcctccctgctaacgactccagcagggcccccaggtgagcagacttgagggtaggggggtacccgagccctggatggtgtgatcttgaagggaaacttacttgccctgcactctgtgtaagaagcctgattagtaaaatgcattcctgggggagggaacggtaggtgcaaaggccctgaggccacaatcgggttagtcccagtccaactgcactgaggttagggtgcatttaatgggaggagagatgggtgggagatatggtgcagccagaggaagctagtactttttttgttttgtttttctgagacagagcctcgctctgtggtccaggctggaatgcaggggtgcaatctcagcttactgcagcttcaacctctcaggctcaagcaatcctcccagcttgagggaggcccagaatttggtttggttctattttttattgagataaattagccatttaaaagtggcatttaggccaggcaggcacagtggctcacacctgtaatcccagcactttgggaggctgaggcaggtggatcacctgaggtcaggagttcaagaccagcttgatcaacatggggaaacccccgtctctactaaaaatacaaaacttagccaagcgtggtggcaggtgcctgtaatcccagctactcgggaggctgagacaggagaatcgcttgaacccaggaggtggaggttgcagtgagctgagatcgcaccactgtattccagcctgggcaacaaaaatgaaactccaactcaaataaataaattaaagtggcatttagtatatttgtgcaaccatcaccactatctaagtcaagaacgtttcctcttttttttttctaattttgtatttttagtacagatggggtttcaccatgttggccaggctgatcttgaactcctgacctcaggtgatccgcccacctcagcctcccaaaatgctgggattacaggtgtgagccactgtgcctggccccaaaaacattttctatttttttttttttttggagcagggtcttgctctgttgcccaggctggagtccagtggcacgatcatagctcactgctgcctcaacctcctgggctcaaggaatcttcctacctcagcccccctagttgctgggaccacaggtgcacaccatcatgtcctgcttgtttttatttttattttttgtagagacagggtctggctatgttgcccaggctggtctggaattcctgggctcaagcgatctgcccacctcagccttgcaaagtgccaggatgacaggtgtgggcacccagccaaccaagaacattttctgttttgtttatttatttatttatttattttggttttttgggtgggtttttttgctttttgtttatttgattttttggagacagggtctcactctaacacccaggctggagtgcaatggcacaatcacagctcactgcaccattgacctccagactccgatgatcctcctgcctcagcctcccaagtagctgggactataggcatgtatcaccatgctgggctaaattttttgtattttttatagagacgagtttttgccatgttgcccaggctggtctcaaagtattgggctcaagtgatctgcctgcctctgactcccaaagtgctgggattacaggtgtgaggcactgttcctggtcataagaacatttttatcaccccagaaagaagccctgtccccatcagcagtcacttcccacttccccctctccccagctcctggcaagcacgaatccactttctgtttctatgaatttgcctgttctgggcatttcatgtaaatggaatcataaaatatgtgatcttttgtgtcttagcataatacatatatattttttgagacggggtttcactttgtcgcccaggctggagtgcagtggcgtgatcccagctcactgcaacctctgcctcccaggttcaagcaattctcctgtctcggcctcctgagtagctggggtcacaggcatatgccaccacgcttgggtaatttttgtatttttagtaaagatggggtttcaccatattgatcaggctggtcttgaactcctgacctcaggagatccacacatcttggcctttcaaagtactgggattacagcagagtacagtggagccactgcactccagtctgggtaacagagtgagactccaccaaaaacaaacaaaaccaaaaacatttgtgaacaagttttggtatggacatatgttttaatttctctaggtatatacctatgagtggaattgctggatcatatggtaattctttaactttttttttttttttttagatggagtcttgctctgtcgcccaggctggagtgcagtggtgtgatctccactcactgcaacctccgcctcctgggttcaagcgattctcccgcttcagcctcccgagtagctgggactacaggcatatgccaccacgcctggctaatttttatatttttagtagagaaggggtttcaccatgttggtcagggtggtctcaaacccctgacctcagatgatccgcctgccttggcctcccagggtgttaggattacaggcctgagccaccacgcccggcctatgtttaactttttgaggaactaccagactgttttccacagcggccacatcattttacattccgaccagcaacatatgaggattctaacttctccacgtcctcgccaatactcattattctccatcctagtgggtgtgaagtgatacctcactgtggttttgatttgcatttccctgatgaataatgatgttgagcatctttcttttcattggccatttgtgcatcttctttggagaaatgtctattcaaaccctttgcccatccagcctgggtaacatagaaagaccctatctctataaaaataaaaatgaaaaaattagctgggcatggtggtgcacacttgtagtcccagctccttgggaggctgaggcaaagaggatcgcttgagcctggggggccaaggctgcagtgaagcatgatcccaccactgcactccatcctaggcaacagagcaagaccctgcctcaaattaaaaaacaaacaaacaaaaaaacaccctttgcccatttttaaattgggtgatttgtctttttattgttgagttataatttacatatttttatatctttatgtattctgggtacaagcccctgatcagatgtataatttgcatgtgatattttctcccattctgtaggttgtcttcattctctcgatagaatcctttgatgcacagaagtttttaattcttttttttggtgggcggatggagtctaactctgtcacccaggctggagtgcagtggtgcgatttcagctcactgcaacctccacctcccaggttcaagggattctcccacctcagcctcgtgagtagctgtgactacaggtgcacaccactatgccaggctaatttttatatttttagtagagatggggtttcaccatgttagccagcctggtttcaactcctgacctcagcctgcctcagcctcccaaagtgctaggattacaggcatgagccaacatgcctggccagaagtttttaattttttttttttttttttgagatggagtctcgctctgttgcccaggctggagtgcaatggtgtgatctcggctcactgcaagctccacctcccgggttcatgccattctcctgcctcagcctctcgagtagctgggactactggcacccgccatcaggcctggctaattttttattatttttttatttttagtagagacagggtttcaccatgttagccaggatggtctcgatctcctgacctcgtgatccacccgccttggcctcccaaagtgctaggattacaggtgtgagccaccacgcccagccagtttttaatttttgatgaagtccaattgatttatttttttctttggtggcttttgcttttggcgtcatatctaagaaacaattgcagtcacgaagattcccacctatgttttcttctgagagtttaatttggtttgattttgagggtgacagggagccacagagggtgacgggcagcagcaggtgatctgagttacattttagtaatgtgccctttggctgtgtgtggaggacgtctagggtggggatgggatacctggagggaaggaacattggctactgcacagatctgggcagacagtaatggaggtctgtgctaggccatggcagttgggggaaggaagcagggggtgaggttggaacagcttttgagtgcaggcaggggataaaagaggaggttcaagtctgtctctcccaacctgcagctcaggaatggacgccagccgacccgccttagctgacagcttctatgccatctcctatctctattacggtgccctgggcacgctgaccactgtgctgtgcggagccctcatcagctgcctgacaggtaggtaaacagagcatgtggcctcagaggtcatcccattcatctctctgcctcaaggctccacccagcagggaggggagaaaggacgctcccattggccaaactgccactgtgtgctgtacacatttgtaccttattattattattattattattattattatcatcatcatcatcatcatcatcatcatttttgagatagagtctcactctgtcacccaggctggagtgcagtggtgtgatctcagttcattgcaacctccacctcccagattcaagcgattctcatgtcacagcctcccgagtagctgggattacaagtgtgtgccgccatgcttggctaattttgcatttttagtagagacggagtttcgccatgtgtctcgaactcctgggctcaagtgatccgcccacctcggcctcgcaaagttctgggattataggtgtgagccactgcacctgggctgtacctatttttttaaaaggaaaaaaaaagtttgtgaggaaaaaagaagtgtgtgtgtatatatacacatacatacacacttttatgtgtatatatacataaaagaaattatgaatatatataaaaattatgactatatatatacataaaagaaagtgtatatatatatagtttcttttaaagggacggggtcgactgggcgtagtggctcatgcctgttatcccagcactttgggaggccgaggcgggtggatcacctgaggtcaggagttcaagaccagcccggccaacatggtgaaaccccgtctctactaaaaatacaaaaaaattagctgggcatggtggcaggcgcctgtaatgccagctacttgggaggctgaggtaagggaatcgcttgatcctgggagatggaggttgcagtgagccaagattgcgtcactgcactccagcctgggcaagagagtgagactccatctaaaagaaagaaagaaagaaggaaggaaggaaggaaggaaggaaggaaagagaaagagagagagagagaaggagagaaagagagagagaaagaaaagagacaggtctcactgttacccagactggagtgcagtggcacaatcatggctcactgcaaccttgaactcctgagctgaaagcaatcctcccacctcatcctcccgagtagctgagactacaggtgcgcgccaacgtgcccggctcacatttacaccctttaaagctatgttgctttcttgacaaccctgcacctctcagagcttgccctattttgcagaggcagaaacggaggcattgcctgcaactcctctccccaacaagattaagtcctcagtagaggatatgggttggggcgggcggcgctatccctggtgctgaaatatcttctaaagctgccggtgactccgcacttgttagggaattctaaattccacggaaaagtagaaggagacaaagaggggaaagtcagtagtgataacagtacctgctcacacttcttgagtctcagacttcacagtcatcaggcctttatcgagtcctcctctgtgctggacgctattttaggcactggggatgcagcagtgaatggaaccgtgtgctggaccctcccagccatccattaatgtctttgttttgttttgttttgtttttttgagatggagtttcactctggtcgcccaggctggagtgcaatggtgcgatgttggctcactgcaacctctgactcccgggttcaagcaattctcttacctcagcctcccgagtagctgggattacaagcgcccacccccacgcctggctaatttttgtatttttagtagaaatggggtttcgccatgttggccagactagtctcgaactcctgacgtcaagtgatcccctgccttggtcttccaaagtgctgggactacaggcgtgagccaccgtgcccaacctccaatgatgtttttgttttgttttgttttgttttgttttagaaacagggtctcactctgtcaccaagctggagtgcagtggcacaatgacggctcactgcagcctcgacctcttgggctcaagcaatcctcctgcctcagcctcccaagtagctgagactagaggcacacaccaccatgcctggctaattttttaatattttgtagagatgggttcttgctatgttgcctaggctggtctccaactactgggcaactctaagcaatcctattgccttagactcccaaagtgcaattatgagccaccatacctggcctcactgatgttttattacaacttcactgtgtagatgaggaaactgaggctcagaggcttgccagggtcccttagtgggactggagcctgttagacttcatagaccagggatctcctttctccttcccaggacctggtctccaacccccatgaccccttcactgaatgcctggatttctccatttctccccgcctctcaggccccaccaagcgcagcaccctggccccgggattgttgtggtgggacctcgcacggcagacagcatcagtggcccccaaggaagaagtggccatcctggatgacaacttggtcaaggtcagtcttaggctgggttcccagatctagaggcagccaagtgactttaggacgtgaccacagctcaggggagggacatggtatatcagcacctttctccatcgctcattatctccagtcaaaagactctattgggagctgattcatcctcaacagtttttatctcccttcacaaggactgaacagagtttaatactattcctttttgtttgtttgttttttgagacagagtctcgctctgttgcccaggctggagtgcagtggtgcaatctcggctcactgcaacctccacatcccgagttcaagcgattctcctgcctcagcctcctgagtagttgctactacaggcgcatgccaccgcacccagctaatttttatgtttttagtagagatggggtttcaccatgttgcccaggctggtctcgaactcctgacctcaaatgatccacccaccttagacccccaaagtgctgggatgacaggcatgagccaccgagcccagcctcatcttcaagtttttgttatctcccttcataaggactgaacaaagttgaatactattcctttttgtcgttatctgtttttacagtgacttccaatctttggcaggtgaaactggtgtgctgttagggtattgatgtaaagtctcttcttaaaataaaattacttaattcaaaagtgagtcaacttggggaaaaaatcttacataagaaacacaacagatggtaaaccgattttggctaaaaccgcgtggttgctttgtgaattcccagagtttggaaaatgctgtccctgggggacctgatcccatgcctacccctgttttggaatccctgttccattctctcatttattgagcacctgctgtgtacccagtcctgctctgggctatggtctaagacccccaccccaccctcatctagcaggggcaggtgaaaactaaaaagagaaacatgtagggtctgtctcagtatgtgataagcattcaaaagataatacaaccagatgctgtcaggccgggcacggtagctcacgcctgtaatcccagcactttgggaggttgaggtggatcgcttgaggccaggagttcaagaccagcctgtcgaacatggcaaaaccctgtctctactaaaaatacaaaaattagccgggcatggtggcgtgtgcctgtaatcccagctactcagtggaatgaggcagaagaattgaacaattgaacccgggaggtagaggttgtagtgagctgagatcgcgccactgcattccagcctgggtgacagagcaagacttcgtcaaaaagataggaaagcaggaagggagggagggagggaaaagaaggaaggaaaggaaagagccaggcgtgatggctcacccctgtaatcccagcactttgggagacttaggcaggtgcatcacctgaggtcaggagttcgagaccaccctggccaacatggtgaaaccccatctctactaaaaatacaaaaaattagccgggtgtggtggtgcatgcctataattccagctattcggaaggctgaggcaggagaatcgattgaactcaggaggtggaggttgcagagagcagagattgtgccattgcactccagcctgggcaacaacagccagacactgtcagaaagaaagaaaagacagagagagagagagagagagagagagagagagagagagagagagagcaagctaaaaagaaaaacgtgtagggtctcagcatgataaatattcaaaggataataaaaccggatgctgtgatggggagcaactttagccagggaagtcaggggtggcctcttgggagaggtgacattgattgaccctgagttaggagaagaggaaccagccacagacaggaacagctttgactgagaaggggattgggaggggaggggtttgcctgaaggtgtttaaagctccctccagctgccctagagaagtgtttatcttttctttctttcctcttttcttttcctttctcttcttttcttttttttctttctctctctttttttgttctttattattttatttttcttttttgttgtctttgttttatttgtgtgttttttttcttttttgtcttttttttttttcctttttttgagatagggactcactctattgcccaggctggagtgtagtggcatgaccatggctcactgcagccccaacctccatggtccgagaaattctcccatctttcaacctcctgagtagctgggattataggcatgcaccaccgagtctggttaatttttttatttttggtagagatggggttttgccatattggccaggctggtcttaaactcctgggctcaagtgatctgcccaccttggcctcccaaagtgctaggattacaggggtgagccaccgtgcccggccagaaatatttattttcttgaaggtgaacaggcagagaagcagagaaaggagggaggaactatagcaggcatctgagaaagcgttgatggcctgggctgtaggtgacatgtgagtggggaagagaagcgcatggaaattttggaggcagagcgggcaggactggcccgtgcactgagcaaggggatagtatgcaattctgtgcacgccccgtcccgccaggtcatcagtagcccatctgggagatgagctgacacggaacagggtggggacagggtctctgatggggtctctttttcccacttttccccagggtcctgaagaactccccactggaaacaagaagccccctggcttcctgcccaccaatgaggatcgtctgtttttcttggggcagaaggagctggagggggctggctcttggaccccctgtgttggacatgatggtggtcgagaccagcaggagacaaacctctgaggacagggccagccgcgggactgacaccctgggatggaacctcaggatgggccaaacccagacaacgggcccatggccttgggctctgattggctggattgccttgtatgcaaatgagttcaggactacaataccctaccctatggggaggccctgcctccgggaggtcattttttaaatccagccccttgcttcaaccgtccccagtattagacgctgcagccctgacggctccccccaaataaggctgggtttttctctctctcttttttttttttttttttttttgagacagggtcatgctctgtcacccaggctggagtgcagtggtgtgatctcggctcactgcaacctctgcctcccaggctcaagtgattctcctgcctcagcctcttgagtagctgggattgtaggtgcccaccaccatgcccagccaactttttgtatttttagtagagacagggtttcaccatgttggtcaggctggtctcgaactcctgacctcaagtgatccacctgcctcggcctcccaaagtgctgggttacaggcgtaagctaccatgcccagcctaccgtttttctcaatctataatagaaagccaccacgcccaggtaatttttgtaattttgtatttttgtagagacggggttttgccatgttggccaggctggtctcaaactcctgatctcaggtgatcctcctgccttggcctcccaaagggctgggattacaggggtgagccaccgcgccccacctctttcttattttcttcctgggattggggaggggatgattcagaccccacatggcctccaaccttggcccacacacctgccatggctcccatcatcctgagcatgctagcgtcccctcctcacctgacaatggaggctctcgaattgggttgtgtccccccaaaatttatgtctacccagaacctcagaacatgagcttacttggaaatagggtctttgcaggtgtaactggttaaattaaaagaggtattactggaggaggatggatgaatccagtgactggttcctcatatgaagtagagaagagatgcagagaaacacatggggaagatgccacgtgaagacagaggcagtggttggatcaatgcatctacgagtcggagaacccaaggattgccagcaacaaccagaaatcaggaggggggcatgagatgcattatttcttagagcctttagagggaacatggccctactgacaccttgatgtcagacttctggctgctagaactgtcagagaataaatttctgttgtttgatgccaccaggcctatagtggtttgtgacagcagccacaggagctcatacacctttttttttttttttttttttttttttttttttaaggcagagtctcgctctgtcgcccagactggagtgcagtggtgcgatcttggctcactgaaacctctgcctcccagattctccttcctcagcctctggaggagctgggattacaggcatgtgccaccattcccggctgacttttgtatttttagtagagacggggtttcaccatgtcggtcaggctgatctcgaactcctgacctcaagtgatctgcctgcctcagcttcccaaagtgctgggattataggcgtgagccactgcgcccggcctcatacacaccttctgatcccgcttctctccaccccttggagacctggtcctctgtgcccgctgttgggattggacacctttagatttggacttaaaactggccattacaactttaaaatcgatgactggacgggtgtggcgtctcatgcctgtaatcccagcacttcgggaggctgaggcgggcagatcactcgaggtcaagagttcaagaccagactggccaacatggtgaaaccccatctctactaaaaatacaaaaattagccgggtgtggtggcgggcgcctgtagtcccaggtactcgggaggctgaggcaggagaatcgcttgaacctgggaggcagaggttgcagtgagatcacgccactgcattccagcctgagtgacagagcaagactatgtctcaaaaaaatatatatatatgtatatgtgtgtgtgtgtgtgtgtgtgtgtgtatatatatatataaaatcaaatcaatgactgagcaacgtggtaagcagattttccacctctgtgtagtcctcactcaaaacagagcccaaatctgagatgggagga

SEQ ID NO: 15960 - DNA, 22010 bp, Human
gtctgggcatcggtgacatcaaagtgtccctttggtaaggttctttcccccacaagacttcccttcccacagtaaccaccacaccgctgtgccaattgcccttcctgtttggtttaacaggcgtttgttgatcgcttaccggcacatcatcaagaaatatacaaattaatgcacattaattgagttgacactttaggcctggattgcgctcagcagaccacctcaatgaggatgctggggagtcagcccatttcacagctgcgaaagctgagtcctaggggtcctagtcctctgattgtcttaaacctcattaggccaggcgcagtttctcacgccggtaatcccagcactttgggagtccgaggcaggaggatcactcgaggtcaggagttccagaccagcctcgccaacatggtgaaaccccgtctctaccaaaaatacaaaaattagccgggcatggtggcgtgcccctgtaatcccagctacttgggaggctgaggcaggagaatcacttgaacccaggatgcagagtaagccgagattgtgccactgcactccagcctggatgacagagctagactctgtctcaaaacaaaaacaaaaaaaccctcattaatgccgccccaccccagccacagggcattattttggatcatagtttttgtattgtgttttttttctagagataaggtcttgctctgtcgcccaggctggagtgcagtggtgtgatcatagctcaatgcagcctcaacttgcagagctgaaggcatcctcctgtctcagcctcccaagtagctaggactatgggggtgtgccaccatgccctgctaattttttagagatgaggtctcaaaatcctagcctcaagtgatccacctgcctcggcctgtcaaagtgctgggattacaaggcttttttttctttttgagaggaggtctcactatattgcccagtctggtttcaaactcctggtctcggccaggcgcggtggctcacacatgtaatccagcattttgggaggctgaggcaggctgatcacttgaggccaggagtttgagatcagtgaaaccccatctctactaaaaatacaagaaaattagctgggcgtggtggtgcccacctgtaatcccagctactggggtggctgaggcacgagaatctcttgaacttgggaggcggaggttgcagtgagctgagattgcgccactgcactccagcctgggtgacagcgcgagactctgtctcaaaaaagcaaaaaacataaaacaaactcctggtctcaagctatccttccttcttggcctccggaaatgatgggattacagacatgagccactgcgccctgctggaacttaggtttttgtttgtttttcccaacactttcttcagatcttcttcattcaggtcaatttgagtgacctcctttttctccccaatttttctcaggggactcgaagccccacccctggccccacccagctgagggccctgagtgctgaggtttctcagggcaagtgagcgagcgggtgggaggtgttgggggctggaagcagggggccagtttcctcctgggcccatcccagggaggctttccttctttctttctttctttctttctttttttttttttttttgagacagagtctgactctgttgtccaggctggagtgcagtggtacaatcttggctcactgcaacctctgcctcccaggttcaagtgattgtcctgcctcagcctcccgagttgctgggattacaggaacgcaccaccacacccggctaagttttgcactttttagaggcagggtttcgccatgttggccaggcaggtctcaaactcctgacctcaagtgatcctcccgcctcggcctcccaaaatgctgtgattacaggcataagccaccgcacccggcctccagcactcctttccatgccctccctgctcagaagtccaatcccctctgaccaggactgaggggctttttctctctgtgccccaggcaagttgcactcatggcacctccaagtgaagagacgcccctgatccctcagcgttcatgcagcctcttgtccacggaggctggtgccctgcatgtgctgctgcccgctcggggccccgggcccccccagcgcctatctttctcctttggggaccacttggctgaggacctgtgcgtgcaggctgccaaggccagcggtgagtgcatccctagtggattgggccagagggaaggatagagctgtgtggggccaagattggaagctggaatagttgcctgcagaagtcagcattggagctggggctttgggggatgagtaggagttttgtaatggagaagggtgtgcagggttggcttctgaggcagagggaatggcctgtgcagacggagaggtgtgacggcacatgaagggaacagctggtcataccttgaggtatggaaggatctggacggttgggtatgatgctggcactcctgaagggcacagatggggtgactcaggagggagctgatgggaccatcccctgtaggcatcctgcctgtgtaccactccctctttgctctggccacggaggacctgtcctgctggttccccccgagccacatcttctccgtggaggatgccagcacccaagtcctgctgtacaggattcggtaggaagtgccccccagcccccagggattgtacaattttatcatctccttgcatttcgaggtgcccacacccctgccccagggaggtatggtcactacccatttctcagatgaggaaacagaccagagagggtgggtcacttgcccaaggtcacacagcaagttaaaggtacaagctgggctctgtgaggcctccgcagaatctgtccctcgcccccaccataatgtcactcctactgaggctgggttgcactttcatcccagggttctctcctctcctcacagcttttacttccccaattggtttgggctggagaagtgccaccgcttcgggctacgcaaggatttggccagtgctatccttgacctgccagtcctggagcacctctttgcccaggtggggttctgcctggggtttgacccagggggttgggggtccaaggggcaacatgaggactggcatgcaatcaggtggggcctcgtctgaccctccctgtggcagtccaggggtgggggtcagcccaggattgggggggtctgcaggttaacaacagggcttgaagttgggtggcctcagctgatgctccctgtggcggccccccagcaccgcagtgacctggtgagtgggcgcctccccgtgggcctcagtctcaaggagcagggtgagtgtctcagcctggccgtgttggacctggcccggatggcgcgagagcaggcccagcggccgggagagctgctgaagactgtcaggtgagagccaccaggctgtggggacggcctctgcttgggagtgagcaacgtgggctccatcggggctttgccgggctcccaccatggagttctcctgcaagctttcagggtgttcctatgacccagggcctcccacgaacccagccctctccacccccaggctccagctggacagacacctgacctcccccagctaaaaggcctgtggggtccctgtccgacctgtgggcgccaatggccctcccctactctgaggtccggtcctcatacctgaccctgaatgagagtctgtgtgtgcctggtgccccaactagggccgcaccccagcccctgggctaaagcctgggtttgtgtgtgtccccgcggggacccctcccgacgctgagggccggctccctcccctccaacccctgcagctacaaggcctgcctacccccaagcctgcgcgacctgatccagggcctgagcttcgtgacgcggaggcgtattcggaggacggtgcgcagagccctgcgccgcgtggccgcctgccaggcagaccggcactcgctcatggccaagtacatcatggacctggagcggctggatccagccggggccgccgagaccttccacgtgggcctccctggggcccttggtggccacgacgggctggggctgctccgcgtggctggtgacggcggcatcgcctggacccagggagaacaggaggtgagggcggactcccccgctgggcggggccaacgtgggggcggggctcggggaggggccggagagtggtaggggatgtggggcggagccaaaacgaaagacttggggaagtgggcgaggcttaatgaggggcggggcttagtgagggaggagactgcgggaatgggaggggcaaactgagtgaagggttgggctgagcgacccgggaatgaaaatgggaggggttgaggagtgggtgggtgggcgctggaacgaggcaagactaagaggcagagtgaggctccgagagctgggaggctgcgaagcggggcagggatcaaggggcggggtccggcagagagaaggaggcggggattggcagagcgggtgggagatgtttggggatgggtaggggaggtgttgagaggttggagttgataggagggggcgcggcttggaagggttgaatggcaaagggatagggagtggatggtgtggcttgggggtgggttcatgggcgtggtttggcggggtccagctgggcccccacttcggtactccccctccttcccaggtcctccagcccttctgcgactttccagaaatcgtagacattagcatcaagcaggccccgcgcgttggcccggccggagagcaccgcctggtcactgttaccaggacagacaaccagattttagtgggtgcaggattcccctccccttcagccttaccccgagggcgggaccggcaccctcgggtttcactgggctctgacgcttgtccctcgcaggaggccgagttcccagggctgcccgaggctctgtcgttcgtggcgctcgtggacggctacttccggctgaccacggactcccagcacttcttctgcaaggaggtggcaccgccgaggctgctggaggaagtggccgagcagtgccacggccccatcacgtaaggacctgtcccccattcccggcctctgtggccactcagggcccctccccttctctatgcctcagtgtcctcaccttccaggagccctggacaggggtcaagttttcaaaccacacctgccgcacagtcagcgctcagtgaagctgaagtattccttctgcttcacagggcgaccactactctctctctctctgaccccagggccatttcctggagatggacaagtcgcccaccttcacctacagcctcttgtttaatctcccaggaagggccaggcatagtggggcacacctgcaatcgcagcgctttgaggggccaaggcaggaggattgtttgaactcaggagttggagacaagtctaggcaacaggagagaccccatctctacaaaaaaagaaaaaaaaatagctgggtgtggtggttgacctgtagtcccagcgactccggaggctgaggcaggaggatcacttgagcccaggagttggaggctgcagtgagctgagattgcactccagcctgggcaaccaagcaagaccctgtctctattaaaacaaacaaacaaacaaacaatctcccagaagaggccaagacttacggctgattttcttttttctttttttttttgagacggagtctggctctgtcgcccaggctggagtgcagtggcacgatctcggctcaatgcaacctctgcttcccagggtcacgccattctcctgcctcagcctcccgagtagctgggactacaggtgctcgccaccacgcccggctatttttttgtattttcagtagcgacggggtttcacggtgttagccaggatggtgttgatctcctgacctcgtgatccacctgcctcggcctcccaaaatgctgggattacaggcgtgagccacggcgcctggcccatggctgattttataaatggggggagggtgtcacctggcaaggatcccagggctacagaggtacctgaatttgagcccaggtctctctgtcttcttctatctctgactcctccccattccctctcaccttcccccacagtctggactttgccatcaacaagctcaagactgggggctcacgtcctggctcctatgttctccgccgcagcccccaggactttgacagcttcctcctcactgtctgtgtccaggtcggtctactgctagggtgggtagtggagggctgcctggaggaggtgacgtttgaattgagatttaaaagatcagtcagcatttggttcctgaagaataggagggaaaagacacccccggtgaacagaacagcatattcaaaggtctaaagactggaatgagttcatggtgctttaggagaaaggactgaggctgggcacagtggcttacgcctgtaatcccagcactttgggaggctgaggtaggcagatcaagagatcaagagatcgaaaccatcctggccaaaatggtgaaaccctgtctctactaaaaatataaaacttagctgggcgtggtagtgggcatctgtagtcccagctactcgggaggctgaggcaggagaatcgcttgaacctgggaggcggaggttgcagtgagccaaggtcacgccattgcactccagcctgggtgacagagccagactccgtctccaaaaaaaaaaaaaaaaaaagaaaaaaaaggaagaaggactgagaaggagagtgtctgtcgctcagtcccactcaggggccactcttctttgcagaacccccttggtcctgattataagggctgcctcatccggcgcagccccacaggaaccttccttctggttggcctcagccgaccccacagcagtcttcgagagctcctggcaacctgctgggatggggggctgcacgtagatggggtggcagtgaccctcacttcctgctgtatccccagacccaaaggtgagccccttcctcccctggaatgagtggctgatctgggaccctggctttctatgtctgtgacagctcctgtgtgggtggcaagtggcagaaactgcaggtcaaggtgggttagggaagaaaaggtgatttgttggctcaggaagttagagatatataacctttaggtctggcttgatctaggcacagctagatgtgagccatgtcatctgcacctagtctctctccagctctcagctcttcctctgggtgaatttcactcctggacaaacccctctgatgggacaattctgagatgtgagttcttctgagtctcccagaatccctggtagaaccgatccctggttgtccacagtgccacttgctcattaaagccccctgcagggctccttccttccttgtcgctcatcccaaatccctatgggggctttctggatctcctttcaaataaaccatgtgccagccaggcacagtggctcacgtctgtaataccagcacttcgggaggctgaggcagatggatcacctgaggtcaggagtttgagaccagcgtggccaacatggtgaaactccatctctactaaaaatacaaaaattagctgggtgtgctggcacactcctgtagtcccagctacttgggaggctgaggcaggagaattacttgaacccaggaggcagaggttgcagtgagccgagatcacaccactgcactccagcctgggtgacagagcgagactctgtctcaaaaaaaaaaaaaaaaaaaaattagccgggcacggtggcacacacctgtagtcccagctattcgggaggccgaggcaggaaaatcgcttgaacctgggaggtggaggttgcagtgagctgagatcgcaccactgcccacccagcctggatgacagagtgagactccgtctcaacagcagcagcaacaacaaaacaaaaacaacaacaaaaagccatgtgccctgaagtcttcatctcagggtcggcttctagagggtacctcaaactaaggcatgagttagctaacccttggggacttttcacctctgatttctggtttttctccctcatcctctccccatagaaaagtccaacctgatcgtggtccagagaggtcacagcccacccacatcatccttggttcagccccaatcccaataccagctgagtcagatgacatttcacaagatccctgctgacagcctggagtgggtaagaggccctgggaaatgaggcgatacctcagtctggggtccagagactcagatgcgtggcctcaggcatatgctataattttaccttgcctcggttttcccatctgtaaaatggggccagcagctatgtctcgcttgggctgggatcctgcaggaaccccctcactggcctcttctgctgtcccctcaccattcagcatgagaacctgggccatgggtccttcaccaagatttaccggggctgtcgccatgaggtggtggatggggaggcccgaaagacagaggtgctgctgaaggtcatggatgccaagcacaagaactgcatggaggtgagagcaatgtggaccagacttttggagtcggggctggctggagagggggtcgtggatgcagagaaatttaaaaacacacagggacctgggcgtggtggctcatgcctgtcatcccagcactttgggaggctgaggcaggaggatggtttgaagccaggagttcaagaacagcctaggcaacatagcgagacctcgtcttgacaaaaaaattttaggccgggcgcggtggctcacgcctgtaatcccagcactttgggaggctgaggcgggcagatcatctgaggtcgggagttcgagaccagcctgaccaacatggagaaaccccgtctctactaaaaatacaaaattagccgggcgtggtggtgcatgcctgtaatcccagctactcgggaggctgaggcaggagaattgcttgaatctgggaagcggaggttgcagtgagtcaagatcgcgccactgcactccagcctgggtgacagagggagactctgtctcaaaaacaaaacaaaacaaaacaaaaaaccatagatgatagtgggaacttctgtcccgtatcagaaaatcatggtagtgctgtgtgcactaatggcagactccagggccaaaggtgacctgtggccaggtgttcccctaaggcaggtctgtgagcacaaaatttgggattattggagtggaagaaacccacgcatcttctctcccttcccaccttccccagtcattcctggaagcagcgagcttgatgagccaagtgtcgtaccggcatctcgtgctgctccacggcgtgtgcatggctggagacagtgagagccccccacccacccaccccacccctgcctcacccaagtctaggctgttcttcccacctctgttctgagccgctatatgacagccccagcaacacactgggccaccctggatgggagccgtgttcattaccctttatttatgtctctccatcatcactccttggaaagcggctccaggttctcacccatatccagccccagaatgacctgaagtcagacaaacctggctttctaatctctgcagctttgtacaggtcacgtaacctttctgagccttggtttcattggttgggagtctaggatgggccaggagctgggacagagcctagaatgtgacaggcagggtgtgatgaggtgtgaggagggcagcacggagcactgtggatggtcagagaggctgctgggccagcctgggggttgggcaatgcttgtgggaagacagagatgcattctaacctggaaagataaggacaagtgtggattaggaaaggaagaggggtgttctaggcagaggacacagaatatgcaaagggttagaagtgagatacagaggctgggcgtggtggctcatgcctgtaattgaaaagccgaggcgagtggatcacctgagatcaggagttcaagaccagtctggccaacatggcaagaccccgtctctactaaaaatacaaaatcagccgggtgtggtggcatgcgcctgtagttccagctacttaggaggctgagacaggagaatcacttgaacccgggaggcagaggttgcagtaagccgagatcgcaccactgcactccagcctgggcaacagagtaagactctgtctcaaaagaaaagagaaaaaaaaaagtgagatacagatacagacagggctcaacaccttccaggcattccaggcaaatcattcagagatggaggtgggaggagaggtgagtactgtatgaacagaggcagcaggggagggaacagacagagatgagagtttgagagaccctgagagccagggtgttggcagaacctcctcaacacaagtgcagttcagtctcccaaccccgcctctccctgctgccaaccaggcaccatggtgcaggaatttgtacacctgggggccatagacatgtatctgcgaaaacgtggccacctggtgccagccagctggaagctgcaggtggtcaaacagctggcctacgccctcaactatctggtgagtgctcctctgcctgctccaccctccattcccagggaaggctttctctgggtggaagaggaattgggagtgggctctgtagtatgcataggagtttggtaagggttcgaggggagggcattttaggttcaggttgtgagaacactagaagagaacaagtcattcttggatgtcagggcgtgtggtgaatgacgaggctgggcaggaagaaaggcttcctagaagaaggaacattggagatagggccttaaaagttgagtagaagttcatcaagagaagaaaggaaggaaggaatgtcaggctgagggaacagcctaggcaaaggcctgcaggctagatagtgtgttgcatcccctggggcctatcaggcagttctgttggcaggagaccagggtgcaagtgtggaagggaagttcattggaagcttgagcaagggccttgaatgccaggctgaggagctttcactttgtgtcaaaggcactggggagtcacaggatggggtggtgtttgagaaggggagggacatagccaggtcagtgtagggggtgaactagaggggcaagacaggatgtcaggagtcagggacgatgctggagcatgtctgagcagtaccaagtgggttttgaaggatgtataggagtttgccaaacagactcttcattcatcaaaccctcccgggcattttcctgtgtctggcccccttaggaggacaaaggcctgccccatggcaatgtctctgcccggaaggtgctcctggctcgggagggggctgatgggagcccgcccttcatcaagctgagtgaccctggggtcagccccgctgtgttaagcctggagagtaagttcctggaggtggaggagggaggggctgagcagggcaaggaagtggatccctgatcccactttcattccctcagtgctcaccgacaggatcccctgggtggcccccgagtgtctccgggaggcgcagacacttagcttggaagctgacaagtggggcttcggcgccacggtctgggaagtgtttagtggcgtcaccatgcccatcagtgccctggatcctgctaaggtcagagcccctcacccggcatcggtctccgaacccccactttgacagaagggcagactgacatccagtctggggagattggggtgggtctattgggttggggattaccgactgctcctctcaccctcagaaactccaattttatgaggaccggcagcagctgccggcccccaagtggacagagctggccctgctgattcaacagtgcatggcctatgagccggtccagaggccctccttccgagccgtcattcgtgacctcaatagcctcatctcttcaggtgcccgctgggacgggttgggtggggagggctgtgatgtcatattgggcccagtggaaggagcgtggtttgcagcaggccacgccctgtgtgtctggtgaggttggaggggttggtgactgtgacagtcagtgtgagcttcaacagctactgtaacgaacagtcccctcagttcaaggttcaacatgatgatattttatttatttatttatttttgagacagagtcttgctctgttgcctaggctggagtgcagtggcacaatttcggctcactgcaacctctacctccttgaacctctagttcaagcgattctcctgcctcagcctcctgagtagctgggattacagtgtgtgccaccacgcccagctaatttttgtatttttggcagatatggggtttcaccatattggctaggctggtctcgaactcttgacctcaggtgatccgcccacctctacctcctaaagtgctgggatttcaggtgtgagccaccatgtctggtctatttcattcttttaaaaaaatgtttggctgggcgcagtggctcatgcctatagttccagctataggtaggtggatcgcttgagcccaggagttcaagaccagcctgggcaacatggcaaaactccatctctacaaacaaacaaacagaaaattagccaggcatggtgatgcatgcctgtatgcatttttattttattttattttatatttttgagacactatctccctctgtcacctaggctggagtgcagtggcgtgatcctggctcactgcaacctctgcctccctggttcaagcaattctcccgcctcagactcccaagtagctaggattacaagggcgtgccaccaaacacggctaaatttttgtattttttagtaaagacagggttttgccatgttggccgggctagtcttgaactcctggtctcaaagagatccgtccacctcagccacccagtgctgggattacaggcatgagccaccacaccaggctggattttttttttttttttttttttttctgtgatggggttttgctatgttccccaggctggtcttgaattactggctcaagcaatcctcctgccttagtctcccaaatagctgggattacaggcacacacaaccatgcccagtgtgatatttagtcttcattcaatgagggtgtccaggcccacaggaacctctcacttagtggctgcactcacctcaggcgttgggtccccgttggatcctctgcagataaaagagagagtgtggagggccccgtattaggtttccatgggtcaggactggaggggcacccagcatatcttgtccatcagcctgagctcagtcatgtggccacatttcatagcagtggaactggggaaatgagttctcattatgtcctccatctttgtagccatgtggagttgcacagggtgtgcactgcacgaggaggcttcctttgcctgggacagagtgggagacacctttttccagtctccacaaggtaccctttggcttgcaatggccctgccataatgcacagagagggtcaatatgcagatggaggttgcacagcaagtcaactcaggagtggggcccaggatgagaggcgctgcttaccactgcccatgcccccaccccagactatgagctcctctcagaccccacacctggtgccctggcacctcgtgatgggctgtggaatggtgcccagctctatgcctgccaagaccccacgatcttcgaggagagacacctcaagtacatctcacagctgggcaaggtaaggtgggcagggccagggtgggttggagagggcagggcagcatccaggtgcctggacatcagtcccgctatcccccagggcaactttggcagcgtggagctgtgccgctatgacccgctaggcgacaatacaggtgccctggtggccgtgaaacagctgcagcacagcgggccagaccagcagagggactttcagcgggagattcagatcctcaaagcactgcacagtgatttcattgtcaagtatcgtggtgtcagctatggcccgggtgagccagctcccggatgagtgaaccaagacgtatgggtgcttttcaaagtgcacattcttaccctcctgccaggccactttaggtaggctgggaacgtgattattgatccagattcacatgggttacaggtttgaatcctgactctaccccttaccagttgtgaaaccttaacttttctgagcctcagtttctccagctgaaaaatgggccattgtgatatttactttgttgttgttgttgtttgtttgtttttttgagacagagtctcgctctgtcacccaggctggaggcagtggctcaatctcggctcactgcaacctctgccttccaagttcaagtgattctcctgcctcagcctccagagtagctgggattacaggagcgtgccaccacacccggctaatttttgtgtttttagtggagatgggttttcaccatgttggccaggctggtcttgaactcctgacctcaagtgaggcttccaaagtgctgggattacaggcgtgagccactgcacctggccgtgatatataaacacatcaatgtatgttgtagaaagtactcaagagatattagcaatgtgtcattgttgcggttcccatattacagtcagcaaaactgaggtcgagagggacacaaggtcccactgtgaaaggggggaagaatggggggacgagcagggctgggccctgctgtgacagatcctgccttctccaggccgccagagcctgcggctggtcatggagtacctgcccagcggctgcttgcgcgacttcctgcagcggcaccgcgcgcgcctcgatgccagccgcctccttctctattcctcgcagatctgcaaggtgcgagggggcgccccgggacttgtggggattcagctggcacggcctgggcaggggtctgcttggaggtcgcggtgaaggctgaggagtggtttggggtccaggtctcgggagtggtggggttggcttagggctcaggatcagaacttcagtggaggatggctcgggggtagggttatagttggggtctgggttggggtgccaggtcacgcttggggtacctgccggattatcctgggatcctctctgcacgctcacaccgcccgcccgcagggcatggagtacctgggctcccgccgctgcgtgcaccgcgacctggccgcccgaaacatcctcgtggagagcgaggcacacgtcaagatcgctgacttcggcctagctaagctgctgccgcttgacaaagactactacgtggtccgcgagccaggccagagccccattttctggtggggaacccgcgcctaggctccgcccctattccccacggctctggctccgcccccagccatgcccccgccccctcccgctgctttgctccccagccttagccccgcccttcctccgctgcagctttggcccctcccactccccagagccccgccccctcaacagcactggctcctctgtctcccgctgccctgctgtcagcggcccccagccttagccccgcccttctctcagctctcgccccgcccaagcttcagaaccccacccctccaacacgctggctccgcccctcagggctggccccctcttagttccgcccttccccccgcccagttctggcccctccccctcccacggctctggccccgcccccatctccgcccctccgtgctgcccccgcctcctccccacagccttagctcttcccaggcacctcccagggctggagaatccacctatcccacagccagggaaaccgagaccctggagacgggactgacctgctcacagtccccacctaccctgaccagttccccattccaaggctgcccccctcttcctgtcctttctacaccctcgcatctcaagaccttgtcccctctccaggtatgcccccgaatccctctcggacaacatcttctctcgccagtcagacgtctggagcttcggggtcgtcctgtacgagctcttcacctactgcgacaaaagctgcagcccctcggccgtgagtcggcttcccagagcccccagccttcttctccctccacgcccctcgtggccaatctccaacctgtctgcgcctgcgtccctctttagcatggggtcacctggtcccagcatcataggccccagtggggaggacgcttcctcacctttctgaccccttcacggttcaggcagcccctccccgctccatcacagatggcccctacccccaccacgggtggcccctccccctccacccacggaggctcctcccccaccacatgcgctcctccttggctccaggagttcctgcggatgatgggatgtgagcgggatgtccccgccctctgccgcctcttggaactgctggaggagggccagaggctgccggcgcctcctgcctgccctgctgaggtgagcgccgcagggctagcctcagtttcccagtctgtagattgggccggggtctcgggcaagccagctggcgcctgagtctctgtactgagaagaaaggctagagtgtgaggccgatgaggatcctggcccccacttggctactctctcactgtgtggcaagtcagagcactttcagagcctcagtttacccttttccaaaatgagaatagtaatgccttatagggtgagggaagattagactcctgaacacctgtgcctatgagggctcagctcaaagccgagcacacagtcgatgctccataaatggtggtgacgttcatggtttttttttttctttctttctttcttttttatagatgggggctcactctgttgcccaggctggggtgcaattatagctcactgcagcctccaactcctgagctcaagtgattcccctagttcagtgtctctagtagcaggagctacaggtgtacaccaccacacttggctaatttaaaaataattttttagagatgggagcctcactatattgcccaggctggtcttgaactcgtgggctcaagcgattctcctgcctcagcctcccaaagtgctgggactataggtgtacatcaccatgcctggctaatttaaaaataattttggccaggtgtggtggctcacacctgtaaacccagcacttttgaaggctgaggcggtcagatcaccggaggtcaggagttcgagactagcctggccaacatggtgacaccctgtctctactaaaaatacaaaaattacccatgtgtgggtgcctgtgatctcagctacttgcgaggctgaggcaggagaattgcttgaacctgggaggggaaggtttcagtgagccaagatcatgccactgcactccagcctgggcgacagagcaagattccatctcaaaataaataaataaataaataaacaaacaaataagataaaaataatttttttaagagacaaggtctcgctatgttgcccaggctggtcttgaactcctgggctcaagcgatcctcctgccttggcctcccaaagtgctgagatttacaggcataagccactgtgcctggctaattttaaaaaatttttttaaagagatggggtctctctgtgttgcctaggctggtcttgagctcgtggggtcaagtgatcctcctgcctcggcctcccaaagtgctgggattacagacgtgagccaccacatcccaccctctcatggtttataatcatataatcataacctttgtggaagtgtctgacatgcagttggtcattgataaattaatttgctcaggccaaaaacatttattgagtgccaactgtgtgccaggacttgttgggtgctgaagaccctgtcctcccagtaactagcaaaatctgataagaacattctaggctgggcacgatggctcatgcctataatcccaacactttgggaggctgaggcagaaggatcactggagcccaggagttcaagaccagcctgggcaacgtagtgagaccttgtctctacaaacaatacaagcaatagccggtgtggtgacatgcacctgtggtttcagctactagggaggctgaggcaggaggatcactggaacccaggagttcaagaccagcctgggcaacatagtgagaccttgtctctacaaacaatacaagcaatagccggtgtggtgacatgcacctgtggtttcagctaccagggaggctgaggcaggaggattgcttgagcccaggaggttaaggctgcagtgagccattattgtaccactgcactccagcctggacaacagagtgacaccctgtctcaaaacaaaacaaaacaaaacaaaacaaaacaaaacaaaaaagacaaaattatggtagtgataagtgccttgaaagagatgaacagagggaaatggtggggtgggggtggtcaaagagggcctcttacggggccgacgctggaaggaggaggagcctacccatgagtaaagctaggagaagaaatctccagtggaggacacggaagggaaaaaggccttggggaggtaatgagctgggtgcctttaagcaccagtgcgatggaggcagatgtgactgcccggaacaaatgagggaaggagggatggagatgagcgaaggagggcatcagggagaggtggtgtttttttgttgtttttttttttttgagacgtggttttgctcttgttggccaggctggagtgcaatggcgcaatctcggctcaccacaacttccgcctcccaggttcaagcaattctcctgccttagactcccgagtagctgggattacaggcacacgccacctgtaattttttttttttttttttttttttttttttttttttttttttagttaagatggggtttctccatgttggtcagggtagtctcgaaaggagaagtgtgttgtaaaatccataagggctgggcgcggtggctcacacctgtaatcccagccctttaggaggccgaggtgggtggattacatgaggtcaggagttcaagaccagcctgaccaacatggtgaaaccccgtctctactaaaaatacagacttagccaggtgtggcggtgtgtgcatgtaatcccagctacttgggaggctgaggcaggagaatcgcttgaacccaggaggcagggtttgcagtgagccgagatcgcaccactgcattccagcctgggcaacaagagcgaaactttatctcaaataaataaataaataagatccatagggagccatgggagtttttggagcagagatgggatggaatttaatttgtgttttaaaactgaatgagtgcggtggctcatgcctataatcccagcactttgggaggccaagacaggtggatcacctgagatcaggaatttgagaccaacctggccaacatggtgaaaccctgtctctactcaaaatacaaaattagccaggcgtggtggcacgtgcctataatcccagctactcaggaggctgaggcaggataattgcttgaacccgggaggcggaggttgcagtgagccgagatcatgccattgcactccagcctggacaacagagctagactccgtctcaaaaaaacaaaaacaaatacgctgaatgggagttgtgtcctttggactgctcaggcacgaccccattatctgtcccccgcccctcaggttcacgagctcatgaagctgtgctgggcccctagcccacaggaccggccatcattcagcgccctgggcccccagctggacatgctgtggagcggaagccgggggtgtgagactcatgccttcactgctcacccagagggcaaacaccactccctgtccttttcatagctcctgcccgcagacctctggattaggtctctgttgactggctgtgtgaccttaggcccggagctgcccctctctgggcctcagaggccttatgagggtcctctacttcaggaacacccccatgacattgcatttgggggggctcccgtggcctgtagaatagcctgtggcctttgcaatttgttaaggttcaagacagatgggcatatgtgtcagtggggctctctgagtcctggcccaaagaagcaaggaaccaaatttaagactctcgcatcttcccaaccccttaagccctggccccctgagtttccttttctgtctctctctttttattttttttatttttatttttatttttgagacagagcctcgctctgttacccagggtggagtgcagtggtgcgatctcggctcagtgcaacctctgcttcccaggttcaagcgattctcctgcctcagcctcccgagtagctgggattacaggtgtgcaccaccacacccggctaattttttttatttttaatagagatgaggtttcaccatgatggccaggctgatctcgaactcctaacctcaagtgatcctcccacctcagcctcccaaagtgttggaataataggcatgagccactgcacccaggctttttttttttttttaatttattattattatttttaagagacaggatcttgctacgttgcccaggctggtcttgaactcctgggctacagtgatcctcctgccttatcctcctaaatagctgggactacagcacctagttttgagtttcctgtcttatttccaatggggacattcatgtagctttttttttttttttttttttgagacggagtctcgctctgtcgcccaggctggagtacagtggcgcaatctaggctcactgcaagctccgcctcctgggttcacaccattctctcgcctcagcctcccaagtagctgggactacaggcgcccgccaccacacccggctaattttttgtatttttagtagagacggggtttcaccttgttagccaggatggtttccatctcctgacctcgtgatctgcccgtctcggcctcccaaagtgctgggattacaggcatgagccactgcgcccggccctcatgtagctttaaatgtatgatctgacttctgctccccgatctctgtttctctggaggaagccaaggacaagagcagttgctgtggctgggactctgccttttaggggagcccgtgtatctctttgggatcctgaaagggggcaggaaaggctggggtcccagtccaccctaatggtatctgagtgtcctagggcttcagttttcccacctgtccaatgggaccctttctgtcctcaccctacaaggggcacaaagggatgacaccaaacctggcaggaacttttcacgcaatcaagggaaggaaaggcattcctggcagagggaacagcatgccaagcgtgagaaggctcagagtaaggaggttaagagcccaagtattggagcctacagttttgccccttccatgcagtgtgacagtgggcaagttcctttccctctctgggtctcagttctgtcccctgcaaaatggtcagagcttaccccttggctgtgcagggtcaactttctgactggtgagagggattctcatgcaggttaagcttctgctgctcctcctcacctgcaaagcttttctgccacttttgcctccttggaaaactcttatccatctctcaaaactccagctaccacatccttgcagccttccctcatatacccccactactactgtagccctgtccttccctccagccccactctggccctggggctggggaagtgtctgtgtccagctgtctcccctgacctcagggttccttgggggctgggctgaggcctcagtacagagggggctctggaaatgtttgttgactgaataaaggaattcagtggaaaagattgtgctggacttggggcgatggggagcctcagagggtgtgtgagctgggagggatgcggttagagctgtgggccagagacctctcagggagccactgtgggggccccagggcaggctggtggaggaggaccactgggtggggcttggctggggccctcaaggacagagccccctcactcccagccccagctgctggccttggctgcagcctgggggagctgattacaggctctctgtgggtggggaaggaacaggatgctctcccggtggtcagaggacaaggccaggttgggggagcgaggctgtggggaggggaccagcatcactggggccggaccacctccccaccgaccggcccccgtc

SEQ ID NO: 15961 - DNA, 5739 bp, Human
ggcaatgcatgccagtgaaacacaatggaagcagtccactttaatctcctaaggcactgcttcttctttttaacatgtgtgaattcatgtcttctctagtgctgttctaactttaattcatattgtttagagtttagttttctttgatgtgacagaaaaatctgcaaaaagcatattaaatgttatatgtctcttgttgacaaaatatctaaggtaaatctattgtcttcccctaactactccataggctactaacatgtctccccacatctactctgccctctaagatccattctcaatgctaaagcccaaaatgttatttaaaaaaaaaaaatctattggtgtcatcccctgccaaaatttcctcaatgaatatccattgctcttagaataaaagatctcatctcattctgtacttcctgaatttgctctgcaaccacactggctttctctctctctaagttgccatgcacatactgccttagatctcattatattatataatttatcccatctaagccaataatatttcaggaggctatccctcatttccgagactgtcacatcttcttaatatgtcctgtattttcctcataagatatcacagttggtaaatatatattgagtagaatttctatttgaatgatttaaatgttattttttcctataactatggcataaattcattgagaattatttcaagttattcaacaaatttgattataccataataaattatcacatgtattaaatcataaattattaaacaaattaaatcaataaattattccataataaatatggaaagtaatatatcaatcactgatctttgtgttttccatatagggaaaaatagacgcattaaacagagattttaaccctcactgttaaaaacatacctttgtgatttccccttagcaggactctggaaagtcttcagggactaacggtttaactatgtccccagttagaattgtctcaatacaaacattacatttgatttaataaaatgcttatttaaatttcaatttattcaagtatcaaagtagtttattagtgagttaaagagtgtgattaacatatgcagccatttgttgaggcaaatcctatcggcagagtattaaaagccaagagtatagggaaggatggtagattacggagacaaaagcaaaaaaatgactctatggaaaaggctactttgagttcgggattttctgggctaagcaatttctaaagaatattcttagcaataatattaacaacattaatgttaccaacaattatttttctgtagagtatattggaaatatgaaaaaaacctgctattgaataggactgtgatctcatagaagatgaacataacatcaaaatgctgtaaagtcataacacagaatgaaacagagtaatttatattgaagcattttctatgtattttcctttatgttttgatcctcatggcctgataaaactaaaaccagaattagcatttgtctggatagaatttgaggaagcaaggctgtgtgtagaagtcttcaaaagttctgatcgcactgtctcttttactcagcaaacgatttaacacgttcctcaaaacatgtctatattgttatgataaattgtatatatatgcagctacagtaatatattaaacacattatccagcatataataaaatagaaatgtaaatatgatggattgaaataagttgaagttttaatataggtacctgtatacaagtggaaaattttagcatcctttgtgtgttcaacccagttcagaacactgtcggggcgtttctttcctccctttttttcgaattggttttgggggtagattcgagttacaaaatggccgcccaaagcgtgttcggcgcggttcccacagcggtctccggctgaaccggcgcgtctcgccgcctcgctgccgaacacagcgtgaggatctcccccaccgccgctccccccaccccccggacatggcgtttgagtctctgggtttgccgagcaccaagtcctctgaggcccgcagcgcaggaccggaagcggccgagcgccctcagccccgcgaccaccagccgctcgagacccctgcgccgctgccccgggtttcgcggcacccaagacccagcgagtgcagcggcggccgctgaggaggttcgaaaacatggccaaaagccgagaaggaactgacagataggaattgggatcaagaagatgaagctgaagaggtgggaacattctctgtggccagtgaggaagtcttgaagaatagagccataaagaaagcaaagcgcagaaatgttggattcgaatctgacagtagaggaggctttaaaagttttaaaggtttagtggtaccttctggaggaggacggtttcctggatttggtagtggtgctggagggaagcctttggaaggactgtcgaatggaaacaacataaccagcgcccctcccttcaccagtgcaaaggcagtggcagagcccaaggtagcctttggttctcttgctgcaaatggccctaccgccttggttgataaaaaagtttcaaatcccaaaactaatggggacagtcagcagccctcctcctctggccttgcttccagtaaagcttgtgtcagaaatgcctatcacaagcagttggccgccttgaactgctccgtgcgggattggatagtgaagcacgtgaatacaaaccccctctgtgatctgacacctatctttaaagactatgagaaatatttagcaaacattgaacagcaacacggcaacagtggcaggaattctgaaagtgaatctaacaaagctgcggctgaaacacggtctccttcccttgttggctcaacaaaattacagcaagagtcagcgtttttgtttcatggcaacaaaactgaagatacacctgacaagaaggtggagctgacatctgaaaagaaaacggacccatcatcactaggagcgacaagtgcctcatttaatttcggcaagaaagttgatagctctgttttgggctcattaagctctgtccccctgactggattttcattctcccctggaaactccagtttatttggcaaagatattaccagagtaaaccagtctcttcaccatttcgcactaaaccattggagggccaagcggaaggtgacagtggtgaatgcaaaggtggagatgaagaagagaatcatgagctacccaaagtagtagttactgaagtaaaagaagaagatgctttttactccaaaaagtgtaaactattttacaagaaagataatgaatttaaagagaaagtcataggtactctgcatttaaaacctacagcaaatcagaagacacagcttttggtgcgggcagacaccaatttaggcaacatattgctgaatgctctgattccacccaatatgccacgtacgccaacagggaaaaataacgtttttattgtctgtgttccaaatccaccaattgacgagaagaatgccaccatgccagtcaccatgttgattcgggtaaacaccagcgaggatgcagacgagttgcacaaaattttactggagaaaaaggatgcctgaacacgcgaagtcggctgcggaattattgccaagttgctgcttcttccaccatcccttcgacttagtttttcttctcttctttgacattctaagaacttacagataacttaaaacttttgagaggaagattaatgtggccaataaaacctttaaatgttaagtgtcaagaaaccgcactctcccttcttaagaactgcctaaagtgtaaaatacatttgaatgcaatttttggaagattttttaatgttcgtttgtttattaaactaaccctaagtgatttcttcaagcactgcaatcagggtatcaattcgctttcccaaaggctcttacaacccgtgggttttggggtccaccgccatcaccagagaggcttttgaacaggtgcctggctgtgttcagaaggaagctggcctgtatgcttctctccggtgggctcagccgacgtgtgagacttgttgttaccaaatgaaccgggctgcgacgctgtgacaggcatttgtcctctgctttatttttattttgaagctaaaatgtgagtactaagtgttcacctcagcgttcgaatcattggcctgtaaccctgtgggctgcttcacgagaattcaggacatgcattttcattctaaaaagaaacgaacagcttgtgaaggagttttttggctttgtagtgtctattcatgaggtagtgttacttctttatcccccaaagacaaaatgaagatatagggggattgccaggaatgggtttaaaagcacaaatttggtagcttatcatatacaccatggagagtgaacccttacgaaatgaaagtcaaatgagaccatcctagaaaaagaagatgctcatagacatttgtaccctgatcaaccccacgcatatgaaaactatgaccaattgacgtgcctgggagctttgacacacgagccgtgtgaattcactaggaaacatgtaataaggtaatgaaagagaaaatcgtgtgtaaattttgcctttaactttagacagcagtataatatacacttgatatctgaaatatttttacttttttaagagtaagattccatatgtctgtttggaagggagccagggttatgcacacgaatatccatgtcacttctccagagctgtcaggtaactaacacgagcattctttgaagtctctgggcacatgaatgagatacagaattgaatgtttaaatttccactttgattcctcatgaatcatttgagactagtagcagctgatcttgtgtacaggctcagggtcagtgcccaagggctcacgtgtgtgtgttctgatcttcagtgcgtagcgcattctcatttagaaaagagtagtctgaataattgcggacggtacagtggctttttaaaaactacagtctttaggtgtaaggtttggggccgggagcaattttatgatcaaatatgatgaactcctaagtacctgaggtgtgattgggccaatgttgtcatgaggttcttgctcgactttcagtgttttgattccactgggagaatttggcctagtgtgtggctttggatgaatccgcgcagagagaggtgagcttgtactgttacaggatgctgtcagacatagcgatagtaggcacctagggaggaagtggccatgatttttacactgactttttagaattgagaatgcacgtggggttttgttgcagatgattcatagtaagcaagtggctgatgctgttaataccggccctgcccgattgacgttaagtttattcaacttttaaaaagatgaagaactaaggggaacaaatttaagtttgtcgcaacttagccacacgtgcttccctggtaccagctggaattatgttttaaaatgtttaatgtggactgaaattttcatcttttgtttgagaatctatgaagtgtatcatatacttggcctaaagcaaggtgtatattttgttattctgaaattgttttgcatctggacaaatactaagtatcccagtggccttttttttcttaaaacctgtgtatccatctcatccttttgtggattcctagtaagcaaaaaaatttgttatgccatcttcattattcaaattacagactgaagatatggccagtttttaaagtagttgagattatgttttccatggaaggacaagtctgactgttcatgggctgatttt

SEQ ID NO: 15962 - DNA, 51671 bp, Human; identical to SEQ ID NO: 12068

SEQ ID NO: 15963 - DNA, 31319 bp, Human
tggcaaatttttgtatttttagtagagacagggtttcgccttgttggccaggctggtctcaaactcctgacctcaggtgatccgcccacctcggcctcccaaagtgttggaattacagatgtgaaccactgcacccagcccagcattatgtttttgagggttcatccacatggtagcttggatcagagcttctccactgacatttagaggctttgccgacagtggggagggaggggcaggaaacaaaatactcagaggctaagaaatggaacatgggggaaagactaagttgcatctcttaaatttttttttttttttttttaagagacaggatcttgctctgttacccagactggagtgcagtggcacaatcacgattcactgcagcctcaacctcctgggttcaagccattctcccacctcagcctcctgagtagctgagaatacagatgtgtgccaccacgactggctaacttttaatttatatatatatatatattttgagatggagtgtcactctgttgcccaggctggagtgcagtggcgcgatctcggctcactgcaacctccacctcctgggttcaagcgattctcctgcctcagcctcctcagtagctgggattacaggtgcctgccaccacacccggttaatttttgtattttcagtagagacagggtttcaccattttggtcaggctggtctcaaactcctgacctcgtgatccacctgccttggcctcccaaagtactgggattacaggcgtgagccaccgcgcctggcctaattctttattttttatagagatggggtcttgctatgttgtttaggtagacccaaactcctggggtcaagtgatcctcccacctcgacctctcaaagtgctgggattagaggggtgagcccaggtgcacaaggctggagcttggcatgtggggaggtgggcattgtggagggccagcatgctgcaagctctttgtaacaatttgttggaaggatgaaattaggccatccaagaacactgccctccttcagctcttgagtctcagattcagaagctggcgagatggcccggtgcggtggctcacgcctgtgatcccagaattttggtaggccaaggcggacggatcatttgaacccgggagtttgagaccagcctgggcaacatggcaaaaccccctctcttaaaaaaaaaaaaatgcaaaaattagctgggcgtggtggtgcatgcctgtagtcccagttcctggggaggctgaggtaggaggatggcctgagcctggggaggttgatgttgcagtgagccgtgattgcaccactgcactacagctgggccacagatcaagaccctatctcaaaagaagaaaaaaagaatttggcagccaggcacggtagctcacgcctgtcatcccagcactttgggaggctgaggtgggtggatcacttagggttaggagttcgagaccagcctggccagcatggtgaaaccctgtctctactaaaaatacaaaaattagctcgatgttgtggcagttgcctgtaattccagctactcgggaggctgaggcaggagaattgcttgaacccgggaggcagaagttgcagtgagtggagatcatgccaccacactccagcccgggcgacagagcagggctccatctcaaaaaaaaaaaaaaaaattggctagagagggccagagacctggccaagtgcatggaaccacaggtggcccatgggcccatggggctggcatctgggtgttcagttcaggtctggggccagcagggcagaaccccctagaaccctgacttgctccaaagtcagacttgctccagagtctgtggccgccaccatcaccaccaccacggagctgacttcctgggtttctctttcactttgacttgccttagggatgggctgtgacactttactttttttcttttttcttttttttcagtcttttctccttgctcagcttcaatgtgttccggagtggggacggggtggctgaacctcgcaggtggcagagaggctcccctggggctgtggggctctacgtggatccgatggagccgctggtgacctgggtggtccccctcctcttcctcttcctgctgtccaggcagggcggtgagtcccctgaccctggcatggcggctcctcttgctgggtggaggcacgtgtatgtgtggagagctgtgggcctgctgtgtgggttggtttcatctctctgtgcctcagtctttcctgctgtcaaatgggagatgggcagtcatggcttctgggatcgaacttagacatctttcctctggtctagattttctcttctgtgaaatgcactaaattttttccacctcccggagttcaatgagaaaaaaaactaaggaaggaataaaaagcaagtatgtatctaataggtatacatagtatagtatcttatgtatgtagtttacaatagatagacatacataatataatgtatacagtcatttccatatttacggggcaatggttccaggaccctctgcagataccaaaatccaaagatgctcaagttcctgatataaaatggtaaagtatttgcatataacctatgcacatccttctgtatactttacttatttatttatttatttatttatttatttatttatttatttactgaggtagggtctcactctgtgtcccaggctggagtgcagtggcctaatcataactcattgcagccttgaccacctgggctcaagtgatcctcctgccttagccccttgagtagctgggactgcaggtgcacactaccatgcctggttaatttttttggtgtatactttttacagagacagcgtctcgctgtgttgcccaggctggtctcgaactcctgggctcaaatgatccactcaccttggcctcccaaagtgctcagattacaggcatgagccaccatgcccagccttcccatatacttttaataatctcaggccctgcacggtgactcactcctgaaaatccagcactatgggaggccaagatgggtggatcacttgaggtcaggagttcgagaccagcctggctaacatggtgaaaccccatctctactaaaaatgcaaaaattagccaggcttgatgatgggcacctgtactcccagctacttaggagctgaggtgggaggatcgcttgaacccaggaggcagaggttgcagtgagccgagattgcagcactgcattccagcctgtgtggcagagcaagactctatctcaataataataataataaataaactttccttctctgtacactggggatcagcggggtgctgactttttcaatggctcttgagatgcactgagtgcctgtagaatgcccacagcagtgctggccacacctcaaggtcccagcgccttcaggggccaggcatggctggagaccagcagcagggagggggcgagaggcagcccacgaggtatcctggagatagtggcagtgagtggtcagtccagggaaagggaaggaggatgggctttaggctctcaggggtgggtgggtgggtgggggttctgtgtcatcacagagagagatggaaggatggagagccttgtgtgttaagcatctttcccccctcaaggttggacacttggggctgtttcctggggtgccgccttctcccccaaggcttccaatctgcctgcagggctcaggacaggtccttcttgtgggagtgagggcgccggggtcttcctgacccatccatggtggcatccccctccttctctcacccagttccacacctagcagactgtggcaatcccaaagggcacggggatcccagtggctgagggaggtcgctgcctcctggagaaatgttattaataattgccctgactgctagtgggccaagtgtgcttgcctgggccagccctggcaggcctctccctgccatgcaccctctactgtctttccccatgctggcttcagacactggtgccaccccaggcacacctccacttctctctgccctccagactgttggtcttactgttctttcctgcaggggtacctcccgagagtgtctcccaaatatgcatctcaacctctgaggactaaagggtggtggatgaatggatagacaggtggatgggtgggtaaatgaatggatggatgaattaataaatacatgtatgtatgtatgtatggatggatggatggatggatggatggatggctggatggatatatcggtaggtagataaatggatggatgggtgggtgtatggatgaatgaatacgtggatggatagatggatagattggtgactagatggatagatggatggttgggtgaatggataatggattaatgaatgcatggatgcatggataaatacatggatggatggatggatggatggactaatgaatacatggatggatgggtgaatgggtggatggtgggatggatggatggatggatggatggattaatacatggatggatggatgaatggacgaatggacggataaatgggtggatggtggggtggatgcatggattaatacatggattgatggatggatggatggatggatggatggatggatagatggatggggggtggatggatggatggatgaatacgtggatggatggacggatggtggggtggatggatggatgtatgaatacgtggatggatggatggtggggcagatggatggatgagtagatggatgaatgaacacatggatggatagatggatgggtagatgcgtggatggatggatgaatacatggatggataaatacatggatggatgggtaaatgggtggatggtggggtggatggatggatggatggatggatggatggatgggtagatgggtgcatggatggatgaatacatggatggatgaatacatggatggatgggtgaatgggtggatggtgaggtggatggatggatggatagatgggtggatggatgaatgaatacatggatggttggatagatggatgggtagatgagtggatggatggatgagtacatggatggatggatgggtagatgggtggatggtggggtggatggatgatggatgaatacatggatggatggatggatggatggatggatggatgggtgaatggatgaattcatgggtggatggatgggtagatggtggacggatgaataaatacatggatggatgggtagatgggcagataaatacatgggcagatggatggatgggtggtggtaggagggtgcatagatgggaaagtgggtgggtgggagggctgatgatcacttgggtgtagaccccaaggctgagcccttctccccacacagtgcaaggccaggaatgtcattatgtcttcattgcctttgcagctgcctgcagaaccagtgagtgctgttttcaggacccgccatatccggatgcagactcaggttcggggcagttcctcattgttggctgaggattatgtagggctctgcctgaccccatccacagcggcccctcccatggcctccaccaccaggccaaagacccagccctgcctgtggtcttgggagtccccaccccaccacctgctggcccattcttaccaggttcaagttgccctggagtagccagccgcctctctgaacattatcacttccctagcatggtctcagggctggtgtctgtgtccgttcagattggtcggtacatgggagaaagtacctgttaagcattttgaagccccccccccaacctgataaattattagaacatttatttcatttatttatttttgagacggagtcttgttctgctgcccaggttggagtgcagtggcctgatcacagctcactgccacctccaccttccaggttcaagctattctccagcctcagccttccaagtagctgggattacaggtgttagccaccacacgcggctaatttttgtatttttagtagagaccaggtttcaccatgtcgcccaggctggtcttgaactcctgagctcaggtgatggtgagccacctgcctcagcctcccaaagtgctgggattccaggaatgagccaccgcgcccggccatattgtcggaacatttatgctcctaatgcaccctgaaaagggtctgaacactaagcagacacgctgtccattcttttgtttgataacgatttactgagcatcttctatgtgcggacacagttctagacataggcaactggctatgagctcaactaacttcccaagaccacagcctagtggaagagatagacaacaggcaaacaaatgtctatcacaaatgtgatgatgtgttttgaagaaccagaggaggaaagttggggccctggggaccccccaaaaaaaaacaccagaggagggtgagggatagagagagaggtggcaggacatctggcctctgtgaggacaagttaggaggctgaggattcggaataggttgaggtgagagacggcaggggatgaggtaggaaggacgcggggagggtttaggctgaggtgacgctgaaagatgtaagcatcacaaagatttgtcttaggcacgaagacccctccagactctggtctgttcccaagcctacaggatctcttccaggctcggcctcgggccctagggacctgagatgctatcggatatccagtgatcgttacgagtgctcctggcagtatgagggtcccacagctggggtcagccacttcctgcggtgttggtgaggacccctctaccattcccaaaccctcacccaccatcccactcttgcttcaaccccctctggtgcccctactctcggatgcgtgatcttggctgggtcaacactccttcctgggcttcagtttctcatctaagaagagagagttggaggattgtggtggggggttggtcagtgaaggtaggcatcccagggtgggtggccatgagggtctctctagtccttttttcttcttcaccctttcacttatccacccatccaaccatccatccatccatccatccatccatccatccattttttcttttttctttttttctttttttgagatggagtcttgctctgttgcccaggctggagtgcagtggcatgatgtcagctcactgcaacctctgcctcctgagttagagtgattttcctgcctcagcctcctgagtagctgggactataggcacacgccaccacacctgctaatttttgtatttttagtagagacagagtctcaccatgttggccaggctggtcttgaactcctggcctcaggtgatccacccccccttggcctcccaaagtgctgggattacaagcgtgaggcactgcgcccagccctttcattcgtttcttcgctgtgtggtgcagtccttgctgggagatactggggtccctcaaacccctccagtcccagactgatctccaaggaacccccaggctgggggaggaggtgtacaagggacagaaaaggatgctgggggctgggcacggtggctcacgcttgtaatcccagcactttgggaggctgaggtgggcggatcacttgaggccagaagttggagaccagcctggccaacatggtgaaactccatctctactaaaaatacaaaacttagacgcatgtggtggcatgtgcctgtaatcccagctactagggaggctgaggtgggagaattgcttgaaccagggaggtggaggttgcagtgagccgagattgcgcgactgcactccagcctgggtgacagaatgaaactccatctccaaacaaacaaacaaacaccaaaaaaacgatgctgggatgtgatgcacaaagtcggctgtggggtccactaggaccccagactcggcactgacaccctccttcctgctgcagccttagctccgggcgctgctgctacttcgccgccggctcagccaccaggctgcagttctccgaccaggctggggtgtctgtgctgtacactgtcacactctgggtggaatcctgggccaggaaccagacagagaagtctcctgaggtgaccctgcagctctacaactcaggttagcaccttgttctccccccgtccgttttttacccagagaggccatcaggctgcaaggctggagctagagaggattcctggcccttggcaagggacttgatactactagccattgtcacttcacgtagtgtcacgcaaacactattgtgacaaagcagtctttcatggtccccttaccaatcccctattcgtgggcacttagattgcttctggtttctctctgctagccataatgctgccaagacctggttgggttcttattatctgttctcatgactcgacatcatgtattttgccgggtgcggtggatcacgcctgtaatcccagcactttgggaggctgaggtgggtggatcacaaggtcaagagatcgagaccatcctggtcaacatggtgaaaccccatctctattaaaaatacaaaaattagccaggagtggccacgcgcgcctgtagtcccagctactggggagactgaggcaggagaatcgcttgaacccgggaggtggaggttacagtgagctgagattgagccactgcactcctgcctggcgacagagcaggactccatctaaaaaacaacagcaacacacaaaaaagccaaaaaaatttgcctggtgtggtggtgcatgcctgcaatcccagctacccaggaggctgaggcgggagaatggcttgaatccaggaggcagatgttgcagtgagctaagatcaagtcactgcattccagcctgagtgacagagcaagacactgtctcaaaaaaaaagaaaaaaaagaaaaaagaaaagaaaagaatgaaggaaaacatgtcatttgccacaacatggacaaagctggaggacattacgctgagtgaagtaagccaggcacagaaacaaaaacatttcatgatctcacttacatgtataatctttttttcttttttcttttttttgagatggagtttcgctctgtcgcccaggctggagtgcagtggcgcgatctcggctcactgcaagctctgcctcctgggttcacaccattctcctgcctcagcctccccagtagctgggactacaggcgcccgccaccgcgcccggctaagtttttgtatttttagtagagacggggtttcaccgtggtctcgatctcctgacctcatgatccacccgcctcagcctcccaaagtgctgggattacaggcgtgagccaccgcgcccatcccacttacatgtataatcttaaaaaaaaaaagtcgaatatctaggcaccgaaagtagaactgtggttaccggggatggagagaaggaggaaatgggggagatgtaggtcaaaggaatacaatttgtagttacgcagcacaaataaatctagagttccaaggtacagtagagaactataattaaaaataatgtatattgaaaatttgctaaaagaatagatttaagggctgggtgcagtggttcacgcctgtaatcctagcacttcgagaggccgaggtgggaggatcacctgaggtcaggagttcgagaccagcctgaccaacatggtgaaaccccatctctactaaaaatacaaaaattagccgagtgtggtggcgggcgcctgtaattccagctactcgggatgctgaggcaggagaatcacgtgaacctgtggtatggaggttacagtgaaccgagatcacaccactgcactccagcctgggtgacagagcgagactccatctcaaaaaaaaaaaaaaaaattttaagtgttctcaccacacaccaaaaaagtaattatagaaggtgatggatatgtatatatatttttaagagatggggtcttgctgtgttggccagggtggtcttgaactcctgggctcaaatgatcctcctgtcttggcctcccaaagtgcttcgagtacaggcgtgggcccctgtgcctggccatggatatgttaaattccttactgtagtaatcatttcactatggatatgtatatcaaaccatcatacctcttaaatttatacaatgatataaaaaaagaatcaggccgggtatgaccacggtgcagcaagactattttatgctaatttatgtctctccttgggtcaggttccttgaaatagatctaaaaactaagtacgatttccctgatagttctaaacaaacaaacaaacaaaaaaagaattggctggacacagtggctcatgcctataatcccagcactttgggagcccgaggtgggcggatcacccccaagagacaggcacttttgtaaattgcttaccagaattgattaccctctggcaagcaatttacaaaagtgcccgtctcttcacagccttgccagcaatgggtgttaatattttaaagttatcttcactaacaggatcctgtgtataaatctttattaaaaattatttatttttaaattttaatttaattttaatttgttttgagacagagtcttgctctgtcacccaggccggagggcagtggtgggatcttgtctaactacaacctccgcctcctgggttcaagcgattctcctgcctcaggctcccaagtagctgggattacaggtgcccaccaccatgcctggctaatttttgtatttagtagagacggtgtttcaccgtgttggccaggttggtcttaaactcctgacctcagatgatccacccaccttggcttcccaaagtgctaggattacagctatgagccactgctcctggccatatttgttgtttttttagagacaagttctccctctctctcctagattggagagcagtggtgtgatcagggctcacttcagcctcagcctcctaggctcaagagatcctcccatctcactctcctaagtagctggaaccacagtcatgaactaccatgcctggctaatttttatgtagagatgagggggtctcactatgttgcccaggctggtctcgaactcctgggcttaagtgatcttcctgccttggcctcccaaaatactggaattacagggtgagccaccgtatgtggcttgtgtataaatcttgactttttgatcataatataccaggcttagctgggacctgcaagtgtcccctaattcatatttagggattcagttgcttaccctggacagggtggattttcagggcccattaactcacatacgtgtgggctgcccctcgccaatccctacctctgcttccagttaaatatgagcctcctctgggagacatcaaggtgtccaagttggccgggcagctgcgtatggagtgggagaccccggataaccaggttggtgctgaggtgcagttccggcaccggacacccagcagcccatggaagttggtgagtttgtttcccaagtccagggtggacacgggcctctccagggcaccttcacccccaaatcagtctcaccatctctgcatctgtccccgctcccaaccagcccccactctagcccctgaggtggtttttttctttttctttttttttttctgagacggagccttgctctgtcgcccaggctggagtgcagtggcatgatctcagctcactgcaacctctgcctcccgggttcaagcgattgtcctgcgtcagcctcccgagtagctgggattacaggcatgcgcccactaccacacgcagctaatttttgtatttttagtagagacggggtttcgccatgtgggccaggctggtctcaaactcctcaggtgatccgcccaccttggccttccaaagtgctgggaatacaggcatgaaccaccacgccttgctcccactaaaattttttaaaataaattttttcttttggaataaccttcgattttcagaaaagttactatataaactggtgcagagaacgcccatatatcctttacccaaactcctctaatgttaatgtcttacataaactccaggcattatttgaatgtcaccaatttttccaggaatgtcttttttctgctcccagattcaatccaggatcccacattgtgtttagtaaaataattattaatttttaaaatttagttataataattttttactgctttatatgttcctaaagaaggtttgaacctagagaaggttctctagtaattaacgatagaaataatccctggaagtatggtctttaatttaaaaaaatttagcgaggtgcggtggctcacgcctgtaatcccagtgctttgggaggccgagttggggtgggattgcttgaggccaggagtttgagaccagcctgggcaacatggtgaaatcccgtctctaccaaaaatgcaaaaattagctgagtgtgatggtgcatgcctgtagtcccaactactcaggagactgaggcgggaggatcacctgagccctgggaggttgaggcttcaataagccatgattgcaccactgcactccagcctagatgacagagtgagaccgtgtctcagataaataagtaaataaataactaattgtaaaacagcaaatatttttcagcaccaaaatgcaaaacaatatatgaatatgtttttattctagggcgactgcggacctcaggatgatgatactggtgagaataataatagtaatgacaacaacagctgcagcaaattggcattaattgagcacctactgtatgccaggtccaatgctgaatttttttgtatgcctcttaccctgccccatagttcagtattggattctttccaaattgcaggtggggaaacaaatcacgacttggagggggtgagaagcctttggccaaggtcacgaccgaagggatggccgcagccaggacttgaactgaggggcagggatggacgtgggtgatcctggaggccctaagaggacagggcctggcctgcttctgctgagcccccaggacccagcacgtggctctgtacacagttggagctcaataagcacatgatggttaagtgactggtgccaagtcctggacaattcttacggcctgatgttcgacctgcctctccccagagtcctgcctctgccccctggagatgaatgtggcccaggaattccagctccgacgacggcagctggggagccaaggaagttcctggagcaagtggagcagccccgtgtgcgttccccctggtaagatcactctgagtacaggaacaggggcaagcattagaaataaggcaacagccggaggtggtggtgcacacctgtagttccagctgctcagaaggctgaggcgggaggatcacttgaggccagtggtttgagaccagcccgggcaacatagtgagaccccatctctaaaaaataaaataaaatggggctgggcgtggtggctgatgcctgtaatcccagcactttgggaggctgaggcgggcagatcacttgaggtcaggagttcgagaccagcctggccaacatggtgaaaccccttctctactaaaaatacgaaaattagctgggcgtggtggcgggagcctgtaatcccagctacttgggaggctgaggcaggagaatcccttgaacccgggaggtggaggttgcagggatccaagatcacaccactgcactccagcctgggtgacagggccagactctgtctcaaaaaaaagtaaaaaaaaaaaaaaaagtaataataaaataaaatggaaaaagaaataaggcagcaggtattagaaacaaggtggtgagtgttagaaataaggcagagggagaaatgggtgctcaaaccctgacaatgtggcatccggtcttgctgcacccactttagggttttttgctgctgttttttttgtttgtttgtttgttgttttttgttgtttttttttttgagacggagtctcactctgtcacccaggctggagtgcagtggcgccatctcggctcactgcaagctccgcctcccgggttcacgccattgtcctgcctcagcctcccaagtagctgggactacaggtgtctgcaaccacgcccggttaattttttgtattttttagtagagacggggtttcaccatgttagccaggatggtctcaatctcctgacctcgtgatctgccctcctcggcctcccaaagtgctgggattacaggcgtgagccaccgcgcccggcctactgctattttttgttttgttttgagactgtcttgctctgtcaccctggctggagtgcagtggtgtgatcttggctcactgcaacctccgcctcacgggttcaagcgattctcctgcctcagcctccagagtagctgggatttacaggcatgcaccaccacgcccagctaattttgtatttttagtagagatggggtttcgccatgtttgcccggctggtctcgaactcctggcctcaagtgatcctcccaccacggtctcccaaagtgctagaattccaggtatgagccactgcgctcagcccactacagggctttatcaagtgagaatcatcaggctgaacctcacggtgtctcaaggacaatgtcacctgcaggtggcagggtgtactaaacagctgctgccctgagcctgggcaacaggaaaatgagtgagagggtttcaaaccatgcagaaaggcctggcgctgtggtttatgcctgtaatcccagcactttgggaggccgaggccagaggattgtttgaggccaggagtttgagacaagcctgggaatcaaaacgagactctgtctctagtctataaaacaacagcaacaacaacaaaaccatgcagagaaatacatttgcattcaaaaaggaacttagaggccaggcgcagtggctcacgcctataattccagcagtttgggaggccgaggcaagtggatcacaaggtcaggagttcaagaacagcctgaccaacatggtgaaaccccgtctctactaaaaatacaaaaattagccggacatggtggtgcatgcctgtaatcccagctacttggaaggctgaggcaggagaatcgcttgaacccagaaggcagagattgcagtgagccgagatcgcaccagtgcactccagcctaggtaatagagtgagacttcgtctcaaaaagcaaacgaacaaacaaacaaacaaaaaaccttaggcaacatgagattacaggtggcagttatccctggggatgcaaattgtgttaatttttcttccttcagttttttctcttttctgcaatttggggcagcaagggattttcactttgtaaatgtggagaatccatcatttacaaagaaaacatccatcagtctttctctccttccaattcgtctagttggtttggttctgattgcagaaaaccccccacagcctcaggtgagattctcggtggagcagctgggccaggatgggaggaggcggctgaccctgaaagagcaggtaacggggctgtcacagggctgtggggtggcctgggatggggagcaggaggcaaaagcctaggcgggggatgagcaagtggtagatggagggagatgagatgtagaggtggcaggaagtgggcaaattgtgggtttaactctgaaggtaatagggagccatggagtgtgtgtgtgagcaggagaggcacatgactggactcagatgttcacagactttccctggctcctgtgtgagaaacagagtgtgggggaattgcacagaagccagaaggccaggaaggagataatggtgactgcatttgcctgggtagcagattattgctttaagtcccaaaacaacccattaagtgcagtctgattagtttacagagagggaaactgaggcatagagggagtatctctgttgagacaaaactgacaaatactccactcgttgactttaccatagtcatcttagtcaggtccctaatgggctgttactataaggctgtagcaaaaatcctttatttcctatgttcctctaactcaaattcctcttcttttttttcctttttttttttttttttttgagatggagtcttgctctgtcgcccaggctggagtgcagtggcgccatctcggctcactacaagctccgcctcccgggttcacgccattctcctgcctcagcctcccgagtagctgggactacaggcgcccaccaccatgccgggctaattttttgtatttttagtagagacggggtttcaccgtgttagccaggatggtctcaatctcctgacctcatgatctacccgtctcggcctcccaaagtgctgggattagaggcgtgagcccccgtgcccggcctctcaaattccttttctaaggaaaaattttctgcttgaggtaactgggttaaaagatggaaacatttttgttttcctgaatgtcagtgggttttgtcaatttcccacctccctcaagctagatgtgtgcgggaggtgaatgcctgtctcacagcagctttgccagcattgaggtttattattcttttaatttttgatgcatgttattggctgtggcctttgtccaagtctgtcttcataggctgtgccctgctgtctgcctatgggatgatgagtgtgatcaggtacccacaagctgtctttcatactcctgacagccaacccagctggagcttccagaaggctgtcaagggctggcgcctggcacggaggtcacttaccgactacagctccacatgctgtcctgcccgtgtaaggccaaggccaccaggaccctgcacctggggaagatgccctatctctcgggtgctgcctacaacgtggctgtcatctcctcgaaccaatttggtcctggcctgaaccagacgtggcacattcctgccgacacccacacaggtgcctcctctgggtggggagggcggtatgagggcccctcagagctgagcacctactctgagcctcagctagaccagggtgagaggagcgaggcagaaaattttaaaggagtgcctgatttaggggtgtatcaaaaattcagtaatcagccaggcacggtggctcacacctgtaatcccagcactttgggaggctaagacaggtgaatcacctgaggtcagcagttcgagaccagtctggccaacgtggtgaaacccagtctctactaaaaatacaaaaattagctgagtgtggtggctgtagtcccagctacttgggaggctgaggcaggagaatcgcttgaacccaggagccagaggttgcagtgagccaaaattgtgccattgcactccagcctgggcaacaaagagcaagactgtgtcaaaaaaaaaaaattcaataatcaagatccataatgcagttttttgttgttgttggtttgttttttttaagagacagagttttgctatgttgcccaggctggacttgaacttctgggctcaagcaatctttctccctcagcctcccaaatagctgggaatataggcatgtgccatcatacctggctattatgcattattaaagaacaacaacaaaaactagctgagccactgcgctccaccctggttgatagagctacactctttttcaaaaaagaaaaaagagagaaagaaagaaaaaaggctagagttgaccctgtgtttatttaagatctaatttcttttttttcttgtgacagatggcatgatctcagctcactgcaacctccgccttccagattcaagagattctcctgcttcagcctcccgagtagctgggattacaggcatctgccaccatacccggctaattttgtatttttagtagagacggggtttcaccacgttggccaggctggtctcgaactcctgacctcaagtgatccacctgccttggcctcccaaagtgttgggattataggcgtgagccaccatgcccagcctaatttttgtatttttagtagagatggagtttcaccatgttgcccaggctggtctcaaactcctgccctcaggtgatccacccacctcagcctctcaaagtgctgggattacaggtgtgagccactgtggccgacctactatttttattatttttgagctaggttctcagtctgttggcagactggagtgcaatcatggctcactgcagccttgaactcccagactcaagtgatccttccacctcagcctctggagtagctgggactacagacatgcaccaccacacctggttaattttttatttttattttttgtagagacaggtgtctccctacgttgcccaggctggtctcgaactcctgggctcaagtgatccacccatctccacctcccaaagtgctaggattacaggcgtgagccaccgtacccagcctggtcccatatcatagtgaaatggtgcctgtaaagctctcagcattggcttggcacatgcagttggtactcaataaacggctgttgctatccccagaattgcaagcagtatccatctctctgacattcatgaagacgccctggcgggagggagtgggagagatttgcccagggactgagtgggtgtgtgctcgtgcttctgagtttggcatgagaccaccagtggcgccggtcaggccagggaggcctagtcttgcatcacactctccgcctaggctaggcaagtggtgggcagccaggtatctgccacagccggagacgcctacaaggctggaagtgggtgtaatggcagtacaggaagctctcatggtgaatatcctggcaaggagacagcagttaggctggaggaggactcagctcattcaaacaccacctgctgactggatgcggcggattatgcctgtaatcccagcactttgggaagccaaggcaggtggatcactggaggtcaggagttcgagaccagcctgggcaacacggtgaaaccccatctccaccaaaaaataataataaattagccaggaaatggtggcgcatgcctgtggtcccagctactcaggaggctgaggcaggagactcatttgaacccgggaggctgaggttgcagggagccgagatcatgccactgcactccagcctgggcgacagagcaagaatccgtctccaaagaaaaaacaaaaaaaaacaaacgccatctgctacccactttgtgcctggccccaaggcagcctccagtgcagggaaacagccaaacacagacacccctggccctgtagggtcaggggtatagacgagagggtgggagagaggctgcaggagccagagaaggggactggggagagagatggcaactgtctcgatgcgtctctcccctctccttccagaaccagtggctctgaatatcagcgtcggaaccaacgggaccaccatgtattggccagcccgggctcagagcatgacgtattgcattgaatggcagcctgtgggccaggacgggggccttgccacctgcagcctgactgcgccgcaagacccggatccggctggaatgggtaatggcctggaatggcctgcgcctacccctcctctgtgccctcccttttaggtcctggtgggttcaaacctgcagggaaggcacacagcgggtgtctaaggcccagagaggtgttgctgcttactcaatgtcatacagaggtagggacagggtgaggttcggagcctctcacccatatgggtctggaacctcttgctggcatcctgagctcagttccaggcagatcacacacatacaggtaatgaatctcacatcccaaggtgtttgttaaatattcaaccgcgccagggaaggtggcagttcgcgagatgctggtggcaaattaatgagcagtctttagggaaaggggggccgtgaggctcaggtggcctctcactctcccgcttcctgctctgggccttgccagagccccagaaagcctcagcctcagcctgttccttgaagaatacacagcctgaggagacagaactggacacggaacccctgaccccattgtccgggcaaggtggctaacacctgtaatcccagcactttgggaggctgaggcaggtggatcaacagaggtcaggagttcgagaccagcctggccaacatggagaaaccctgtctctactaaaaatataaaaattagccaggcatgatggtgtgcacctgtaaatcccagctactcaggaggctgagacaggagaatcgcttgaacccgggaggcagggattgcagtgagtcaagattgcgctattgcactccagcctgggtgacacagcgagactccatctcaaaaaaaaaaaaaaaagaagccctggttccatggagtaagggctgggttagagggggatggggatggggttgggggtgttgcatagggaagagatcttggaggaggggatattggtgcaagggctttgaaacatgagtaggagttttctgggggttcctggcagatggcacagccagtgcaaaggtgcagaggtgggaacacaatctactgaatggcctggcctttgcttatccttccagcaacctacagctggagtcgagagtctggggcaatggggcaggaaaagtgttactacattaccatctttgcctctgcgcaccccgagaagctcaccttgtggtctacggtcctgtccacctaccactttgggggcaatggtaagtgacccaaacctgcaggtttacattattttttctttttaaataatttaaaaaaatagaggctgggcacagtgactcacgcatgtaatcccagcactttgggaggccaaggtgggtggatcacctgaggtcaggagtttgaaaccagcctggccaatgtggcgaaaccctgtctctactaaaaatacaaaaattagccgggtgtggtggcgggtgcctgtaattccagatacttgggaggctgaggcaggagaatcgcttgaacccaggaggcggaggttgcagtgagctgagatcatgccactgtactccagtctgggtgacagagcaagactctgtctcaaaaaaaaaaaaaaaaaaaaaaaaaaggacaatgctgttaaggcagacagaatggctcacccctgtaatcccagcactttggcactttgggaggctgaggcttgtggatcacttgaacccaggagttcaagaacagcctgggcaacatagcaagaccccgtctctacagaaagaaaaaagtttgccagccatggtggcatgtgcctgtagtcccaactactcaggaggctgaggtggtaagatcacttgatcccaggagtttgaggctgcagtgagctatgattgcaccactgcaatcatacaacctctgcctcccgggttcaagccattctccttcctcagcctcctgagtagctgggattataggtgtgcactaccatgcctggataattttttgtatctttagtagagacagggttttagcatgttggccaggctggtctcaaatgcctaacctcgtgatccacctgccttggcctcccaaagtgccgggattacaggtgtgagccactgcgcccggccagcattgtccattttatagataagaaaactgaggcccagggaagggaaatgacagtgactgagtggcagaaccagaattaaaacccagctcacctgactctgtggccaatgttacctccgtctctggacagtgggaggctgggcattcaggaagtgctcaaccagcactccttttttttttttttttttttttttcttgagacagagtcactctctgtggcccaggctggagtgcagtggcacgatcttggctcactgaaacctctgcatcccgggttcaagcgattctcgtgcctcagcctgccgagtagctgggattacaggcgcccaccatcatgcctggctaatttttgtagttttagtagaaacagggtttccccatgttcctcaggctagtctcgaactcctgaccttaagtgatctgcccaccttggcctcccaatatgctgggattgcaggcatgagccatcgtggctgggctttttttttttttaaagacagggtcttgctctgttgcccaggctggagtgcagtggtgccatcttggctcactgcaacctctgcctcctgggctcaagtgattctcctgcctcagcctcctgagtagctgggattacaggtgtccgccaccatgcctggctaatttttgtatttttagtagagaaggggttttgccatgttggccaggctggtcttgaactcctggcctcaaatgacttacccacctcggcctcccaaagtgctgggattacaggtgcgagccactgtgccaggcctcgaccagcattcttggtgttgactatgacaatggtactggttgcagcctcagcagctgggacaccgcaccacgtctcggtgaagaatcatagcttggactctgtgtctgtggactgggcaccatccctgctgagcacctgtcccggcgtcctaaaggagtatgttgtccgctgccgagatgaagacagcaaacaggtgtcaggtacgtgaggcagtgcagacctggcttggggaggaagggaggatcctggcctgtgatctctcttgctgtgtgaccctgggcaccttgccgtccttctctgggccttggttatcaaacccttaaaacaagagaattggctgggcgcagtggctcacgcctgtaatcccagcactttgggaggccaaggcgggcggatcacctgaggtcaggagttcaagaccagcctgaccaacttggagaaaccccgtctctcctaaaaatacaaaattagccgggcatggtggcacatgcctgtaattctagctacacgggaggctgaggcaggagaatcgcttgaacccaggaggcggagattgcagtgagccgagattgtaccagtgcactccagcctgggtgacagagtgagactctgtctcagaaaaaacaaaaacgaaaacaaacaaacaaaaaacaaaaacaagagaattagacttgagggtctttttttttttttttttaattttatagacagggactcactctgtgcccaggctggagtgcagtggtgccatcatagctcacagcagcctcaacctcctgggctcaagcgatcctcccacctcagcctccctagtagctggaaacacaggtgcacaccaccatgcacagttaatattttattttttgtagaaatgaggccttgctatattgcccaggctgggattttttcttttttttctttttgagagggagtctgtctctgtcacccaggctggagtgcagtggcgccatctcagctcactgcaacctctgcctcccgggttcaggcaattctcttgcctcagcctcccaagtagctgggattacaggcacccaccaccatgcctggcaaatttttgtatttttagcagagacggagtttcaccatgttgaccaggctggtctcaaactcttgacctcaggtgaatcacccgccttggcctcccaaagggctgggattacaggtgtgagccaccgtgtccggcctcgctcaggctggtttcaaacttctggcctcaaactatcctcccaccttggcctcccaaagtgctgggattagtcatgagcacccagctgaacttgagggtctcgatcaccccttgcagaccctggagaaggctgggtgggcaccagccaagtgcttatggtgtattggattcatccatgggaagctgcccctcacatgtagcagcagctgaactctcatcaagcagggatgactgtctccattccacagatgaggaaaccaaggcctggaggggggatctgatgagggacaggaaagcccacaaaacagggtttagccaggagggtttttggctttccccaggaaagagttcaagtgcatgtcggtggtgttagacagaaacttttactgaagtggccgtgtagagcagcagcagaagtcctgctccttgcagagtggggacgccccacaggcagggcagctacgtctcatatttatacccgcttttaattatatgcaaatgaaggggcggtttatgcagaaatatctaggatgaaggtagtaacttccgggttgtgggatcattgccgtggacaggggcggtaatttccgggtgttgccatggtaatggtaaactgacatggcacactggtgggcgtgtcttatggaaagcccaggacctgctttagctagtcctcagtttggtcctgtgtccaagccctgcctccagagtccaatcctgcctccaacctcagatccacctgcccaaagatccaacaagtcagccggacgcggtggctcacgcctgtaatcccagcactttgggaggctgaggcgggcggatcacttgaggccaggagttcaagaccagcctggccaacatggtgaaacctcatgtgtattaaaaatacaaaaaattagctggctatggtggtgggcgcctgtaatcccggctactcaggaggctgaggcacaagaatcgcttgaacctgggaggtggaggttgcagtgagctgagattgtgccactgcactccagcctgggcaacagagtgagactccatctcaaaaaaaaaaaaaatcttgagatgaatgggcgcattaagagaagagattttaggttgggcttggtggctcacacctgtaatcccagcactttgggaggccgaggtgggcagatcacgaggtcaggagatcgagaccatcctggctaacacagtgaaaccccgtctctactacaaatacaaaaaattagctgggcgtggtggcgggcgcctgtagtctcagctactcgggaggctgaggcaggagaatggtgtgaacccaggaggcagagcttgcagtgagccgagatggcgccactacactccagcctgggcgacagagcaagactccgtctcaaaaaaaaaaaaaaaaaaagaaagaaagagtagagattttagcaaaatgcctatgaatccccaccccacccacaggctgtggtagcccagcctggcctctgaggagtaaagaggtcccaggactcagggttgcctctcccactgcagagcatcccgtgcagcccacagagacccaagttaccctcagtggcctgcgggctggtgtagcctacacggtgcaggtgcgagcagacacagcgtggctgaggggtgtctggagccagccccagcgcttcagcatcggtgagtggagggggtaggacccagttatttacccagcatgcactgcactgcgcttcccacaatgatcttagcagccctgccctcactctcactccctctatggctccctactgccctcaggagaaagtagcagctcaaactgctcccattgccttctctcgcagcttcctctcacactccaggagccttgcccatgcaggcccttccctgcctcctgcctggaatgtttgttttccacacggtccaactcctattcgtccttcaaaactcagctcaaaagttccctcctccagcaagacttctctgcctccttctggccatgcccttgtttacaactgtcccttctccctggtctgacactgcggggttggggtagatgtgtcaaggtatctgggggctcttggggaggaggaagatgcaggaatctgttcattgagcgacaaataaatgaatgcaaaaataaggaggacacaggcaaaacccggtgtggtggctcacacctgtaatcccagcactttgggaggctgaggctggaggattgcttgagccgaggagttcaagaccagcctgggcaacatggtgagacctcatctctacaaaaaatatttttaaaatagtggggtgtggtggtgcacacctgtagtctcagctgctcaggaggctgaggtgggaggatggcttgagaccaggagttcaaggttgcagtgagccgtgactgcaccactgcactctggcctgggcgacggagcaagaccctgtctcaaaaaaaaaaaaaaaaaaaaaaaaaatagaagaagaagaaggagaagaaagaagaagaagaggaagaggaatagaagaagagggaggaggaggaggaggaggaggaagagaacaacacaggctctgttgtcgggtgcatggttataagagattcagagatcaaatgatccctgttcatgccacggtgtcctttcagttccaagagaaccaactggaacccagagaacaaaagagtcagggttggtggggggcaggcaggcctgggtccaggggcagccacatgtgccctatgtgcaggctcctggaattacagagtctttttttatctttttgagacagattttccctcttattgccgaggctggaatgcaatgatgcgatctcggctcactgcaacctccgcctcccgagttcaagcgattcttctgtctcaccctcccaagtagctgggattaccggcgcacaccaccacgcccagctaatttttgtgtttttagtagagacaggtttcatcatattggtcaggctggtctcgaactcctgacctcaggtgatcagcccacgttggcctcccaaagtgctgggataacagtcatgagtcactgtgcccggcctggaattacagagtcttgaacacttcctgcatgccaggcctttatttcttgacagctaccgggcaggtgggttctgtggtctcccagtgagaagcccgtggcatgtgcaccaggatcagcagcaagttcatggagaaaccaggccctcctagctccttccctgaggaagaggcaggaggtagccctctgccaacccacgctctcccacctcagaagtgcaggtttctgattggctcatcttcttcgcctccctggggagcttcctgagcatccttctcgtgggcgtccttggctaccttggcctgaacaggtaactgacacctcttaccgttaccatagcgatggtaatgatgctgggcaggggagccctaaagtggagcttagcccgcagattgggtccttggctttgcccaggaaataattcaagggcaagccagaggtagaagaaaacagctttattgaagcagcagttatagctccgtgactgcctctgcagagcagggcttccctgtaggcggagagtagccgctgagagcggttttgcagtcagatttatacttacttttaattgcatgcagattaaggggggcagtttatgcaaaatttctttcttttttttttctttttttttttcttttttgagatggagtcttactctgttacccaggctagagtgcagtggcacgatcttggcttattgcaacctccccctcccgggttcaagccattctcctgtctcagcctcccaagtagctgggactacaggtgcgtgccatcacacccagctatttattttgtattttcagtagagatagggtttcaccatgttggccaggctggtcttgaactcctgacctcaggtgatcctatgcagaaatttctagggaagggatagtaacttttgggtccttggtcattcccatggaaaggggcggtgacactggtgggcatgtctgattgaaagctgctttcaagccgggcacggtggctcactcctgtaatcccagcactttgggaggctgaggcaggcagatcgctttaggccaggagttggacaccagcctggccaacatggcgaaacctctctctaccaaaactacaaaaattagccgggtgtggtggcacacgtttgtaatctcagctactcaggaggctgagtcaggagaatcgattgaacccaggaggcagaggttgcagtgagccgagatcgcgccactgcactccagcctgggcaacagagcaagactccgtctccaaaaaaaaaaaaaaacctcagctcctctcactggtcccctttcctccccagggccgcacggcacctgtgcccgccgctgcccacaccctgtgccagctccgccattgagttccctggagggaaggaggtaaggatgccttttctaattccaagtctttttattgggtgcacacgctggacaagggttacgcattagctcattttattctctcccaattcatcaaggtaaggactccaaaaccagtgctccataccccttcccattttaaagacaggcaggcagaggtccatttcctggcactagaaacagaattcaaagtggctttattataaaggaaacctgatggaaaaaatcccaagggaatgggcttcagatatgcctgaatccagcgattggggtctatctcggagctgcccgttcagggttcttccgcaggcaggctgagccttctctgattggaagcagggtgtccattttccccattaactggggcaaaagtctcagggccatcactgattggtccagcttgggtcacatgcccttccctgagcctatggctagaaccagaggggtagggaagggtctgatgggtgggctggccagggtcacatgaccattgctagagctgaggtggggtcactgcactgtcaaccacaccatctgtgaaaagagggagggaaatttcccaaagacagatgggagtgctcttcctaagaggggctgaatgggagtcagtgcggcagactccatcctcaaatcggtctcaggatatatggagtctcgctctgtcacccagcctggagtgcagtggcgccatctcggctcactgcaacctctgattcccgggttcaaacgattctcctgcttcagcctcccaagtagctgggattacaggcgtgcgcaaccaagctcagctaatttttgtatttttagtagagatggggtttggccatgttctccaggctggtctcaaactgctgacctcaagtgatccacccgcctcagcctcccaaagtgctgggatgacaggtgtgagccactgcacccgtccaggtctcaggatgttagagaatttaaccagcagtgacctggtccgttccatcctgctgtggatgggaagtagagctctgctcacagctgtggccctaccctccctctgcagacttggcagtggatcaacccagtggacttccaggaagaggcatccctgcaggaggccctggtggtagagatgtcctgggacaaaggcgagaggactgagcctctcgagaagacagagctacctgagggtgcccctgagctggccctggatacagagttgtccttggaggatggagacaggtgcaaggccaaggtcctggggcccagtgggccagacggtcaggggtgcaaccctgcccggggggtgggggggctagacatccatcgctcctgggatatcagggcctggaggcctgagggagaaacgaaaacatccactttgtcttacagacacgaagagcgactatctcaatcacaacggctggttattaagcacttatggcatacccagcccattccatccactcacatgattccctaccaaatccctacaaccaccccctgaaaggaaccatgactgttgtactttacagatgtgatcgttgaggctcagagagggtgagtgactcgcccgaggctacgtagcacacacaggagtcacatttggacccaaataacccagagctcctccaggctccagtgcacctgcctcctctctgccccgtgcctgttgccacccatcctgcgggggaaccctagatgctgccatgaaatggaagctgctgcaccctgctgggcctggcatccgtggggcaggagcagaccctgccatttacctgttctggcgtagaatggactgggaatgggggcaaggggggctcagatggatccctggaccctgggctgggcatccacccccaggagcactggatggggagtctggactcaagggctccctgcagcattgcggggtcttgtagcttggaggatccaggcatatagggaagggggctgtaaacattgtgggaaaaatgacggtcctcccatcccaccccccaccccaccctcacccccctataaaatgggggtggtgataatgaccttacacagctgttcaaaatcatcgtaaatgagcctcctcttgggtatttttttcctgtttgaagcttgaatgtcctgctcaaaatctcaaaacacgagccttggaattcattcattcattcattcattcattccacatatatttattaatctcttcctctaggtctcctccaggagcacctaatccgggggagacagagccggatgagagcttggaaccctactaagttaggactgagcaggggaagggacggcctagggggagtggagcagccgggcactccggtaacaggaaccgtggtttgcccccacgctccttcctcctcacgcccaccaactcgcagcaggacccttgccccccttacacaccctgaatcctccctctttctgcccacactgccccacctccctcgcgttctgcagccgcctccccctgatccccactgcggtctgagccgaggtgtgggggggggctcctgaaatcccaccccagccctggcgattagcgggtagtccagattctccccatggccaccaggtggcaacagcggcgcgcgtttccccggccgggcccgccctgcctcctcccaccgcgtttgctaaacagacttttccggtttcagacagaggaggggagttaaaaagcccagaactactgaattttgtggcaaaaaaaggatgagacctctcggggagagacccctggcagccaatagggccaggaggcaagaggcccaggccccgcccctttggtctgggggcctccctttccccatcgatgcatctagatagggaaacagaggcctggatctcggtgccccagccacacggtggctggtcagagttctgcaaatgccccccgccccgctccggatctgccacatcccagcttctgctcaagccgttccctccaccaggcatgccctcccttgagcgtttatcctcctttcttttttctgagacggagtttggctcttgttgctggagtgcaatggcgcgatcttggctcacggcaacctcccgggttcaagcgattctcctgcctcagcctcccaagtagctgggattacaggcgcccgccaccctgaccagctaaaatgtgtttgtatttttagtagaaacagggtttcaccatgttggccaggctcgtcttgaactccagacctcaagtgatccacccgcctcggcctcccaaactgctgggattgcaggtgtgagccctggaggcccctggagttggccgcaaacccacccctatgcacagtcccttgggtgcgagaagtaggagacaggcaatgtttactggcagcagctgggacttttgccagagtgcatggggaagatgcacaccctgcttccactagcgggagactgagctggacagagggaagcctggagcttggagcctctttccttcctaccgtggggatgcctgtctgagagaggagcctgcagggaggacagcagcaccgagatgaagcattagttcctggatccagccatacctgaaacccaatattttccatctggttcctctttttaaaaa

SEQ ID NO: 15964 - DNA, 90618 bp, Human
caaggtcactatgaggactcaaaatgctcaatgcgtccctgcttgcggaggcgaggcttgctcagagtcaggagggcaggactgtctcaggcagtgaaaggaggatggggctgggcacggtggctcatgcctggaactccagcactttgggaggcagaggcaggtggatcacttgagccccagactttgagaccagcctgggcaacatagtgagaccccatctctacgaaaaaatacaaaaattagccgtgcatggtggcatgagccttgtagtcccagctacttgggaggctgaaataggaggattgcttgagcctgggaggtcaaggctgcagtgagccatgatcataccactgtactccagcctgggtgagagagtgagaccctgtctcaaaaaaaaaaaaaaaaaaaaaaagcagatgagctcccaggatgccggccctgagctggcagccatgaaggcgcttgcctccctccacttcctagggtgcagtgtgggtggggcgggggcagctagggagtcctccgggctctgccgagccccttccccagtgtgaagtccagcctgttctgaagtcgcacagggccagacacctgggctgccacctcccctctggaaacagtcctccttgcctcggtgggtcgacagctccaggctattttcttcccctgaggatctgaaagttggaggtaattggttggctcaaaaaaaaaaaaaaaaaaaaaggaaaagggcatgcaagcacaattgtgcaggctgcaaaggagggaggcatcctagggcttcgtctccatgggaactactggcacaggctggctcctctgggctccaaaaagggaaacttggcaaaggtttcaggcacctggctcctgagtggtttgcttgggggccaagcaaatgcccaggagctgcccgcccaagggacaggacacagccccctctctcagggatgcctgggagccctcggccccatccttcaccctcacaccccaggagatcccgtcaggtcctcagccaccctggatgcatcctgacttgggagctgggaggggacccagcacagctggagagcatgagcaggtcatgctttggggagacacccgtgcttcgaggccctcggatgggtgaatgggaggtagttaataagggacagatgaaagaggtggaaggaccctgagtgtcaccctgctgatgtagccctggtggctgttgctgtttctaggatgtgagccccagaccagcaccttgcagaccagcacctcaggccaggaccctgagagaggacgcttcagatgctgggtgcagtggctccctgctgtcctgggggccccttgggctgagatcatcataagggtggcactgtcctgtgtgtgtgaagagtggcaggcgggactggggcagtgggggtgtcctggcttgttctggaaaatacctccaggaatgatcccttccttttccacttccacagtccctcctgggcactctgggttcaactgctgctcctccccacttcttggggcagaaactcctgccctgaactcccctctccccagccccagctccctgcaccctctacccccattcctccttggtgaccaaaaagggcaaggagcagagaaagaggcagcgggcaggggaggcacagagagccgctggtgacagggtaggggagaggccaggagagccagacagaggcttggacaggctctgagagaccaggattaggggccatggagagagagagagaaagaggggagagagagagagagaaagaggggagagagagagagagagagaaagagagaaagggagggagcgaggaggcagaggggtggagcgatagaagccggcagggaggaaggggtgggcagggggagggcgagaagccgccgttgacaattacgtctgggtccaagcaaacatgaggcagctgccagccggcctgggcagtcttgtctgcctcggctgtgaagtggggaggctggcaacagttttcttcagcgcccaggatgcagccggctaaggtaggtgctgggggaatggggtcttgctctggaggggggtgggggggaggaatggaggcttctgggggttgctctggaccaggaagcctttttctttgacccttgtcccctcttgttccactttcctttggggaaagtgagcgttggggcgtcctggctggcgctggggtgtcctggctggtgttggagtgtcctggctggcgttggggtgtcctggctggtgttggggtgtcctggctgggaggctgaactcctagggctccctttggatgggagaggtttataagtgtttgcggaagaaaagctggacagaggaggagcttggggtcagcccacgactcatcctgctcagttaggtccctgggtcaggtgccagcgtggctgacactgagcccgggccccacagccttcaggtttgggggaggggtgagcctgggagggagtcacttgtgcttggaggttggtcaatgaacgcatcttctaatcaagcaatcaagtaacgaatgagtgcccacttcctctgaaagggctaggagcccctaacaagagcacttcccacacattccctttcagtagggctgtggggaggtcagagagagaatgcaaggaaaacgcctggcacagagtttgagaaacagtggtggggaacagggaagggtgaagaattaaaggaggaatgagggaaggagaaataagctggccctccagcctctagctgactctcaaaaggtctggcctgatgccctgtgagctgctcacacattcaggatagttcaggactaggtctggctgctcataacagaacgccccaaataacagtggatggaacaaggttagcggggtttctctctcatgcagaagtccagaggggcagtggagggctggcttggaggccgcctgatcagcagcatttcaggcctgccctgtatcacccctgaggttaccttaaggtgcaacataactgctggagctccagccagcacacatgggctcatactgacatatgagcaggaaggagaaagaaagaagggcaaaaggacccagagacaatcagggtcttgaatgtaggaaagaagggatatggggttggcacctcagcgtctctgccctgaacagatggcttcctgcctctttcatctgtgaggacaagcatccaagcatgggcgggtggctggcttggaccacactgcccccaaaccccaggcctcccttgtgctatctgctccatcttccagggtgccaagaggatcagctgaggtgatggcatgaagccctttgagcatggcaacactacacatggaaaatgtgccttctctcctgtcacctcaagtctccccagcaaccaccatgcaggcagggcagagtggagaaacgtagcgccttgccccaggctcacacactacggcgtcagggtgcacagtgcaaccgtgcccataggcagagacacattgagcgaccctgcatgactacagagatgggaatttccagagtcaggctgcacacagatgtgcacacagccagctctgacctccagcagaagacagtcctcccctcctttgcctttcctctgcgggccttaactgccaaaggtcactctgggagcttggccactcctgcccctgccagactggcagagtgggtggcctgagtcctgcacttacatctggttcttcccttggccattgtgaccccacactgcgctctaccctcccacaaccagctcctgggccccagtgggtctcactgtccttatgtctgctggtggccttcctgtggctggcctggccagggaggggagtgggacccacacctcctggtgctgggcccagcagagacagtggtcctaggagaagccaccattaggtttctcatcaagatcaatgggagattgtgaaaaataaccttcctctcttgtggcagcagggactgtagtcagagctcaggttgggaggtgttctgactcctcagggtcacggtcagtggctgtcccccagtaacgccccatgactgcccggctccctagcctactccccagccattcatgaattctcacctcactcctatggggaggcggggaggcactgccattcctattctagacactgaggctcagaaaactggaacagctccaggactccatgagcttgatcccatgagctcttaggagaaaggagcgaaagacccgcagtttctgcgacaggcgctgctgtcgcggtgttgaggctgtggtgtcttcacagctcagcccgtgcactgggaaccccttttgcctggcttccagccttgttgcagggcactgtgcgagatgggccctaatttgctcccacatttcaaaagaccccaggctgcactgggaagaaaggggctctgcctcagccctccaggtagagcccaggagaagggcagagctgagagccagaagcctgagggtaccaacgcccatctaggacattgtctcccgcattatctccctggaccctcacgcagcccacaaggcagctgttggtatcatccccacttcacagatggggaaacagaggcctgccccagactgcaggctacaagagttgtggctgagatttgaaccctgctctgtcttactccagagcgcagcaagtccctagggcttgggggttgcggaagaagacgcaggaggagaagggcatgcctttaaccagatggcagaggaggggcccatcccagccgtgcggccggtggtctgttgtgccctctgagccctccagtgagtgcacacaagccagactccacctggccgcatcccctgcgttagccacgtgacctggagctagctgcctcccatttttggactgtggatccagagctaggaaggaaaggaccccaacattttaaattcaggctgccttgtcttatcaagaccttctgtgtgaggcagggaactgctttactgacttagcagaggggccttagagcccccctgccctccccagcccacccctgggcatcccagtgacttccaggagcagccaatgtggcttctgcacggaagaaagcactctcagtttccaaggtgaagcagaagaggggagagaagttagcacgtctttctggcctagtgcccagacctggggcaggcaggagcctgagagtcgcatggggcgagtcccgtgctgcttcctgcccagggctcccggcctcagctgactgatgttgcctttgagcaggtgcgtctgtcatctgagatcagcccatgccttagaaggccaaagagcagccctgtggcagggaaagaagcaaggggacctgcagagttggagagggagcagctgagctgagacgggagggcagcgtgggggtggcgtgtcccacactagagtcggcccagcctccccctctgacctgccacctcagctctctgcccagcatgccctctccatcagcctggccatgcctgggccaggctcagccaggaaaagcagctgctggtcttttctggcctcacctcccagcctgcccaacgcccccagccttccccagcctttatcacatggacagtgggcagatgccagggtaggcaagggacaagtcccctgcatcccagtcctctgctgctggtgccacatgcccctgtgcccagctctgtcgtgggatcctctctcaagatgggcactctggacagtgctcccagagaaccaaactgtagccccacctctgccccactgactcagggcctcagtcttcccatctgggtctgagagatgctcacagcatctgccaggccttgtgatgagcagtgcagggctgggaggcacgggcctggctgactcaagtcagggccactgccagcagtgccccacatgtgcacacaaatgtccatgggtcttgcgcagagccctgatcctcactgtgcgggactaaaggaccccgggcaggagacaggcatggccaagaggcatcatggctgtgccttgttggctgtgagccctgactgcaccagcagacctgggctcagtccaggccctgtcacacactggctgtgtgtcctctgacaggttacttagctcatctgtgccactgtgtcctcattttcctgggggaagtatgaatatcacagaacccccagataaatgtgatcctataccaaccagcttggcctggcccctggcacagagtgaggcctccacacatgaagggaatacctatgccatcccttctgactgttgaggagagcctgggaaggccaccaagaggcaatttggccatgggcaactcaagttcacccctgggttaacgtgacaccctcactgccaggcagcatggggagcttgtccttgtcaaggtggcagccatcagagcaggggtggacagcccagctctcctgctccagtgctgccagagggctggggcccagggctgtgtgtgtgtgtgtgtgtgtgtgcgcgctcataggtgtgtttgcaggcatgtgtacgtgtgtgtgtatgtgcatatgtgcacacatgcatcttcagggactcatgacaacctcggctcccccgacaaggcgagctgccttgcctgtgtctgtctgtgcccaggggtgggtggagaatccaggctccccaaagcttccccattccataccctggggcctgcacgacacaacgcccaccactgcttcctgccatctgtcccgagtgatggaaatagagccagtgacagcaagcagtgctgggtgggccagtctgcaccgcagcagccgtggacagggtggggggtggggagccccacatctgagtagcctggatgtctcatgctggccctggcctcggtgaagcccttccggaaaggaagggggtgagaatcgggggaccccctttgcctttcaggcaaggccaagaattttctatctggagggacagacactctaaacaaattccccaagctgcattttcagatctattgaggagctttataagaacagagtagcccagccctctctgcatcaaacaatccagctcctgggcaggcagatggtgggagcctccccacgtgattctggcatgtggcagctgagagcggcacattgggcctccctgccaggcatgctaggctgtgggtttggacagccagaccctccctgggatcagaagggcgaggaacactgactctcccccactgggggctttgtcaccttgccttccccttaaccctgtgagggcacattgtcacccccattttgcagatgagtaaactgaggctcggagctgtcaggttctctgtcagggtcaccgagctgggaagcgagggtgcgggattcatgtaactggttggccacagacccctcccactgtcctcggctgctggaaatcacatccacctgccttcgatctcctgccctgcccccaactagccgtgccctctgagcccacacccaggggccctggtggcacatacgaagccactcacttctgttttgcatccgttaagtctgtagacatctgggaggagtcagcgatgcatcttgcccatgcatgtactcctagaacgccacccgggagcctggatactttaacgcaggttttccaggacccccacttctcacaggctgtcatgtgccccccagtcacctctgccacatctgctctggaaggctttctgggagtttctctggagcacagttgatgagaaccatggagactgaactagcggctcgagggtttcaccttggcacactcctgacagtctgactccatcttctcagccagatgggcctcctcaagacgaagctgtgccatgctgggcatggggcaaggagtgggacgctgctccgtgggccacctggcctctcaggggacctacagtgtagggagccacgaggcaaaatgtccggtccaggtcctggaggtttgttccaagtgctcagcctctgtctgtggtgtggaaactctcgggatgatggtgtggtgtttgcggcagagactggactgtgttcagggggagaggaaggcatgggggacagccctgcctcctacattcccgcagtgacagttttctcaggcactgggaagtcgccgcccctccctcactggccacatctagagtaggtcctgagtacctgtctccataatatccccagcacccagccatgacctccgcctggctcagccttcccccgctctcctgggcctgggcatccctcgcctcccccagatggccgcctgcctcatcgaacccccaatctgatctgcacattccaccaggccacccttctgaggcagctgcgagtccagctggacttgagtggcagagagcagctggggcggctgtgccctgccaggaggatgctgccccaagcctgccggctggcaggtctgagaaccatccggatcagtcctgtccaatagagacatgatgcaagccacagatgtcacttaaaatgtgccagtaggcacagtaaagaaagaaaaaaaggttaaattattttaaccatatgttttattaaacccagtgtaaatgattatcatttcaacctgcaattgatataaagcatttttaatgaactatttgatagtctagtaagtaaatgtttggaacccagtgtgtgtttacacgagggcacgtctcagtgtggaccagccacatgtcagtctcagcagcctggcgagaggccgccgtcactcagacttgaggggtcgcctggctgagtcgaggaagcccccagcctcagccacagagagaaacatacacttcctgcctttaccgttttgctgtatctgttgtgacctgtgctattgtttcttattatttttctttaaattaactcatgcattgaattttagtgaattcatttaaaagggaatctttaaatcagtactgtaagtgggaagccgggagcagaagtggaaggtaaccaccacattgccatgaaataaggcagcagcgataaactcccacccatggtctgtggcctgttgaggctctgagctgaggccgtgccctccctttgtaaagagaatggcagtggggagctggagagtgtgctggccccgagtctaagtcatctcctgcacctcgtaggtgcagctccccactgccagagacctcaggccaaagcccccaggacgcagctgactcagaacaggctgggtttacccctgttgaataacaggagaacgcataccccagggaccctggcaaactgcatgagaacgggtgagctagaatccattaccggatttggggctcagttgggtgctttgggtaattttgaggttctaaggaacctcaaaaagttggtgtgaccattaaatatgataacccctccaaacaactaactcagcaccagcacacagcaggggcatcacccacgccatctttttccatccctccctggctccccacaggccaggaggacttagaaggaagttgaggcctggtcctggcctgcctggctgggcaggagctacagatctcggccaccaggtgactggcagagaatggcctgcctggctcaccagcagcctctatccttcagggaaacttgtgacctttgagaaggctgcaggtccccagggccagcctagggccgtttctgggacacagccctaaatgcccacactgccaagtatgccaccagggactctgcctgaacccagggcccagatcttctggcttcactcgtctctgccactcaaccctggccatcctctaaagctggtagacaatgacagttctgtcacccattaaaatgaggccggcatcgagcaggagtgggaggagagagtcccaggtgaattgtgaagagcacaggggacttttgatcattcgtgaatatttattcagagccttgtgcatgcttgcgtttttaacaccttctttttgggtgcatgagagtattttttgatggaaatctttattgagctcgttgtagattcacatgcagttgcaggagctcacaaagagggcccatgtacacttaacctggtttccccaatgacagcatatttcaaaactacaacacaatagcacaactggagtgtctgcaatgatgcaacccaccagtcctagtccgatttcccagttcacacgcactcatttccgtgtgcattttttgctacaatttttatcacgtgtaggttcaggcactcaacagcaccatcaagatgcaaaacagctctgtcccctcaaggcccctcctgccgccctgtgagagccacacccctctccctcctgcctgcctccccccatccttaaaccctggccctctaatctgttctccatttctaaaactttgtcattttacaatgttatataaatagaatcacacagaatgtgaccttttgggttggctttttcattcagcgtaattctctggaggttcacgcaggtgtggtgtgcgccaacagtttgtttgttttacttgtccagaattccgtggtatggatgcactggagtttgtttaatcattcacccattgaagggcattgggttgcttccagtatggggccgttccaagtaaagctgccatgaacatttgtgtacatgttttcacttgaacataacttttcgtttcttcaggataaacggccaaaaataccgtggtcgggctctgtggtagcgcatgcctagtttttataggaagctgccagactgttctccagagtggctaaggcgttttccctttccaccgacaatggaggggtgattccgtttctccacatcctcaccagctttcagttgtcattatctttggttctagctgttcggacaggcacatggtggtgtctcacagcggtcctcctctgcgttgccagaatggctaatgacggcgaacatctcttcccgccgcctttgccatccacgtgtcctctctggtgaaatgtctgtgcatgtctttcacattttctaacctgatggtttgctcttttactgttgagttttgggagtgaggatctcttgggtgccaggctgtgtcacgaggaaaagcaggtcacatgaggatcaggttccactctcgcagagctgatgcgctaaaggggagagacagaaaacacaataataggatcagttcacaagggctgggtgaagaagtgctgagatggaggtgcatgggggagggtggcctaggtagtcaggcagggctcttctaggacctgagccgtgagtgaggccttaaacgcctggggcagaagtgtccagtgccaggagcagcaggtgccaaggcggtggtgtgggagcagacttggaggggcacggtggggctgtcagggcctggcaaggaggcactggggctcccggcagggttggggcatctaattcatgttccatctcatcactgccccagcttctctcccagcaccaaggcactgtggggtgaggggccagggggccgcctcttaggacgccctcccttccatgctgtgagcctcccaagccagcaggagggtgcctgggctgctatttaacattccctgacagctcagtcagaccctcttccagacagacaagtgtcagatattcatgaggatgacctcctcccacctccccagcagcctgagggcccaggccgcagcctgatgagtcccagcttcccaggctcggctgctggggtctccctgccctcctgtccctggccctcccctcccttctcttctcagaacccaccccctgcctcacaaagaggggtgcccatcatgggcctgccttgtggggctcacaggtgggattctggcccctcagccagatggaggagcctggcccggaacccccaccaccactccacccagactctctccacagggagaaaagacacactggggccccctagcccaggagggcatcacagcactcctcaacggatatttttggaaggctgctgatgtgcctgaggggcttcggaacacacccagctccagagaccgccccagggacccaggccgagaaacagcctcagcagcaaagcccgtggtcaagcccatgtgaactttggaatcagaagactatatgtgtagtgtggccctggcatgtcccaaaacttctcagggaattagtttcctcatctgtgaaatggggatcgtcttaccgattgcagggggttgtcgtgacgagattactttcagctcaacatagacatccacttgggaggtgctcagcctgccctttgggctcacccagccttcccgggaggactgagccctgtgagctagaacccaggacacccatgggatctcccgcacgacctgggcctggggcttcaagacagaatccctgtgactaaccctgggccccgagaagcagccttgccagccaagccagtgctgttctgagatgggctgcagacggggctgggggtcccagtgaagagctcctgccaggggctccgaggccgcctcagtttcttctgatgtcctctgctcaccccccacgcagagcctgcagcaaagaatttgtgatgtaatgaagcacctgctgcccctctctcccctacgaccctccttaaccaaaataaagactcctgaataagatcatgaataatggagaaagtgcgtttctgacccagcctgacaggacgtgtgtgtgcatatgtatgtgtgagcacatgtgcatatgagcatgtgtacgtgtgtgtgcctatgcatgtgtgcttgtgtgtgcatatgaacatgtgtacttgtgtgcatgtgtgtgtgcgtgtgtgcatgtgagcattgtacacgtgtgtgtgcatagcgtgtgcacatagggagcttccctcagcaccccaggcacccgtccacccccagctctccccctgtttctgctccatcagcatggtcagtgcctcttcttgctgcagctctgggcaccactgagccccctcattgcttggtgagccttggagaaggggagggacgtgcaggggttgttgccaagggtgtgtcggaggaagggtggatgatgactgtgagctggaggactggtagttgggacctagctggggaaggcccaaaagccaggataagggaactggacatctccctgcctaggggaccacttcatcaaacactgactagtgggccagctgcccatcccgaatgtggataggcctcaggggaccatgagccagtgaagcacccagagaatcctcccccagctggagcctgcagtgtgcagagaccagtgggggtgccaggcccatgcctcgggagaggggccagcctttgcagcagcagcagagccctgtcgctgggctctgtgtggacgggcatggccagggctggtgtccggcgctgctctctgatctcgtctgctttccaggactggctctctgtgcttccctgcaggctgtgactggcccgggctccctgctgccaattcttccagttcaaatcaacctgggtcagtctctggctcttgcacctgacagtccaactagcacaggggctgtcttccagggctgcctctgtagaagctgcttgacggccccgtccatctgttatttactttgaacaaccaaatacttttcaggaccgtgcaaaggtagcacacacgagaccctgtgacctgggaagggtatggacaacccaccccctgagtggccctctttactggccaaggaacccaactgctcagaacacatatgcatgtgggggtggtgccactgccacagctggaggtcaggcagtgcgtcacagacaaaatgagggccattggtgggctgtggtccaatgggccagaccacacctgtccccctgccaccccgagcaggagaggacagcacaaaggcagcaaactagacccagcaggtgcacagaggtgtggccagcggcagcctgcggtgcacctccctcctctgtgcctcatgggccagctgccagcatgggaactgagcatggtgggcagtttggatgtcaggattggggggcctgaaatacgttgtaggagagcaaatcctgctgccctggggcctccaccatgaccccaggaggttgttttctgatccacaccgactcaggcacatggcccactgcttttttttttttttttgagacagtctggctctgttggccttgctggagtgcagtggcatgatctcagctcactgtaacctccgtctcccgggctcaagcaattctcctgcttcaacctcctgagtagctgggattacaggcacatgccaccacgtctggctaatttttgtatttttagtagagacagggtttcatcatgttggtcaggctggtctcgaactcctgacctcaggtgatccgcctgcctcggcctcctaaagtgctaggattacaggcgtgaaccaccacgcccggctgatccactgcctcttaatgaccacccatgactcactcctcccaagactctcctgcccatagctggagctgtttcttcagatccctgccagcctcagtggtcggttccaccagtgcagccctcctggggtcaccacccagcctttcattcattctcagcttgcctcagcatgaaaactcaggcagagcaggggccctgctgggggagtgagggagccagacgtggctgtgtgaccctgtacagatccacttgcctctctggttttcaggcagatgagggattgggatcgtgatttctaaggggctgtccagctccgacaacctggcctgtgccaaggtggagaatccaatgagtaagtctgggatcactgctgacatcccctctctgcacccctgtctgcccctcttccaggggtcccatcttacaccatagccagggtgtagagtgaaaggaacctccccaggtctggcaggaatggccaggacaaggggcactaggcatgcagccccggaaggtgagccctctgttgtgttcaggctggcctcatctaggatatcagggcagctcgggaccatccaggggtcccccctctgagcaggggctcagggctgctctgcctgttcctactgcaggaagtgacaaaggcgtcggacggcagcctcctgggggacctcgggcacacaccacttagcaagaaggagggtatcaagtggcagaggccgaggctcagccgccaggctttgatgagatgctgcctggtcaagtggatcctgtccagcacagccccacagggctcaggtaggggccagggtgggctgtggtcaagggtgggggtggggagatctgttctgagcactgtcctttctgagggctcaaaggccagcctgggaccccagcctgggctacatcgcccctgtctctattggaggtgtgttttcattcattcacacccttccccattcattgagtgcctgcttcacacaggccactgagctcccagtgggacccacagagcatgggtacagagagctgggaccacactgcggttttccagttggctaggaagacagagccaggctgcagagtccaacaaaccaggctccaccctgcccactgctcacgccctgagtaagccggggcacctcattgatcctttctaagccttccgtgagaagccaggctggaacctgtccacagggcacatttgaagatgggaaataatgtgtgcagtgcctggtgatcaggaggccccaccctcagcccctccttggtcctgttcagtgcaccccaaggattggtgctggctctttgccttgggctgcattctggtggtgtgttaacgagagaacgggcagaaatcactgccctgggcttgccatgggtgatatttggtgtttgccgagtataacagggctgaacagacaatggcagcctcatgcggcccccacgatctcacacacacattcagacacctcacactcacacctatgcacacacaccggtgcctctaccacacacaagcttgcacactcatcatgcacacataggtaggcataccatacacacttgcatactcacatacacacaccacatgcaggcacccacacaccatgcacactcatgggatcacacatgtgagtatggtgcgtataagagtctgcctctgactttaaggaaaaggtgcagacttgcccttgacagctgcatcttgtttgctctcttggaccctctctagctgtgtgatttccagggagcgtttgtcccctggccaggagaatgggcatgatcggggtcccagcctcctaggcttgatgggggtcatgagtggaggggatcaactgaggggtctgggcaaacagcaggcacagtggctgacagccacagccagaggtccatgcctgtgcacaaagggactggctgctacgcaccagatccccgtcctttacccacaaatgccactccagggtgctcccagcacgattccagccccctcccttttgccaccaccacctctgcttccccacagagcccctacccatctgtgatgctgtcaccttggctgagacttgtccccaaccccttcccatggaagcgctagcacctgtgaatgcatgagtgaggtccacatgcacccccaacttctcggggatgggggtggcaggttttgcaggtagcagaaacatgatgaggtcactaaaagcacatgcacatagctcgaccgggaaggaccgccttcagggcactgttcattctgcatcagaatgaaaatgcgcctgctctcccttagggtgggggcgagagcacggtggccatcgcatgcgctggcggctcaggtccactctgacgggcacagcttcaggtcgctcgagactcagatttcctccacttcagtcttccagggttttcttggtggcaacaagtatttaaggggtgctgcagtggtaccctccctccatccctcaggtcctgcagatgctcagcctcatcctcccgtctctctctggcaggcagaggtggctcaggacgggtggggctggtgtgcatcctttgccgaagctttctgcacacccgtgacagcagcagctatgctgagtggggtggacggggagaaaggtgacagaggggccggcatggcgtgttcaagtcagggcgggggggaccacccctgcacggcccacccctgcatgccccatcccacctcacggaagcttcctagagggcagggcctttccacacccagctgtcaggacacgtttgctgaacaacttgtcaaaggcgcacaggagacagggccagggctgggccagggcaccagcgatgggtttgttcccctgcatggatgtgtttaccggaccttgtgccggcactgggagcagatgtgaacgacacatccaagagcctatttgattgtgcaaggaaggcagtgtggagctcatcaccctgatttaccagagcgtccatggcagctcagagaggtcacgtgactcagcagatggcacaagaagcgggggttggggtgggggaggctcgggcccagagctccacggtgcccaccctgacgagcgtctttggtgggagctgagggacgagggagcccagggacctcacggacagaggagccgggactccaatgtgccctttgtctcccttggccatagctcccgggtctcctctcttcagtccaaacacgtcccgtgtgtgtcccgcaaggaggccgggctggtgtggtcacactgagggctttgtgcacgtgtgaagtgctgcgcggtgtgcagatgaggcatcccccctctttgggagctggcacaggctctgggtgcaaagaacaatggggcccattcagtgcagccccactgtgtgctctgcgaggcccagcacggtgtcctgagccttggggtcctgtgggaggggggcggcccagacactgtgcccttgtactggggtttttccattcagcagaagtggggccagagacacatgtcgggaacagctgggagtgaaagccaaggcccagcctgggagtcctggaggcttgggtgaggtagaacgtcggcaaggagtggacaggacccagggtcctggagacagtgggcaagggctagagcatctgtggctgggccctgggtggccaattctgggtgtgaagaccccaggatggagtcaggaggtggccagcagtggggcctctaagaggggagcccaggagactcagagcacaggcagcctggccccaccctacccaggagaggcgccccatcctcagcctagaagctccttggaccctcttccatgacccggaagctgggactctggcctgccctgcatacctcccctgcatctaaagcctctccctgcaggatgcctctccagaggcatggccagtgccacaactggacagacctgtttctcaagtttgatgcccacaagggctgtgggacttgggtttcttcaactggaataataatgtcacccacaaataacctggggtcccagctgcagacaaccgaaacagggtgggctccaggcctcaggaagttcacagaaactccggaggaccagagaacgaggtctgaatgggacgaagccagggccccacctagcgccttgggagatgcctggcatcctggaccactctggcaggaacgctctagcagctgctgcacgcttctgtgtgacacggtgcagccattcctcacacacacacacacacatacacacacacacacatacacacacaagcacacacacatacacacacacatgagcacacacacacgcatacttacacacacgcatgcacatgcccctcccccagagagaagacccacatcctcctcagtcgccgatgcatcccagggagatgctcattctccccggggtgccatggcaaccccacgtaaaatcataaagacaccaccaccagtgctcctgggaaagaggggtagcagaaaggcatcggaacaaaaggtgagttaactcgtctctaatacgtaaagatctataaacagaattttcgcgtatttgaagatacaggatacaattgacatcatgaagcatcaagatacatgatatcaaagtgagatgtcagatcagtgcaaattttcaaggatttctgagaattaacccctttccatggggttgtagtatgacatctgtggccatctttaatccaccacaaagatggattaaagatggattaaagccacaaagatgtggctgagtccttggtggagtgatccaaacccccattcctgagggatctgagtcctgggtggtcctgcctcattggggttgctagaagcccccactgactttcatcactgtaactggcagtgttgctaggctccctggagaattcactggatttgaggcagagtcctccctgctcccctcgataatagggtcattcactggccgatggcccttgatgccagttggtctgagtggtgtgaggggcccagcatggccaggcggccgtcccagcttccagtttagcagaacccctgctgcctcctgctggggacccattctcccatgggaatttaaagcctctaatccagagcctggagtattggtgaggagcagcagaggtgcggtgagcaggcactggatgagggaggggcctttgcgtgttttcccgggctccgggcttgttcttctggctgggggagaggcagcacatccagcagtgtcactggcacccgacagggcagccctggaacccgcaacggctgccagaaccagtcttcagcgggtctcatcactgttctgtgaggccagctgcctctgggggtgggcacaggacggggacgggagcctgtgagccctggtctttggtcacaccgctctattccgtggtgaaatgagtctgttgcttgggatctatggcgtggaggcaccgtgatgggggaggtgctggcagcaccagggcaggccagagggaaggtcacacccagagtgaccatcactcccatgaggataatgggagccccagagtgatggcagggatgcagagtggctgacctgccacctggtggctggctgggcactgaactgcagctgcagcctgatcggcccagggagaagttcttttattgaatctacggtgtttcgttctcaagcaaatgccagaggagccaggaacagaggctgtgaggtgcacagaggggaccactggcccacctgatcgtccagtgcctcctcggccccagcgccccttggagggcacttgtgaagcacttgctgtcccacactccgggtggttcctccccaggcctcccagcccttactcccccgatcctgcccctccacctccctgacccctgaactaatggttaacagccatccatgaatcagtgtaaacctgtgccttcggccctctcttcttcagacaatgtgggcaacacatgtaccaggaagatgtcccttctccacgtccttcccctaggtgggcctcagtgtcacctagagttggggccaacatttcttgcagctctgtctataagtcacctccgaaagtttttcctcctcagacggcttcgagaccgtagggggcgggtgggctgtggggaaagcggcaatgcagcaggtactgtgggagtcgcagcccccgcaggtacagcctccctgcgccctccagacctgccctgcctcgggccccatccacagcacctgggcatgacgacagagcactgtgtgcacatgcagataccagtggggctgggcgagaggttgatactcgattgctgttgggtgtttcggggctcatggccacctactctgtctctctgtctctgtctctctcaccatcaggcgctccacccccacagcagcccagcagtgggaagttagctgaatgccaacaggagagatttttggcattgctcaaaacccaagagaccacagatttcccctctgggggcctgccatggccccgtagagcattccaacttgccttagactcatcgtgtgtcattgaatgttctgggtcattaggcccaaggggcagcactgcttgtacttggcctgcacctgcggaacagcctctgagccgcacatttaactgtggtgcacaggaggcccgccgggcaccgcaccttcctttactggcaggggtgcgaggtgcagcagctcgtctttccctctgcaagggatcccttggcttgcctgaacttgcatataacagaaaccccaaataacagtggcttgatcaagacaggtgcatcggctcctatatgggaaacatggggtgaggcggtggctggcactagtttggcagctgggggacgtcagtgtcaatgtcttgggttcttctaccgttcccctcactgtggcaatgtggttgctttgcagcccacacagcctcatttcaggcaacaggaaggagaacccaggtggaagcggagagtggtggtccccatgtcaggaaggcagcactcacagaagtctctggaagacagatgcttccattccactggccagagataagctgccctcactgcgaggaaggcaggggaatggtggagttttcagctgggcgcatttccatctccaacagcatctgaaccctgctggtgaaactcaggaagaatgaatacagaactggcattctcagccacatgtggcttgcagggttgttttgatgactgaaggcactcactggcacccagaaagaccttagcaagctgcctggctgttatcgcctttatttattgctaagtgctcaaaaatgtggagggcagggggttggtcagctccagtcatgaatttggctctcccttctgctcctcagcagaggaaccgcttcccacttccccttctgcattttagagaggcacagcagggctgagggatgaggccagtggatagaggtcagaggtcaagagacagcctaaggctagggccctacctatgcccccgtcctactcagggcccctggccctgagcctcctaggcaggggactgtgtgagagcaggctgttccctgtctggctgcagagaagccctggggcccgggtgaggcccctctgcagtgagatcacaccctcagctgataatcacaccagtgtcacctcctctgttggtgctgggagctcaggagtgacgcccaccccatccccacgcctcccagcccaggaagccgcaggggcccttctgcctccaggaacagtgagctccgggggcctggaggctgaggccaggcaccaggtgaaggggccagccctgtggcaggggcaggggctacctgagaaggcagacccaaggcaggaggactgagtgcactctggctgccccggggctctgggctgaggggcaggcagtccccggaaaggctgggagagccagaagcagggacagaaagcagaggagagaaggacaggcccagagcgcccaagacactggggacaagctgagaccaagaggagagacgctgcttttgagagacagagacagacagacagaccaggagtggggagtcctagaaaaagaaaggtgttgagtgtcaggctgaggagaggctggcagaggaggtcagggagcaggcttgtgggggtaccgcctgcacagtggcaggcagggcagagctgagggcaggagtcgggcggattaagccaggcccaaggatggcagggtgcggccctggcccgaggctgcaggagtgccagcatggctgtgggaagcacctgggaggcatcatcagcgtcttcttccgcttcatctctgggaacctggctggaggtgagggttgctttggtggggctgggatggggctacagaagggacagctttgggccgggtcaaggattgggcctgccttatctggggtaggggtgacagggggcaggggtgggcagtggccctgggagcaggaccaggaaggactgcagtctttgcagcccacccctccccactgtgacctggggacagtgaatgccaagcctgggatcccccactcatgggcccagggagggagagcagatggggagccgctggcttctccatggggtacacagactcaggacaagcctgggctgggagagagtggggtggctctcaggccagtcctcctcctgtgcacactgactcgaccgcccaggccctccccgtctccttccctcactggaaaccctctcctcttccatcaaaggcagaagtggtgtctgtgatgaggattaacaaaaatgggcaggtgtgtattaagacctctatacagaaagtgctcagttaatgacagccacctcccaaaacctatgaaacctaagcaacctggaggccttggcagggatgtaggggactccctgagtcggtacttgtgggcccaggcctgtggggaaccgggaggtgggtgatccacagccagccagttccactccaggctctccctcctctgcctgcacccggggctgagcaggaccaagaccaagtctcggccacggggctacgaagcaggcacaggggtggtgccctgcatggggggacctggcatttgctgggaagggttgatatcaggagcttcagaccctgaaaggagtgagcatcagcagcttggagtgctgagcaagtgctgtggggacgcggaggagagtaggctaaagaagtcaagtgatttccaaagagagataaaatgatgtccctaaaacaaagatgagctggtgtagacatgtgacatgtacatcccaggacctggtgccacaagctgcctatgctgccagaagatgctgcccccatgctgagaggtcacctgcagccgccggcagggctgggctgccacagcatctccagggaccaggggctcatcccccaatcttgtccctgccctgtcctgagtgccttgcacagagcctggcacataaaatacctgtcaaattcatgcatgacattttgagaagcatgcaaatgtaagattgagcatacactcacgcatccccaaacaagtagaataacaggggcttggagagcggtagagcagcacagagtctgcaggaggaaggcggaccctgctgtgcggaggctggtggagccgggggctcagtctagccccaggtggcaagtttggtggctctgagtggggactcggagagcccagggttcctgggccttccagtttttcaaaagagaggggaatgctgtggctacatgtgctgtcccttagcggtgccttaggctcccaagccttcccttcctcaggaagttattttggggaaggagagaactttgaagacagtggaccctgggccgcttctctgtgaggtgagacactagtgggccaggcccagggggagaggaatgtacctgaggtcactgagctgctgggcatgaccctccaagctgggtgctcctccttgctcctcctggctagtgaccccaagcatccctcctgcccgcccttggcctggctccttatcttccctggaggggctagagcgatagtgcctcctccgctgggtggcccagagggccagtttattgccatgatgttgccataagcaagagtccgtatcgtctggagctccgggcgcctgtgtcatgccttttacctgcctcacaggctcttgggctcatggtgctccctctctctccctccgctgcgccgtctgtctcagtccatgttccttgccttccttagggagagtgagacataagcctcgtattggattaggaggccaggagggctgctcccaaggtggccgttgagccccatctcagaacaagggagggagggcaagagcggcaggtttgcctctgcccggggccccaggtgcctctcctggcaccgagggctggggcttgctggtccacctctgagttcctcccagctctggcgatgccggttctgggattctcagccagccagggaggtgctctctgggagcaggggtgaggaggctagagctggctgggtgtggacccggaggcgcggctgagaatgaggtgggtgctgctgaaaacaccactgcctgctgccaaggtatggaaccacacggagggagcctgaggcgctgtggcctctgaccctcagtccactcggtgtggctgctcttccctgccatttgcattaaattttctgcagatcctgtggtcacctttcaggtgtcagcaagtactcagggaatcctttccagcccggcaccccttctttgcttcaggactccctcctgccactcacggcagcctggaggggtcggggaggaggaggcagggtgtggtggggtgtgggcgggtcccgggtctctatgcccttcccagacctgcccaaggccgccacccctcagcagcccctgccacccctcggcctgtctcccaggtgctgagcctgcccctctcccgtggtctttcttgtggggaggatgggactttgaagatggattccctgggagcatcccctccggctccatgaaggcctctgggtgggtgtccagttcactgtcctcaccctggcggccactggccagtgtagccacagtcaccacccgacctcctccaggagtacgtcagacccaactggccctgcatcccccaaactccaggggacacattcagatcaccatggccttctcagaagtccctgaattggagggaggatggactgaagctccccagggtgggagaaggagggaaaatgctcagcactccacccagccttccctaggccctctcctccccgcccccctcggccccacccagcctctcctccctgcccccccagccttccctaggccctctcctccccacccctccccagcctctcctccctggcatccccagcctttcctaggccctctcctccctgacccccagcctctcctccccacacccccagcctctcctccccacaccccaagcctctcctccctggccctgccccccgagccttccctaggccctcccctccccagtcccccaagcctagggaagtctaggccctttcctccccggcacccccagccttccctacgccaccctctgtggatgaaggggtgggtcacagagccggtttcgcagcaccttagtgtggcctgcagagctggtcctgtatctctcgtgctgttcctggctgttgggacttctctcaaactcaacaggaaaagttacatttaataccagatataagcatggagttcacgtcaagagagcgtcagccctgtgctctgggtcactcaccctatcacagggcaggcgccccggatggagccccagagacaagtctggggtgcagtggaagaaggggggtcagggctggggctggggcacccgacggaggcagcagagaccagaagttacacacaaaattgggcacatctggcttgaattgacacagcgtcattctgacgcactaaaaatgccattctgcaaatagacattgagtgcgtgtcaaggttctgttgaactccctaatgaggggactaacgaacgacagagctgatttaagagaaacacggggctctttagagagggtgggaacaaaaggcacacagagacaggactgctcagttaaacagaagggatatgaaactgagaaagacccaggtgagtgaggccactgcctgcagggttatctcctctgccagagggaagaggaaaccatggcatctgtaactgtgttacaggcctggaagacatcggagccctaatcaatcgtgcagcttagttctgcccctccgagagtcagatcccctgaccgccatgctagacagtgcctggtgggacctcaaaggccactcaattctcctcaggccacgtttccactactcttaagcatctcatctctgccactcatagctctgtgtgaagcaaattgcttctaacctctctgagcctcagtttcctcatctgcaaaatggccataagaataatgaggttggcaaggcctagtggctcatgcctgtaatcccagcactttgggaggtcgaggtgggcagattgcttgagcccaggagttcgagaccagcttgggcacacagtgagatccaatctctacaaaaaatacaaaaattagccggacatggtgacacacacctgtggtcctagctacttgcagggaacatgggcagatcgcttgaacccgggaggtcaaggctgcagtgagctgtgtttgtgccactgcactccagcctgggtaacagagtgagatcctgcctcaaagaaaaaaataaaaaagaatgaggtcactgtagagggttgtcagaggcacgtgaaaagccctgtccccgtgggacagcctgctgccctccccaccttgctgtgaccctggacaagttgctgggtctctatgcatctcagtctcctcatccatcaaatgcgcacagtggagagtggttttaaggattctatcagtgtccataaagggccaaagcagtgctgcccctggccacaagggcagggctggtgatagttggactggtttcaaggccctgagttggggcctcggttttcttgtctgtgaagtgaaggctggagagaaggattttcaaggtctagaccagatgtctatcccgtgatttctccccaccccgcttatcccggcacaggggccagggagcctggggtgtgcttgcggctcctgttcacgggacggggcctgccttcaaaacaccacccaaccccagcccttggcagctctctctggcgcttctgagtactgcgaggccctgtgcccctctgctcagagcactcctcaaacacttccccagggccttgccaatgaggcagagttcattaagagccaccgcgagcaggtccatgctcttctttacccaggaatttgggattctcaaggaagaatgggctgctgtggtcctggcccccgctctggcctccacccacccagcctcccccattgcctgcctcctaacggccaaatagaacatgtaggagggggatgaacaggaacactatgggagggtcagcggaaggacgtgatgactggcgagatgggcagggcagcctccagaaaggtgcagagccacctgcccaggcacagggccgtttggccccatggccaccttcctggcaccaggtccctccccagtatgctgggcatgtggggcccacatccctgccctctggggtgcaggaggttgggagttttttgggaaggtggggagaggagacaggagcagctttcagatgctctggggtgggaggaaacgtctctgtgtgcttagagctactcaaggaaaaggcagaactgcggtggcagagagggcagtcagtgctctgggctccgtggcacaatcttccaggctggagcccgcaggcctggccacccctccaggaaagggcccctccctgcgggtgcaggtgtgctctctgcaggcattccctcctcttccaccagggggtagcaggtgccaacgcgtccgcctccctggaccatttcactccttcaagtcactggctccaccgcgttttctgttcccaccccgtcacaactttggggcttaaaggcaccaggatctggcatccccgggatgccacctgtcttccaggatgtgtcctggctcccgatgccccaagctaagccccggacaggctgggaacctctccctagcagcccctgccctggtccctagggccccgcaggccttggggtggcagtggccttgtcccatgtcatcccagaggcctcgggaggcagatggttttgtctaggaagacctgtcctcctgtatggatgaggggccagctcctgagggcaggggaggggagggctgccagggccacgtgcagggcttctgactgcaggtgcctcatccacactccgggcctgcacctgatggggcggggaggcagaggaagcccgcggccactgccttggaatccccacccacgcagatagaccggggctccccacctcccctccgtgggctggcggggcctctgtggggaatgaggagagatgggcgctgggctgacttagtcagtgaactaaacggattccctgacacagattcaggttttcattcttgtttgaaataatgctcagaagtttttcttaataacgtgagggccgggcgcggtggctcacgcctgtaatcccagcactttgggaggccgaggcaggcggatcacgaggtcaggagatcgagaccatcctggctaacacggtgaaaccccgtctctactaaaaaataccaaaaaaattagctgggcgtggtggcgggcgcctgtagtcacagctactccagaggctgaggcaggagaatggcgtgggcccaggaggcggagcttgcagtaagcgagattgcgccactgcactccagcttgggcgacagagcgagactccgtctcaaaataaatagataaataaataaataaataaataaataaataaataaataaaaataacgtgagtagttttttaaaaaacatttttttcatgcccttgctttgcaaaataaaaaaaatgacagttttggcctggcatggtggctcacgcctgtaatcccagcactttgggaggccaaggtgggcgaatcacaaggtcaggagttcgagaccagcctggccaatatggtgaaaccccgtctctactaaaaacacaaaagttagcctggcgtagtggcgggcgcctgtagtcccagctactcgggaggttgaggcagaagaatggcttgaacctgggaggctgaggttgcaatgagctgagatggcgccactgcactccagcctgggtgacagagtgagactctgtctcaaaaacaagacaaaacaaaagacagttttatgatctcttccaatttgggaggaaatgcaaaaagcccaggaccacggtgacaaacccctggctggctgaggctgggctgggaggtagaaggggggctccagtcccttgctggctgagcgacaggcagaggacagggacagcgtgaggagggaagtgtactggctgggcccctgccagcctttggagcaaggtgcagccacgctggtggggtccacaggcctggaccccaactcgggtggctgagagctggccctcccagagagggaagggcttgggcttgggcctgggcctgagcattgaccggaatcctgggactggagtggggcctggcggagacggtgcaggagctcacctgagcagcggggaggctgtggcagggagtgctggccgcagctcagcccagcaggagggcgggtgcggaaacctgtgcccgcctctgagcctaagaaagaacacaagaggacagtcaggggacgtcccagcagcttggggtctggctgaaagctgggtatcccgtgaggagggtcctggccaggcaggaggttcagggggccaaggcagccattgtcccctacccccaaaacaggtgtcctggagcgaggcaagatgcccagagcagggggcaggtcagggcacatgcacgcacacacgcactcacacactcatacacacgtacacacacacactcacacacacacacgcatacacacaaatagatacacactcatacacatacacactcatacacatacacactcatacatacacacagtcatacacttatacacatacacactcatacacacgcactcatacacacatacacactcatatacacacactcatacacactcatacacacatacactcatacacacatacacatacactcatacacactcatacacacatacactcaggcacacatacactcagacatacacacactcatagacacacattcactcatacacatacacactcatacacatacacatacacactcacacatacacacactcataggcacacatacactcctacacactcacacacactcagacacacacatacacattcactcatacacacatacactcatatacacacacacatacacattcactcatactaacacactcatatacacatacacactcatatacacatacacatacacgcacacttataaagtcagacacacatacacttatatacgcactcatatacacatatacacagtcatacacacatacacgcactcatatacacatacactcatacacatacacatacacacacacaacactcacacatacacacacatacactcactacacatacacactcattacacacatacacatacacacacacgtgtaaacacatatactcacatgtgcacacataaacacacaccccagtacacactcacactcacatacacatacatgcacacacacgttcacacactgcactcgggagggccaagaacagcatcacgccaggctctgggagggcagcggctcccaaattcttagcgcccaacatggcctacaggacctgtgtaactggaccggcctgccggccctgttctcaaatgggaagccctacaggacaccccctgctgcactgcggctgtgcttgtgaatggcggtgggaacgcccatggtgggggttgctcttgactcttttccttgttccccggtctccccagaggacaggcctcctctggccacctggcccaggggcagcttcagaaatgtaaattggagtctgccactctcctgcccaaaccctgatttccgttggtcctcgaataaattccaaatgcacctcggcctacagggccccgtgggacctggctctgcccacatggctgagccccttggccccagtaggcctccgcctggaactcccctcgccctgcccttcctcggcagggcactcatgcgtggggccctcgctgcccccagcacccgcacctcatggccgctctcctcagcaggcctcggtttacgggtcgcctcctcagaagacttgctccctcttatcaccacagtgctcggcacgtgccggctgcccagtcagattgcacgggacaagtcactctcttgccggaggactgaaggctgactgttcactagacctagactgtgccacgtctacggaacaaggaaggcttgagtaggtcaccacctagctccattctaggaaccctaggtcaactggccgactcccaaggtctctgcgagtcctgatgatggtgccttacactaaccatgcccaccttgtctgtagtgagtggcatcacttgcccctagttcccatccccaggacctcattgtccccttgcacttagggatcccagctcagtggctgaggccaccctacctgctttttaagaaccctggatgtgcactcacacacattcacacacacgcacacatacacacactctcacatacgcttacactcacacatgcacacacgtacacacccacacacgcacagtcaccatgcacactcacactctctgtcacacttacatgcacctggaagcagtggctgttgttttcatttgtagccacagttgatgtggcttctgagcacctcctggggccagagcaaggggatgtccactgtgaggagggatctggagtggcaggacaccttctctgtcttgggcaggtgctggtgcccacacctgtgccctcagctagtcttcatgctaatcctgcagggggcgtcaccatcgcccccatcttccaggggaagagcttgaggctgagagagggaatggtttgtccatccatctgtttgtccatctatccgtccaacacacagcatgaggcaccctagaggctacacgcagcaggactcagcccagctgggagggaagaaggagccagggaagccttcccctctgcctcccaccttgcaggtccccttccaatctcaccccaaacactcaccccaaacttccatgctaaacttgccgtagaatctgctgtggttgggttgtcggggacagacctgacctggggagatttgcagacctgctgccagcctgtactggaaagagctggggctccgtggcccccacaccctctcaggggaagagagcaggggcaagggcccgtgtgcagtttatctcagcctcaccccatggggacttcaccatgaggatctcacacacgcaagcctgcaccacccccagcccccaccagcttccccaggactgggaaaatgggccaaacatgatggcacactctcccccctcccccggcccctctggccttcatcgtagaccttctgagctctcatggcaccaatgaggaaactgaggactggagaaagaatgtgagctgtctgaggtcgtttaggtctaactcccagagcagtgctgctgctgctccacacactgtctgagccacagtatcccgcttgggaaatgtgaggcccactcagagaggctgtgggctctgtctgagcgcctggaggagagcggtggggagggcagtgggcagctgagctgtttccaagcactgatctcacaaaggaagtggtgaatctggggagggtgggctggacgccgctgcgtgcctgcttaggtgcgtgtacccatgtgtgtggcacatgcatgtgtgtgcacactcctgtgtgtgtgagcgtgctcaccgccttcaggtcgtctgtgactgccgtccctgtgtgctggggaggggctcgggtgctattcttagggcagcattctcagtctacagtcagatctgctaactgaccgccagggagcctggcctgagcaggcattgctccccagtaccagactcttggggtggggaagagtgtgccccagcacacaccttggaggaagaaacacaggtcagatgtctttcagttctagctgcctccgagctctggcctttgctgggccttagctatgccctcaggaatgcaggctgctggctggggccagggactcctctcagtgacccatggaaggaagaggggagctgcagaggaggggagggcagagaatggatgggtctcagtgtagcccagcggttcctaggaaaggtgggatggcttggactgcagagaccttgggcaagtcaccatgcctctcttggcctccacttcctcatctttaacatgggctgtgatgagagaagaaattgtctctttgggttacttcgaggattaaatagaacacggcgattagcccaggagtactccgtgcacagtaagtgcctagttagtgctgtggctcccagcgcggggccaagcctcagagtggccctacaaccttcttatcccatagcactcctatggagaacatcccactttctagagtaagctgatcctgtacttcgactaagccaaaggtctggggtaagagcagaggcccatgcatctcccttgatacctgccctccacctctggaccaccaggccccaggccaacaggactggcattcgctgggcactggccaccctggacactgcactgggcttgctcacatgccctgacatgggcatcactagcccatcctacaggggggttaagcagcctgtctggtgtgatcaagctggtagggcccccctgtatctgactccagaccccgtgccctgagggcacctgcaccgctggggctccatcaccgctggtctcacacagtgctggcctggctgccgggagtggggggacccgggagcaggctgaagctgtgccctctggctggcctgacgggggtctgctgggcatggacccctgcgtcaggtttgtggctggcgtgcacgttcccaattaagccgagtaaatatttacagccattacggccattgatcgccttcgatcctgggtgctgctgtgagatgcccctgcttactcatgctttcttaaaaacagctcttccctgcgcgtctttaataattcaactcctaattgtctccaaacgcaaacctgaaaatgccaactcagggccttcgcccccgctctggtccccctctcgtcccctctgccggaggcccctctccccatttctgctgcagatcctggcctccctgccctgcctctgaccacttctaggagggactcaggacgtccctcacctccggccgcagccaccgccagctgccgcagcagaagtgagctgggagtaattgagttgcagggctggggtgagaagaggcaggagcaggaaggtctggccgcggctccccagggtgccctgaagtgatactgggcagggaggggcagggatctggggcatctcgaggtgacaggggaggctgattctgaatgggtccctggacaggcctcagcccagacctcccctgccaagggctgggggtggaggtgaagccaaatcaatatttatagcatctcctgggcaccaggtctcctggctggggctgctccccagtggcctctgagggccatcccatatggggtggagtctaggggactgcgttgtgtcccagccctgctctcagggcagggtgaccaggcgctcccaagagctccactaccaacttcacttgcctctccctcgaggcccagtccgggtcacacattggtgctaagggagactcacccgtccgtaccccccagggcagctgcccagtgtaaaactctcacagccagacaaacaccacaaggggcgtgagaggacaggcacacagtcactagaactgcagctggcctggagccagtggccaccgatgcagagggccctttcagccagggtgccggggctgtggctcccaatcccagttcactgggctggcactgatccctcctctgctctctggtctgagaacatcccattgtgaagccgtgggtctccttgcctcctctggcaggcaatgtcccaggctctggggacacagcagggaaccagacagaataaaaacccctagagcttataggctataaaatgagattgatgagtaaacgatatattgcaagggaatagggctgcagaaattacctaggactgggaagaagggaggggtgcctagggcagggcctgcagggcacatggcgttcaaatacagatccgaggggtgagggagagtgaaagggaagctgtccaggcaggcagaggggcagcaagggccagagctcagggtgaggtgagctggcaggagaggcccctcctgctgatgaggggtggaggctgagcccgaggggtaggcgagggagtggcagggatttgtggctgtccagggtggcagcggaggcgggagggagcagcggtacatttggaggcactctgaagatgggaccgaaaggatttgcagatgtcctgggtgtctgttgcgtgagaacgagaggagtcaggccaaggcttttgtcctgagctgctggaagaaccaagctgttattcactgtggtgggaaaaacagaagctggcctggcgtgaggggaggagggggcttggtggtagcatttcaagtctgagacatctaaagagatcctagcagaggcttcaaggaggcaggtgggatctgcaagggttggaagtggagggatacatttgggggtcatcagcacatagacggatttgaagccaaaagaccgagcagaagaggcccaggactgagccagtcgtgcacgctgatgtctaaaggcctccttgctcccgctgcctgcgcccatcctcagagcttggcttggacatttgcagaaggctgctattgtttcttctgttcagaaagacacctatccacattccaaagagcgccccacatcctgttctgccatcggtagccacgagggctcccagcttcttacccgatccagctggccagtcacgacaggaatacccactggccagggcaggtgcccgacccaggctgggccaaggagatcccttctcagatattttgacagtgggaggccctgtgactgggatgcagaggctgtgacatgcaggcctgggcaacttcttgtagccaaccatgaagccacatggaagaagccacttgagtagggacgctgacatgcagcgtctgcatgtgagaggtgaaggacacggtgtgagcggacttttctggtcatccccgccccgttctcttccagtggtttggtttaagggctaacaggtccctttgactgagcaagttcactcaagttagccttaatacagcatctcagcattcagacagagagaggaggcacaggccaaggaatccaggggcccaggagcacaggcaaaaggccggtcctcctgagccctcaaccagactgcacagagccaggcgagaacatgcatgtgacacacaaatggccctggcgctctggggcagatgcgtaccaacaggagaacgtattgatgatctgattttattctgagtcaactgttttaaggtttatataagtctggcccgccttggtggctcatgcctataataccagcactttgggaggctgaggcgggtggatgacctgaggtcaggagttcaagaccagcctggccaacatggcggaacgccatctcttattttgaaaatatcaaaaagaacttaaaagtcatggaggagagttcagcatgctcatctttcatctaaaaggagtcccagaaaacaggtgaggggacggagaggaggaggtgttccttaatattaaagagaacaaatgtaagcattatttcatttcgtcttcaagtgtgggccatgggatattaatatgtgtcatgtggaaaggtattttgtgggcaaacacatttggggagtactagtcatatgaggctacacaaattctttcactacagaacttctcagaacctttactatacaccctttatattttcaagacaacatgggggtggtgaagagccctggctttggaatctcagacctgggttctcaagccttccctgcctctttttgtctctgtgtttgggaagaccttttgtccctctgggcctcaattttctcatctgttaaatgggaatcacaattacatccttgggggtcttccagacttagggacaaagggacaagacaaatgtgaagatgcttaataaaatgtaaagttatgtgaatgtgaaatgccctgtctcgcgtgagttctgtgacagcctctggctgggcctcacttgtctcacctgtgaaatgggagttggggtaaaatcactgtagctcccctactctgcatgcagtcacgctgcagctagagtggttgttatagagaaaacaaaaaccaaacgaatgctcccttgctctgaggataaatccccggccacagacttggccatgcccttataactgtttgactatctgcctgcacctctagagtgtaagctccttgaggccagggccgcagctgcagcatgtagtgccacatctggcaggcacagagtcgacttgggaagtatttgtcaaatgagtaaatgcatgaacctaggcctcttctaactctgaaatcttacatccctccggattgagaaaagaatcaaaagccattctaccactactgctgcgggaaacagactgccctggaccctgactcctctcctctggtggcctcaccagggcccgccctcggtcaacctagcctcgaagaagggaatgcttgggtgtttccagagactcctcagagcacgtgctcaggatagagtcctgatgcttctagagaccgtatgggcaagtcctgtagcctctgttggttgcaattgtgacagctcgtaggagcatggtgaggattcaatgatactatgtcagtgagtgcctaggacagtgcctggcacatggtaagcagcaatgaatgacactgctgctatccattattattacccaattccctcactgaacgcagagggcatgatgggtggctgagtcctcccagcttccttgaggcaaaggtgggacttggatagggggcgtctcactcctgcccagcaccctggctgctcccctgctgctttctgactcagaccccaaggttgtgattcccaagtcattcgtctgcattcagctgacacaggccatctgcaagacacacacctctctgagctgtcagaagacactgcagaagctgagatcctggcatcaagcgtcccagatggaaattccccaagacacccttgggccctcggctcaagttcaaacaaagaaatgcttatgttcagagatcttcacagatcaccagcgaggatgtaacttgagaacactttgcgtcagcatcataaaacatgaggattgatgacccgtgtgagtggggcgagtgccaggggaacacaggctctgagttggccggccgtgcttcctgcatacactctgtgcagagggtgccagcctagactggcgggggggttagaatagcaccgcactagttagcatgtcccataggaccctgtttacagcacacttgcatgggcatgtgtgcacctggttctcatgacaatatgcagggtgggcaggggttaaggaatgcttccccactttggggatgaaggaaactgaggctcaaggaggtgcgaagccaggcagctgaggtcacacagccttggatctccctaccgtcactatcctcccctcttgccagcagagagaggtgggaaagccacgttcagccaaaacccagaaatttacccagagaaactcacaaaccaacatggtgggccttgtacaaactctaagagtatgaagagaagagctacagctggccttacccagtcctgccatgctgggactggtcagctcccctgcactgaatctgggtaggggcatgaaaagacacaagatgggatgagaaatcctccacatgggagaggaaatgggaacctttcatcactggggaccaggaagcagggtgaggggctcacaggacaagctggcctcaaacgttccccttccattgcctgttcaatgttactagatacttgcagacctctggcagaacagatggggacttggatataccttgtaaggggatgggggcatgaagacagattcgttcccctgaccaagggggaatcaaacaggtcactgagcgctcaaaggagaatattcccagagctatgcagtgaggggcctgctaccacagtaacacttgggcatgtgtcaagtccccacttggccaagtagcttggtcttctcctaccttccaagtctttcctgaccatgagaaccatgggaaccagaactacttaattaagaacatgaaattcctttcctttcagatcactggtcctgactctggcctgagatgctaagagatcccacagctcctgtgatgggaaaagttctattcccagaatgtggttcccacatgggaaattttacctgttcagtacttcttgtggaatgtatctactaatgatatattctcacaatttttacttaacttggaatgccttaatttacccttcattttttaaaagacatttttgctgggtatagatttccaggatggccagttactgttctttgagcaatagcatttgaaaaatgttcttccattgtattctggcttctgtggtttttgttgtgaaatctaccatcatttttgtattgttatttctctgagtacaatgtgtctgtttttcttctggatgcttttaaggttttctctttacctctaattttcagcagtttgaccatgcacatgtcagaatctccacaccatagcagatgtacctacctgtggttttctttgtatttatcctgcctggggttcattgagcttattaaacccatgatatgatatctttcatcagttttggaaaatttcttcaaattctattgttatttctttaaattatttttaaaattattatcataatttattcaagttctaagtatttcttctaattctaattccatgcttttctctctctccttttcttctgggagtctagttatacatttgttagacttttttacttcgacccacatatcctccttaaattcttttctgtttttttcttccattcatttttagtccattcacatttaaggtaatgattggtatgataggatttacactgccattttgctacttgttttctatttgtcacatgcctttttgttcctctgttcctccgttattatcatctgttgtatttgcacttccttgtctcttgccatgtcttataatttttagttgaacactgtagctctgtgacagacagtgtgaacttcttttgcaggtcacccatgttgtcaggtttgggggcagtgagagacagatgtggattctagtttgtccttttgagttccagtttgttctcactttatcttacttcatgtccagtctctcttcccattttctggtcctgccaacctacagcaacttcaggcatatgcagaggcaacagccctcaataagacttcttccccagcttccacaactatacaaagtctcattcttataacaaagcccagactccgtatcagtcatagtggttccacgtctctgatcaagccttcaatgatacaagatccaaattctctgttaaattttaaactacatcttttcatttactttgtccatttcttttttctatttttaaaaacatatttatcatagttattttgaactatgtccttatctgcttacttaaacatctgagtcatctctgaattttatttctattgacttcataatcagccactttctccctcttctcatgtctaacaattttttattgcatgctggaaattgtgagtgatatgttatacaggccctggatttacttacctccctataaagagcattgagttttgttttggcgagcatttaaattcctggcaaatcacaccgttcctgtcaaagtttgcttttagcctttgttagggagggtctgtttcagctttttgccttattcatagagtatagctcttctcttaaggtgtgatcttaatcctaacaaatggcttttctgaggtctcaacagaaagcccagggtgttcaccagtgcgtgggtgggcctgaacctccatatttcctcagtgctctctgacccctgggatctttgctctgctctcaacatcgcggcagttgttcctgcaagcactccagagtctctccctgctaatgcagagcctagcaattagccaaggccccaaaggatctgttcgtgcagattttgggggctactttttctctgtggctccctcctttccagacccccatcatctcaaatgttagctgccttagcagccttgaactctgagctctatttcctttatccagtgtgaccgccagtgctaggagaccttgtatgcccagcattttggagaatatactcaaggataaagatgaagtaaactgcggggtccattcagtgcgattctcttttctcgaggatcattgcctcgagaaatgatttgttgctgtccagtgccctcctagagttgctgtacatactctgtccaggtcctagagttgttttcagtgggcagattagtctgatgccacctactctaacatggttggaaccttcttttcctggattcaagggggcgggggagggaatgatgtttgtatggttaaaaatacaaatttattcaaacttgtctatgttcctgctaggtctcttgagtgtgtcattgggatataagatgaatcctttctctgccataacagttgaggctatagcccttattgagtacctcaaatggaccaaggctttattctaaagtgctttatacatctaattgttgtcaccttcccactcactctgagacatatgcactactatcattcccattttacagttgcagacattgagtgatgttgaggctaagttacttgcccaaggtctgttggctttattacttccccctgatgatgtcctcacctctccagtccttctgccgctacctcagtccaggccaccctcatctttcacccaagctctctgctgtcctcatgatgggcttttctgcttctagacttctctgataagcagggtcagaatagaaaggcgggcagctaggctgggggtgctgatgaggactggggccaagaaagtccaggcccaaccacggggctacagtgtgggaaactggaggtggtgggggaagcaggagaacaaacagtgaatgtttctcagtcaggtattaggcctgtgggaggagacacgggcccaagactgatggcccacgaggagcaggcagacaccaggcaaggcagaggccccgaggcatcggcacagccagggcaggaggtaggtggggaggcaggggctgtggggcagcatgtcactgtggcactgccttcaggctgagttcaaaccgcagctctgcctctcaccagctgtggacacttgggcacatctcttaggctcagtttctccaccttagactccatttgaggttgatgttagcttcgtgaaatagaacacctaattatggcgacttaaatgagacgagtttagctttctcaagcaatgagaaatccagacgtttagcttggtagctccagccatcagagcccaggaacctgtgtccttctttcatggttccagggacagtcatcataagcccatcccagaaatgaggagggagaaatggcaacaagagtatgctagctgagtccttcccactgccataaagatggtttcctaaaagccctacccagtggtttctacttatgacccattggcccaaactatatcacatggccatctagccataaagaccccgggaaatgtaattctgtggcaaagaacactgtcgcccccaatgaaattagacttgatgttaaccaaaaggcagagaagcaattccaacaagataaggagtctactcgagcggaagaaggagagaggtgacgtgaaatcagcaaccagaagtctctgtctgccacaggggtaaatgatgtcacttcctttatctgtgaggttgatgtgaggaggaaatcaagacatattggtgtaaagcacctaacaggtactcgttcagcaaatggcaacaggtattcttgagtttgaggaacttttctaatgatccctcgaaggcccatccccagagaaaaggcttcataagtgcttgcagcattgacttgtctaagccccacccaaagagagacccatctgtacaggccgatgggacacagcctggagcctttgtaaagccctgccttggaggaagctgatgctctttacttgctatcttgactcagcgggtggaggatgaggctctgggccctgtgcctaaatatcataaggagctgggagttagtgcagacactgctgattatctgccccaatctatccctctcttcttcctcttctacaagctctgcttttggccccaatttcaggtgtcccccctcctccttcagccacaaggggagccaggcctgactgatctgatcatcatgcttgtggtaattaggtcaggccaggcacggtggctcacacctgtaatctcagcactctgggaggctgaggcgggcagatcacttgagatcaggagatcgagaccagcctggccaacacggtgaaaccccgtctctaccaaaaaaacacacaaaaattagctgggcatggtggtgcatgcctgtaatcccagctacttgggaggctgaggcgggagaatcacttgaactcaggaggcggaggtcacagtgaggtgagattgtgccaacgcactcctgcgtgggtggcagagtaagaccctgtcaaaaaaaaaaaaagattgaaaataataataataatgaagtcagaccaggtgctgtaatagtgagacccccaaaacccagtagcatcagtcttatctcttctgtttggtccaaaagcaattggcttttccaacactgtgaataagccttcaatacctggtatctccatctctctttccacctctatttccaaatcgatagctcttacttgatctcatctctttccttaaggcataaaaaaagtatatttctttctccctttctccctgggtgagagttctagattggtgggaggctctgttccatgcagccattcaggcacccaggccctttctaccctgtggctgtgttctcccctaacccctaagatctgcatgagtgaggctggtcaccaacatgtgtgagttccagccagtgggaaaagagaagagagaacaagtaggagagtcacttaccgtcttaaaaactccgtcccaggctgggcacggtggctcatgcctgtaatcacagcactttgggatgctgaggcaggtggatcacctgaggtcaggagtttgagaccagcctggccaacatggcgaaaccctgtctctactaaaaatacaaaattagccaggcatggtggtgcatgcctgtaatcccagctgctcaggaggtgcggcaggagaatcacttgaacctgggaggcagaggttgcagtgagctgagatggtgccattgcactccagcttgggcaaaaagggtgaaactccatctcaaaaacaaacaaacaaacaaacaaacaaacaacaacaacaaaacctccatccccaaagcagcattcatagcttcctttggcaacaatgcacatccacactaattacaaagaggcctgggaaatgcagtccctgctagatggtcacacgtgtagctaagactttactgtagaagagagaagaatgggttttggtggcaagctggcagtctctgccacagtggtggcctcttttctgttgccagcaatttcggcatggcatgtgacacaatcgtagccaatgaaacatgaggggatttttcatgagaagtttatgggaaagtctttctcacagtaagagatgccggaagagacggtttcttctccccttggacagtatcatgtcagaatgtgatatctggaattaggcatctgttttgtgatcatgatgggaacaggctgtggttaaggcagatgctctaaagctggtagtgtagttagatgcaagagcccaggttcttgctgataccactgcatctaagctggctgcccctggaagccaccctctggctggactttccatgtgtgacatagtacatttccttatgatttaagccaaggaatggggttttctgttacctgtagccataagcctcccagatttcatgtgaagttgggccagagcagaggctgtgtggaagggttctgtgcggcccctgggggtctgattcaacggtggtatggtttgggtctgtgtctccacccaaatctcaagtcgaactgtaatccctaatgttggaggtggggtcccgtgagaggtgactggatcatggcgttgtttctcattgatgatttagcagcatccacttggagctgttctcacgatacagagtgagatcttgtgagacctgggtgttaaaagtgtgtggcacctcccccctcactctctttcttgctcctgctcctgccacgtgagatgtgcctgctcccccttcaccttccaccatgattgaggataccagcaccacgctgcctggtcagcctgtggaaccatgagatgaatatacctcttttctttataaattacccagtctcagggatttctttatagcaatgtgagaatggactaatacagagggcttggtcaatactctaaggtcaagatagctgggctcccttggtgtcatttcgtaggttgtcttggctgtgaggaaacaggctctccagaaacaaagtccctcttgcgcgtcttgagatgctttcatatccatagcccactgtgcaacaggcaggtaaatatcaccaagtgactccattttacaaggaggaaaggaaggctcaaagaggcaatgtgctgtggccaagtccatgaacaggctagggttgggaccaggaactcagccctggttctcctggactcccaggcctgtgctcttgctagtgacaccagggcatcctgtgctgaaacaattgggaaaaggtgtcatgtgaaccctatcaattataataaatatttatacaaggcaggcaatagctgtccctttgggaagcttgcagtctagtgggagagcagaaacaagtaaacacgtaagcaaatatctatgttcccattgcagtaactgcaaggagggaaaaggacgggggcggggtggagactgatgatggaggagatctaggaaggtgactctgcggaagtgacattagagtgcagaccccaaggatgatgaggcataaactggacaaagacagggaggtggaaaagtgttcacagttcacggaagagcatgtgcgaagaccctgagatgagagagtgctgggctcattctggtagctgcgagtgtgaccacagccacacgagaaagagagaggaggggcccggccatggggggcaaggttgaattgaaatcacaggctttggagctggactgcttgggttcaaatcctgactctggtttatcagctgtgtgcccttaagcaaagcattaaccactctgtgcttcaacttcttcctcctttccagttcctaccttatcagaactgtgaggaatgaagagataagtcatgttgaaacacctggtacatagtaagtgctttagctgcttggattaggggccttcttaggactgtggtctttgttccgtgagaagtgcagaatgcattagttaggaccctgttggctgcaggggacagcaactcaactcacattggcttaagccacagttggcggattgattggttcatatgtccgaaagatacaggtttagatgtgtcatggggcacgcagcgttgccagctggacttgatctctttgtcttcatttttagctgtgttttctcctgaggtgactccgttctcaggcccgctgttcccacatggtggcagcctggccacttatctactataatcgcctgcttttccccggggccagtctcatggaggactctcactatcctggctcccgtctggtggccatccctgagccaatcactgtggcagcagaggggtggtatggagtggaaaagagaaattgacactgattgagccaacctccaaagtcactgcactgaggctgggaaaggaaattggggtgtggtcaccagccacacaggcaaacatggccattgctgaaccaggaggcccctggtagtttccagttgggaaagggcacggtctgatttttgtcttgagatgatcatgctggttgctgaaccgagaagaggtaggaggagaaccacagtggaggtggggagaggcactggggacccatgttgggagtccaggagggagaacaatgctgtggctgggctggtggcagtggggcagagatggacgaggaggcacagggcgagagtgtggtgacaggctggacggggtggggacaggcagatattccaaggtaagagccagggttttggctgaacagctgagatggggagacttgggaagtggcaggttgggagaggatgaagaggtcagctttggaggtgctgagtttgaggagccttgagagtgtgaaattccattcctgggcattcttgtctggtttctatgaaatatgggaagaataaataaattgaataatgcctgctttgcccagtagaaagcattagaactaaactagaataaggcaggcctcccccagccccactccggagagttgggactggaccagtgtgctgagctgttttcacggaatgggtccctcaaacagcatgcatccagcccagacccgcccttatgagtcaggagacctcatgaaatacctgggcagctaggtggtcaggaacagttagcatgggacatccagggaatgtcggtcaaactgacagagtcccaggccttgggaaccaccagtacagctgtggtaacaagatggaagatgccggggcagagagccaaaatgcagggaggaagagtgtggcccaggcaggtgtgtgctagttcataggcaaaggcagtcaagacagggctggtagaatctgggttggcttcttggagacagaactggatggcagcttcaatattccagccatggttgtgacctcaggtgtggggtgcctgtccaggtttggagtgaccccccaccccgaccccaaagcaatttcctctgaaaacttcctaaactagagcaagatgcaggacacccctgtctcctagtcatcctgaggacttcaggagagggctcagggccccagccttctccaatcaccccaaggaccagtgaactgctccctccacattgcccctcaacttgtccccacctctggggcagtccttccctaactccccgccctgaagaggtttttttgcatgtccctcacctccagcctgtgctttcctcaaagcaatgagtgctacccatacacagcatactgccacatggaggcacttgggatgtgctggggaccaaggaaatgcacgccagggcagacagtcgcctgggaaggcacttcatgggtggcggggtgggggggggcacatggggcttcagggctcgcctgctggcttccttctccaagtcccagggaaggggagtgtgataagaccctcagcccagcctcagtgggcctacgctggtgagtgagcctgggagtcagctccccatccattaggcccgtagcccaggtggctaatgccacgtggatactctgctctcaggcctcgtatccacttaggcgttgttaatattttacacggcacagccagaggatcgatgtcttgtttatagctcagggtttataggcagtcatcgaagctctcactgggaactgggaagatgctcagaagcatccagggaaacagaggcagagaagagggttggaggccagcctcaggacccccaagatggcctcctttgcatgctcagttctctgtctcatctgacacgtgccaccctgtgaagctgggcacatgcagctctgagggtgcattgtaggggccactggagcccctgccacgtgccagcctgcatctcattccatcctttcaagcccccggagaggctggattattgttcccattttatggatgaggaaactgaggcttagaggggttatgtaccactacacttttacaggtcactaatggaggctgagccggcactacctgggcacaggctggatcttgttcagcacttaagtgtgtaaattacattgcaggaggctctttaaccttaaaagctctgctccaacagagctgttttctctggggattgttagcctctctgcttaggacttttgcctttggtcagtggagaatcaccacatcccaattaactagaattaaaagctatgcatttacagttctttaaaactaacgccaacggctcagacatttaactaggcatgtgatacagtgaagctgcactgcgcagcccctctcccggtcatttcccaccagaaacaggctggtgtcacgggaaagtccccgctccggactccagcaggcctggctgtccctgtgcccctcacgtaattagccctctagcctaggtttcctcccccgtaaaatggaggaagaggaaagcccacggggggagccctttaagaatcacacgtaagctcaaaggcttggcacacgtaggcgcgctccagggggccctcgcagccacgcgccgcggctcccaccccacccaggcagcgagctctgtgcctgggaccaagcaccgtgttacgctcaacatcagctgaatgaatggccgagtgagtggcagaggctccctagatggaagctgcaattgctcaggccgtgagtccaaacaggactcgcgcttataggcgtggagcggagctggatttctcccttggctaacacagcgggaaggatgaggtgcgggccgtagccgcgctgccgcgctgagtccgtccggcggggatgcccacagtgcgccgcgcccgctggagggcagcagagggccaggctcccggctcaggtctccggcctcgcggctccaaggaccccgggctccgcccggccacgcctcgtcctcccctattttctccttccttttcgcggctttccctcctctaccagacccggcaggaagaaagccacccacaaacgaataagcatgcccttgccctgcccgtgcgtggcactccgcatccgcttagctcttccccgccgcccgaaggcgggcgtctccccctctctgcggagcaggcggcggcggctgcgagtccgtgactcgaccaaggtcacgcagcaaagtcagcgaccaagctctgttccgcagacgccagggccaaagcccacactttccctaaagccccgagtgcacgcgcgtttccagaacgggagaactttggagaccaacttctgcattttcaaagggggccagcctgggcccagtttaatctccggcggaggaccggggttgcgggaaatgcgccggggagtgagggcttcccggatcccccgccgccgactccgcgcgggccagcggcgcggggcgggccgggatcagcgcctccccgggagagcgcagccgccgccccctcctctcgggctcccggcccctccccagcccctcggcccccatcctgcgcgtgggagaaaccgccgaccgcgcggcctccaggggctggcggagcagcggtggcgacgcgccagactccgtcctgggctggcccgtgccgggcggggcggggccggctccctccgcccttcccgggcaggcgcgggggggccgcagggacgcctcccggagtggccgccgcgcctaggccaatgagcgcgcggggagcggcgatggaggctggggcggccgggagcgcccgggacccccgccgccgcgccgccgccgccgcgcccccgcgccccggcgcccgcggggctggagagggggcgacagaggcgcagcgcccgcgccgggcatggaggcgccgctggcccgcgctggccgtccgcgctgcgtttcgcgccgccgccgccgccgcgcctcgaagtttgccggctgactcggaaagttgcgctcgggctcggccgccgcgtccggtccccgcgtccagcctccggcctgacccgctcgccgccgccgccgccctccacggggccccggcccagccaacccagcagccccgcctgccgggggcatgtgagccgtcgccgcccccgagaggccgtgcgggctgcaggggccccggtgcctccgaggcagcgcgtgggcgaggggtgcgcccgggccccagggccccaggcagcccggcttgccatgggcatccagggcatggagctgtgcgccatggccgtggtggtgctgctgttcatcgccgtcctcaagcagttcggcatcctggagcccatatccatggaaggtaacgcgtggccacttgccccttcgccgcctccgcggcagaccagtggtctggagggagggaccagtacccgcacgccggggtgcactggtctggcgaggagcggcctgggccgccgccccctcccggctccggagggttgggcctgggactaaggagacgtagtcccaggaagccccagaggggacgaagccgcagcgcttgggctgggtgtgagtgaggcgcctggtgacaccttgagcggacagctcctgccatcctaggcctgcagtccgggcgcccctggtgagcacaccggcttgggtcgccctgtagcgggaggtggcgcagggtgcagatgacaggaaggaccctcagcccagggcacctggcagccggcggtggggagagatttgaggcctctgccctgtgatggggcctcccctttcgccccgcacctggtatccagttacccctccccaagcaaggttcaagcccatgggatcagtaaccaaacccgcaggcgccacatttctgtctcaataaaatattaactgaggagacagacccacacttggatcagacactgacggccccctggggcccttccatggtacacctggttctgaaggggaccctgaagccagggatgtagcttttcccctgttcaaagaggccctgcacctctggccgtggggaaggggctagctcgtcctgttctcgtccctgttgccctctccgaggacatgggcatcctgcctgccccagcactctgctgaccttgccgggctccaactctcagtactgagacccagaggcctgagaatgagagagagcgagcttgcccctgcctgggagctgcccagcagcccctcgggcatggggaagtgccccaagttcctgcgaagggctgctgagtgcgggaaggggcaggaagcaaggcttccctccattctaccttcgatgtccagggctggcccttttcccaaagtccacagccacatgcccctcagaagccactgggctctgccacaccttctctcttggtgagtgtatgaggcccagagagaacgggcttgctccaagtggttcagaggggtgccaccaggagctttggattggagatgggggagaaagtggcccaggctgggccttcgctcggccggatgctggccctggcaggaggaatctgtgacagggaacttcgtgggacatacaggtgctgggattggggcagagtgtggaggggtgagcgtcctgtgctgctgtgcctcagaggaccgtgcctcctgcagggattgccatcccctgtccccttgccccattttctttccccatctggagcctggggtgggcgtggggggtggctggtgcacagggaagctgtgatctctccattgctcttccctgatcctcggggcctccagtggccaggagcaacagccagcctcacttcacttagtacctcagaccttcctaacagcgggttcacccacagtcgggggcagtgtgaggtttgcctttgtgatttctgaggaggtttctttgcaaggtggacagtatgcacaagatgacagatggtttattccacctgccaaaaaccccattcaggctcccatgaggctccgttttctgtgggtatgtgcccactcatacccctggagttctggggtcttgatccagttgggggagctcagagcctcagagtcagccaggcctgtgctgagatcctgtcaccttcataaactggctgtaaaaatcccttaaacagtcgaagcctcagttcaccatctgtaaagtggggctgataagaattcctgctccctagggctgtggcaggcttgaaccagtcagtggggcttgcatggataataaatgtgcaggctttgtgagccgtgcttatcagggatattagcaatgcgtatgtgagtggtactcacaataacagcactgattcatggttgcagccattctctcactcagacacccccccccgccccccgtcagagggagggcgtcgtgagttccagatgttctgttgatggggaatggtgtcagccagccgagggcctggaagctcccattggccaggcagtgtctaaggaactgtcagatgagctgtgaggagcccaggctgtcccaccagcctggatgtgagctatcctcagtgccactgggggccggaaggggactgttgccccagctctgctccaagtctgcgtgtgtgcagtcagaggggtctcttgtcctctctgagcctccgtggttctcatctgtaatagaccagagttatggtgccctggggattgttaggaactaatggatctgggttctggggatgcagccttctagaaatacatgcagcagtcaaaaagccttcctctctgccctgggtcccccatcagtccctttcccttgatgacttcatggaagagtcacctcagtcacttttcctgagcagtaatggagcaggaagctcgccccttgatccatggacaagggggctgagcccggggtggtggcatggctgtcctgaccaccagggcaaatcagtgggcagcagggcatgggcctggccagaggccaggctagcctcagtgtgacagaccctgggtggcagaaaagcagtcctcatcctgtctgcttaattaggattcctccttccctggtgacctacgggatatcagagatgaagaagctgcctgccatccacgagccttgcttcggcaagtgtgcgagagcttggagctgctgggacggccccgagggccatcaaggggatctcatgttggctttgggacctggaccctgtagggctgggctgggggtggggtctgcatctgaagggctatggtgcctgacactccatgtttaacacagtggggtcccagcccagaaggtccataaagctcctgaaattatgggcaagattatgtgtttggtgcttcttcctggagtgctgaaatacggttctcaaggggatctgcgttcccaaagtgttcaaaggctcgcccctgtggctctccctggagccttgctggtggagggtgttggtgggccccggcaggcagcattcctgatgtgctggtgacataaaggtcctccttgtccctctgtgtctcctggctcctagcacattccttgtaggagcagagactcccttacacacttgatttttctccacagccttgtcactcccttaagatactgggtatctcagtttctttatcattagtttgtggtttgtctcccccagctgcgggtcacatgagggcagggactttgtcttggtcacgttagcaccctgtgcctagaacagtgcctggcaccaggcagcagctcggggaggatttgttaaattcatgagggaacctgctgaccaagagggagaactggagccttctcctgtcccctctgctccacctcctgctggcgaacctgaggccaggtcctgtgagagctactgcctggatgggcaccgagcagggggcccggagcagcaggggtgggggctgctgcagagagcacagaggctggaggtggggtgtgctcggtgtcatcagggtaagtgggtggagccgagtgagtgaggagtggtggcagtggaggtggggggccagtgggctctttacccagctgtacattatcattgtaatcacctgggaactttaaaaaatacccgctgtgcccaccctggggcatcgaactctaaatctctgggtgaaacccaggcactgggatttttaggagtttcttgggggactctctgtcctgggtcccccatcagtgcctttctctgggtgacttcatgggggagtcactgcagccacttctcctgagcagtgttcagtgtcatcaggggtgagcaaactctgaagccagagttgggagttgggcgcaaggccttcgaggacaggggctctgggtcagcagcagcagcagcccaggagcttggtagaaatgcatcttcaggcccctgccccaaacctgcgggctcagaaagtctgggcttgggcccagcggcttctctcttccccagctccaggtgctagggacatactcaagcctgaagactactgccctggccaggggtggacctccgcaaggacattggcttttactgtaggagaaacctggagccatcggaaggtcctgacaagaggagtgaagtggctttgcatttccgcagggtcccactggctgctgtgttgagagcagacttggggtgcgaggcaccaggggaagcagatcctatgagaggcatttgcagccatttaggagggagacagcattggggttgggggaagtcgccagttccagatgcatttcccggggagagctgttggtttgcagtggggcatgagaggaagggaggagtctggaagactggcctgagcacctagaaggtgcagtggccatctattgagatggggaagcctggggcggggtgcaggtttgtgggaagctcagcagctccatttggacctggtaagtttgggatgtattttctatcactgctgtgacagattcccacagatgtcatgcctgaaaccaaaacaaatttactgtcgtatagctctgtggctcagaggtctgcagggacctccctggctcatgcctgtaatccctgcactttgagaggctgaggcgggagggtcacgggaggccaggagttccagaccaacctcatcaacatagcaagaccctgtctctacaaaacaaaaaaagatccaagtggagccatgaaggaggtgttggggtgtacgtgtcaggaatttatgggagtagtctggctgagaaagaagtttacaggccactggctaatgtagggatatagcactgtgagactgggggagtcaccagagaagagggtgggacaggccaggtgcggtggatcaggcctataatcccagcactttgggaggccgaggtgggcagatcacttgaggtcaggagttcaagaccagcctggccaacatggtaaaaccccgtctctactaaaaatacaaaaattagccgggcatggtggcgggcgtctgtaatttcagctacttgggaggctgaggcaagagaatcacttgaacccggattgcagtttgccaagatcacgccactgcactccagcctgggcaacagagcaagactctgtctcaaaacaaacaagaagtgggtaggacagaaaggggaccagattcaagggcccaaccctggggccctccagcatttgttagcaggtcagggagaaagagcagggtcaggaacactgggagagctgtgtcctggaggccaggggaggaagggtagctggggagggcgggagtgaccctggggtcagaggctgctgacgagctggttgtggaccccgaatatccaggctccaggtcacctgagaacaagacccagcactggacttagcagcccctcctggaatctccatgctccccgaccagccttccccccagccctccctctccagccctctctccctccctacctctcgaaggagtctcacagtgctgtgtccccacatttgccagtggcctgtaaacttcctctgccctccctcccctgccatttcccctagtcctccctcccttgcctttcccccaagcccttcctcccctgccttccagttcagggacatcctgttgccagttaggggctggccagggggccagccagggccctgacccactggcaatgccggaccttccttggtcatcacaactggtgaccagacatgtccaggagggagacaggaaggccagatgctttcctgtgtggagctgttaacagcctggtcaccctgcaggaggcctccagtccatggctgaagagggtgtgcagctgtcaggttgttgcttcagtgatttgggggttcccaggcatctgccctctaaacctggcactctatcccaatgcctatagtcccaccattagtcatatgggttagcgagcaaacactgagagtgtgtgttggggtggggggctgtaagggcctcccagctgggcaggattggattctggctggggcaggagtgtctcctagtgggaggattgagccctatgcacaaagtgagtgagttgccaagactgtacaggaggcaaggccctgggaagagaaagagatgctttccatgcagagaacctgggtgggggcctctcccagcactccccacacaactgatcccagaggaagagcagctgacaccaggcccctcatcggatgtggctgtgtggtccagttcagctcccccatgaagggccttctgggatcagatcggattcagaggccagagcgcgaggcagccagcattgggctggagccgggcatcctgacccgcaggccctgcctggtcgagcacactgggtttccctccgttccagcccggtttggccacctgcttaccaggtgacttctctacgtttaacctccttgagcttcaccttcctcatctgtagaatggggataataatacctcccagtatccactttagccagagggggtgctgagccaaaaacactttggaaaagttgaaagaggaactcagatctcagaaattcagaaggggagggcaagcagaagtgggtgcaggcgggcgagcctgggtgctgttgcgaggctgatgcagcccgacccagagctttgtgaccacatctgtggcatgaggctcggctttggctgcggcttctcttagctcggctcagatttccacacggctctcaaccaagggcagttttaccctgcagggacgtttggcaacgtcgagagacatttttggttgtcacagttggggaggtgctactggcatctgggggttacaggccaggggtgctgctcaccatctggcagtgcacaggacggccccagcacagagaggtgtctgaccccatgtcagtggcacggaagtggaggatgctgttctaaaagcagtgctggccgaggactgggagtgccacttcacgtggacaagtcacttctgtctgagtggtttcctcacctgtaagtgaggggtggggagcagaggtaccatctcccctgggaactctcccggaccttgccctctccctgccccctcaggttgtgttagataacactgccctcagattttctgtgttcctgtcctgccctgccatgggctcttctcagagcagcaggggcgtgtgtctctatacttagggcctcacggtatgcccaacactgcctggcaagcatcgggtgttcagtaaatgtaagttatatgccaccatagcacgcacttattggacatgcgttttatgccaggcagcacaggtaacatggagtcttggccctacctttacagtagctctgggacggtgccctctgcagggagggtccctctggctggggcggaggcagggagactgggttgtgggtctggggacagcagaggtgtgaggtgtgatggggaagaggagaatgtctagaaccaggatgtgcagggtctggcccactgcccttgctcctccatcctgggaggtgaccccaaacactgcacatgccctctgcgcacttgccctgaaagcgtctctaactgcggggccaaggggactaccaggggcctggtcttacaaaggtgaccttggggcctgttgggtctgcagctacctcttggcttggagcaggcccaaggggccattgtgatccttcctgctcgttctcttgctctcctttcccccaacaccctctcccacctttgctggggccagtggtgatgctgtgggtgtgctgggtgctctgttccctggctgggtctggtgccctttgtaaactgccagtccctcaggtcttgtgcagctccttgagcaggctttccagatctgggatgctgatgacagtgataggaaccagcctctagagaatgctctctctttgggggcactttatgcatatcccaatcttgtcctcatgagcaggctcgtttcatcgacgaggaaactgagggccggggagcggcagagtcaggacctttctgaacaccggcacacctgccctgaatgcatccacagctgcagggccttggggaccaccggagatggttgtgtgtgtcccagcctcttacaggacaggtgtcaggagcccaaagtggaggcagctgccctggtccaagtccacagtgagaggacccactgccctgagctggtgtggagactgcatgtgtgagtgtgcacagagcttgtaaggcagcgtctggcatggaggaggcgctttctttcttttttaattattattattattatactttaagctgtagggtacatgtgcacaatgtgcaggtttgatacataggtatacatgtgtcatgttggtttgctgcactcatcaactcatcatttacattaggtatttcgcctaatgctatccctcctccagccccccagcctccaacaggccctgatgtgtaatgttccccgccctgtgtccaagtgatctcattgttcagttcccacctgtgagtgagaacatgcggtgtttggttttctgtccttgtgatagtttgctgagaacgatggtttccagcttcatccatgtccctgcaaaggacatgaactcatccttttttatggctgcatagtattccatggtgtatatgtgccacattttcttaatccagtctatcattgatggacatttgggttggttccgagtctttgctattgtgaatagtgctgctataaacatacgtgtgcatgtgtctttacagcagcatgatttataatcctttgggtatataaccagtaatgggattgctgggtcaaatggtaattctagttctagatccctgaggaatcaccacactgtcttccacaatgtttgaactaatttacactcctaccaacagtgtaaaggcgttcctatttctccacatcctctctagcatctgtggtttcctgactttttaatgatcgccattctaactggcatgagatggtatctcattggggttttgatttgcgtttctctgatgaccagtgatgatgagcattttttcgtgtgtctgttggctgcatagatgtctgcttttgagaagtgtctgttcatatcctttgcccactttttgatggggttgtttgtttttttttcttgtaaatttgtttgggttcattgtagattctggatatcagccctttgcccgatgggtagattgcaaaaaatttctcccattctgtaggttgtctgttcactctgatggtagtttattttgtcgtgcagaagctctttagtttacttagatcccatttgtctattttaacttttgttgctattgcttttggtgttttagtcatgaagtcctcgcccatgcctatgtcctgaatggtattgcctaggttttcttctagggtttttatggttttaggtctaacatttaagtctttaatccatcttgaattaatttttgtataaggtgtcaggaggggatccagtttcagctttctacatatggctagccagttttcccagcaccatttattaaatagggaatcgtttccccatttcttgtttttgtcaggtttgtcaaagatcagatggttgtagatgtgtggtgttatttctgaggcctctgttctgttccattggtctatatatctattttggtacccgtaccatgctgttttggttactgtagccttgtagtatagtttgaagtcaggtagcatgacgcctaggaggaggcacttttggagtgtacattcgctttacttcttgcccgaaatgacccaggcaacattcccccacagctacacatcactacctgtgtcctaggagttagtgggaagggaagatgcatgtggcccacacttggttgtgttgggctttcttcatcccgtgccctgtagggtcaggagcccagaggctgctggcccagggactgctgggccatgctcgccggcgtgggtggcctctgcaggagacagtgtgggctggagctggatgcttgatgttgctctaggctgggaacctgggcaaggcccctccctccccaggtcagcggctctactgtcacatacctagacacaggtggtagcatcacagcagtctcaccacagactttccaataagtcttacaagtccagtgccccttgatgggtaaaagggacagctcagctcagattcaaagggagtcttgcccgaaaggcctcccttcaccccatggcagttcctggaccttctgtggaaccctatggtttagtagtgacctgagcagcagagactaagtgaaggctgagatccccggcctgggacaggggtagggagccccatttcatggtgtgctggatgccctgcctgcctcttccccaagccctcatggactgtcagccagaggcaccagtgggcaattccagggctaactgcgcctctgaggagctgagctccggtcgtctagaggctggacccctggggcggtggttagggctgctttcttccctggtccccacaggccttatggggattaggcagccttcctgcccagtgctcagtcactaaggagggtatcatgtgaagtcatgagtgcagggccacaccaaggctctcagtggacccaggactgcaggaattccagggcttcccatcattaaattaaattagtattgaaatgcagtatctatgtcaggaaggccatgagtgttccccttggtgaccacatgtgtacttttggaaatatcagatccagtcacaccccagcctggtgccctgccttgctggcctcgccttgctgtggctggagctggaactggctggctgttgtctgagccagctgtgtccacccctggcttctgtgtgtgtcaggcacaggccgtgcgcagtgtcacacaggggcatgaatgtgctgcagtgcaccaaggggaccttgaccagcagctttggggagtactggtggggggagcatctgaatggagtgtgttcaggagggatgggagccggggaacatggcacctctttggagttttgccacagaggggaacaggatgggtgacagctgtcaggggacataggctcgagaggtttttagagaatcttccattgcttctgcttctctcctatgtggcaagctgcaggaggcctatgaggggctttgcagaggtactggtgcagctcagagaggtttcacaggcttcacccatggggtggcgaaaaagtgcctcttgcccagtacctggtgcatttcagcttagtgaattaaagatttggagacactttgctgagcttttgcacagagaggactacatggggtatgggacaggacctggactgagacttttacacactgggaagaaagccctgcttgtagtctgtcaggctgctgtacaacttttaaacatcaaaaagtcctcatgcttttactcctttggcaaaatgcttgttggatagaggaattcaaacttgattgcagcccccctggctatcaacggtgtattagcctgttttctgctgctataacagaataccacagaatgggtaattctattgtacagaaatgtattggtttacagttctggaagcttggaagtataagacggaggggctggcatctggcgagggccctcttgctgtgtcataacatggcggaaagcatcacatggctgaagggcacagggagcaagagagagtaagaggggcaaaactactctcatggtaacaaacccacttctgcagtaagggcactagttcattcatgagggcagagccctcgtaaactaaacatttcttaaaggtcccacctcttgccaagcatgatgctgtgcacctgtagtcctagctacgtggaaggctgaggtaggaggatcacttgagatcaggagttggacacctgcctgggcaacacagtcagacccccctttcaaaaaccaaacaaatttttttttttaaaaaaaggtcccatctcttaatactgttgcagtggcaactaaatttcaacatgagttttggaggggacaaacattcaaactgtagcattctgcccagcccacccctggaaaattcatgtccttctcacatacaaaatatattcattccatcctgatagctcccaaaggtcttagctcattccagcagcaactcataagcccagagtctcatctaaatcagatatgggtgagactcaaggcatgattcatcctgaggcaaattcctctccagctgtgagcctgtgaaatttaaacaagttacatgcttccagaatacaacggtgagacagttgtgggatagacatttccattcagggagaaaccggcaagaaaaaagggggtaactggtcccaagtacgtccaaaaccaaccatgaagagcaacattaaatcttgagactcgggaataatgttccttgactccacatcacacactggggccctgggcacccccacccccatggctttggtgggctcggcagccacaggagctctcccaggttgatgttgctagccggtcacgctggtagctctgcagtctcaagggcagcccagcccctgtggctccacaaggcattgtcctagcaaggactctctggagtggctctccctctgcaacaggtctctgcctggacccccagtctgtctgatccagcctttgaaatccaggcagaggcagccacgcctccactgctcttgaactctgtgtgcctgcagaattagcaccacatggatgctgccaaggcttactgcttgccctctggagccgtggcctgagccacacccaggcccacttgagccacagctggggcagccaaggagcactgtggtggaatgtgaggagcagagtcccaaaggtagtccagggcagcaggtccttggagggggcccttggcccatcccctaaaaccattctcccttcctagagctctgggcctgtgatgagaggggcagcttggaatatcctgaaatgccttcatgataaattctgtctttaagtcatttctttcttctttcattttactatatgatattaaaagaaaccacacagcacctcaatattttgcttagaaatttcttctgctgggtatcccagttcatcactcttaaattctgccttccatactccagtctgggcaacagtgtgagactccgtctcaaaaaaaaaaaaaaaaaaaattctgccttccataaacataaagccactgggtgtggacacaattcagccaagttccttttcactataaggatgggcttttctccagtttccaataccttattcctcaattccctctgagacctcatcaccatccatatttctgccaacattctgatgacagccactttaatctccaggaagtttcagacttttcctacagctcttctcatcttctgagcccttaatgttctgttcatggcgacaggcttttttctagtctgctcttccagactcttccagcctctactcactacccagttccaaagccactttcacatttttaagtatttgttataacaacacccactctcagtaccagttttctgtcttaggctgttttgtgcagaataccacaaacagggtaatttataatgaacagatatgtattggctcgcagttctggaggctgggaagtccaagatcgagggcttggcatctggggatggccttcttactgaatcatcattccatggcgaagaacagacagacagacagagagagagagagcgagagacagagagagagagagagaaagagggggcaaagccaccactgtgataatggtattagtccattcgtgagggtggggccctcatggcctgaacacttcttacaggttccacctcttaatactgtcacagtggtgactaaatttcaacatgagttttggaggagacaaacattcaaaccacagcaaatggagactttgatggggaggaggtggcccaggactagcccctggagaaggaggaagagagccacgctgggggagaggtagaaagggaaatggctgagttcgttggcatcacaattttgccctgagcagtcttctacaagttaacatctaaacacacagagctggagcgctgatcaatagtaaaaagcccaagtttcctatagacagtgctctaatgttacgttgaaaagccatgcagccatcttcttgcctttcttccatttctgggtaatttcttccatgtcttggtggatgacaccagcagtcaccctgtttcccaggtcagaaatgtggagtcattctggactctgcctgccccatcctggtcaagtcagcagctaggaactctggcttcttcattcctgacacctcccgccagttcccttcactccattctcttcacgtcactgtgacaccctgtggccagagtgaccattctggagtggaaatcagacaaccctttctctgctttggacccttcgatagctctcatgcccacatgtgccttggctcaccttagactccatgcccgggtgcccttgaccccagttcacctgctgtcactggacctgagtcttggaatattatctctttttctctgattctcctgcccactctgtgcccaacaggtgtaaacatcagggaatgctggggcctgggacaatctgcaggaggcaggctctgcctagagacattaaaattaaagcccacgccagtactccataaactcaccctaggaaacatagctgggaggatcctacccagcctgcattccagagcacctcccatgcacaggcactgttccagggctgggtacggcagcgaggagacccgaatccctgctgcggtcaccctgtagagggagagaccaacaatataccagatgtcttagtcttctctggctgccataacaaaataacacagactgaaggacttaaacaacagaaatgtattttctcccagctctggaaagaaagtctgagaagagggtgccagcagggtcagtttctggtgagggctgtcttcctggtgtgctgacggctgccttcttgctctgtcttcatgtggccttttgctgcatgcacgtggaggcagacatagctgtctctcctacccttttttttttctttttttttttgagatggagtcttgctctgtcacccaggctggagcgcagtggtgtgatctcagctcactgcaagctccgcctcctgggttcaagcgattctcctgcctcagcctcccgagtagctgggattacaggcatgcaccactatgcccggctaattttgtatttttagtagagacagggtttctccatgttggtcaggccggtctcgaactcccgacctcaggtgatccgcccacctcggcctcccaaagtgctgggattacaggcatgagccaccacacccggcctctcttactcttcatataaggctaccaatcttatgggataagggcccaaccttgtgaccccacgtaaccttggttacctcctaaggaccctatctccaaatacagtcacactgggggttaagacttcaacgatgaagttgaggggacacagttcaatcctatgcactagtaaacagaaatctgcatatgcacccctcgcatgcacagttcacggtagggtttgcgctcctatgagaatttaatgccgctgctcatctgacaggaggtgaagctcaggcaggaatgcgagcagtggggaccagctgtagatacagatgaagcttcacttgctcacctgccgcccacctcctgctgtgcagcccagttcctaacagaccaccgactagtactggtcctcggcccagggagttgaggacccctgcactagagtgtttcagaattaccattgatctacatatttgccaaaaaaacttattttttcattattattatctcttagcaatctaggaggtactgcattctcatgctaatttacgtgttcctgtttattactgaaattgagccatcttttgggtttgtatccatctttctggtttccctttctgctgatacctgctctagagattcttctttcatcatttgtgaacactctacgctatcttcttctattctgttgagtgtctcactctgacctttgttgaacagaaatctttaattttgatgtaatcagattcatccttttttttccttgtggtttgagcttttggagttttaagaaatctgtccagaatcttaggttaacaggaggctcttttacattttattatagctctatcatttaccattcacattggggtctctaatgcacctggaacctacatttgcatgtgggatatggaaggagtctagattgttttctttatgtggtgatccagttttcctaacaccatctactaaacactctgaccttttttcccatagctttcatgaaattccctcctacacctcactctcttttttgagctctctggtctgtttgttggtacgtttgtctgttcttgtaccaaccatacaatttttattacaatgactatacaacatgtactagtgtctgagagaaactcctcccttgttatttttctttttaggtttttatgaattgtttgtttctccatatacatttcagtgtgtgtttatcaagctttccaaaaaaaaaatccaactgaattttttattggaattgcactgaatttacttacagattactttggggagaaatgacattaatatgtggccataagatggaatgtctcatgtattcagaatatctttccatgtagaggtcctttgagtttttattactacttagagatactctttagttttattgctattgtgagtgtttatcttggtatttttaattatattttctagatggttattactggtgtagagaactgctattgatttttgtatcgattaatcttatatctggcaaccttactgaactctcctgtctgttgattcttttagtccctctggggaccctatcatctaaataatgttaattttatcctttacttctcaattcgtacactatttatttcttttctaaatttcctaagagcattggcaggacattgattagtggggactgtggccaaacttgtcccaaatattaaagggaatgtatctaagcttttgccattaaatccaatattttctgtaattttttttgtaaatatgtgatttgcaaatataagcaaatcacgttaaagaacttccctttgactcctggtttgctgagagttttttttggtcatcgtttattttaattataaatagacatgaaagcttatcaaatgccctttctgcattaagattttcatgtgatttttcctctttatgttcttccagataaaatcttcttgatcatgatgtacttaaaaaaatgccattggcttcatttagctaacatttggtttagggttttgcatctgtgttcaaaagtggcattaggcatacgttgttcactctcactcttgcgttttctgatatggtttggatgtttgtccccccccacatctcatgttgaaatgaatccccaatgttggaggtggggactagtgggaagtattgaatcacgggcgcggatccctcctgaatggcccagcaccatgctcatggtaatgagtgagttctctccatgagttcatgtgaaatctgacttttatacaatttatataatacattaaagagcctggcacctcctcccttgtgtctcttgcttccattcttgccacgtgacctgcttgctccctcttcaccctccatcacgattggaagcttcctgaggccctcaccagaggcagatgccagcactgtgctttgtgtacatcctgcagaaccacaagtgaaataaacgtcttttctttataaataatgcagtcttgaggatcacttgagcccaggagtttgagaccagcctgggcaacatgacaaaaccctgtctctattataaataaaaaaaattagctggttatagtggtgtgtgcctgtagtctcagctacttgggagactgaggtgggaggatcacctgagcctggaaggctgcagtgagctgtgattgcaccactgcactccagcctggacaacagagtgagaccctgtctcaaaaaaataaaaaatttacctagtctcaggtattcctttctagcaatgcaagaatggattaacaccttgtccttatgtctttttttttttttttttttttgagacagagtctctctctgttgcccaggctggattacggtgacatgatctcagctcactgcagcctccgccttcagggttcaagcaattctcctgcctcagcttcccaagtagctgggattacaggcgtgcaccactgtgcccagataatttttgtatttttagtagagacggggtttcgccatgttggccaggctggtcttgaactcctggcctcaggtcatccacccgcctcggcctcccaaagtgctgggattacaggcatgagccaccgcacttggccccttatgtcattttttaaatcaaaattacaatattgaccacatggagatcatccacgatccttgtaagagcagttttcttggagtggagtaagtttgagggagaacaggaggagaggaagtgaaggcagggagttacaggaggtgagaaaaaggcttaggggaaaatatggtcaaggagttttgttgtttttaatggaagaaatagcagcaggtttggagtttctgtcttattttgtttcttggccctcgggaaagaggattaagttcatcctactctgtagttcatgggatatcatcagccttgacccatttacagcctctcatttgtttttcctcttttacacccctatttccctcctccccatagctaagtattctcattttttctaatttaaattaatgtaaaatttacctttttggctgtctagttctatgaatctcgatacatgcatagtcatgtaaccattaccacaatcaagatgtggaacaatttattttaatttaatttaattttaatttttatttacttacttagtttttggagatggggtctctgtcgcccagactggagtgcagtagtgtgatcctagctcatggcggccttgaactccagggctcaagcagtcctcccacctcagcctcctgagaggtaggactacaggtgtgcaccaccacaccgggcacctggcgatatagaacaatgtcgtcaccacaaaaaattgccttatgctgcctctttggtagtcagcccccaggcagccactgatctgttctctttccctgtaattttctgtccttttatcttttccagactgtcccatggatgttgtcagacatgatctgcctctggagtctggactctttcacgtcattgcatgtgcgattcattcatgttttgcgtgtgtcaggagtttgttccgtattgttgctgagtatctttccttgtgtgatgtaccacagctcatccactcaccagttggagggcatttgtatatacagtttggggcaattttgaataaaattgctctaaacatttgcctaaagttgaatatagtagctttcatttcatttgggtaaataaccagaaatgggattgctgggtcttatgggaagagcctctttataagaaagtggcaacgtgatttccagcatggcagtaccacttctctctcctgccagcaacatatagtggttcccgtcgctctgcatccccccactgcaagcgcccgacattgtcaatatttgttatgtaagcaattctcataggtatatagcagtatttcactgaggtttcaatttgcatttccttaatggaaaatgatgctaatcctctttcttgtgcttattttatcagcgttttatcctctatagtgaagtgtttgattaggttttttgacatttactaatttgagttctttgatttcttactgcagagttttgagacttctttatatattctgtatatcctttgtcagatatgcagtttgcaaaggtaatattttctcccagtctgtgcttacctttttatttaacaatatctttgtaatcccagcacttttggaggctgaggtggccggatcactcaggaactcctgaggtcaggagttcgagaccagcctcgccaacatggtgaaatcctgtctctactaaaaatacaaaaactagctaggtgtggtggtgcgtgcctgtagtcccagttactcgggagactgaggcaggagaatcacttgaactcgggaggcagaggttgcagtgagctgagatcatgccactgcactccagcctgggcgacggagccaaactctgtcttaaaaaaataataaaataaaataaaaataaaaaaaccaatatctttattcttctttcacaaaattattttagctattctagttcctctgtctttctagataaattttagagcatgttgtctgtatgtacaaaaaaactcttgctgggattttgataggaattgtatgaaatctgtgaatcattttggagataactggcatctttatagcactgagtctttcaatccatgaacatagttatgtttcttccatcatttgaatcctccgtgatttctttcatcagcattttgtagtttttggcatacggattatatacatgttttgcaagatatatacctaagtatttcatttgtgagatgagcaattgtaaatggtattgttttttaagttctgtctttttatttgtgtgtaagatttttattctaatttgcattccaaaggaaattacaaaatccattcacttctttatataaaaaagtgacttaacattttttttttttttttttttgagatggagtctcgctcttgtttcccaggctggagtgcaatggcacgatctcagctcactgcaacctctgcctcccaggttcaagcgattctcctgtcttagcctcccgagtagctgggattacaggcgcctgccatcacgcctggctaatttttgtatttttagtagagacagggtttcgccatgttggccaggctggtctcgaactcctgacctcaggtgatccacccgccttggcctcccaaagtgctgggattacaggcatgagccaccgcgcccggcctgttacttaacattttaatgcaaattataaaacatgataaagttgcaggacaaactaggctagctgcttggagtaacaagtttttaagtcaccattttctacttccatgctaaggataaccttctaattagtgatcagctgtactgtaatagcagaataaccctgagacttgagtaaacagaaaagctgaagatcttctccagttcccagccaggtagttttctatgccttctcatagtagcaaacagcaactatgtcaccaaaagtgaggatccaacagcataagaatgacacaatggactttggggactctggggaaagggtgggagggggtgagggataaaagactataaattgggttgagcatatactgccggggtgatgggtgcaccacaatctcacaaatcaccactaaagaacttactcatgtaagcagacacgacctgttcctcaataacctatggaaataaaaaaaaattaagtgggagtcataaccattttgccatccttaatttctcttacaaaatttgtgtctttgccatcccgtttctgtatgtgaacacttttgtctccatccaggctaacaacagacatactctaccagtgtacagtgtctgtcatcagcagtggtgtctctgtgtgaatgaatatgctttgagtcctgctcaccactttgtctccttcctgactgataatcactgttggtttggtcacatttccacctgcccagtggcaaagcctacacctttgatgacccttcatgtcgtcatcagagttctgactgtccctcagcttccaggtagcacaaaaagcccccaccatccttccctctccctgtttagctccaaaacagatcaaagagaccggagcaagactcttggatcttactgccactgaaattctggagacacctttgcctaaattttgatttctaattgttcattactgatctgtagaaatgtgattgatttttgtatattgaccttttttctttggggggaaacattctgttttttaccgttaagaatgatgttaactatagattttgtgtagatgctctttaataatgtggggaagttccctttcattcccagttatttttaatgaatggatgttgaattttgtcaaatgctttttctgcatcaattgatatgattatgtgcttttttcttttttagactattaatgtggtggattatgttgttttatttttaaatattgaatcagcctcatgttcctggaaaacccctcttggtgtggtgtattattctttttattcatcaaaggattcaatttgctaatattttgttgagaaatttcacacctgtgttcatgaagaatattggttgggactatttaggttatctttttcacctgggatgaatttgggtagtctgtaatttttcaggaattggtccattttatagaagttgttgaatttgtgtgtgaagacttgttcataatatcccctttttatccttttaatgtctggaaagttagtacttatttcccttgtttccttcctgatgttggtagcttatgtcttttctctctttttttttcaattttttcaatttatttttttttgagctggggtcttgccctgctgcccaggctgaagtgcagtggtatgaccatggctcactgcagcgtcaatctcccaggctcaagtgctcctcccaccttagcctcccaagcagctgggactacaggtgcacacaaccatgcctgggcaatttttttgtagagacagggtcttgctatgttgcccaggctggtctcgaactcctgggctcaatcaatccacctgcctcagcctctggtgctgggattacaggcgtgaaccactgcactcagtccatccagtgaatttttaattttaggtattgttttgttcaagcttagaagttccattttgttcttttattatagtttttaatttttctattaagattctcatctattatgctttcttttctttatttctttcaaagtgttgataatagttgttttaaagttcttttctaataattctaacaaaagtctaataattctgcttatccttcatctctttattatggtcacattttcttgcttcttctcatgtctttttattttttattgtatgttggacattgtgaaagggatagtgtaggcaatggattatattgttttaatataaatgctaacaaattttggtttggcatgtagttaaattattggccaactcatgtgatcttcacagactttattttaggctttgtcagagtaggtttgttttgactttgtcattgggtctagagcatgcgcttactcaaggatgtggttcacagtcctaaagcatagcttttctggggtttcagccaacacctgagatgcttagggaggtatctccactctggctgagccagtactccagttttcccatcactgcatgaattctcacatgtcctttcaagtaccttttcctgtgcttattggccagttgtatatctttttttgtgacacgtccttgtcttttgcctgtttacaaaatcgagttattagtcttatgctgatttgtagaagttaattatgtattctggaaatgagtcctttgtcagatacatatactggagatatgtttttccagcctgtgacttgagtttcttaatgactttattataaggtttgtggctatgcttatatttgtcattgatttttttttctttttttttgagacgaagttttgctctgtcaacaggctggagtgcagtggtgtgatctctgctcactgcaatctccaacctcctgggctcaagcgattctcatgccccagcctcctgagtagctaggattacaggtgtgcaccaccacacctggctaacttttttttttttgtatttttagtagagacagggtttcgccatgttggccaggctggtcttgaactcctgacctcaagtgatccacctgcctcggcctcccaaagtgctgggattataggcgtgagccactgcacccagcctgtcattgatttctactcttgtttttattatgttctttcttctatttactttgaatttaatttgctctgcattttttagattctgactcttagatctagaagcttatgtcattgcttttacacctatcttcttttctaataaaggaattgaaagcaataaatttccctgtcagcccagctttacctgcatccagcaaattttgatatgctctgtttttttaatcattcaattcaaaatatctcaaaatgtgatcaccttgcagtttattctctgacctatgagctaattagaaatgtattgtttatttccaaatacttgagattttctaaatatcttgtcctgaattttaacttagtaccattgtggtaagagtctgtgttccagcatctgatatatattggtaacctcaggatatgctcttgaaaagaatgtgtatctacaattatacagtgttctataaatattaattaggtcaaattggttgatggtgtttttcaaaccttttatttcgtcacttgtcataccatttactggaaaggggtgctaaaatcttccaattatgattgtgacttttttgtttctctctttagttctgaattttttgttttaggtattttaaagctctgttactaggtgatgtctgttttagattattctgccttcttgatgaattaatccttgtatcattataaaacatccagctttcttaatgtttttccattcttttattttaaatcttttttttttttttttgagatggagtctcactctgtcacccaggctggagtgtaatggcgcgatcttggctcactgcaaccttcgcctcctggattgaagcgattctcctgcctcagcctcctgagtagctgggattacaggtgcccgccactgcacccggctcatttttgtatttttagtagagatggggtttcaccatgttggccaggctggtcttgagcgcctgacctcaggtgatccacccacctcagcctcccaaagtgttggggttacaggagtgagccacagcacccagccttaatatatctttgtattaggagtatccctcttgtaaacaggatataattggatcttgcttttccagtctgaaaagtctgcctcttaatcaaaggattcttaccatccatccatccatccatccatccacgctgctgtgtgtacatctgctccacggcacagttctccccagtgtgcagcctccatattttgcctacccatcctgcctgccataaacccctgagttgcctccaactctcctgccaaaaatgctgttgctgtgagcatccttgtgcaggcccctgggcaggggaagagtctatgtgggatgcttgcctggcgtgggatgctggtttacagggtttgcctatacttaatatgactaaggattcgagatactacagtatgtctatatggtgatgggaatgatccagaagaggggaaaaggtgatgaggaaagagtgggagacttggctggcaccgcttgcctgagtaggtgagagggatcgggacccactgcacaagtggcaggtttgcctttgctgggagcaggcacagttcagccatggagcaggcaggcgtgcagacgtctgggccaggtgcaggcaggtgggtaggtgtggggtgagggcttggggaagttttcctccatggcttgtgtcttctcagtgaagtgggaagcaacctgagggtaaggatgggagaggagatactggaaacttaaggggaaggatggtatgaaatagttatcttggagatggggagcatgtgtggaccaaagaaacagcccaattgctgagcagctttcagggtgctcttgtggttagtgtgagtgggcagtgcaggctgtctttcccaccacgctctcgggagaggcctgggtatggagcaagctcagcacaggaccagtgcccagcaccatgccaggcaccacgggcacaggatgagctgtgcaggacagctgcccctgaagagctcactgtgcagtgggagaggcagcagccagcaccagagtaccagccatgagggtgattatggatcaccaccattctgtgtggcccaggggagacagggcgacggtgcagcggggcccatgagtcctgggtctgtgggaaggtggcgctctgtaattatgcgaggatgctgctcagcaaggtgtgggcactcagtgctgtttcagccctagctttattttgcattgtaaaagtgatgcatgtcacaccaaaagaaattaggaaaatgttttttaaaatcataaataaaaaagtaaaaatcacctgaaattgcacctccccctcaaatgtagccatggttagttaacaagtttgtggtttttttttttttttttttttttttgagatgcagtcttgctctgtcacccaggctggagttcagtggcgcgatcgcggctcactgcaagctccgcctccccggttcacaccattctcctgcctcagcctcccgagtagctgggactacaggcgcccgccaccatgcctggctaattttttgtatttttattagagacggggtttcaccgtgttagccaggatggtctcgatctcctgacctcgtgatctgcctcagcctcccaaagtgctgggattacaggtgtgagtcaccgcaccctgccaagtttgtgtattgtttttaaaggacaggtctgatccctgcccccacagccctggaggtttagcctcctaaccagatgtgaataacacccctctgccaactgtagctgaacagcatcgccttaggccttgagggccaagggaggcaccctctccattcctggggaaagtcagggagggccacatggaggaagtggtctaggaattggatactgaagttcaagtgtccctcatgcctgtcttgctgtctttccccctcctatatccccttgttcagtgcctctttaggacaagagcagctcccaccttgtcccactgtgcggctgacaggggggcacactgcaggggctgcgatggggaggcccgccctgtggggggcaggaaagcagaggcacagctcttgtgtgggccactcagtcacaccccctctgtgcagtgcacagcctgtgtggctgtccatggtagtcatgcaaagagagttcctccacctgctattttggcccatgccctggccacactggagcaagatggaggagcagggctacaggccttacactctctggtctgtgtcccactccagatagcagcgacagtgagctggagctgtccacggtgcgccaccagccagaggggctggaccagctgcaggcccagaccaagttcaccaagaaggagctgcagtctctctacaggggctttaagaatgtgagtgttccccattcccccgggagaggccttggagaccctggctcagggagacctggaaacttctccatgccacagtaaatatcccaggggcctttaaggggcttatgtgttgtgggaaagctgtgtggcgggggcaggctccggaatgggcatcgctgaggccgccatgctcctccctccgtgtctttgctgctggtacagaggaggagggtatgggggagcagtcacccccttcctattcacccctcctccctctcaccccacctctacccaggctttccacaacccaggccagggggccccagcagtgccacaggcagcaggcagcccccaagggggtggagagaggccagccaggcaccatgcagagtcgggcttggagctgggggtggccgagggctgagggggtgccttcctgctgcaggagtgtcccacgggcctggtggacgaagacaccttcaaactcatttacgcgcagttcttccctcagggaggtgagtctgaggcagggcagccctgctgtgtcccagtgtggagggaggggaccctcctgctgccccttgcatcctggaggcttggtgctgcccctgtcccgtgggaaacagggactccaagccaggacgcagttagcaccctcagctggggttgcctggggtgggagatgagccgccaggcagccccgacacaccccagcctcttccttgccctccccagatgccaccacctatgcacacttcctcttcaacgcctttgatgcggacgggaacggggccatccactttgaggtaggtcctcgcggattcctcccacgtgtcctgcccctgtggttgcaggagtgaatccttaccctggcgtcactgtcagggctgtcgagagagccatggtcctgggtgggaaggatcttgtgagtcaccctgggaatgagtggatgtggctggccctgggccagtgagctctggggtgtttgactttgctgggccggcaccacgttctcagccttttcttccatttgagagtttgcatccagctctgcctggtcaagggagcccccgagacacacacgggtggtagtgacccagcgggaatttgcattttcaaagggatcagggcttaactcagaggcctggtttgctgacggtgggatgtgagacctccattttcagaatttactccttgttacccagaaaataggccaaaaatatctagaaaacatcccagccggagcagcctccagggctcatcccagctgggcactgagagcaaagcctggtgttacccactggcggaaggagaagcctgtcccccacccagacagcttccctgtggggtcctggcctgggctcctccccagccccgccacacaggatcattggagagaggccccatctgcggagcccaagcctctaaaaatagctgcaggcgaaaagctgaaaccgctttggggaggaaaacctttctgagagccggcttgatcgataccccgacagcttggcttccactgggctaagggcagctaacaggaaagcacagagaagcacatggggccagaaggccccggccacacggggtaataataacttgtcgataagctgcgcgggttatttttatgccgcaagcccgccaggcacactgacgctccccgcctgccctgtgaccacaggacccctcgactctgagccacactctgagggctctgcacatagaagcagaccgtgttttcaaatcttgttttcagatttgaaataccaaccccacagcacacagaaaacacccggttagcatggaggagcctcagggaggactcaaggtcctttccctgcccctctctcctggggtgccctttaagaggcacctgacacttcaggcagtaaagcatctttaggaaacggtgtaagggagcaggcggggtgcgagtggtttttcttgttcaggaatgagatgactgagaggctcggcagagcccctgctcatggcagtgctcaggaaggtcacagtcgcccctcacctcctgtggccatcaccctcgctgtcctgagggacagccttgtggccctttaaggaagcaggtggcagccctctgggctgggtctgtcagtggctgtgctgtggcccctctgctgggcaccttctcagaagatcactcatccctggcatcttcctgggccttctgcagcttctctgcacgtgaaacgaagtcctctggcttcacgcaggtacatttaccttgaggaacttctcgatttcaaagtgttctgctctgggaaggaggagggcacaagcccccatggccccatcctgggagccccacagactgggatcccagtggtcacaaaggatcctgccagggacggaggcaccaaatctagtctggagaacaccgggccatcctcactgccagccctcagagcctcctacgtgcgtctgtaatgcaaggcaaccctgcatgacactgtctgcaatgattctgtccctttctgtatattcttagagacaagatgcatattagttacagtttactgatatggtaaaaggtaataccctccctccgctcaccaaaaagaataaccaaaaagaccaaatcggaaaacacacagacctcaacagagccaagcgggcgatgccatccccacaccccaccttggagtggctcctgctcccatccccacggaccttctgggatttgccagcagcagggagccccaggtgagcagcgccacacacagatttgctgaacgctctggccaccagggcctttctcgtgcaactcatctggcttgccaggacgtgcagagcttccaaaacgattccgtagactgttggggcctcttcagtgcccaggatcaagtcaggcccagtttggaagtggcagccaggcaggcatctggaggtgcggccgcttctctgttacctcccccgacagtaaactgctccatgtgccagtggccaagcggcatccagggccgtgtgagggcagcctgcaagcccagcaaccacatgcgactcccaccccctcgctgagcacctgctccgggctctgccgggagaccctcctgtgcactcttgtgcaccttcacctggaagtatgctgtgtcactggagccctcaccctgcctagcccctgccatggggacagccgtagaacagaggctgtggatgtgacagggttcctacactttggcattcagagcatggagttacaacttgccatggttgcactgtgtatggccaaggaatttagaaccagcgtgcactcagacatgggctggctggacttggggtcatctgtgtattacctttatgaatggagactagccagtggcctaacaggacattcccaccatctcctagtactgtcactactgtagccaacacacagagagaggctaagggatactgcatagggacattcctcagctgctagcagcaggctctgtggctgaacatgagggcttctccgcagcagacagacagaccacctgaggggcccatgtcagctgaagataaggtggaggacagcggtgcctgcccagggtccccaggagaacggtgtgctccacgcctttgctacccactaggaaggcctgtctgacccagggcttcagggataacttagaatcttcactactgtgtaaaccatgcccaagcttcagtgattattattccctaaacttgggcatagtagaaaatataacaatgtttctccttgttttttaatttttattttttttgttttatttttagacaggctggagtgcagtggcaccaccatagctcattgcagcctcgacctcctggcctcaagtgatcctcctaccccagcctcccgagtacctgggactgcgggtgcatgccaccatgcccagctaatttttttattttaattgttgtagatgcaaggtctcactatgttgtccaggctagtcttgaaatcctggcctcaagcaattctcctgtctcagcctcccaaagtgctggaattgcaggtgtgagccaccacacctgggtgttgcttctttaaaatattttcattggccgggctcggtggctcacgcctgcaatcccagcactttgagaggccaaggcggtcagatcacctgaggtcaggagtttgagacaagcctggccaacatagcgaaaccccgtctctactaaaaatacaaaaaaaaaaaaaaaattagctgggcatggtggcgggtgcctataattccagctgcttgggaggctgaggcaagtgaatcactttgagcccaggagtcagaggttgcagtgagctgagattgcaccactgtactccatccagcctgggtgacagagtgagactcaatctcaaaaacaaaaacaaaatatatatatatatacacacacacacacacatatatatatatacacacacacacacatatatacacacatatttatatacacatatatatacacatatatacacacacacacatatatatacacacacacacatatatatatatatattcattgtcttcagttatacacacacatgactggagtccaacacattcgcagggtgcacgttggaaaaccagcaggtgaccaccaccttgtctgctgtagccagtcacctgtgcttgtttccatgtcccccagaagcttgcttccacttttccaccccctgccacaagtgagaatttgggactccctcagacatacaacgttcccgtccccccagccccccacccatcccccaggaggctgaggtgggaggatcgcttgagcccaggagttcagctttccaacagactctaggcttcaggttggataaggccttggtttactctgatttgtgaactggacccctcgctgaggcttgttgtccattgcgatgatcttttcctttcctttgcctacggttaacattggtcctgatgattagtttgtctgtgttctgtgacctcattattcattcaagcccaggcccttctccagtcatctgaacctgttgcccggcatctgccagaggaggcccccccaccagcctcccacagctccatcctcgctggggcctggtgccctctggggcttcctcccctgtctgctgggctgggccttctggttctgggatccctgatctgcctttctcttgctttactctctgtgtgttcaggggcttactgcccagctgcttcctataaaagaggatgtgagctgtaactttggagcgtttgagcacctgggagtgtctttattctgtttttactcttgcttgatccattgtagggaccagcacccccagggggagctgttctccttcaaagttgggggtcgcttcgttccctgggcctcctgcctcaggcgctgctgcagagcaggtgcccctgctgacactgacccgtgatgggtcccgattttgctttttctgtttggctttgctttcctctctgaaagtttataggatcctctgcacccaatttgctgaaatttcaccatgatctatgcttgcagctaaactgcaggctgttttcatgcattgtgccaagccttggtggacactggaaatctctgcttccattctgggaaatcgtctttcctgattgctcctacccactttcctctgttttctcccgttcttcccgaactgcctgtgtcccagcattggcccctctggagtgcaactctcattatcctctgttctcccctatattccagctatttgccttctcattccacttcatggaagattccatttgctctcccaacctttctttttaagtctgtcattttgctttcttatttttaatttccaagagctctttcttttttccagttacctcttttttgggacatcctattcttattttagtgatggaagatttgtaatctctgaacctaatagttgttgtcaaatttttttctcctgggataatttttgttcttccaaatcgctttcctctgtctctgtctctctcatggtacagacttcttccagtcccgaaaatctaacacttgaggggcctcggggccttggtgcatggccctgtcccttgcactctgaccgtcctctgtcccacttcgctggtacagcccctttctcacccctttctttcagagtagcctgggaggaccccagggtgcagggagggtttcacctttaaaccttccaagaggtagggggaaaacctgctttctaccaactgctgtaacaaaacagttgaagttgtcacatggaaaccatttaaacagccatattctgtcatattagtagtaaagtttcccatgccaaaggcgatggccacacacagcatgtcatgactcaagagttgagcaccaggtttgggcgaggtggccctgggattacacctgtaatcccagcacttctgaagcccaaggtaggaggattacttggggccaggagttggagaccagcctggacaacatagcgagaccccatctctataagtataaaataaattagccaggcatggattattccgagtggtcccagctactcaggaggctgaggtggaggatcgcttgagcctgggagtttgggactgcagtgagccatgatggcgactggtgacagtctgagactctgtctctaaaaacaacaacaaacaaaaagctgagcatcattcctctagctatttaatctggaagttttcaagcacctttgccatgcagatgcttggcagaataaacatagagcacctcctttattaaaagagtaccccaggcgtctccagcggcagcactgcattaaatgggtctaggacaccatatatatttgaatatctttctctggcatcagtatcagctaccatgccactcctgccacacatgcagacacatgcgcatgcactcacacaggttcacacactcacacaggtgcacacacaggtgcacaccctcacaggttcacacatacagatgcacaccctcacacaggtgcacaccctcacacaagttctcacacaggtgcacaccctcacacaagttcacacacacaggtgcacacccgtgcatgcgctcacacacgggcacacactcaccctgtgctgacctgaatggatgccgtcagtctcttagggaggctctgtgcctgttggaggcgtgaatttcagtggaagccacacagcaactggaactagaacctgggcattgattggatgtcacgccccacactctcctttccccataggactttgtggttggcctctccatcctgctgcggggcacagtccacgagaagctcaagtgggcctttaatctctacgacattaacaaggatggctacatcaccaaagaggtagtagggggctgggggcagggattgtcccctcctcccctcctgctgctccacccctcccgccgctcttcctctccctgctcctgctgcccacctgtcttctcccgctgtccatccagagactggccccagggacagcagccagtgggctctcctctcctgggctcggtcctggacaccccggtgtggagtgtgggttcaggtaccctgtaccacacatctcggtccagctcagcaagtgttctcggtcatactgtcttacacaaaaggcctcggggagatttaagtggagaagccagaggtcctggccttggcccccatcaagtgaagggggcagtgcggtcccttaaggcatgggtggagaggggagccctcgcacatgggcccacagacaggttttgtttggtccaagcactttttctgctgccgcgtcacattttggagataagcacatagcaatccatctcccacttctctgggagatgagcttcccctagagtcagaagctcgctctgggtgccctggaagcggacaggcttctctctccagctcgtccggcccctcgcactcactgccttggaggtgccctgcacccttggatgccgcccgctccctttgggccctcacagccaccccggccttgcagcaggctcatgccagcctccccctccaggagatgctggccatcatgaagtccatctatgacatgatgggccgccacacctaccccatcctgcgggaggacgcgccggcggagcacgtggagaggttcttcgaggtgagcgagcgccagccctgcctagggaggggagcctggcagaggaaggggctctcgcttttggggccaccccgggcaagtggcttgcccctctgagcctccctactccccatgaggaggttaaacttgcccctccagtctggctggttgtcagaacccctgagaagtgaactacaccactgctctgccctgtggacctcatctgggggccagagctggggatcctgaggcagctgaccctgggccggagctccatgcctcctgagagctgtgtggctcctccaggaagacgctctgggagaggagcaggttgggggccttcacctgtatgcatggcggctgcaggggctgcaggctttgcctcctacttgctggggccactagacatgggccatcctgtgactcagttgctccctctgccctggctgcctctcagggaggtgaggcggtcagatgagcatggggacaaattctgggaaacccaagcccaggagggctcagggaattggcctaggggagcagtggggagatgcttggagcctcagcagttggttgggaggtggctatgaagggtggattatgtggcctggatccagagtagtcacaggggacaagttagagtggagggagcccacccgcccatccacccacccatgacttctgcgtcctcaggccaggggcggggctgtctctgctggggcacagactcactttgggcatggcttgggttgcagaaaatggaccggaaccaggatggggtagtgaccattgaagagttcctggaggcctgtcagaaggtaggtggcacgggaggctgggccacagttctctgcaggctctacacggaggtgggtggttggcagcgtctgccccttccctcaccccagtcccacccctgccagtccaggatgtggcagctgtccttggccccttgccacctcctggacagccccaagctccacttgccctcttgtctgagtctcctcctccccacccacccctgcagcccacagcatccccccactacccccacaccctccctcagcccagtccctggagaacctcaagttaggggcagacatggggccagccagagggagagggtcaccgtggggaggcaccagagcttccgcagtgttgctgctggcccttccagagagcacctcagggggcaggatgctgggcctccagcgcctctattgccccactcccagagcagtcctggttagcgcccacctcctctggaggccagccgggatcgccttcatcagctcatcccagatgggcttgcagtcaggagtggggttgaagacaggctgtgcctcaccagctggggacctcggaccagctacttcacctccctgtcccccagctccctgcacccaataagacagacagacaggcagtcgctgcaggctccgagtccctggcgggaatctgctcaagggggtcggatttggagcccacccagcacctgaaggcctcccttcctctctccatgcaggatgagaacatcatgagctccatgcagctgtttgagaatgtcatctaggacacgtccaaaggagtgcatggccacagccacctccacccccaagaaacctccatcctgccaggagcagcctccaagaaacttttaaaaaatagatttgcaaaaagtgaacagattgctacacacacacacacacacacacacacacacacacacacacacagccattcatctgggctggcagaggggacagagttcagggaggggctgagtctggctaggggccgagtccaggagccccagccagcccttcccaggccagcgaggcgaggctgcctctgggtgagtggctgacagagcaggtctgcaggccaccagctgctggatgtcaccaagaaggggctcgagtgcccctgcaggggagggtccaatctccggtgtgagcccacctcgtcccgttctccattctgctttcttgccacacagtgggccggccccaggctcccctggtctcctccccgtagccactctctgcccactacctatgcttctagaaagcccctcacctcaggaccccagagggaccagctggggggcaggggggagagggggtaatggaggccaagcctgcagctttctggaaattcttccctgggggtcccaggatcccctgctactccactgacctggaagagctgggtaccaggccacccactgtggggcaagcctgagtggtgaggggccactgggccccattctccctccatggcaggaaggcgggggatttcaagtttagggattgggtcgtggtggagaatctgagggcactctctgccagctccacagggtgggatgagcctctccttgccccagtcctggttcagtgggaatgcagtgggtggggctgtacacaccctccagcacagactgttccctccaaggtcctcttaggtcccgggaggaacgtggttcagagactggcagccagggagcccggggcagagctcagaggagtctgggaaggggcgtgtccctcctcttcctgtagtgcccctcccatggcccagcagcttggctgagccccctctcctgaagcagtgtcgccgtccctctgccttgcacaaaaagcacaagcattccttagcagctcaggcgcagccctagtgggagcccagcacactgcttctcggaggccaggccctcctgctggctgaggcttgggcccagtagccccaatatggtggccctggggaagaggccttgggggtctgctctgtgcctgggatcagtggggccccaaagcccagcccggctgaccaacattcaaaagcacaaaccctggggactctgcttggctgtcccctccatctggggatggagaatgccagcccaaagctggagccaatggtgagggctgagagggctgtggctgggtggtcagcagaaacccccaggaggagagagatgctgctcccgcctgattggggcctcacccagaaggaacccggtcccaggccgcatggcccctccaggaacattcccacataatacattccatcacagccagcccagctccactcagggctggcccggggagtccccgtgtgccccaagaggctagccccagggtgagcagggccctcagaggaaaggcagtatggcggaggccatgggggcccctcggcattcacacacagcctggcctcccctgcggagctgcatggacgcctggctccaggctccaggctgactgggggcctctgcctccaggagggcatcagctttccctggctcagggatcttctccctcccctcacccgctgcccagccctcccagctggtgtcactctgcctctaaggccaaggcctcaggagagcatcaccaccacacccctgccggccttggccttggggccagactggctgcacagcccaaccaggaggggtctgcctcccacgctgggacacagaccggccgcatgtctgcatggcagaagcgtctcccttggccacggcctgggagggtggttcctgttctcagcatccactaatattcagtcct

SEQ ID NO: 15965 - DNA, 9364 bp, Human
ggaccttttcaccaaatcccagtgcctgaattcttcaggaggtaacacgcagatatctaacaggaagtgcttctgataggcggtgcagtaaacatctggaatgcatcacagccagggaatagcacagacaggatagcacagagaggatataagaccttcaagatggctcaaaagaccttggggttgatgaactatgctgttactaaggactgtttggggtacattgatcattgttagggtaaaaagcaggtgatacagtccagtcctgtcctcacacttcacaatttttactggagacaagaatgggcaggataaactatggggcccataggaccctcccatcgtctgctgtctatctggccggaaagcatgatgatgaacaaagcaaccttgcctctgtcaggcacacctataatggttccaagagccacattccgactgttgtactgcgggtggcaatggaacggtcttccgattacctaaaatgccacagattcccttcttctctaatacgcatccgattaccatagaactctaagatatcttttaaaacctagtcatattaaaagttcctttttctccattaatcagtctgccccaaagaagcttttccgtatttcacaggatccttagaagaggccagctaactgtgatacctagcacccttatcttttctcgatacacagcgtccttcctccagcagaatcctaaaatagcagcagtccggattaacatggctgtgaggagtaggtgcttagctgaataacatcagaattaatgaggggccggaccccaaacagagccacctggtgggcatgaacaccaggcagttatggggccgtttccttcaaccaagtgtctggtccctggctatctctgcttcagccagaacacattctgtcccccaccgaggctttaagggccagcgcgcagcaccctcacctttcagcaggtccgggtgcacatagcccaacacgtcggagacccccagctcctggcgcgaacaggtgcctccgtggatgtgcaaccaggcgggctcggcgagggcagtgcacagcgccgtgatagacagggcgccaggcagggccgaggccaggctacgctccggctgcttgggcagagcgctgcctcccgggctcctccgccggcgcccgccgggcagccctgcgcctccgggggcgtacatgcccggggccgcccgccgtcgctccgcagtcgctgctggtcgccgccgacctccgcggggcgcgcagagcctgacagtccggtggaggatagcaacgctccgggttcgctgcaggtgaagccgggactgggctgtcagggttgacaccagaggataggggggtgggacccggggctgacggagacggggagggctgcgggaattcggggggcggagacaggagactccggaatgggactgcgggacgacaaccgaagagggccaggggccagatggggtctgggcagactcgagtggggggcggagggatcggggatcggctactgctagagcaaagacccggagtcagggtctcagccagaggatgccgaggggcggaggaccgggctgggccgcggggatcggggacccgtgatctgggaccggcggtttggggtgcgacctgtgcgcagaaaagaccctccccacgccgcccactgttcctcaccagtcagcaggccccagggctgggatggtgctgctcagcccagtcacgggcttctcggctgccgggggccgagcgttcccaggccccaatcccgcaacgcccggacagacccggggccgatgcacttccggcttcctcctcctctgcctccgcctcctccggctccccgccccgtcccccgcgcgcgtcacagcctgggcgcgccgccggctctgcgcagggcctcacgggactggtagttcgaggcggtcccgcgatgctttccctgccgaggtgaggggagcgactacaactcccagagggtatggcggccgcagcagtgggcagttgagtttccggggcgacccaggtcctccggcggaagcgggagcctctgtcggccgcggaagcctggagtgggcggtacgcagacgcgcgcggtgagacccgctgtctgctcagcggactctgcccgcccccacctccccctgcgtcgggccgacatgaaggactcgctggtgctgctgggccgtgtcccggcgcacccggactcccgctgctggttcctggcctggaaccccgcggggaccctgctggcctcgtgcggcggcgaccggagaatccgcatctggggcacggagggtaaggcccagcctggttgcgcggccctcagcgctgagggctcagcctgcgcgtagtgcaggcgctcagcctgcaggggaggctgaacctgttcctggcggagggagagtgggatgttagccacgccgagaagggctttacaggcaaagaagtctgcgactgttgggaggaaaaacgtcagcagacaagctgaaatgtcaagggaattgtgttagctgcagaggcaggaaaatgggaaaagagaggtgttaggaaagtggccttcagagtaacttgcgactggatggtcacattttatcccgagggcattggggaaccaatagcaattttagatcagatttgttttagaaagatgcctccagaggttgggcgcggtggctcacgcctgtaatcctagcagtttgggaagcagaggcgggtagatcacctgaggtcaagaggtcaagaccagcctggccaacatggtgaaaccccgtctctactaaaactacaaaattagctgggcgttgtggcgggcacctgtaatcccagctactcgggaggctgaggcaggagaatcccttgaacccaggaggcgaagattgcagtgagccgagattgtgccattgcaccccagcctgggcatcagagcaaaaactccgtctcaaaaaaaaaaaaaaaaaaaaaaaaaagcttccagacgaagtagattcatttgcatctttgtaaaagctgtgaaatacactccctgagctttcccccactagcttgattccagtgctagcccctgatattgaatggcttcatggtgctgcacccagctccagagcctggcctgcgctccgcctttaggtgacagctggatctgcaagtctgtcctttctgaaggccaccagcgcaccgtgcggaaggtagcctggtccccctgcggtaattacctggcctctgccagctttgatgctaccacttgcatttggaagaagaaccaggatgactttgaggtacccaggctggttgggaccagaattattgcctgtttcctccccagggctggttcaggaacctgagccaacctgcgccagttgggctgtacccatgggaaggggcttaggggtgttagctgctgttaattctcattttctttcccctttcacagtgtgtaaccactctcgagggccatgaaaatgaggtcaagtcagtggcttgggccccatctggcaacctcctggccacttgcagccgagataagagcgtttgggtctgggaaggtgaggccaggtccctccaggtggattgggaaccacctgacagccccctctgtgtccctgacagggtcggctcttgggtcccctttttctctcccacagttgatgaagaggatgagtatgaatgtgtcagtgttctcaactcccacacacaggatgtcaagcatgtggtttggcacccaagtcaggaggtaagagtcaagcagggactcttgtgggaagggctctggtgtgcaggcttgtgcccagccttcctctgcttttcagccttaatctagcttttacggagagttccatctgtgaacaaaaaacattagtccctttataaaaacagatccggctgggtgtggtggctcacacctataatctcagcactttgggaggccatggtgggtggatcatctgaggtcaggagttcgagaccagcctggccaacatggtgaaactccgtctctactaaaaatacaaaattagcgggcatggtggcacatgcctgtaatcccagctattcgggaggctgaggcaggagaatcacttgaacccaggagacgggggttacggtgagccgagatcgtgctattgcactccagcctgggcaacaacagcaaacttcatctcaaataaataataaaataaaataaaagcagatacctggaactgacctgtcctttgcttcctgggccacacagacacatgttgggtttcctttcactcttcccccagctcttagcttctgccagctatgatgacacagtgaagctgtaccgggaggaagaggatgactgggtatgctgtgccacccttgagggccatgaatccactgtgtggagcttggcctttgacccgagtggccagcgcctggcgtcttgtagtgatgaccgtactgtgcgtatctggcgtcagtatctaccaggcaatgaacaaggtgaggtccattagtagagctaaagaagacccatctctcaaggggttcacagtctgctaagacacgtacatgagtcagagcaaatgggggtaaaaggtaagatgtgctacaagagggctctggatagagtgctggaagaatcaggaaagttttgtagaatgggttgtttcatctgaatttaaaagggtatgtaggattttaacatgagaatttcacgtgagaattcaagtgaaaactcaacagtgtgagtaaagataacaatggcgggaatgcttagactgaggggtggtaatgcatttaaatggggcataggacgtctggggtttggagaggaataaagtgggttgggtcggctggtgggtggccttcacaggcacgcaaagtagttacatacagtctgcaacagaacagggatgtttcctcggaattctgcttgagaaacgccagtctggctatagtgtgtaaggcagataagcagggatggggacacgaacggagacacagactcataatcagttgaagatgagggtgagggaaggtaagttaggttctcctttgaggtgcccaggacataggaacgtttaagggcaagagaagtctgtcttgcaggggtggcatgcagcggctctgaccccagttggaaatgtatctgtactttgtccggcttccactcaaggaccatttatgacattgcttggtaagactccatccccccaccccatcccatccccataaatcagggattttagagaaggcataccctatgcagtcctctgcaaccctgggggagtgcttgggaattgagggcagccacccccattccttatcaggcctgactctaccatgctggtttacagctggctgggctggcattcacaggagcagagaacagtcccaggctgtgagggtagcaccagcgctagaggttcgcacagctcgtgctgtccagaagttattattgaatctgcattcgtggctgagggtttttttttgtttttttgttttttgagacagagtctcactctgcagcccaggctggagtgcggtggcgtgatctcatctcactgcaagctccgtctcccgggttcacaccattctcctgcctcagcctcccaagtagctgggattacaggcgcccgccaccatgcctggctaattttttatttttagtagagacggggtttcaccgcgttagccaggatggtctcgatctcctgacctcatgatccgcccaccttggcctcccaaagtgctgggattacaggcatgagccaccgcacctggcagtggctggggtttttataggtaacactgactctggccttgtggaagctggaaaagctgcaccattcatataggagagtaggttagagggtagttctggccctgagaattgatccctaggaaatccaaaacagtgaaaaaaactgagcacttaagcttgctttatattagcaaacatttgggaatcacctattcaacaaaagtgaacttaagtaaattatggtagaactcagcttgttgtatcactgtttaaagaaaggggttaagaatactttatgatggggccaggcgctgtggctcacgcctgtaatcccaacactttgggaggccaaggtgagtgaatcatgaggtcaggagttcaagaccagcctgaccaacatggtgaaaccccgtctctactaaaaatacaaaaattagctgggcgtgttggcacgcacccaatcccagctactcagaggctgaggcaggagaatcgcttgaacccgggaggcggaggttgcagtgagccgagattgcgccactgcactccagcctggtgatggagcaagactccatctaaagaaaaaaaaaaaaaactttatgatggctgggcccagtggctcatggcctgtaatcccagcactttgggaggctgaggcaggtggatcacttgaggtctggagtttgagaccagcctgtccaatgtgataaaaccctgtctctactgaaaatacaaaaattagccgggcatggtggcacatgcctgtagtcccagctactcaggaggctgaggcaggagaatcgcttgaacctgggagggggaggttgcagtcagccaagattgtgccactgcactccagcctgggcgacacagcaagactccatctcaaaaaaaaaaaaaaaaaaacaactttatgacatgggaaactgcttatgccaagtgaggaaagtgcagttcataattgcatgtcgttttttaggataatcatagtaggggaaagaactagattgcagcatctgaagatataagtgggtgatatttgtgactccttattagttaaggaaacattttaataagaggtttttagctgaggcctgaagttagggaagagaacaggccaggaactatggaacaggtctctctggcctaattagtcaggtatacccactgatgtcactttccttccaggtgtcagctgacaggggctctggccacagcttgtggggatgacgcgatccgcgtgtttcaggaggatcccaactcggatccacagcagcccaccttctccctgacagcccacttgcatcaggcccattcccaggatgtcaactgtgtggcctggaaccccaaggagccagggctactggcctcctgcagtgatgatggggaggtggccttctggaagtatcagcggcctgaaggcctctgagctacctcgactttggacagagtaatgactccccagaaaacgtcatataagactttaccagcccctgagaggaccaggaggagcatccttgaccttcatttaacttggctcacttctcttcagacttgggtagaagtgcagagccacagaattgctttccttccccgcctttgacatgaggccttcagtaaagagctacagaacatgagtacattgttataccacagatttttcttgcattagggcacagtgttaaattttttggaggtaaatatactatttataatcactatatatagtaggagggggtatgtgtctcaggcttttctgaagttgcaagacttaaagaaataatccatctgcatcccaagtcctattttataaggatattcataaaaattccatggtgaatccttgtctgaaataggtcctcccttcccagtttctgtgtaagtctttgcatttaagacatccaatcaataatgaaggaaatttttttctgaatgtaggtttgagtgaggggcacctctgctttcccttagcaaccctcatatacctccctgcaccgttacgctgtgatggcaactggggatagaaaaaaaatggggaaagacaggaatcctaaaagggagagttattactggccacaagccctgtattctcaacagggatgcaaattggttcttcagtaaggataaaaaaaaatcacaagcagttgtttgtggccctcctaaggcccacagcacatatagtgtgtctgtgatattccattttcatggcagggagtgatcaggaagaaggcttcctaggggactggcgatttaaaccagttgagaaacactgccatcagcaggcagtttcagactcactcaagttgtctcttgacagtcacttctaaatgggttctaatgtgacaatggcctccaaaactacagccttccctgaagtttaagctgtgaccttagattttagaaggacagtggggctgtacctagaatagtggttctcgaagaatgcggcctgcagatcctgggagtcccaagaccctttcagggaggatctgtgaggtcaactgttggcactgtggcatgaatcaaggtggtggcagcaaacttctagtagttttgatatgtccttgatagaacaaatagcaatggttaactattaaatgttgacctagccagcgcagtggctcatgcctgtaatcccagcactttgggaggctgaggcgggcggatcacctgaggtcgggagttcgaggccagcctgaccaacatggagaaaccccgtctcttctaaaaatacaaaattagctgggcatggtggtgcatgcctgtaattccagctactcgggaggctgaggcaagagaatcgcttgaatccggtaggtggaggttgcagtgagccgagatcataccattgcactccagcccaggcaacaagagtgaaaccctgtctcaaaaagaaaaaaaaagttgaccttgagaatttataatattctgagaaaactggaagcatgcataaagcccctctgctgtgcactgaagtatgggtgccttgaggaaaagcagttacacagttgagttgcaagctgaattggctgtgttcaaggcatgccctttagaattgaaagaactagcagattacggtatttagacttgaatatttggctgatattttctggaaattaatggaatgagcctctcacctcaagggaaacaactgatagtgttgccagtgataaagctttcaagcaaaaattggaatttccgaaaatctgtactccaccatgagctttattgttggggatattaacaaatgtgatttgtataatgaaatgcatttcatttggaagaattcaatgaaccatttttccaagtgaccagtacgtgatgttacaaaatcatgcatggctcaaagattgattcaaaagtgtaagacaggccagtggattttaatgtattaacaatataagagtgcattaagttttcggagtctacattgcctttaagaaactatgacttgtagtaagccgggcgcggtggctcacgcctgtaatcccaacactttgggaggccaaggtgggtggatcacaaggtcaggagttcaagaccagcctggccaatatggtgaaagtccgtctctactaaaattacaaaaattagccgggcgtggtggcagatcccttgtagtcccagctactcggga

SEQ ID NO: 15966 - DNA, 96048 bp, Human
aacagtagaagtttgactttgtagactctactgagagaaaagaggcacaggaactagactataggctattgatgcaagagaactggattttggtgaaacattgctttagacacatgaagcaaaagggacgggaaataaggaggaaagggtgtggctgtaggtaagattgtggctaatgtatcaaatagagggtatttcctctgatactgtggggaaagtgcatgctgagagaaaggggaacaatggcggccctcgaggaaaacaacccatggtggatgtgggaatgatcacaaggtgactctgaggggtcagctgagcttgaaggcacaggtgggtggtggccataggccacctgcagcagcctggatatcaggttccagattgagagtttacctggacaggatcacctaaaggtaaaggatgatgctgctgagaatggcagtaggattatggttgaaggagtgagactcaatagagagaaccagcctagttagggaagtgagcagaggagtagtgaaaagggcctgaaaaaaagagagtagagtgaggtgcgaggagcaagtgcattggggagaatggaaggagggccagtcctagaaggaggaggcttatttgtaagcagtatatcggagtgatacattgagacttgacatttctttaccagataaataccttggaaagtatttatcctgagtttgtattgttgtccaaaacattatggggaataactttattggaactcagctgggactttgccacacagcttttgactatttggagtcttggtgattcttagcccgtttggaagtggatttgatttttgcacactgccgggtcattcagggtcaagtttggtaaataaagtagacaatcaagctggataataacatttttggtaagaatggaaatgtggatttaaagaacagtgctattttatttatgtgacttgtaatagtccctgatagtaatttccaaaggcagcaatgacagtatctttggaatatatatagcttctcaaaacaaaggtcttcctaatacgtgggactctcagcattgaagcatggctggcatccctggcttctgggccctaagtgtcagtatcccttgcaagtccttgtggcagtcagaaaagccatcacacatttccaaatgcttctggttgtctctagactgccagggcctggaggacttgtttacagagagccagggaagagaggaagatactcttttctgtcccttttactctttatctatatatctatttatttactttgctttctcgctggttttttcttcttaaaaaattttgtttgttttcattgattgtggtgtaaggaatgacagaaacaggaggaaaaagggaactttattaaataaagattgaaagtaaatgaataatccaagggaaggctatggacgaatagaagaaaagagacagaaaatagagtagtcgtggggaaactggaagaaatgtttctgccacatttgtctgtggtctcttgtgattttctctgaagccaagaataagatttcctgtaagaacgctcatgtgttgttgcattatagggtataactgattgcagaggcaccctaaatagatttcactgagaatatagttagaattgtgtaaggctttaaatccagactgaaagaggaaaacaacttgttataaggcgagtccatttcgacttcatctgagggggttttcatgactgataggctcaagcccctgttttaaaatgatgatgtttacgtgattgtccaggaactttgaacttcaaaacagttttagctcctgagtaccaagtttttaatttaatttgtacaaaatgaataccaataccctttactaaaaatagtatacctggctagcatttaaaagttataacctttagcttgccatgattgctaaaagtcatctgttgtgtgtttttaaaatctgcactaacacttgtggaccattcatgccatactgaagctgattttctactttattttttcagttgttcatggtggacaatggagcagatgactggagaatagccatgacttatgagcgtattttcttcatctgcttggaaatactggtgtgtgctattcatcccatacctgggaattatacattcacatggacggcccggcttgccttctcctatgccccatccacaaccaccgctgatgtggatattattttatctataccaatgttcttaagactctatctgattgccagagtcatgcttttacatagcaaacttttcactgatgcctcctctagaagcattggagcacttaataagataaacttcaatacacgttttgttatgaagactttaatgactatatgcccaggaactgtactcttggtttttagtatctcattatggataattgccgcatggactgtccgagcttgtgaaaggtaagtttgtttcttttcctgagaacataatttaccatgtggtatcttcacaagtaagaaaaaaaaaattttagacttgagacgtgtagtgtctcactcttaaaaattttggattttctgacaggcttctttgaaatgactgtgacaaagcttttctgaagattttttcgtagagcaaatgccttcatgcttgtgtgttttctttctaatttgatcagttttcagtagagggctgcctttataattttgtgccaaaatttggagacctagaaattgtacaggacacttttattggaaatgtgagtttaatggtaatattgagtcatttctgtgcctgattgcttatgagcgttgtttgttgttgagacagaaatcctgtcaaacagtgttgatgcaaaatgcctgggctttagggaatatcttaaagcggtttgttggttttagtgcctgtatataatagttttcaaatgattacttgataaggaggttatgggtatgcgtattagtttgtactgaactttcaacaattagtaagaacaggcaatgtgtatttgttttaatgtctgcagcgctctggtggtctagacctaggcatatattctcagatttcaggagtggctcagtgatcttaatcagttatacgttaataatgttaactttgccatttaagaaaaatagacttatgacataagcaggaatagttgtctcatagtgggctacagagtaccctcacatgaccttggttaagaaaattcaagttgaaattaacagtagagacataggaatgatttagacatttctaggagtgttgaaagttcagatgttagtctttgtagttttttttgttttgttttgttttgtttttttttttgagacggagtctcgctctgtcgcccaggctagaatgcagtggcccgatctcggctcactgcaagctctgcctcccaggttcacaccattctcctgcctcagcctcccgagtagctgggactacaggtgcctgccaccatacctggctaattttttgtatttttagtagagacggggtttcaccgtgttagctgggatggtctcaatctcctgacctcgtgatctgcctgcctcagcctcccaaagtgctgggattacaggcgtgagccaccgcaccaggccgaatattttttttttaaatttggcttttgaaagtcaaggttatacactcagatagttcaaggaagaaaaacagctatatgagagttgctggaaaaaaaaaaaaaaaaagggtagtgaaccctgaccaccccccagcccattccagctttccagaagcattcactttaaatctgtttagccattctcttggtaactgctttttatagttttgtattttaaatacaaaaataaattgtattttaaatacaattgcttatgttgctgcatctagattttttgttgttgttttggagctatctattaactttcttctgtggaagtcagttttttttttttccccgtatataaacatacccctttcacaacttcactcctccccaaaaaagtgatttttatctccctatctcccagtaagatatataaaccctaaaatctatattctatgtttacattgttattactgtataaactgcatttgtagctgaacaagataatatatcgtaatcatttttcctttcctgcacaatttttttttttttctggaagaaatagttgcctcattttttatttgcttagttttctgtatacttgtcactaaatcatctctaaattctctcacattatataaataccttttactcttttcaaatatattaagcaattcatcaacttcaccttgaagaaatgactcttggaacattctgacttgcatctctatcatgttggggactttctttgccttttttgtatgctcagtagcccctttcttgaaccccatttcaccctctttcttcgttctttattttggtggaatctgtcttccagtagttttgaagcaaaggtagtatataagagagatatttttgagatcttgcagatatgggagtctttagtcttctctcatgcttaactggtaatcagctggatataaaactctagattggaaatcactttacttcagaatattgaagtatccattttcttctggtattcagggtctagcagtctgatgccatgctccttttttatttattttgtttctggaggcttctagtattggtattctaaaattacacaaggatgtaatttaatgcatccttgtaaaatacaaggatgtattttaatccatggtactgggaacttggtggacctgttcaatctcgaaattcatgtccttcaatttttggagatttttctgaattctttaatgatttttgttcctattttctgttgtgtagataatggccctcctatattattccctaattttcttattctttgtttatagttttccatttgtttttgctctatatatggaagataacctcaaatttatctttcacactttctattgggattttacttcttctgtattgtgtattaatttccagtgtctaatttttgatccctgaatgccttttttttaatagcatcatgcttttctttcatagaaacttttctctggagatgttaattatggctttttgaaatttttctctttgcattttgtttccccaaagatgcatttttcttttgttttggcttctgttttaggagctttgcatacatacttcaaatttgtcagctgcaggctttattaaagggtgatttgagtgggggacatagaacagcaatttcaatacctttacatattttgtgtcttctctgaccatctgaccagtgcatcggaagtcttttctgctcttctgccatgaaagcagaagcctgaggtgacagcgtcttgggaattgaaacacagggcaaagaagaggtctcaacagttactatgcaagcatttgcttgttctcctggtatcagtacagtagcttgctctctccagtgtctgatgccctgcagtaggtccacagaccttgtgttgtactgtctccagataatagattttcagacttctgccaggttgagaaagaacagttagtgtttctacagagcagaagaggacatctgtgtgtctaactgcctctatgccttttttgaacctgtcctccctttcgaaactctatggttatccccacatgcagaagtactggtgccaacagtgcctaagtcatgggtgaggggtttggttctcagtgcatgtgcggttgcctcttggtttttcaccactgttgccacagaattctgcattctcatgtcaggtaagtcagtggccacctgtcgactggctttctagctttttttttttttttaactactcttctgtcattcattcttgttgtccttatgggtttacatgcttttttgctgtctgcttgttttagtattatttataatcattttaaggttgttaagggaaggagctgaggccagcatgtttgttgagcccacctgtttataccagaaatttggtagtgactagtttttaatatcatgtctctgaacgtttttttagaacttctctgcgtaaatatgccatttgagggattaacgttttctttttaaggaaaggtagactccttatggtaatgctttgtttcctagcaatcatggtatttacaggcttatgatattttctggagcagatgtaccttatgatggttgaagaataaatatggaaaactctagttgacatacctatttactgtataaagataagccctaattaaaaattatgcataacaatgtaacaatgagggaaatagccaggtctgacaatatatacatctccatgggtggtctctagtgcatctgcttccaaaggccaattaagagagcctcaaaattgtgtacatgccatatattttcttttcaaaaatagttcatcttagctgttttaacccattatcactaaatacagaatgccaaggcaagctgtgccacattcgcttagcagccccaagtctgtgtgttttttaacatgctcagattgtgaggtgatgaccattgctgttttcatgtaaagaggcaataaaaggtgaaaactgttcatttcatagcaagaatgagagtgtgtagccagcaggtacataaaggaaacaaatctgtgacagtgtggtggggaagggacagaggccaaaactctggattgggacactgggatttagtctcagttgtgtaatttaggggctgagtgacctcaggccaaacatctcatgtctttttgccttagtttattcatttgccaactaaatggcttgttaagacttcttcccaacgtaacgttttatcattacacaaatgtgtaaaagaaaaaaaaattattaaccagcattgtgttaatagaagattttccacatttggtttttattaaacttcccattttgctgcacaaattctccagattgtggtttgtaagatacaaagataaaaaaaaattgtttttccgtaaatttgcaatttggaacatgatgtcaccagtatcttacgcttccttgataattattttctgacccttttttttcccctcttatatgaagtttacaatactaaatataacacacagcttttctatttatttggtttaggatttggatttgaatgaatcctaccagttccatctttggtccatccaagcatcctctccatgtaaaaaggggagattcacatctgatagaaatttttatttttagttaattagatatctaaaaagagacttagatttttggacttttttaaaaggaaagagctagagaaaaagagaaacagctttctagagaagtttgcattaaaaacctattcctgtccttctaggagcacaagattcaggatttctataagtttctagaaattgttctgtattaatggggagagcatcctatgggaggcatttattccttgtggtattattttccctggcatatcatgtgcctctgaaattttttacctgtaggtaataaaaattctctctctctctctctctctttttggtgaatgataggaggaagcagagaaggaagaatctagcattatttctgtggcctacatttgttaataagcagcttccccagaccagaccacagtaatctactctttctctggttatggtttggctttgtgttaaggtaggcatcagttctaggaagaacactgtcctcttaagcagctgagaagtgtggcctagtgctgctaagcgatctcatgttcatggggtcccaggccaaggcatttaatcacaatgtattaggagaaatttcaggaacatttatgttttagaagaaacctgaaactcagagcttggggtcctgaagattgggaattatccaatcctgacttgtaccttttgagacttctctagttttgtaaagatagcgtacgtaggcagctattcaccccaaagtgtgttttactgggcaccgtttctgagcaagaatagtagctattttgcaacaggtagaactggatattgtgggtcagtgctgtgttacacaaagaaaggagttttgtttctttttcactgtaagagttctcagagcatttagtatatgtatatgcattagaaatcctcaagagggaaaaggagtatttatttggccatgctttctgggaaacatacttgacatatgacaatactgaagttttggagatagaaagaaattgaacttttctgcacagtttggattcaaaataatgtttctgtgttcaatgaaatcttttcctttttgacataggtttgtaatgctgtgttagggggcaaattggggatggaaaggaaaagagagagcaaaggtgagttaggtatttaggtggtagtgttcccaagcagaaaagcaaacattgtgataatatataataaattggagattccaggtaatgtttggaatggaaaagggtcatttggttaaaaaagtggccaactattgtcctttcttttcccattattttatctctcagggcacttaaatatgtattaactaggtatcatttgttaaggaacattttctaaaaatgacttaacaataatttgctctttttgaaagcagacaaactggagaagcataatgcaacttttgaatacctttggataatctaaactgcattttagatgaataaagaataaattcttgtgatcactgaaaactgatagatgaaaataaattaggtatttattctcaaattagcatagagaacctgaggaatagagacttcaatttcagttgtgtttagagtctactattcagtgtcttaaaagtatattttgttctttcattagaataatccaggtagatttcactctattttttgtcaccctgtcactaatactcttctatgttgtattattttgttttcgtttttaatttcctggaagatgatttctgaaatgcagttgaaacataatttattattatatagtctgttagagaagcacaaccaagaggatatagatataaatatatgagaggagatttattagaggaattggctcacaggattatggagactgagaagtcccaaggagaggccatctgcaagctggagacaggggatgctggtatatgtggctcagtccaagtctaaaagcctcagatccaaggaagccagtggtgcaactctcagtccaaagctgaaggcctgtgaatccaaagagatgcaggtgcaagtcctagagtccaaaggctggaatgcctgaagttctgaggcacaggacaggagtctgaagtctaaggacaggagaggaagaatgtcccagctccaggagagagagagagggggcgggagagagaggaactcaccttttctctaccttttttgtcctgtcctagcccccagccaggatggtgctcacccacgttgagggtggatcttcctcactcagttcgctgactcacacaccagtctcctttggaaacaccctcacagacactcagaaataatgctttaccagttctctaggtattccttaatctagttaagttgacacctaaaattaaccatcacatatggtatattgtggaatattacagtcaaatcatgccccataataaaactatatacaacataagttttatataaaatagctgcttttagcacaaggatcagttatgtcttctgacatcagtagtatgaaggagttgctaagggaaagctcctgtaggatgagagaatatctcattttgtaactagacagatttctagtctcttagcactaatttatagaggatatgagatttggggtcccactttctctgtatccctatagagaatatgtaatttggggtcccacttgcatatggaatatgggcattgaatataatcttgtacatactgatttaaaatgaatacccttgttcctgagcaccaataaaacaaaaaataggatggtagttgtttacatctagtaaattaatttagcattgcagtggatgtcttttaataacttaatctgttcctctaacaccacatgtattcattacttctctttgtagaacatgcttttaaatgaactttaagattcaatatgtgatcaactctgtatcttaaatgatctgggttctaattttcaagttttccatttcaaaacagtttcagtgttttttatctgtttatataacataagccagttgtcatggaggaagggatgaatggcatctgaaagtttcacttgttctatttgtgtttttttattatttacataagatgaatgtgaaatagggagccacatattagagtgctagctcattttcctggtctgccagccatgattttattttgtattttcaggagagtcacccagaggcctagcctactcctttcccagcactagccattagaggtgcctatttcctgatgatttacttaaatttgaaacatgttacttgggatcaagtttctttaatagttgtaaaagtagtcataaaatatgcattgcagtgctgggaaaacatatccaccttgatttattacagaatattggatagttattggataatgagattatttcctaccacttgaagattcagctgttgccaagtaaactctaagtatttcatcaatggatttgtaatttgtggttgatggcaatgtaatactttgtaaacttgtacttccaagttggtctgattcatacatacagatatagcattttcaggctcataaatgagtcacaactttaaaatgggccctttcaagttataaaagtcggcagtttgaaagcattcatcctgcatctgtgacttgcaaaacatcaatgctaagtataatgtttgccaaataaattggtcattaaagtcttttatggaaagaaaaaccagtactccctcaaattcaattttctcttctttcttatgtagatatgcttcttgttttgttttgttttgttttttgtagttttattttttgagttggagtcttgctcttgtcactcaggctggagtgcagtggcgcaatcttggctcactgcaacctctgcctcctgcgttcaagcgattctcctgcctcagcctcccaagtagctgggactacaggtgcccgccaccatgcctggctaattttttatgtatttttagtagaaatggggtttcaccatgttggccaggctggtcttgaattcttgacctcaggtgatttgcccactaggcctctcaaagtgctgggattacaggcgtgagccaccacacctggccttgtttttattttttaactctttttggtctacctcctgagagaataatgaggaatagtatttgttggcaaggggctttgagatcctggtttaaagaatgcagattgaaaataccagcactgttaaattcacgtagaaaaaacatgaaaagctcagcagctcaggaatccaacctcaatgatctcatagccagttcattatggtcctcctcatcctgtcatccatgctgatgtacagatttcatggaatagaggtcctaagtgttttctgactttgaaaatccctgtaattatccatatatacatcagcagcatgcatgtgtgcactcctgggtagcattctcatgtaattcagcttcagaaccactgtgccagataaaaagaaggaacataaagtctaaatgtaaacatgctgacattcaagccattttgtctttaaggaaattaatacatttcttagacataaatagggcttggttggagaaaatgcaagtgcttcctacttcctgctggattttctgcattgtattttttttaattttatactctttattttaaaatgtttccttaatgtaagattgtattaatacaatcatagaaatgcaagacaaaagtgcctttacatgccataaaaaaagacattttatatcttgctgagcttcgatggatctgccttctattataatgttaagcttttataaccttagtccatgttaatggacttgcttactattatgagaattaaatggggaatgaggtagattttagtattgtatccccaagctggtgtcaggtaataaagcacctactgtctttcaagggagcctcttggcttgagtctcttaggagggactatgtgaactgtttctccgctgcttgctgactggtagagcaatgtctagtctatggatggttcctgaggctctgcggagaggggcatcagtctgtcccaccctgatagttccaatgctgttttgtctctcattcaaaatcccatgagtcaataaatagtctgatcactgtcaaataattaaggatactaaaaaaggcccaggcatcagatatttaaaccatagtgtggtggtaaagtcaaagccattttgggtttgtggccattattcagtgactgtttggtgaataaatattagaatttaaaaactttgtgtagaattttaccatgatttttggttacagtgtaaaaagacaaaaggatctttgtcattttttaaaacaactttattgaggtataatttacgcaccgtaaactccatctatttaaagtgtacaagccaagaattttaggggctatgcaaccatcactacaatccagttttagaacagttccatcaccctccaaaactttcatcatctccgtgcccatttgcaataaatccctgctccctcttgcagtcttccaggtgaccactaatatactatctgtctccatagatttgcctttctgaggctgtcatataaattgaatcaaataatatatagtcttttacatccagtcttttttacttaaagattttgatgtttgcctatgttgtagtatgtattgaagtttgttcctttttattgatgaatactattctgttgtaagaatatgccacaatttggtcactcattcaccagttgatctacatttagtttgttttctgtttttggctactaagaatagggttgctttgaacttgtgcacacaattctctggatgaacttgtttttctcctcttaggtagccatctaagagtatataattttacaaacccaccagcaatcggcaatgtatgaaggttccagttttatcacatccttgacaacattgtcagttgtgtgcgtgtgtgtgtgtattatatatattgtcatatctggatatgggtatatagcattgccagtatgtctgaatatacacatatgtgtatgtcttaatgtgtgtatataaacatacagaaatatatggtcttaatatacgtttatttatagtcttataaccattctagtgagtataaagtggtatcttattgtggttgtaatttgcaatcctctaatgactaataatggtgaatatcttttaagtgatcattagttctttgtgtatcttctttggcaaaatggcaattcaaattgcccatttttaaactggggcatttgtcttattaaattttaagagttctttgtatattctggttactagtatgttatcaaatatatgatttgcaaatattttccatggcttgtgttgtaattttcattttcattgtttttgaatgtgctgaggctgtgtacccttggctttctctaagtcagtcttgccttgcctcccaaagccatgcaggaaaaaagccagctacacacacacagctgactgtgagctctttgaagaggcttaactcccttgttcagttctgtgcttcacatgcctcttcttgctgcccttttcctaccctgaagtctttcttttctagtaaccactattttctagtaacagcaaagagaggaaagagcaaaaaaagactgtttttcaatcctgcttaaaaagtctttccagttcttgcgttgctttgatggttgtagtagctgcgaaaaatgaagcccagagaatatccgtcattttttcacttaggattaagtgttcctgacttgcctccaatgggaattttaagattctttttgttttctctcctagttgaggtagtaatttgttttgattgatccacagctttcttcatgaccaaaagcaaacatttgcaatgtgtctgaccccgttttagggatgtagctagacattgtgaaaaaccaagctcctccgtcccttttaggtgaccttgctgggttttatgaccgtccacagtcatgactttggaaggatgatgctctagccatgggctgcttgaccaaatgatcactgtgtgactgttctttatactgtgctttgtatcacagtgacaggatattatagtacaggtcatagggatgtggcaattgattttgacatacgatattctcagtgccacaggagcaaaagatgtttgagtgactactgtctaatatctttgctttcatgtctctgctcatgatttagtcttctaaaagctttctgtgtcatataaaatatactgtttcagtttattaaattgtatttaatattctaacagaagatataatttaaaaataagattttacggacttttgtatttaatgttgtggttttagaacttcatataaaacctcatgtaggaatcatggtttgtaaatatgaaagccacaaagtaaggcacatattattcagaaccaatttattagcagaaaatatcttttatatcagtgatcatggggaaaattaaatttagtgactttcttgcgttaaagaaatggttgtgattgagcatattagtaattataaactcctgtttttgaacaaaactgggttatactaggcatatgtggagaatcatcctaaatgcccatttggtattatttggaataataccttttatgccagagggcatcttacgaaatgaaacatccagtagacaaaaatcagtaattttaatctggtttaaatattaatctgtttttgtcccagaggacataatgttatcaaatgaaatacccaatataaaaagatcagctttagtcattagtttttatctaatttaatggtgaccagcccttagaatttctggcttactacatgtctggaagggaatgagtattcttatatttattgttgttatgataatctgcctactgtgctttctactatttagtaaggtgtttttattgttttattttgttttgcttttaagatgggttctgagaagtttggaggtgtcggtgtgaagtgagaagccactctgctaggttttttatccctgtttaaagattccatttttgaaatatcacactgataccttttgttcctcctcttaaccatcattcaccgactatatcatctagatctctgttctttcagccctaccaaggtcactggcatttattgtgacgtaggtgcctgatagatagttgggtggtaaaagggatgaaggtgccacattaggcaggtttgatgtggtcaggaaaagaaccagggggactgttgtagtcagtaatcagtggtgtagttgcctaaaacttttgtctggctctgattaggttaggagatgagttccctctgcaggttaaaggtgttcattaagtgcttatggtattctataccatgtaaaaatgggggtacaaaagccttatctgaatcaagctcctcaatggtaaaaggtgtatttgataccatctgaatagccacagagcccagagccctttaatatctgggtcagataaaaccttacaagtcatctaatcctatcaggccaagaggaacaccaactgctgtcattacatgaggacttgtggggtaaatgtttctgcacagatgtgtacctatcagttataacaatagaagaatgataattaacacttaatgagtgacttaaagtgttgaaatttaaccctacaaagggtcgttatgaagaagattactaatgggaatattatacattaagtgtgaaaaaaattcttacacctttattttatctggttcatttgcaagtaattagggttttaccatttagtaagttaacaaaggttaataaggaaatctgcattaatttaaaatttctgtgattcaggagcaaaaatagcacttactgaatatctgaaagactgcagacaaattggtcttggaaaactgaagccttccttatgtgctggactgacaggaggagggcttcacagaaacgtgacaggcatggttcagcactgcttgaaacccttctgtgtgttcagcctggaagtatttccatttactctgctggagcacacagacttcagacagagttttcttcgtcttttatcttggatgttgccttacgggctctcagcaactgtgcagctgccatcattgtctgggatttgcaatggggcaagtggggctggcggggagttggggggcagtggcaagcaagggaaccccattctgaggcagcagtagtgacagagctccaaagtttttgtgactattttgagtaaccctaaagcagcatttcaactttcctttcatgaaactgtccatgtgctaagatcactgccactcaacttaggtcctgctgtgcatttaatttcttgggtatttcctgaaagccccactaataggaacagcgatctagaattgctccttttggaaatgcactctgcagatgctgctcactaaggtctgcagaacttctgctaattcccaccaactgcctctggggaaaaaaaggatcatgagttttaaacccccacgtttcacttcctcatacaagcatatcttcaagtaatcacataactgaatgtgcctgagtagactaaatttgaaagagaacgtaataatttttttcgtagctctttatccagttttagtttgtattagagattttacctggtttagactttgtcttaatttgtgcttcttattgataatgttttgaagggaaaaatagcagcaaggattaagaaaatgaaaatattctttattagtgtggtacactagttaaagcaggggttggtaaaccatggcccttgggccaaatctggcccaccacttgtttttgtaaagcctatgagctaagaatagttttcacattttttaattgtttggcgaaaaagagattatgtgatagagactatatgtagtctacaaagcctaaaatatttattacctagccttatgctgaacaagtttgccaacctcttatctaaagtagcatcattttgtcaaatttgttttaagcacaatgtgatattttcaattacaaagcatttaaaaatttttactttggggtcagacaatggatttctatttgttatagcttaaatctggaggcaccaccccctaccaaataatcactataatatctttaggactaaatataaactacttttggtaccaatgatcaaacattgacattagttccagtgatgataggtgcaagtaccatactcagtaacctaagtctttctgactagtactagctagatgcataagtaatttatttttacatatactaaataaaaactaccttattggcctgtgcagtggctcatgcctgttatcccagcaattgggaggccaaggtgggaggattgctttaggcaaggaattcaagaccagcctgggcaacatagtgagactcccgtctctgcaaaagtaaaaaaaaataagaattagccagatgtggtggcatgtgccttcaggcccaaatacttaagaggctgaggcagcaggatcacttgagcccaggagtttgaggctgcaatgagctatgatcacgaggctatactccagcctgggaaacatagtgagaccctgtctcaaaacaaagctaccttctccattcatctacagagaatgcagtaagatatgaaagaattgctctgatctcttgaggaatctggtctcctagattttaacttcattgaccttgggtaacatcagtacaacactgagtcattaagaaatctaatctgaaagctgtggaggagcaggtcttgggatggacttggaacagtagcctctaaaacatagtcattggacattggcagaatgcctttcctttgactagggaaataatgtaaagtctttttgcaatatctctctctgcaagcatgtaaactgagctatgcaaaaagcagtagctccaggctagttattcctagggcagttataaggataaaataacctttattgctactgtttagtggagtactgtaatgaaatactgtgattgtctttgtcccctggtctctgcttccaaatgcaggactgcttctaccaagtatagcctatgttacttaacatgggagaaattgaccagcaaaagattaaaataattcctgtttgattttcttataggagtctctactaagacctcttatgaagtttgcctgctatctctcttaagcaatactaccttttccataaacaacgttcattccttagaagagtataaaagaagacgctataatttgtctaagataccagatatcagagacaatgccatggttgtgataacatttttactttaaattaagaaagcattcacagaacatgttttataggcaatctagaactttaatggcatgataagaattccatattatgttcagatggtagctttcctctccccacttcttcatgctatttgatccttcagacaggctgtaggtctggctcattttggctgggcctgctgtgggccaaaggactatcattttatggcaattttcaagttaggtaaaaataatattccccttccacattatttttgatggccatatttttcatatttaagacagtttgggatatgactaaaaattgtggtggtgattctttggcaaaacaagttgatttcttgaatgctgcagatttttgtacctttccaatacagcctaatttgtcttagctacttttcgatctattttgcgcatagccttggatattcttgattttagtatatgtttcctttttatagaatggtctttgctaggaaggaataaatcctgacatatggtttttagtgaaccaacatacatgaaattttacaaaaaaaaaaagccaacatgttggttaggtgttaagacaaatttaattaattaattaattaattttattttttaaacatttttgagacagagtctcgctctgtggcccaagctggaatgcagtggcacgatcccagctcactgcaaccaccacctcttgggttcaagtgattctcctgcctcagcctcccgagtagctgggattacaggcacctgccaccatgcccggctaatttttgtatttttagtagagatgcagtttcaccatgtcggccacgctggtctcgaactcctgacctcaggtgatctacctgcctaatttatattcctaccagaagtgtataagtattctcttttctctacaacctccccagcatctgtttttgttttgttttgttttttgagacggaatttcactcttgttacccaggctggagtgcaatggcatgttctcggctcactgcaacctctgcttcccaggttcaagtgattctgttgcctcagcctcctgagtagctgggattacaggcacccgccaccatgcccagctaatttttgtatttttagtagagacagggtttcaccatgttgtccaggtgggtctcgaactcctgacctcaggttatccacccgcctcggcctcccaaagtgtttacaggtgtgattacaggcgtgagccaccacacgtggccataaattaaaaagaatgtatctgtaatttggccaccttgattcacattcaaattaatctttttggtcttttttgtaagaagccaaggtatttgaaccacccttatgtttcccagctttttatatcagtagtcactggtattctaccaaaaccattctgctaattagttttttccaacatcagtgctaggcacaaagagagaatgtgagttaatcagaaagcgaacttgtgctgctacaggagatgtctcaaatcaagggggctattttagacacgtcttactgctatagattaaatttttatgttcccccaaaattcatgttgaaacctaatttccagtgtgataatatttaaaactggggtctttcatagatgattgggtcatgagggtggagccctcatgaatgggattagtgttcttataaaaagagaccccagagagctccctagccccttgctctgtgaggacacagagagaaggtgattgtctgtgaaccatgaaatgggccctcacccgacactgaatcttcctgtgaattgatcttggacttctcagccttgagaactgtgagaaataaatgtctgttttatataagccagtcagcttatggtattctgatatagcagctcaaacagactaagacaattactcttccctaaaaagagaaaaaagactgaatgtacaagtctgttatggattacaaatggctaggcattccaaaacaaagcaaaataaaaaaaacgaggatcatatattatttaagtgtcgtcttttaaatacccttcagtaagtctgaccatgtggtctcctggatttgctttgtgtacagctgtgggctgttttttttgagcaaatgtgggcagaccatcgtcagagactcatagatgactgacactaatctgactggaacttctcagaaagcacattctgttaaagttggttgtcctattgccagacaaatgattagcacttttataataagttttatcagccttggggctattctttggccagatacagtcttagaaggtaaaagttacaattcatgttatgtggcaaataaagttaaaacatagaagtatccacatctcccagcacataagctggcacaaagctggtgttcaattaatgcattgtctgttaagcattacctgaagtaaaacaagggatattttcccaaattttcatggagtactataccactgattcacagcttgactccttgagggcagggatgatagctcttattttctctgtgcctggcaccaagcactaaacctggaacagaaccagtgatcagaaaatagttgttggataagagaatcgggctaatttttgatattttgctgatttttaaggttcatttctcatcgtgtcctcagatttaattaaatgggaatatgggttcctactcacccccacagcccccaaaaaagacacaagaagaaaaacagaatggtacgatatgagcctaaataaagaggctaatcaaaagctaacttctccagggacttaggaagtgtttcataagttgcattgcaatcagtaagttagatttgcccttacttatattaagacctatttctaaaggtattcatttattaggagaggaaaaaaaaccctgcaaacaggtccaggggcagcaatgaaaagagatataaaatttcttacccattatcttatttacaaatatatatattggcatttcttcttggttgtggggaccatgaataaaaaaatggcatagtgtttgccctgtaggagcttacaatataataggtatatgcatgtgtaaacaaactgtcatttgagagagaagcaatcactataatcaagggacaagcaaacaggtcattaagtcataatttcaaaactcaggggaagactttctagaaagaaaacttgatttgaggcttcagaataaatccaatttcaaaaggccaaaaagtgaggcaggatatcccagacagaaggaacagcataaatacaggcatggagaaagggaaggtgcagggcagtttcgagggtcagagaagtatctgtgtccaagtgaagaatttatgaagaagggttgcagttggaaattaagctaaattggaactgatgcatgggaaaatacggagtctggattttagtccataggtatgttcccaaattctttcttggtgatgtttatgccaaaggcattattatttattagaacttttattacattgacatttttcttaaatactttgacttaccataactatggataataatcctgtattacttgccctgaataaattcaaaaaaccaaacacttataacattttaatttgacactgttctttcactaatgctctgaactgaacctgcaggcttgttaaaaagggagatgagcacacatcagaagcatgatcctgacctatgagcactaaactgacaccttttcttagctatactgaaagaatcagaagaggatcaaaacgaaaataaatcactaagagatactatatttttaaatcttgaggttctatgctactgaaattcatctcaaatacctcctaaaaatttagcctgtgccactgcctacatcttatgccttcagaaactcagctagagacactggagcaggcctaaagtgttttaggtatctgagtaatataaatgctgctcatattttagaaggaaaaccctggcagcattgtaaagggcagttcggagaggccaggcactggaaacaggaaagccagctgagaggctatcatgtagcctaggctagtggggaggggtctccattaaagggtgcatcctttaatattcagtactgagagagtaggaccaagtgacccagacagaggccagagagaaagtttgaagaggagtctaaggtttctaacatatgtgaagtagcaaatgtagtaggtacttacaatatacactgaacacaggaggagagagttgaagaaggggcaatgatggattttatcttgtagatgcccagatgttgaaaggtagaagggaagaaggtggtcaagacaagcctgagtatacctccatctaaagacgttgtttatataatgggggaagaagaaaggacaaatacgtcaaggctcaagtcacagaaagggaagttaagggaattcacatcaaatggcccttggcatctgtgaaatgaaagataaagttatgtatgaaaggcaagcctggtgaagaaatgatgaaaattctaaattcagtaaatgaaagatactacaatttgttctacccaaggccatggtgtgaagaaggggcttaactatcatgcttttaaatattacagattctgcataaatcccaaaatactgcaacttccaattcacatggcagttactagggaaattcagctaggagctaatatatcatgcatgtctgaagggtcccacattgctaattccataggacctacaccaacagtcagaaatttctggactgtgctaatttctggacacctcctactactttacaaaatatttacacccctgtgtcaaatgccaatctgttgaccttcccagcttagtttacatggtccatagtgattgacaatccctcctttgcacacatcctcaataaccttgcaccctctcccttcatcatacctacctggaaaaaccagccttggttaaatcaaatgctccacctgctctgcctggacccaacctcagatcagagctgcaggaaaaacacacaaacatgctgacaggctcactttaaatttttgtctatctgcaaatcctgttggctctcccttcaaaattatgccctgaattcaaccacttcttagtacctcctcagctgccattgtagtccaagtcaccaccattctcattattaagggaaaatagattgtcaagcatttctcctgtaattgccttccaccttggctccctgtggccatccctgttcccatggtcaggtccccaccagcagccaaagatccttttaaaaaacgtgaaaaaaggctgggtgcagtggctcacacctgcaatcctagcactttgtgaggccgaggtgggtgaatgacttgagcttaggagtttgagaccagcctgggcaacattacaaaaccccatctctaccaaaaaaaaaaaaaaattagctgggcatggtggcacatacctgtagtcccagctacttggggagctgaggcaggagggttgcttggcccaggacattgagattgcagtaagccaagatcatgccactgccctccaccctgtctcaaaaaaaaaatgtgaaaaagatcatataaccttcctaatcacaagcctccagtgacttcccaattatattttgaacaaatccaaagggtggtagattttgtcaaatacttttcttgtgtctatcaagatgcttatatgtttttcagatgttaatccaagcttgcattcctgtcataaatcctacttggtcattttgtataattctttttacctgtatgtgttgctgaatttggtttgctagtattttgttgagttttttaaaatccatattcataaaagatactggtctatagtttttttctgatgatgtctttgatttaatctcaggttaatattgactcagagaattaattaaatgaagtgttccttccatttttttaaagtatttgtgaagagtgagtataattcttctttaaacataaggtagaattcattgatgattttataggcctctcatttttaaaatttatgctgaatatgaatatttagaacatttgtggtcattggaactaagtttttaaactgtagtcatttttactgctgttagagaatgaagaataacagccaaatgagagttctttttagatgtttgtattgaatggtatcatataggggaggggaaagaatcacccggactgctcatagtatattatgtcttacaggattccctttgcgattgtagttttatcttcccaatcatttccctcagcttttagttagattctctaacggaagcatataaaattaactttctgaattgttccatgggatgaagcattacacactcacagcggaaaggaaagtttcacattttgtagactacaagaaaagtttgcttattgtggaatggggaactttttaatgatgccatctaaattgaaccaagtgggaacatgaccaccagccacccacctgcacctggagtcatctccatcctgccacagcactcaccatgtttcctttacttgttctcttctccccctgcaccttctcctcttccaagagcaaacttgtcctgggacttccctgacttctagctcaccaagttcccaattttctactcacctggtactttaagaatcttgccatttctttgaaatattttccaattaacaataataaaaaaattttgacatgtgggtttgatgggagtattcagactgcaggggagaaagaagacaagggaggaacattcactaggaccttggaccaactgaggggagtgggactggcccctgtggggacaatcccataggtggagctaaagggtgatagatgacgcagacagcccaagtggctgtttgggtatttggctggcttctaaattcccatcaaaccaatcccactcttgtttattagagtcctattatgttaatattggtcccagtgtttatagaatttgtactctggagcagtttacaccatttggtgataaaagcactatacaagaatattcttcatgtatgtgctcatttctcctggaacatttccttgcagctgtcagtaaatggggccttccccagataaaggaaatctctttcttggaaaatctttgaaaataagtatggaatgctaagggatagccttattaataaggtggggaataaattaaatgacccatagacctttggaagctaagtgttttattctgcttaatattttaatgatggctttgggccttcttagcactgcattataacagagtcattccattatacataaattggtactattaatctaaaagtgctaattcagacttatatttactgtgcttctatttcttgtgagatcaaaacacatcataatgggcatttgctcctaggaaagggcgttatatgtatgagaaggtaaaggagaaaagctgtaatacctcgggcctgttctgtctgaagttaagagtaagctgtactcatttcatttcatttaagagcgggtcaaggattcttctctcttcctctgtttatatctttcatatttattcaatgaaaagtttatagctctttaatctgtattatgtctcaattttacaaagtaattttgttagaccataatttttcatttcactctctgttttatgaagagtttctcattagaataatgaatgtatgtgttttaataacaaatagaaagaataaaaatcccttaaagggaaaagtattaaatgaatctgctccatcatttaatgggaatttctagttattcagatatatttgcagtaccttattatgctaatggaatagttgatatctcctaaagtataatcctattccttatatctagaaaatagtagttttgaactctttagaaaaacatgttttaagccttagttttttatctataaaagtatgcatatttattataaaagcattttgaaaacacaggtaaagatcaaataaaataatttcattgatatattctattttaatactaatgtctttgtgaaaattatgtaaaaatgtatttctgtttgttggtttttaatttctcaagaaataatcttttcatacagtgaatatatccactgccctaaaaagtctcatcagtctacctattaatccctttcttctctattctgcccccataatcccctggcaatcactgatcttttcattgtcttcatatttttatctgttttaacatgtcatatagttgaattcatagagtatgtacccctttcagattggcttctttcacttagcaatatgcatttaagattcttccatatctttttgtggcttgatagctcatttctttttaatgctaaataatccattgtctgaatgtactacagtttattcatgtactcattagagggcatcttggtggcttccaagtttgggcaattataaatataactgttatagacatttcatgtgtaggtttttgagtggacataagttttcaagtcatttggattaatacctgggagcatgattgatggatcatatggaaagaatatgtttagttttgtaaggaactgaaaaactgtcttccaaagtgacataccattttgtaattccaccagcaatgaatgagagttccttttctccacatccttgtcagcatttgtttttgcaacaacaaatactggtaaatacaaatcaaaatacaatgagataccactatgtatctattagaatggccaaaatctaaaaagaatagaaaggatcaattttggcttttctagtatgtatgtagtggtatttcattgttgtttggatttctgtttccctaatgacagatgatgtggcgcatcttttcatttgctcatttgccatctgtatatcttctttaatgtggtgccgttcagatcttttgcccattttctaaatcgggttgttcattttcttattgtagagttttaagtgttctttgtatctcttggatactcccagtctgtggcttgtactttgtgtcctcagcagagaagcttttaagtttaatgaaggccagcacaatcaatgttttcttccgtggattgtgcctttggagttgtatctaaaaagttcttggcaaacccaagtttacctagattttctcctaatatattttccaggatttttatagttttgcattttacatttgagtctatgatccattttgaaggttttgggggtttttttgtgggtagaaaggtgtaaggtctgtatatagatgctttttttttttttttttttttttaacatgtggatgccctgttgttctagcatcatttgtggaaaagattgtcctttccctctgttgatttgcctgtatcaatgatcagttgattatacttgtatgagtgtattttctacctcgcctattctgttacattggtctatttgtatattttttcactattaacacactgtcttgattaatggcacattatactaagtctcgaagtcaaatagtgttattcctctaaacttattcttctccttcaaaattatgttggttattctggctcctttgtttctccatagaaactttagaatcaatttgttgatatccacaaaataacttgctgtaattttggttgggattgcactgaatctttagatcaagttagaagaactgaaatctcaacaattgttagcttttctgtctatgaacatagagtatttatttagctcttcttggatttctttcctcagtgttttgtagtgttcatcatagaacttgtacatactttgttagatgtacaactattattcatttatttgctgctaatgtaaatggtgttgtgttttttattttaaattctatttcattgctgatacatagaaaagtaatagacttggatattatctttgtatcctgcaaccttgcaatacttacttattagttccagtgttcttgtcccttccttgggatttacagagaaaattgtttatctgtgaaaaagatggttttatttctcccttctcaatctgtgtactattttttcttgtctttattagctagaactttcagtacaaagttgaataggaatgatgagaacagacatccttgccttgttcctgatcttaccaggaaagcacctagtttcttaagtgtgatattaactgtaattatagctgtaggtttttgtggatgttttttaccaagttgaggaaattcccctctattcttagtttcctggtagattttaccatgaatgggtgttagatttttgtcaagtgccttttctgcatctattgatatgattatgtaatttttcttttttaacctgttatgtggttgatggattacattgattttcaaatgttgaactagccttgtatgctcagaataaattccgtttaattgtgatataaaagtgttttgtactttaagtaaacttgctaacattttttgaggatttttgcatctacattcatgagagatattggttgatagtcttacgtccttataatctctttggttttggtattagggtaatcctggctttatacaatgagttagaaacttacccccccatcccggcttctgtctctagaagacgttgtagagaattagtataatttcttctttaaatgtttgggagaattcaccagtgaacccatgtggtcctggggctttctgttttggaaggttattagtagttttctggatttctttaatagatatgggcctctttagttactttttttttcttgtgtgatttttggcagattgtgttgttcaaggaatttttccattttatctaggttgtcaaatgtgtgggcagaatgttgttcataatattactttgctatcctttaaaccttatggaatcagcagtgatgccccctctttcatttctgatgtttgtaatttttgtcttttttccttcatttgcttgtcatgaaatttatcaattttattaatcttttcaaagaactagcttttgatttttctgattttctccattgacttactgttttccacttcattgatatctgctctaattttttaattcttttccttttgcttatcttggggttaaacttcctttttctcattttctaaggtggaagcttgaatgactgattttaaaacttccttcttttctaatatatgtgttcagtgctataaatttccttccaagtactgcttttggtgtatctcacaaattttgatacattgtattttcaatttcatttactttaaaatatttttaaatttctcttgagaattgttctgggacccatgtactatttcagagtttattgtttagtgtccaggtatttgagattttccagttatctttgtgtttttgatttctagtttaattccattttggtctgagagcacatattgtatgatttctattccttaaaaaattttaagttatctttcagggcccagaatatgtctattttagtgaatatgtgtgcttaagaaagtgtattctgctgttgttgtgtaaagtattctataaatgtcagctagatccagttgattgatggtggtcctcaattcaactacgttgttactgattttctgcctgttggatctatgaattactaacagagagatgttgaaatctccaactatgatagtggatttgttcttttctccttgcagttctatcagcttttgctttatatattttgatgctctgttgttaggcccacacccaataaggattgttatgtctccttggaagattgaccttttaacattatgtaatgcccctctttatctctaatcggctcttttgctttgaagtttgctttgtctgaaattaatatagctactccaactttcttttgattagtattaccatggtatatcattctctattgccttacttttaattcatatgtgtctttattattaaagtgggtttcttgtggacaacacatggttgagaggtgacagcgtgctggcagtcctcacagccctcgctcgctctcggcgcctcctctgcctgggctcccactttggtggcacttgaggagcccttcagcccaccgctgcactgtgggagcccctttctgggctggccaaggccagagccggctccctcagcttgcagggaggtgtggagggagaggcgcgagcgggaaccggggctgtgcgcggcacttgtgggccagctggagttccgggtgggcgtgggcttggcaggccgcgcacgccgagcagccggccagccctgccggcccgggcaatgaggggcttagcacctgggccagcggctgcggtggttgtactgggtcccccagcagtgccagctcaccagcgctgcgcttgatttctcactgggccttagctgccttcccgcggggcatggctggggacctgcagcccgccatgcctgaacctcccaccccctccatgggctcctgtgcggccggagcctccctgatgagcgccaccccctgctccacggtgcccagtcccatcgaccacccaagggctgagtagtgcgggcgcacagcacgggactggcaggcagctccacctgcagcccctgtgcaggatccactgggtgaagccagctgggctcctgagtctggtggggccttggagaacctttatgtctagcccagggattgtaaatacaccaattggcattctgtatctagctcaaggtttgtaaatacaccaatcagcaccctgtgtctagctcagggtttgtgaatgcaccaatcgacactgtatctagctactctggtggggccttggagaacctttgtgtggacactctgtatctgtctaatctggtggggacgtggagaacctttgtgtctagctcagggattgtaaacacaccaatcagtgccctgtcaaaacagaccactcggctctaccaatcagcaggatgtgggtggggccagataagagaataaaagcaggctactggagccagcagtggcaacccgctcgggtcctcttcaacactgtggaagctttgttctttcgctcttttgcaataaatcttgctactgctcactctttgggtccacactgcctttatgagctgtaacactcaccgcgaaaggtctgcagcttcactcctgaagccagcgagcccacgagcccacagggaggaatgaacaactccagatgcaccgccttaagagctgtaacactcacggcgaaggtctgcagcttcactcctgagccagcgagaccaggaacccaccagaaggaagaaactccgaacacatccgaacatcagaaggaacaaactccagacggcgccaccttaagagctgtaacactcaccgccagggtccagggcttcgttcttgaagtcagtgagaccaagaacccaccaattccggacgcagttgggtcttgcttttattcactctgacagcctctttttactaatgtattcagaccattgatgtttaaagtgattattagtatagttgtattattatttatcatatttttctttattttctgttcattgcccttgttctgttttttgttaatttttttgtcttctgcccttcttctgatttctgcagtaataattgagcataatatattatttcactttttatcctttttagcatatcagttatactactattttttttctgtttgggaggtttctattgaaatatcttcaagctcagagatttttttttccttcgctataaacagtctactactcataagcccatcaagacattctttatttttgatagtgttttgatctctagcatttctttttggttttttcttacaatttctatctctctgcttaccttacccatttattcttgcgtgctgcctctttttcctttagatcccttaacatactaatcatagttattttaaatcccagtctgataaccccaacattcctaccatatctgagtcaggttgatgcttgctctgtcttcacacttttttatttggaatgccttgtaattttgtgttgaaagccagatataagatactgggtaaaaggagctgggataaaccggtctgttgtaatcccctggtattatacaagagccctattgatatcagtagtggttagctgtgagaagaaaggagccattctgtagtccggtgattagttctcagtcgtttaataagtacaggtccctgggctgtgactttcatcagtgcttctcaggtttttttcctctcccatttagatgcaacagtaaggctagaaggggctgaagtgggggtgttttccttccctcaaatgccagatcactccggggggagatggggaatggggtgcctgtaattgggtatttcccttttcccaagtgttttaggctctggtgaaacccaaggtggttacagtctggtaaaataatttcctatgagggcaagctattgttaagaacaaaatgttctgggcttataaaatggttacttttccattttctctgctggaagcaggaggggatttttctgtgatctttatcctaagatcctattggagctcctggaaattaaacttagaaaaatgtgatgccactctctacccgtcactccccacccctcacccctcaccccttacccctcaccccaggaccaggccttcctgagtttgttttctctctcaagctagtgagtgcacagtctctagcaattagtcaattaccttttaagtatcattacctgaggctggcttcagaggtggtttttgggtggtttttgttccaagtaagctgtgggttttccttatctacctgtgtccctagttttgagggtggtggtttgtcttgtgaccttaattctctgctagatctaagaaaatttgttggtttttagtttgtcacctttttttattttcttgttgtgaggataggaacgatgagtctcaaactcctttgggccagaaactggtagtaatgaaaaataatgtttctagacttcatagtattctatcaggtggattgtgtctcactctaaacaaaactccttttgaaagcaggagaaaatcttttagtttgatcaaagagccaaatataggcatcacagaatttgctttatttttactctaaaaaaaaaagatgatttagatagtatttagatcattataatgttatttgggtgattataattttatatattaagttatacattttacattcttttcatttaagcattctacatcatgagtaaatgtgaaatgttaagtgataatcattttaaattaaagtcttttaattttatgtttttacatgaatatgaaaacaaactttagtcactgcttctaaagtgaaactatattttgggttatcttcaagaaggcacaattccttaagtagataagttaatgagcatttggacttttacttttggtcattatgcttctttgtaagggtgccttaaatttggctagtttctgttttctctgaagtaggggtttttatctctgaccaccttgaactgatttgcattgtaacttgtttgtcgtaatctttttgcatttgctctgcaaagctgcatttcacacctccgactgtaatgggtcagtcagggtcacctcattgtacttgaaatatgaaatgacaccctgtaggtcatcatcaccctgcatgtctaccagaaatgagaaattgtccttaagaatacactttgtcagcttggtgttacaagtaccaaagtggttacagtattttacattgggttttgaagtattttttaagttttaggtgtttaatcagtgtaacagatttaggaatggtttcctatcaactatgagatagtctgtaacacagttttttggattttagtgtataatcagttcaactgattctttttgttccccttatggaatcattaaatgatcgtaaaattagagcaacaaatgcctcagattaaacaatcttgatttacttgtatgtcatttgatcagatgaataaggccttagaaaatcaactaaataaagtcagcattcagagtcctgactttggccttgctatttattatgaaattccacctaggcatacatacttggacggttgtttggttttttcctcacgatactttgtttcttcatcttttggactatgtgtataacattgacatttaatgaaacgtatctgtacatttttcatttggctaaataaaggcatacaagtatgaaagggaaaaaatcgatgaatgaatcatgcagttcagcttcctaccattttttctaaaatctatagaagctttgaaacagtgctatccaatagaactttctgcagtgatggcagtgctctttgacactatccaatgtgatatccactagccaaatgaggttattgagcctctgaaatgtggctggcattattgaggaattgtattttttattttatttaattttacttaaatgtaagtagcactttgagctagaggctaccatattggacagcacagatttaggttttatttgtgggttgtttttttcttatctataaaatgtgtgtgtgtttgtgtgtgtgtgtttgtgtgtgtgtatgcgtgcatgcatgcatgtgttgcaagaaaaactgagctttaagtacaagtctttcattcaaggaaaggtatcaagaagagaaattggcaccaaaacagtagaattggatatatatatagaatctgtccaagaaatcatttaaaacatagtaaatttggtacacagaattaaatggacttcttcccagaacaatggaacagcagtcgaggaattgaaaacagtgcctgctggagaaaaacaggaagagaaagagacagtgggaacagagagaaggggaggaagagaggacgtgaatgaatgcaagtgttatttattgacattttagaaattttaattgaggtgatattactgtactggctttgtaatctagtaggggaaaaagctaatttagtctagcttctttttgtagtgaagactcaatagttaaataaacagtgctctgcagaatctgtttattccttcaaaacagttaacctttcagattaaagatggcaagagctaaaagtagaaaataaaaaagtgttatattgacaggtttggggactattgaaagtgttacatagttcaaatccttctgattaacttgagttttccaactacatgtgatcacataacatactatagtttgaaattaaagaaccaacatttttgtaggactctctggtgtaaaaggatcttcattctgggaaggtagaaaatcatgagtctggggaagaggacattgagaagcagtcacgtgtctatttgcctgggtgatatttgagtaagattttttctggatcgtcagtaaatttgtttttggcttttctaaactttctttcttagttcattttcttaaatatttctttttctcttggtttttgcctatcccagaaaattatcatccagttctaggagcataataacatgtttaaatgttgtgaccagttaaaacacaaagccccactttatctacaccaatctgttaatataattcctttcacctttatctccttctcagtctttctaaagcaactgtacagcttttccttccttggagaaagaaaacagattgccagcaatctgccacatttgagtgttgtggtctgggtgtgacatttctgagcgtagtgattccagtagaacacacttactatatttacagtttgaaatgtaggagtgccagatagtaacataaagggaggttgaaagttttacataatgagatgcttagcatcagctcggtttggatgaactgctctatggacactaattcccatcactccatgtgactagatggaattttggctgggtcattggcatttgggaggattatgataggggaaagtgtggaattccagagatgggacatagtggtattagaaaaaatatatttctgttgcaacttttgatcttttggggacaggatagaaaaggggcttagcagctagaatctctaatttcacgcctcacttaaaataatttatctagaagatctttgggaaggtgccataatgttcccaggggtagtttagccatgccaacaacagcaacaacaacaacaacaaacagtctctatgatgcttcctcctgtccccatttgttggggaaaatggtgatgtcaccatgcttcagacattccccgagcatgttgtcactatgcctaccagccatcttaccttagcacttggtcaaaaataaattctgccctggtgcctctttaagttctattttcccctatttgcctgtctgaaaactcccgttgctcttacgaactggacaactaaagctgcaaaaccctatgttagagaatctctttctacagataaatgtgacagccttggtacagcaatgagtgcgttggaaagcacatttaataactttctgtagtgtcattataaaatatgttaatagagtgtaattacaacatattttaactgtaaatttaacttagacattatagtgcatgcattcaaataaaattcaaaggaaaaaagtacagtacataaaaaaatctgaaatttcatattcagtaaaatgatagacttgatattctcataaccttttgcgtaacatctagaggagctggacaaatggacgcccatagctaaatgggaagggaaatctccacatgcctacatatatgtatgaaaacatatcagcagaaatgcaagtaataagctggctctcacgcttcagctactctgaggaccacttctaatcttggtaattaagagccttaacttttttaggttctttttttaaagagaaaactgcagtaagaatataatttatattagaacatggtatataatctcacaccccactgaatagcagattttgtagcaatgtgcacagttcttactaaggatcagtgttaactactcttttttacgattgtactccattctgttttattacaaaatgctggtcataatggtggttctcagtcttgacacctaggagccataaaaatatatatgccagggtcccaccctcagtgattctgatttcactggtcttgggttgtggcccaggaatcagggttttaaaagctccctgggtgattctaatgcaccgccaaggttaagaaccatagcaccaaattgatttcactatgtactaatagaacttgacagcatatttcaaaaccattgctctaaagggatatacctataataaaagaatagactaaatataaaatctcccaccacagaaagaaagcaaaccaacaaacaaaaaaacacccttgattcccaggctgggtggggtgtgtgcttggtgaggttataggggtagaaagtggtctaccctaaagaatatgtaaccaaaggcctactcacatatgcttttgaaattatactatgacaagttcagaaatcagcatttaaatccctggtgggtaacaccttgaattgcatggtggaagcaaacactaatctctatgaagggacataccttgactcaggttcagctgggttttttttctgacataagacataagcctccctccacccaaccacccaaggctgcaagctgcaaccaccatgaattctctgtttctggaagtgtaacagatccaaagccaagtaaagaaaaaagaaacctacatgtagacacatgaacgtaaaaggagtcagaaaaagaaaagaaaaaacttgccacaatgattgctgatcctagaacatcctaacataaaaaactagagctggaatatactgcctatttctaaactgctgaaagaagttaactcctaacctagacttctatgccttcctaaatttaatttaaaaacaaaggcaaaataaaggcattaggtaattaaaaagtgagagtatgtaccaccaggtcctcactaaaataacttctaaaggatttccctcaaaaagagggatgagatcccagaaaggatttttgacatcttaaatgtgagaaggaatagggaggaaagaaaaaatagccctctggataaatgtaaacaaacagggtctacaaataacaaaacaacaccaaaaatgagtacttgggagggtaaagaaggttgaactgaggagttgggtgacatggtacaggtgtgattagatttaaagccttctaagggtcatgtacctgcactactcaggggaagtggggtgggggtggggggggctttgaattctaagtctacaatcaagtatgtcttgttaaaagttataagtataacctgtaaagtaataaaaatagaatgtataacatctaagcaaatagaatagaaaaatgtgtagtatgaagggagcatataacaaacagggaattattaatagaaatttgaacacaatgtgatggctaaaacccacagatgttagtgatcacaataaatgatattcttttttttattctaactatataaagcttacaagagttatagctaaaacaagtatgtcaatgggttgaaaataaaagattggaaaagatacaacaggcaactacttaccaaaatgagtttagtgtcactatgttaatatctgataaagatagtgttaaaagcaaaaactagtaggaataaaaaaagatcactacataatgtaaactgcaattcactgcaaagttgtaataattctaaacttgtttgtatatatttaattatatagcctcaaaatatataaaataaaacagtgagcaaactagagaaattaatacatttactattatagtgcaaggttaatacaactcagtatttaatgagtcatgcagatgaaaaagattatagatgatttgaataacacagttaacaagcttaatctagcatacatatattaaaccctgtagccaataactagtaaagatacattcccttccagcacgcatagactgtttcagtaattgaccatatgtgatgccataaaatacatctcagtagatttcatagaattagcatcaatgtgtaattcatgttctcagagaacaatgcagaaaaattagaaatcaaaactccagaagtaactaaactaaaaacatactgttagtcttccctcctccctagcaataaacactatattcctaggaaaaatgtcatgataatatgagggtggcatcctttcaaactgtatataaatgtataatttttttttcaaaacagggacatgtttgtgtgatcatgtaatttggtttctgtttgtttttaactcagcaggctattacagatatgctgccatggcagtacacacaggtatcccactagactagatcactaatatatgtctctaaaacaagagcttagtaaacgaggcacttgactttgggtcacctcactttgctcctaaagatctattatcccacagcctgtccctccagaattcacactgagaaagaaacaagactgccagtgagtagccaaaaatgcatgttttaaaacttaactgctgtattcatagaaaaaataattggtggactcagggatagctttctgcctttcattgcatactattttagtatagctcagaatcccatttctcaaacacaaattaaaaagagaaaaaagccactggagtgaggataacagaagttagtgacaacctggttggttcctggttaggaacaggataaacaaaacagtacaaaagtgacattattagaaaccacaatctagagagatttcacgtggggaagagacatccctctcagtgcatcaccattacagcagaacgaattatatatatacatatatatatataattttcatatatttactgtatatatatagagagagagtcaatatttgtaaatataagaaaagagtaacttctgttcattgaagtttggaggacagggacatttatgtagtgattttaaggaaaaacaatgcatttaaaaatggagttgatgcagaaagttacctggttataggggctgaaatcatcaggaatttacctatgtggggtgaactttggcaagtcccttcaccaggctgaacctcagtttcctcagtgatatgacaagctgctcccatgcttctgtcctgggatacagttgtctctttcctgccctcatgcaatacatctctatgaatacctcctttttgaagtatgcctcgccagatgctattggggcttatgaatggcaaacgacggaagactcagaccataaacctgcccctcgggtttacagtctaggaggaaagatgagagatgtgcaccagtaacagcagtgcagggactaaaggatatgtaagagagggatggaaaatactgtggtgtataaaattaagtctcatcggaacaggaccttcagaatatgaaacacttgtgaactcggagagatgtgggcagggggaaaagaggacacacagtagttctgtttaagaacatagtgcatgagcatggtcagaagggtaaattggaacgtcatttagagggacctcatgccagcacaagagatttttaaaggtgtttttttcacaaaggagtgactatttaaatgcttaaggccgggtgcagtggctcaagtctgtaatcccagcactgtgggaggctgagggggtcagatcacgaggtcaggagtttgagaccagcctgaccaacatggtgaaaccctgtctttgctaaaaatacaaaaattaactgggcgtggtggcgcgtgcctgtaatcccagctactgaggaggctgaggcagaagaattgcttgaacgcaggagggggaggttgcagtgagccgagatcatgccactgactccagcctggcgacagagagagactccgtctcaaaaaaaaagaaacaaagaaaaaagaaaaaaaaaaaagaggcttaagaacatgggggtcattaatacagtactaacagttgatttaaaatttttctgcttcagtggaagacttgtaggttattttcagcatttggtcacataatgttcattgttctcatgtagaaagaactttagaatcattaggctaaatgcttcgttgggattatgtaaggaatgccttgcttccacagtctaaatcagattgaagagttaaaagggaacaagaacacaaggatctcaaattatccattgcataaaatatttaatttcctatgaataagtggattttactaaaattatttttctgccctcaggggctctcaggaaagcagtttaatgaagggtactgattttagaagctcttaaaatttttatagtagaagtaatctgtgaagacacgtgaaatagatgcacgggtggcaagtattgaaatctatattgtagtgggtgaacctcagatttactaagaagcagcctgaacgtgtgtttggaagtaaagagatctgggttatcactcttctctgctcataatttgtcatgtggctggtgataagaagaagtgtcaggaaaggtgggttgggacccaattattaatggcttggggtatatgctaaagcaattggacttttcattctaagcagtggggaatcaccttgttttagaaagataactcacagaacaatgagaaggatgatatagagagataggctggagacaaggaaagaggtagactggtaagatgtctgttacaatggactaagcctctgtcttctcatcactagaataaggcagtggaaatgggagttctcccacttattcattcaccaagactctcctttttgagtaccatgtaacaggcatggttctaaccagcacagggcatattgctttgagcaagacagagaccactccttagcacaagtagtggtaattccaggtgccatggaccatacagcaagggatacataaccccttctcaggaggaggaggggttagagtattaagaaatcactgacttcggaatgtgaaggaccaaaatacaggccaaagtggggattaagatacaagaaaaaaaagacagcatatgagaatcctggaggggtaagagcaatatatgccccatgaattgaaactacttcagctggagcttagggtgcaagtgcaggacagcaaaaattaagattggagtggcaagcagaggccaggccaaaaagaatgctcaatttgagaatgtttgaaagtggatgccccagaacgtcagggttccttgatttgagggatgagacataggtaaaggtgacttcaacttgtgtgatttgatttcaggcaccttggtatttggaaataccatcttaacagacgaaaggaatatggagggaggacagctgtgtgctgtgtaatggcactgatgagagagcaccatttgggtgtctgggtactatgctgacctgaagcttcacaaaaacaccttcttgtctcaccaaatgagtctggggattggacaaagctgaagaaagcctgctgctcttcctagaacctcccctcactcaaataccccctgaaaaaatttttctccttgcaccccacattgcatcaagtacagtgatttgcacagtgtgggtcttcattgtattatttttctaaaccagcaggttgtttatttagaacacaaagtttagatgggttcatgatttgtatatgatgggaggtcacaattctgaatacagtagtaacataacatatgtgcttgcatgtatatgtgtgtgtctttacatgtatatgtatacatgcaatgtggggtgcaaagagaaaaagtatttcagggactatttgggggatttctaggaagggcagctggccttctttagctgtgcccaagtgatttcaggataagcaccttttatgataaagtgtatgtaaattggatcaaataaatctttaatatgataaaagcaaaaatgccctacaacatgccttacctccgtttactaagaaaaaaggggttatcatgagatcccttttcaattgtagatgtcaacattttaataaagtgttcagctacctttgcatccatgagacactttataaaaatattacttatcagtaaaatacacaagttaagaaacaaacactttaattaaattgcacagagcaaaagaaagctttagttggctgcattattcttcacactgtgttttaaaactatttctatgtaagctaagtagctacacaaatagtcacaccattggaagcatctgtttaaaaatgtttgacatgcatcaaaatacacaaagtaataaaaagatcatctctatatgtattccattacttttttcctgtagtttgctagtattgctatcaatatgcatatcactaaacaatatataaaattatcttgtaaatgtataaattaagccttgcttctgttatttcttcagtagcatgccaggtgagcagaacctcagtactgggtaatgagagacactctcttttattctagttgtttgatttggaaagcaatgcatcccaaaagcatctaccctgcagtaacctttttgtggatcccaccttgggcaccagctgtttcccacagtatgggcaggatcacgggaagtgaccagcataggcttaataggaagaacaagggtgctttgcaagcctgtgaagcctaggataattcttcacttcttgtggatgtcagaatttctggatagacgttactggcctcctcccctggccccagtacttggtacagtcttcctatgaactaggggagtactacctgtctgagtaaactaatatacaaaaatgagtctaaactcatttctttaaagtattcgacttattttccttgtccaagaagcatcacaacaaaataaccaaatgacagaagcgcatagaatactgtgtcaaatatgtatatataaagtcttggaaattggggaaggtattatatcttctgtgtcctattttactttggcaaagaggaagttcttagtgaatcttaatggctaaattgaaatagccctgttatgaaagcatttatatatgtgttctgtggatctcacaacttggctctctggtccttgctgtccaacatggcagccaataacatcatacggctatttaatttatattttattttttgagacagagtctcgccttgttgcccaggctggagtgcagcggtgtgatctcagctccctgccacctccgtctcccaggttcaagctattctcctgcctcagcctcccaagcagctggaattacaggcatgcacctctgtgcccggctaatttttgtaatttttttggtagagacagggtttcaccatgtcggccaggctggtctcgaactcctgacctcaagtgatccagctgcctcagcctcccaaatttctgagattacaggcatgagtcactacacctggcctttaaatttaattttaattgcctgcaatctacttggaaggctgaagcaggataattgcttgaatcagggaggtcgaagttgcagtgagccgagatcacaccactgcgctccagactgggtgacagagcaagactctgtctcagtcgatcaatcaatcaaaattttaatttattaaaatgacataaacttaaaaatctagttcctcatttgacactattcatcttcaggtgctcagtagacacatgtggctagtggccactgtgttgcacagcacagatattgaatattttcattatttttgcagaaagttattttcaacagtgctgtagtgcagctcctatttccttttctaatatgcttccaggtcagatatttcctataagcttcctcaaagcctatgtagaacacatgcaaatacttatttatatcctctagagcacccctgtggctaccaagctgggcacatagtaattcttagcctgattggtagaatggaggagaaagctggttttgatccttttgactttcacctgcctagtggccatttaagttcactgcactgagaactgaatggttttagatccagctattgtatttggctaagagtttgactgtcatcagcctaattttgttattttaatagaaggaaatgtctctgggtttgataggttcttgtttgggaagtatagtttaacagaggtagaatttaagaagatgtcctgtgtttgttttgaagagagatgactgacaaacattttgcacaactgagctcaagctcatgggtctgtttgatttttgtaattctgatcctcgatggcctttggttaactgcaaaacagtcaaagtgcagaggctattctctctccaagcttccctttgcagtattccatcctattgattcctgcattacctatggggaaaaaaaaagtttgttagaccaatttagtgagccagaattgtgattctgttcaggaaaatgtctgctgtatttgtcattgctagtcattttacaagtgtattttgatgagctgagtatgtaccacactttacgaagggtgcgctttttcctttttgcttctacaggtgaaaaccttcaaccaggaagcatttttatcattttaaattccaaaaatactaatatttaagaataatgaaatattgaattgcctttttcttttcacctttttttctggattagttggaaactttataggaactagtgaaagctacatgatctatttgtggatagtgctggaaaacaaggctggctttttaagtaattagtaggctggctggcattgaaagttttggggttttcgtgatttatgtagtgatttttctccaaccattatatgtttacaaaattttacttgcagttattttcactcttttattcactttctcactttcagctcccctatctcatcctttcttgttacccaactcttcttttcttcccttcatttcttattttctgcctgtataaaaatatttttccggctttaacacaacatattgtgtcagttccagatctctacaagggtgttctgaagcctttatggagtaggggactggtgggtcttagcggtgatggtttgagtttgagacagcttcgttcactacactgtgctcctcctgcatgaacctagacctgtgttttaattcagttcctgacattttggcattgaagtctatattttagctgcccatgctgaatcaagcaaggtgcaattaggaggcattctaagactaatttttagaattgaagtgggaaaatttaactggtaaaccttgaaaatgaccttcccagaaaatctgtgctcattctcctcagcctgtctggaatcatcttcatctgagaactctctcagctcgctgggtttggtggctcagttttctgactctgcttcttatctctccccgaggaataatgcaatgacattcaggaatgttctgcttccctagaaacatagcttgaaactgtgaagtgctggaggctaagacttcttgtcattgtttgttctacgtaggaattttcatttgctgtattttgaaaattaaaaatttagaatcaatttgtgataactgcgtactgtagatggggcaccttaagctggttgatttggatcagtggcgcatatttttttctcagttgactgagagccctaaacagaagccctgtcaaaaaattctcaggaatacgtgactgatactagacatagagatgtacgtcctccctcggcctgccaccctggagattgaagtgctagtgttggtaggagaggcagctgagggggcccaaaaatgaaatggcacagaacgatcgtgagctttcttttttcatttggacttcttgtcactgaacttcccactttcttcctggtttcattttgtggcctgctgtaccctcaccctatgttgctcctgcctttccaagggacctctgactaaccttttcctctccctcctctccttctccagccctcttttcagtctttgtcatactagttactgtgctcattggcagtggcagcaaaacgtagtgtagggtagaagggagcaaaaccaaagctgcgcatactctgagcagccctcaggtatgtcaccttgcttctgtgcaagaaggcccacttccaaaagtaatgacttttctttgtatctacttttacgtaaatagagtacttgctgaatatagagcacacagtctgtacactgatgaggacttgggtagcgttttgttatctccgtgctcacagccacctggtgaggtagacagtctgttctcttagagaaaagcgaggctcagacattaggatgcactgctgtgggtcatgcagaacaagaggtggggcagcacctctgaacccagctcagttcctccttgcctcttgtctcagagcaagtgaacaagaccctgacttttatatcttcaaatgcaggttcatttccaacattgcctagttaaaaatatccacagggattttttttttccttacagatttaagagataagatctggtctttgatcttgagaatctcagaggggtgaaatgtacagatgctgcctcctcagatctgctaccttagattggatttagaatagagtaagcatccaaacatacacacacacacacacacacacgcgcgctcgcgtgcgcgcactcttcccttagaagagcccttaacccagaatgggggctttccctacagggtattcccacaacatcacctcacagccctcctctagcactgatctggctgaactctgcagagcagctgtggggataaactggtgtggcactgccacctagtgactgcccgccacaccgttctttgcctctgaggtgccgtgcatccgtcagctggccgctacccatcatggaaaatcatagtgggggcttctaaaaatagagtctgccaggccagtgtcaacatgctttctctgctatcagcagagcctggcacacatcagacatggattagattaagtgtttttgaaaaagtggttttttgggtaagggaatctttgggcctggtcgagcatggctccatctgtctgctggggttccagtttcctcttggaggagctcacagtgtgcacaggatgcctggcacgcagcaggagctgaatgaatagaggttgccccgcaatgtttaaatatccactggtctggaagttagaaaaggaacaggaggaaagagaaacttggtcagaaatgctagtcctggttaaaacattgttctggattttgatattttttgatttcccagaaagtatcaggggcttgagaatataattctcttcaggcgtttttgccaaattccaagattttccagtttcactactttccagatgtgttgatatgaagccagctccagattgtctgatggccattactagagtcccagctgccctgaaactctaggccagtggttcagaacaggagtaataccgcccccaggggaattatggaaattagtggagaattttttttcttgttgctgccttgggccagggatgctgtgtatctgttacgcatttaacaaaacactgttctacatcccacttgacttcagattgacctactggatattacatataacaaaaacctgtttataattttcttagcttagacctaaattcattttaaataaggacataaaatagttttgctcagtagtaatcaacatttaattttcaaataatgtaattttctaataatatataaattgggggaaattattagtgataccgtctgtgttcttataggtttttaacatagtagtgaaagttatataggtgtaagatttgagacttttaacttattgacagataagtcattgctgaagtcacttattccaatatgacatgtaaatgcatagtgaataatagagttagaaaacaaaacctctttgtcctctcagggaaacacgataaatgtaattcttcaagtttgaaaatttgtggatgttctatcattcccttttccattgggacatcgaactttattttaaagtaagcttatgctcttagaacatagccgctgatggtctggagacaaaaaagtaagttgtctatatcccaagtgtgaatgaaactgtcattagccaaggttaatgcatgaaaagaaaccggacattttacagaaccatgccccgccaaacatacgcacacacacacagggagagagaaaaggggttagctttgacatttttctcaatgaaaagaagagaggaagacattccaaatgtgcaaaattaaaggagcaaaagaaaatcaaggtgaaaatactcactttggcattttagagtcaataaagaattatataatttataaaaattcaaggctggaggcggtggctcaagcctgtaatcccagcactttgggaggccaaggcgggcggattatgaggtcaggagatcaagaccatcctgcctaacatggtgaaaccccatctctactaaaaatacaaaaaaattagccaggcatggtagcgggtgcctgtagtctcagctacttgggaggctgaggcagcagaatggcgtgaacccgggtggcggagcttgcagtgagccaagatcacgccactacactccagcctgggtgacagagcaagacactgtctcaaaaaaaaaaaaaaaagaatcaaatggaatcctgcctaaattaaagctgggctttagatgtagcagcattatactgcctgttgccactgctgcttctctttgtttacttactaatattaaaggaagtctgtattgaaatcctcaagatcctaaagccatgtttatgttttcataactcagttatagggaaaaaataggagtgcaaggaggggactatgagaacgtcaaatagattggggcagtttacattctcatacgttctataaattagttccagagagagtagtttcatacataaaactacagcatttatactttagagcaccctcacttagggaggtttttattaaagtgtttggacttactggattttacattttatttgaatttagaactgtaattttaggtgtcagtgatggaacattattagacactcatgtcatcattttcaatctgttgcatatatttttctttgataggtctttacatctggtgttcacatttattacagcttgcatattaccttactccttgcaaccagttttctgccttaccacattttaagcttctcatgaatgcttactatttttactcatctacatattctcagtgcctccaaaagtttctttacatgtagatgttcaccatgttattgaatgagaaactcctgaaataaagctaattgatggttctcagactagatagcacattaaaatcatctggggagcttttaaaaaatccctgtgccatggcttcacccccggagacctcagcttcattgtttacggatggggctttgcacaggattccttttaacacttcccaggtggctccaatatgcagctacaggtgaatatgccgctacagtgaatagctacgtgtgaatatcagcaacaagtaagagacacgttagctctttcttctgagccattggcagtaagctcttttccttttgaacttagatatgtaccttctttgaatttctttttatgcttatatgttctaattaattgaagcagttattttatttgcctttacttcaaatgaaaactacatgcacatagttgcaatttggaaggagaccatttatcagactccttgcatctctctgagcctgcagctggtggacacggcaatatcagctttgttactgaaattaaacggatttggacaccaccacttgccctacagccacatgggctttctaatgttctgctgatttaccactgaatttgaaaaaagtcgtaggtgtaccctcacactgagggagtcactctgtgtcccaggtgagcttaccacatagaaaaccccatacacctgctttgtgggcaagccaaggaaagagagggcctgatctatgcctgctcagttcctactgccagatttttcatccctcccctgtacaaaacaagagatgcattgcctacctcttttcctcccaacacacatacacactacttaaaacaaataatgttagaggcaagcatttgaatatttagctcggtctatttttctcctcttagaaactttttaagatcttttctttattcctggtatttaaaaatttacagtcatctgccatgacttaggtcatttcttatttcgtatacatattctcagtagaatcttccctttagagatagatgtgtgccttccagttttccagtcaaagaaatagaagaacactatttcttttcttccactgtccatattatccttctggaaagatagttgttggaacctctattttaattgtctgagaatgtatcttttttgttctcctcttctctttttgcttttttctactttctgggaaatttctgtcaacttacattctaactgcattacggttactttttcatcataagttggtgttgtatagttgtattccacttttcctcttcctattaatgcaatttttttttaactttcagttcctgtgatacatgtgctgaatgtgtaggtttgttacattgatatacatgtgtcatggtggtttgctgcacctgtcaacccgtcatctaggttttaagccccacacgcattaggtatttgtcctaatgctgtccctgtcctttctcaccacaccccagtaggccccggtatgtgatgttccctgccctgtgtccacgcattctcattgttgaactcccacttacgagtgagaacatgcggtgtttggttttctgttcccgtgttagtttgctgagaatgatggtttccagcttcatccatgtccctgcaaaggacatgaactcattctttttatggctgcatagtaaagtttttatttagcctttttgtagtataatttacatagttcaggagtcctgtcccctcatcactctacatcatctcaggtttgttctgtttcctcccttcccttcctttctttcttcctccctcctttttgtgtcttttcgatagaaatcagattcaagtgtgtgctgatcatttgccattctctcgtattaagagtggcaattggaagccagttggaagctcggtaagggtaagggtttactgtttgatgacaatcactgtggggtgatagttgagtttttcattagggaattcttgatattattaatacatgaatgtctttcctgagaagttgtcctgtttctccagggaaaaatattctttctctgtattatcaaattctaatattagggtcaggtatgggaagtgaaggaaagagactagaaatgctactgttcagcttagaaacttgaacttaaggccccaaacatttcttctgcccttggctgggccctaagtctctgagtatccagtgtatccccagagaatgaacctatctcctgtgagttgtctgttgataccaggcagggcaggtacgtgcgtatccatcattctgtatacttacagttaatcagttcccctggttttagctttggactttatccacacattttgtggtacttggtttctccaagttgtgacacttccacgggttctatgacaatttgtgccttcgaattgggggtacacagaccatttatatttaatgtggttacagatacgcttatgtaaatctctcctgttgctatttgtttactatttgctccatctctttttttcctttatttctggctctcttgggattttttttaatattcaattttctatcctttattgagttatcagctattctttttcaatgtgttacttcagtggttcctttggggtttatggcacacaggcttacctcattttattgtgcttcactttattgtgtttcacagatactgcattttttacaaactgaaggactgtgtcagtgctgcatcgagctaggcgatcagcatcattttttccatagcacatgctcagttggtgtctttgtgtcacattttggtaattcttgtagcttctcaaactttttcattattgtacctcttatggtgatttatgatcagggatctttgatattacaattctatttatcttggggttccatgaatcaagcccataagagaaggcaaacttaaatgataaatgttgtgtgtgttgactgcttcaccaactagctgttcccccatctctctcacttttatctggctttcctattccctgaaacgcagtgatacttaaatgaggccaactaatgacctacaatggcttccaagtgttcacgtgacaagaaggattgcgtatctctcactttcaatcaaaaactagacatgattaagcttaatgaggaaggcatttcaaaagctgggataagctgaaagctaggcttcttataccaaacatttatccaagttgtgaatgcaaaggaaaagttgaaggaaattaaaagtgctactccagtgaacacatgaataataggaaacaaaacagccttaatgcggttatggagaaagtttgagtagtctggatagaagataaaacaagctgcaacatttcctcaagccaaagcctaatccatacaaggtcctaactctcttcagttctttgaaggctgagagaggtgaggaagctgcagaagaaaagcttgaagccagcagaggttggttcattagatttaaggaaagaaaccatctttataacataaaagcaaggtgaagcaggaagtgctgatgtggcgacagcaaggtgtccacatgtgatctagctaagatcgttgaaggtggctacaataaacaatagattttcaatgtagatgaaacaggcttctattggaaaaatatgtcatctaggaattccatagctagagtggagaagttaatgcctggcttcaaagtttcaaaggacacatgaactgtcttgttaggtactaatgctgctggtgactctgagttgaaggcaatcctgatttaccatgctgaaaaacctagggccgttaagaattatactaaatctactttgcctgtgccctgtaaatggaacaacaaagcctggatgacagcacatctgtttatagcatcatttactgaatattttaagccacttttgagttctgttgctcaaaacaaacaaacaaaaaaagacttctctgaaattattactgatcactgacaatgcacttggtcacccaagatctccgatggagatggacaagattagtgttgttttcatgcctgctaacaaaacatctattctgcagcacacagatcaaggagtaattatgactctcaagtcatattatttcaaaaatacattttgtaaggctatagctgatggagctaggcaaagtaaattgaaaaccttctggaaaggattaatttattctacatgccattaagaacatctgtgattcagggaaggaggtcaaaatagcaacattaacaggagtttggaagaagttgattctaaacctcatggataacttgaaaggattcaaatttcaacagaagaagtagctgcaggtataatggaaatagcaagataactagaaatattaatagaagtagagcctgaataagtgattgaattgctgcaatctcatgatcaaatttgaatgtatggggagtttgctttgcttcctatggatcagcaaataaactgtttcttgagatggaatctactcctggagaagatgctgtgaacattgttgaaatgacaacaaagactttagaaaatacataaacttagttgataaagctgtgtcacggtttgggaggattgattccaattttgaaagaagttctatgggtaaaatgctatcatatagcatcatatgctatagataaatctttcctgaaagaaagagtccattgatgtggcaaacttcattgctgtgttattttaagaaattgccacagccatctcaaccttcagcaagcaccaccctgatcagtcagcagccatcaacactgaggcaagaccctccaccagaaaaaagattatgactcattgaagacttaaatccatagaatttttgagcaatacagcactcttcaattaaggtatatacattttttaagacatcatgctatagcacacttaatagaactacagtatagtatacacataacaacatttttagaaactgggaaacaaatttgtgtgacttgctttgttgaaatatttgcatgattgcagtgatctgcatctgaacctgcaatatcccccaggtatgactgcacttacacacttaggcatactatacctatgttatcacagtctttcttcacctgatagtatatactatcttttactgcagtctatcttcaagcggtactgtatcacttcacatagatgagttttcagctgaataatcaagcagaaccctatgaagttctctgcatgtgtctctgtacaggtctctcctttttgatttttgcccttttgaattcttaacctccctggatttccagctctgtccttcaacagagggagacctccaggcagtgccaggtttccttccctgagctgcacctgagagattctctttagtcattaaagtgggggccattgtattgctcagttgttttccatctctcaagaatcactgtcctttgttgctagataaccaatgtcttgataaccattgtatcaaatattttatctgcttttttagttgtttcaggagagagtataaatctagttctctgttgctccatcttggctgaaagcaaattacacagtaattgacataagaatgtgttgtttcttcttctctgatgtctcctttcatttccctttgttcttgttggtttacaccttttaaaaaaaatgcattgctgtcactttaatggtatttcaggagagaggtggattccagaaagagaactgatggtggattgatcacatgcatttacatctccataatacttctcactaactatggctgacatttgagaccagagctgacatttgagatgagattttttttccatttttagtattactggtaaatttaatagaaaaggattaatgaacacaatttgttagctgttaacctccacgactgaattatttttacagatataaaaataccttctaagttgcacacagatcttggaacataacacgacaaatccaatttatgttcactgatgagcaagaattatttttatccactttttatatgtctatgtgtataatcctaaaaatctagcatgtggcccaaggcaagtcaacttgaggacatgtttccctttgtcacattaattacttcaaatattacttccctgctatgtttttgtaagcatctgtgactatacaacaatgaataaggcatagtcgttatcttcaaattctttataatttcgattctaagggtatgttagatgagtgaattccacattacctgtcttatgacccaaagtaacgtttatcaaatggtgctagagatatctacaagatgttcctgggatacagagagggaaccaggcttggagtatcatgctgaccaaaagctacagggaatctggagaaggggacccacaaacagatcctcagagtacaaacgagggttagagagaaggggggacgtgtttcccagcagaaggaaatacatctgcagagaaagagagctgtgaaggataacagcatacctcccagccattagtgtgcgggtgctgagggaggcaggagcgcaggccagaggccatcactctcttggggaagaaggcactgattccttgggaaagataacttctgtgaactttgacacacgttatagaaagctgtcatatttgtaatctaagaaagagtgtgagacccttagtcagcaatgaattaagaaatgaattaggaatagaaactaagaaaaggaacagtttgcttcttttaaaacattaaagttgatcttacagtctttgtctctgaagcatgcagttcatgccaaaactccaaagtcctcattttaaaagcttgagattattgggcattccttgcactaattttaatcttattgaatgtgtttttattaaatcagcattcatgttgatcaaaacttgaaatttgtacaaatcatttcttcatgcctttctcagaatagttctccttgtagagaaggttggaattgtctaagtatgtgaagcgaacttctataaaaaatgttttgaaaatttttaaacattgtattaatcattcacagtgatgtgaatctgtcatagattaaaaacctggggatgttcaaaatgataatatcatcctgtgaaaagtctaattttgtttctgagttgctgaaaaacaaaataggggattattctaatagtatctaatttggttcctgattacctcatcttgaatattcacaatcatgtatgtctgagtgcaacataaacattagtatgagatgtcatttttctattctgagctatttttagggcaggtttattattttgtaagcaaaaaggataatttatcattgaatcccaagccctaaaatgccaactcctagaaagatgcatgtttctatttaaagctcttcaatacaggatgacaatctctgatgcaatgtaatgcgaacagcatatagtaaatattaattgagtgatttaatgatgtatttcctgagagtatttggcaaataaggatggaagaaatttgtctatctaagatttgagcatttgttaaaggtaagcgtctaatgagttagcttgcctaaatgttccagtgtatgcttttcattgcagttttcagtcatttactgcccccaactctgaaaaacatttttaataaaaagtgctgcaggagcaggagattagaaagaccttcacacccatgccaaagttgaaatttccctgcaggcaacggccatgaaggtaccccctagaaatctttgtttatcgtatgaaatctcttacttctcttcgtagttacctgctctgtgaaaaccacatgcctaggaaggttgtttttttgtttgtttgtttgttgttttttgacaaggagtctcactctgtcatccaggctggagtgcagtggcagtgcagtcttggctcactgcaacctctgcctcccaggttcaagtgattcccctccctcagcctcccaagtaggtgggactatcggcttacactaccatacctggctaacttttgcatttttagtagagatggggtttcactgtgttggcccaagctggtcccgaactcctgacctcaggagatccacctactttggtctcccaaagtggtaggattccaggtgtgagccaccacacctggctggcctagctagatattaataatagtgttctggtcactcactgtggcagtgaaaaaacaacttgaagatttcactgggacccaggcacattttctaagtgtctagaaactaagtatctaaggacactttgctgatatagagacagtcaagaatataactgtttcagccaaagattgtccatgcattacaacatacgtcaaattagaaaatgcaagttaagctctctgagtacatagtgaacactcagtaagtatggtatgtacatacatatgcatcatggaaccagagccattagctcttaagtgtatcacatcagtgtatgaattgtgctaagaagcagctttgtctcacaattaaaaactgaataggaaatgaactcttttgcctcccctctctttacagaccattcttacgatagggtaatgtatttcctgttttaggaaattgcttggtgaggaatacttactagagagccccaatattattaatagattataatccagagtttatttctaggggttttattttgaaaggaaaaccacgtcctcccattgaagctctgttacatacgcatagcaggctcccagagcagtccacagaatcctgcttagctcatattgtggctgagcatagcactgatcacatagcatcttcctaggtatatattaggtaacaaagattctcaggggaaatgcactcagctgccttcctggaatgctaggaatacatatgactttccttttgacaatgacagcctctacaccaagaccttctggggagaggggactttacagctaggtcatggaggttgtttaggggtgaggaacggtggtgatttctgcacctctgccacagaaacttgcaggatgctcctaatcaggctggctgcctgttcacatgcccttccctttgattccaggagatcagtgattgccctttctctggggttccactcactccagcccggagcctgtttccttagtccacagtagcaggaaacagaatttcttagcttctctattctttggaagaaggcaaagggacaaatgtgataagaatgggtctcttgtatgtccaaagatagagtgtaagatctactgatattgtggagaaaagcttataccctgtaagataaatctgcattttttatttttgaagcaggaagcttggcatgggatgagggacaggaaaaaaaaaaaaagcatagcgaatgccatggtccagtgtaggttgcatatagggctaatcctggggctctggctaggagcagcctccttgccaccacagccctggcagcacagacacagatggggaattgagttgaaaggcaggactgagtgagcgaagcaggagatgatgagtaccgcgcaattatcagtatattttgcagagcaagaaatgaggaaaggaaagccctctgagtggtatctgagagatgggaaggagtgatggtcctttccaatggtgggtgaaaagtaaggaagtcttctagtgaccagagtctggggcctgactgtcatagaaaccagagcagggcctctctgccccatgaccacacagaatgtgcatctagagcaaattcttctagggtgacaactctgatggccttgctgttgtatgcatacatgctgttgtataaaaccagtgtccacatcacgggcacagagggttactgtttcgtactgttaattcaaccgaagtgtgataggatacctgtttctgatataaaagctttcttccttaccagtaaaatttgacacctcaaagaatgattaggatactttgtatccctctccctcttttcgactgtaagttctttgtgtataactggtaagacaacttctattaagctctggttatgggcagggactctgtgatcagaggtacagtttctgtgttcaaggatgaaggacatccaggtagattgacctattataatatggtcccatgatctagggatgtgcccgatactcagggagcacaggggaagcactgaggggaagagaagacagaaaaggctcccacttgaacttactttgaaggatgaagaggtgttagcccatcgtcaggaaatcgaggtagcaaaggccagtccaagcaaagggaacatcataattcattttggttacaaaggtgtggagtgagattgggcagctgcatattgtctcttaagtctggcacatcagctaggcaaggagtgacgagacacgggcaggggccggaggagtctacaaagataaatgtgcctgtatcatcttacaccagtgaggaaatctgttttatattttacagtctctttcagatgatatataaagttgaggcactttctgatgtcgtggattgcttagatggaacctcaattttgtttatattcacaagctttgaaaacttctaaatatagcagtttatagaagatacagtaaattcgttgaattgaaccaaaccacacttaactatcatattggagattaattataaaggactggttttgtttgctgtttttcaggtaccatgatcaacaggatgttactagcaacttccttggagcgatgtggttgatatcaataacttttctctccattggttatggtgacatggtacctaacacatactgtggaaaaggagtctgcttacttactggaattatggtaagtgtctttatacttcacatctcttttatttacgctcaagaaggcacttaaaccactcagtccacgtgcataagtaattgtgagctacttcttttcccatcagcaggaaatcagtataaataaatcaattttgtgttgagagagaatgtcaacagttttcctcttaattcttctcatcatgaaattctgttgaagaggtagagctgtttgattgccccttgtggggcatgcactaatttgataaactaatttgatcttggagctttggcttcagaatcaggaagtcctttaagactgtgtcctcccatctcctactagctgtgcaaatttgagtaaattgtaaaatatagcccataataactatcttgaaatgtgttgaagggtagaagatatattaattataatatttatttttctttcttttaacaaatgtttgttgagtgctaggcactggcctaggtactaggaatacatcaaaagaagatagaaacttactgccctgccttcatggagcttacaagggaagacttgcattttaaaaataataaataatggttcattacatttgtgaactagtaaagcttctgacctgttttgggcctgggggagagggatgggatctactcagagaaatcatcactagaaaattgatttttacgctgaagtgagaagggtccatacccaggaagggaagtagggagagcattccaggaagaggaaatggtgtatttgaaggcaatgaggcaagaaggagctcagtacagtggagccaggtcattgggccaggagtacacagagcaaaaggggagagcggcctggcatgaggcagggacaggaggccacgtcttgtggagcacttgggaaaggtctgctactgacatgccatcgttcttctggcatgcctcataggctcagacatcttttttgcccctccacacatgactagccaggaccacttttttgctccatttgttttttaggtataggaaatgggaggctagcaagctgtgattataatgtggtatgaacttctaaatatttaagccagaggtagtttcaaattgttgatgcacagttttcaatgacctaggcttgtctgcattctttatctactttttaaagtttgcttacagcaaagagtgtcatcttgatccttgtgtggtttctgtctacatgaggatgtgaacgagtactgcaggttccaaattgtcagaatttctgaaatcaggtaccctgttcaacacctctaactgtattcacccacaggctggtaggagagagcagagggttgtcatttgagggcctctgagtggtggccagtggagggtgcacacctttgcagaagctgcctgggaagactgctccaagagtcacagctaagtggaaggagagcgtgcccttggcatagacaggcaacatccttctcccccctcggtagtgttcaactgggataaggcagctaactttgaaaataagaatccagggtcaattttaatgtcccagtagtaacaagatggccatttcaagtcccaattgtagaaaatatagtttgggggcataatttaacattatttgcctttaaaagaaaaataatagttttaattatagtgaactttaaaaaaaaaaacggtatgctgcattatctgtttactattggatcacttccccttttttcctcaaataatagcattttattatgtggtataatgctttgggaaatgtaatttgcatagattatttttaggaggcccataacaagtccacaagggatataaatgatgctatttataaaaactagtaattgcagagtctttcccctagtgcttcttagaaacaacttccttagtgttactttttgtcaagatggtaccctcttttattctccaatcaggtgtgactcaagggtcatgtgcacaggcttatttgccatggaatctgagccaaatttgaggttaaccttgcctgggttttacaaaatgtttatcgttccttgatattttcttgttcctcgtgtctcaaaaactgttccttcaaagtctcatcagatagtacaaatcttttatttaccttcttgaactgcctcttgctcaggtttcactactgatcttactttgcttaaaaaagagaggttatggcctggcactgtgtcccacgcctgtaatcccaacactttgggaggccgaggcaggtggatcacctgaggttgggagttcgagaccaacctgaccaacatggagaaaccccctctctactaaaaatacagaattagccaggtgtggtggcacatgcctataatcccagctattcaggaggctgaggcaggagaatctcttgaacgtgggaggcggaggttgcagtgagccgagattgcgccatggcactctagcctgggcaacaagagtgaaactccatcatctcaaaaaaaaaaaaagagagaggttatagtaccattaaatatatgtggacacaaaaatgttatatgtaatggaatttatggtgacttcgttccagcccttaagcttatggtaaaagagtccctctattcttaggctgaggagctccattccctctccttcataaggatcagacttatttcctaattaattgacttgatcaaaattggtttacttgcatacagagaaattcactaatatttgagtaacatatttgagatgctctgtagagttggattatctcttcttctagactaagcagattcccatggagtcaggctacggggcagtcttcctgggattcacttctggcagttgattacatcttacatcagctccttagggatcaagagcatatggatgaaagtgacctagacactcctatggagaatgtagaaatttcttcattaccaagaccaatatgggaattaaagcttaagagaccaagatctcttattattatttttataaaataagtcatgagattgcctaatagaagaaataaaagaaaaccactcactacccttcaagagaaaaccattatggttgtaattacttattttctctttttattcttctacccttctgctatttgaggaagtactgaagacctgagggtttactattgtaaaggtcatgataaacaatgggatgatttctgagtagctttgtacttttggttgaagatggtaggcaagtaatatggttagatcacagtgtctatcagcttttggacagcaccagctagtttctcaatgtctccaattttccaataaagtaattgttttacttagcatttacaaagttattttatcttcctagaaatatatatatatatatataaaacacatcctgaaagctatgaattctcccacaactatgaatatatatgattgtttcaagagtgaaaaatagccttgtgggtaagggtatctttcatcttatactggaattaaggttgctcatttgttctttttgcttctctatttctgtaaaattacagtgactcttggtggccttttgactagagtatggatgactggattttttggtttaattatctttaaatatcgagtaatatctgttcattcctagggatgcaggttgttattcaataaatggttctctaatagtgatttataaaccactagactttgacaacatctagcatgactccctcaacaaaactgaggacacttcagatatcagtgatttaggtttcttccatcccactagtagttctatgtaaacaaaagcaatgcgtaaagctttcgcagttcatagcaatttgaaagtcactacgctaattaaattttaaaattttcttcaaggagcaaaaaaacaagtcagttcaggacagaagcctttacacagccttgccttttccttaagatttgataataatcctttccacgttaaatttgccctgtgccgaggaaatcttaatttaacatcacatggtgactccattagttgtcagttaaacaaacagtttgcatcctgaagagcaaaaacactaccctgttaagtcgctaagagggtgttccaaaacagcacgaattagctagagctcataaaaaagaagtgattggtatgaaagaatgcgaaacctaaggtctgattatactcctcttcctgtaacactctctgtttccatttgaggatttgttttcccccgccagtgtacatagaaatcctgcaaaactgatctgaagccattccttagtgttgaatgtttgagaatgtgcaaaacactcaaggatttttaaaaatgtcttacacaatttgacattgggtgtttaattttgaagaggttttaacttttgtattgcttgctttttggttctttctggtgcgttcactgaatctcatcagataaagccccagtgaagagagtatatctttaagttcttacatacaatagtttctattttgtgcagagcagctggaggagatgggccttttcagtcataaggctaaattccccaccaatgtcctttcttgaggaccttcacttcccaccaagaaatttcataagtggatcgcaaaaaaatgtcttaaatatgacagctgccgtcttccgggtacaggaaagtataggtggaagttgttgtgaccttttagcacacagctcatggactccacaatttcacccaatttttctaaactatcagcacttttaattggcagagctgcccttcctatctctgaagtacctgcactcacactggcactgttgctaatcaggagatttaaaccgagggatgattcattgttgatgaccagttttatgaggtacttccttctttctgaccctaaaagtagaagaatgagctgaacaagcaaatcactataaaggaggctcgggttgcccaggcccaggcttaataactgggctcaaacaccacacactctcccctcttttcttacaatgaggacatttgaaattgacctccacccttagtagcaaatatcaacttgtatttgaagacacttagagggcatttttgatagaatttgtcatcaaaacttccttgaaacttatttattttcatgacctgaggaaaccttgtaaaactccaatgggatataatattaaagcagagtgctttataaaatgttacttgccagaattgattgtttcacatgtttttatgaaagaataattatttatgtcagtcaagtatagtaaaaatgtttttatggttctggcacattgagtcagtcagccccagggacagaaaaacaggcaatgtgttcaagtatttgttttaccttccttttggagggcaagctgatttgtgaaagatcttaaagctgttttatttttacataaaagcgtgattttttttcaagttaactattttggataaattttaattataggctaatagtctatttagtctaataaactggctgtcaaactgaattttgaactttgaggagcaggagctattataaatcccacaggaggatactttaagcctagaatattttgaacattagtgttttttatcagagccattctctgtagcagtaaaaattctggaatttgtttaaaaagtataaatttcattattatgttgaatcttttgaagatgtctttttcacagttgaaataatcaaaacctttccacagtgtgttatgtgaaggaatttctctttttcataggcttgtatccttgttattaaagcttgatcccaaaatggtttttcaaaatgattcttggaagtatttgcaggatcagcataagtagatgatttagggcaaaaatgtgtcacattttaatttttcaaatattatgtgatacatgcttttgagggaaatgggatacctgaacttcttttacatccaagggctcaacatggcttacagtttctgcgctataatggagaagaatacagtggagaaaaacactacattttaattttaacttggcagcatctaagactatccacgtgttgggatttccctagaggtacataggtaatagtaactaattgtcatttgtctgttcagtttaatctggcttggcttagggtagtaaacgttaacaacacttgtcattacttaccttttctaaagcaaagtccttctccctctgccccccttaacttatccctttttctctctttcaccatcttctctgttagaaggaaagatgataaacaagccaagcgaaacctgaacctttgcttttaatatattgacttcctaaatacactgtattttcttcattttgtttttaaatgcccaagcatcttgaagtgacaggttagtgattttgcttaagttttttctaagaagataaatgaaatgagagaaaagtaaccaggatacattttctgactttggtgaaaggaatatgactcatcttgttaaatgcatacagggatcttaatttcagagagtaacatatgttagtcccaactgtttctacatcgattgtggtggtgacaagctttggagaaaatgttgtaaaatcgtacttatttccattcttattcactttatgaaacggaatcgtcctggaaatagacactgggtggacaataatattatgccattacttaaattactataaccatgaatatgttggcaggaatttaccttgaacctagaaagctttcggaagtgagccagcttcatcttgcataactctaaaaattaaaaaataaaggttactttcatcagattctcttacgatttattaatctagggaagtataagtttatggttttcttcactaaaataaacagttaaggggtttgtatttgaacaaaaaggtttctaagtggctctggaggtataacttaaaggagtagtgttaggataatggagtgaggtatatagataatagttttgataattactaaatgattggattaatttcttttccactttgcaacagaggtactcatttttaatgcatgtcttagatgacacccggtgagaaatgggccagtagcagaaaagaatggagcctgagaataaacacaaataaaaatccactttccaaggctcttgattccagtgattttccactcctgttaggattttgatttctttccagaaagatctcagcagaggccacctgccaggggagaacaatattcaactttttatgccaactaccctctcatagctgtctctgcagtagttaggaacccctcaggtttttatgacctctgcttattaaagaatcattgctgccctgaaccaccaagttcctgtagaacccagtgattgaggagtagtacctaggagcatatctacaaaaggctagcctgtgtttgtcgagcatacgctataccatacagcaggtagctttatggtggttatcataggtggtcactgatttggtttcatcagcctgctagaactctttctttagacttcatggtagatgtttgaaagtcagtaaaatgggtagagatgcttccaaaggccattcttttctttcattagtacccagatctaaaatacctcgctttcattgtctgcatatggcacaaaatatcaaaataacatcacaccctctgcctttactttccttgtttatcgtgtcttcataagtcagtcaaatgactcttataagaattttgaccctcttgttttaataggtttatggagtttgtcatagtcactgcatatcctcctttatctaaagcagtgactataccttgggatcacctggagagcttttaaaaaatttcagacacctgggttttatccctggagatgaagatttgctgtgaggcacacagctctcagcactaggatttttacaaactctccaagtgattctatagtcaaggttaaaaactaccaatttaaaagttataccagttacacaatagggacaatgttgattattttgataatcatattgcttgatttttagacattcatactttatcatataaaataggtgaatttgaatttcctgtcttgctttgaaatacagtgcttcataatgcattatggctatggaataatcacaaataagaatatacagtcatcccttagtatccatgggggttcagttccagaaccccacttcctgccatgaataccaaaattcacggatgctcaagtcctttataaaatagtgtattacttgcatgtaacctaggtacatcctcctgtgtactttaatctctagattacttataatacttaatacaatataaatgctctgcaaatagttgctaaacagtattgttattgtttaaagaataattacaaaagaaaacggtctataatgttcagtacaggtgcagccatccatttttttactgaaatattttcaatccagttgaattcatgtatacggaacccatggatatagagattcaagtgtatgtgatcctaaatatagatatagatattatgagatgaagtaaagagtaggaaaaatatcaatgctaatcaaagtttataactgaataatcatttactctgctttagttgtctcatctctaaaatcagaaggctaaatcagaatgtctaaatacttggcaacctctttctctgatcatgtgatcagtagcactttctttctgaggatactgatttcttcatagaactagatggaacaggctatttaagccctctggaaatatattaaagcagtattggctcatcattgtggcaatgtttccatgatcataatgatcaggtcgtgtatttattttctccttttctcctcaatcgtgtccctcctgccagatttgttgcagcaactcattgagtaagcccaaagatggattctttggtctataactgaatagctaaatcacatctactttctgtgcctctgtctagcggactctgcctgtgccctgccatttacattgttatctgtttgttgagactagctgggcaatgtctatggttctgtggtcctctcagggttgagattctatctggaggtgtgacttccctttcacagacccctgaggtagttcctcacatgcccccttccctgctgggaggttggctgtgcccaggactgatgaattggctgcagcaccttgaccttgcctggaccctccaatcggtgccccagcaagtagttgctcgtagcacagaagactctcacaacttggaatgagcacaccttgatcacggagcgggaggactgtaattcttagagtaccacacagagtctctctttcaagagatcagaacaatggtctgtaattcaaaaaggaacactgttggttttttcaaaatgaagatgacccgtgcctttcctagtgtcatgttagtaaatctgtaaaatggtataatggttaccccttaccttcagtacttcatctatctctgttgcccaggttaagatcactgtgatcttcctgttacgcttcctcttgtgtgtgtggaaccctgatgaagcagtgtatatgctgagataatttattgtttttattcctggtgcattgcagttgatcaccttgaaggcctgctgatctcatcttaagattagaggtttattctgtatggaaaaatccttatttctaccccatatacatttatgctaatctactcatttgttatttgttcctattataattataggtatataactgacttgctctgttttttaaaaagtctccaaaaattcaccaagttgcttttaggccatttatttcttagaatggaaatgttttttccaaatatgcttttgttcttaaaatatgtaaactaaatttttaatcccagtttaaggcacattgcttacatgtgttgatcacacattttctgtaatacttattgaagacaatgtttttaatcctgagaaacttttgcatttgatgcaaaacattttctaatgtgtctgagacagaaagtagttagtaatgctttgggtttctcttctctccttgttttcagggtgctggttgcacagccctggtggtagctgtagtggcaaggaagctagaacttaccaaagcagaaaaacacgtgcacaatttcatgatggatactcagctgactaaaagagtaagttactatccatatatcttcaaagagaatattattgtgattttttcagtgttaggaaatatggtttttattttgacatccgaagctgaaatgacatggtttgaaagtataggcattcttggaatcacttccattttatcacattttgagaatagactatttctaccttgaggtcagttaggaagtaattgggcagtcttggtatttggataaagacgagtcacataaatgttaggtatgcctacttgtttagatttcagtatagtatatgaggccaattcttggattgagtaggaaggaaaatactattaatgtaaaatagtaatttgatggaaacgtgattgaaaatgttttactgaacttctaagatcaagtcactgttctcaagacagggttgcaaagacaaaagaaaccaccactaacttttagaagcccaagatagggccagaaacaggctctttccttgacttacaggccataaaagagatgttaaaaatagtataccatccagttgggcaatcgctgtccaaatattagcagaagaaaacagtaatcacaatgtttaagagcactttctgtgccaggcactgttccaagtgtgccatgtgtataaactcacttcatcctcataacagcgttatgagggaagtgctattattctggccattttataaatgtggaaactaagacacaaaggggttaggtaacttgctcaaagtcaccagatccaggtagaaaactgcaagaagagaaaggtttttattagactaaatttttagcctttcttgatagtcacttgagacaaataccaaagtcaaaaaattattttatagtagagtcatcttgctgtgtaactactgctcaatgtggaatgcaatcaggctgtcagtgaaataacaaaatacattgtcaacttggtaactttacccataaatgaatcaatagatatttcaagcatagttccaacttccagtagtgttttcactcactcttgattttggttgtatatttaaaagtaatcttgtttaatttggttgatacttcctaacaggccagtcattttaatgcaaatatatatttatatagattatacttaggaaatgaaaacatgaattgctattgcctgctcatgctaagtcttacctatcagacagtcctgtgatacttcattgcagttagtaggtccacgtttatagtagatggtcagagcctcccaggttcagatgctacattttcagcctacatttaccactttggaatgtcttctactctccatgacttactctcattttcttcaaactcctaaatttgttctcaaaacttgtgaacatccctgtatgagagtgtgcagggaaaaaggtcaatgaggagctgaataaaggcttgggtttcttttactttttaaagatctactagagataaaaatatgtgcatatgagattagactacatctaatccataaattggagcagatgttttgtgtatttcatcatgtgcatgtttggtcctttcagggctctatgctgggacaatttgtgtttaagagtcacaagttttataatattcaaaagaacacttgcattaagacccttgtaatccatattattttaccatgaagattatacatttcctcaggaattaagttaatgccacacttaagatattagggagaaaaataccttaaaataccatgtcgcccatatgtttgcctgtaaatcttaacagaaaaaaaaaaagtgacagaatcacaaataagaaagccaagttagcatgtttgggcagacttctccatgtttcataagcagattttaatttcatcttaagaaggaagcatatagtttctctaaatattactttggaatattgatattccatatcttaattattaaaacattttaagagttagaaaagacaaagagttagaaaagacaaagactttgagtacaaaatttacagtatcacactgccatctaccacctttgataaaaatttttttatgaagttcaccgaggtcaaccagtttcatttgggagacattccaagttggttttatagtgtagttgctgtattccagggcctctcaaccttggcactcgtgacttttttggctgaataattctttttcatgtgggactgtcctgtgtgttctggatgtttctcaccatacttgacttctacacactagatgccagtagcactacccccaacttgtgacaaccagaaatccctcaagagacaaaatcacctgcaggagagaaccaccttttaatgtgctgttccacaaggatttgacatcttagaaaggacagtctctcttaaaagatactgagtctactgaatatattgtaatttccttttttggaataacatataaaaaatatactgtatactaaatatggttgtcatgctatgttaactgttaaggatcaagagctaaagaatcacattcgagtattccaaagattttaagcttttccagtactgaccactcagaaaatcagacgaaatctcagatgcttcctgcttggcagaaaaatgcacgtgtgcttgtgctcatgggtcccctaaagtccggtcagaggcccctttagagaactatggatccaggatctagatctatggattttggtgaccctccttcagtttttatgaatgaaaagcatcttcccaaactgacaaagttttctgatgatgctacagcttttttgttgtaagttcttgtatactttaaacttcctttggataatgttgcctgaattgtcaacttattgcctgttgaaagctttttcattaagtactgttctggtttcaaattttacattttatataatacttaccatgctttaataattctgttatttcattactacttttttttttaaattatactttaagttttagggtacatgtgcacattgtgcaggttagttacatatgtatacatgtgccatgctggtgcgctgcacccactaactcgtcatctagcattaggtatatctcccaatgctatccctccccccaccccaccacagtccccagagtgtgatattccccttcctgtgtccatgtccaacaatgatagactggattaagaaaatgtggcacatatacaccatggaatactatgcagccataaaaaatgatgagttcattactactttttaaaagtagaactactttgcagtatttcttgagactggagtctcttgagaccggagtctcttataggtctgagaaatatactctagtaggcttgctgacagatccatttttttttttttttggagatggagttttgctcttgttgcccaggctgcagtacagtggcgcaacctccacctcctggattcaagtgattctcctgcctcagccccccaaatagctgggattacaggcatgcaccaccatgcccagctaattttttgtatttttagtggagatgggggtttctccatgttggtcaggctggtctggaactcccgacctcaggtgatccgcctgccttagcctcccaaagtgctgggattacaggcgtgagccaccgcacctggccgacagatccatttagtgacatccaagatgtcactaaataaagatattaatgttaaaatgacactagaagaaaacagattgctggtttataatacccattcctgtattatatatactcaacaaggtataggcaaataatagccattttatagtcctctcattattttatacaaagtcatcaacttaatgagtatcatttacttggaatttgattccatttgcttatttatggaaattccaaatggactcatataaatgagtataaactttaaacttttaaaataattctaaaatgctgaatgatttgtgaataattaaaagtaaatagagatctaaaaaccatacctagtaactaagatacaaactcaaggttactacatattgttagagaaaaatacaactattccctgaaacattatctagaaagaaatcattttttctgatggttaacaggagtaatagtcacagatgttctgaaatctgaatatgactctaaagaaaaaagcaatatgaatgttaaaagatagtctgttctcccaggaacagatgtaacattccaagtcttccagtttgtatctttagtgaactgaacaatttctgtgaaaaattattcactatgtacagattttcaggggaacaattttatataaaagttgtttctctgtatgactacattaaccaagtaaaatactgtatttgaaagtagaatactatttattgtacatcagcaccgagaagattgttttgtctaatcctaaatatttacatgacattctgcaattcaaaaatggccgacaggtacatgtgtccagaacaaactaatgattttgaagtgaaaacataataccattaccttgtctcctagtttagtaagacaggaccagctatttaatagatttacagtttatcaccttacaggggcaatatatttaccatgcaatatcttttggaaatatattattattactgctcattccattctgagcaaacaggaaatcttgtagtttgatccccagaatacctttttggaaaagaaacttgaaaacaagcaattccaaaacccagacataatttttaaagttgctagataccccacaaaggataattatacatattaatgtccactgtgggtgttgttaatctgttaagaattctcaatcagatccataataagaacactattatgcagttatataattttgtttcctgtatgtctcttaacaagggaacagaaattctaaaggatttatttcacattgtccttggctcacagcccagggggttaacacattaaaatgaatcacttggctatgccctgttccacagctacaacattcacccaggcctcatacacctgacctaaaggaaaactggagagagaggttggagcatgaacaaatctatccctgctgctgcaagggtggttgagagcatatggcaccctggtgcattccccttgaattggcgaggagtggaagtgttatgctaaaaaagcctctgagaaagcagcaggagaaaaaaacaacaacaaagaaatggaagttgaaaatgaagatccaaaatagccttttaaactatgttgtcattacctatatgctataggtttgaacaaagcaaagttttaatgaaaagaatgaatgaaaaagagtgaacaaaacctccgagaatatgggattatgtaaagagatcaaacatacaactgattggggtacctgaaagagatggggagtatggtactaagttggaaaacatacttccggatatcatccaggagaatttcctcagcctagcaagacaggccaacattcaaattcaggaaatgcagagatctccagtaaggtactccacaagaaggtcaacccccaagacacaaaatcatcagattctccaaggtcaaaatgcaagaaaaaaaagttaagggaagccagagagaaaggccagatcacttatgaaataaaacccgtctgactaacagtagacccctcagcagaaatcctacaaggcagaagagactgggggcccatattcaacattcttgaagaatttccaacctagaatttcgttatctggccaaactaagcttcgtaagtgaaggagaatataagatcctttccagacaagcaaatgctgagggaattcatcaccaccaggcctgcctttcaagatctcctgaaggaagcactaaatatggaaaggaaaagccgttaccacccactacaaaaacataccaaagtacatagaccactgacactatgaagcaaccaaataagcaactcttcaaaataaccagctagcatcatgatgacaggatcaaattcacacagagcaatagtaaccttaaatttaaataggctgaatgccacaattaaaagacacagaatggcaagctggataaagagccaagacccatcagtgtgctgtcttcaagagaccctctcatgtgcagacacacacataggctcaaaataaagggatggaggaaaatttaccaaccaaatgaaaactataaaaaaaaaaaaaagaaaaacaaaacaggggtggaaatcctagttcctgacaaaagagacttcaaaccaacaaagattaaaaaaagatgaagagcattacataatggtaaagggttcaattcaacaaaagagttaactattctaaatatatatgcacccaatacaggaacacccagattcataaagcaagtacttagggacctacaaagagacattgacttccacacaataataggagactttaatacctcactgtcagtattagataattgagacagaaaattgtaacagagatattcagaacctgaactcagctttggatcgagtggacctgatagcaacagaatacacattgttctgatcgctatgtggcacttaatgtaaaattggtgacataatcagaagtataacactcctcagcaaatgcaaaagaactgaaatcataacaaacagtctcagaccacagtgcaatcaaattagaacacaagatcaagaatttcactcaaaaccacaccacaactacatggaaattgaacaaccggctcctgaatgactcttgggtagataatgaaattaaggcagaaatcaagaagttctttgaaactaaggagaacaaagaggcaacgtagcagaatctctgggatgcagctaaagcagtgttaagaaggaaatttatagcactaaatccccacaccaaaagccagaaagatttcaagttacaacagaacatctggagaaccaagaacaaaccaaccccaaagatagcagaagacaagaaataaccaagatcagagctgaactgaagaagacagagacacaaataacccttcaaaaaaaaatcaacaaatccaggagctggttctttgaaaaaattaaaataaatagatagaccactagatagacaaagaagaaagaagcaaagagtcaaataaacactttgataagggggatattaccactgaccctacagaaatacagacgaccatcagagaatgctattaaacacctctatgcatataaactagaaaatctagaagaaatggataaattcccggacacataataccctcctacgaccgaaccaagaagaaattgaattcctgaatagaccaataatgagttctgaaattgaggcaggaataaattgcctaccaaccaaaaacccaggaacagatacattcacaactgaattttaccagaggcacgaagaagagctggtgccatttctgcagaaactatcccaaaaaatcacaaaggagggactgctccctaactcattctatgaggcaagcatcatcctgataccaaaatccggcagagatacaacaaaaaaagaaaacttctagtcaatatctcaatatccttggtgaacattgatgaaaaaatcctcaataaaatactggcaaactaaattcagcagcacatcaaaagccttatccaccatgatcaagttggcttcatccctgggatgcaagattggttcaacatatgcaaatcaataaatgtgattcatcacaataacagaactaaggacaaaaaccacacagttctctcaatagatgcagaaaaggccatcaaaaaaattcaacatccctgcatgttagatgctctcaataaactaggtactgaaggaacatacctcaaaataataagagccgtctatgacaaatccacagccagtatcataatgggcaaaagccagaagcattccccttgaaaaccagcacaagataaggatgccctctctcaccactcctattcaacatagtatgggaagttctgggtaatcaggcaagagaaagaaagagtattcaaataggaagagaggaagtcaaattacctttgcagatgacatgatcctttatctagaaaaccccaacatctcagcccaaagcttcttaagctgataagcaacttcagcaaagcctcaggatacaaaatcagtgtgcaaaaattgctagcattcctatacaccaccaacaggcaagcagagagccaaatcatgaatgaactgccatccacaattgctaccaaagaataaaatacttaggaatacagctaacaagggaaatgaaggacctcttcaaggagaactacaaaccactactcaaagaaatcagaaaggacacaaacaaattgggaaacattccctgctcatagataagaatcaatatcatgaaaatagccatactgcccatgctcatagataacaatcaatatcatgaaaatagccatactgcccaaagtaatttaatagtttcagtgctattcccattaaactaccattgccattcttcacagaattagaaaaaaaactattttaaaatttacatggaaccaaaaaagagttggagttgccaagacaatcctaagcaaaaagaacaaagctggaggcatcatggtacccaacttcaaactatattatagggctacagtaactaaaacaccgtggtaaactggtacaaaaacagacacatagaccaatggaacagaaatgaagtccacacacctacaaccatcatgatcttcaacaaacctgacaaaaacaagcaatgcagaaaggagtccctatttaataaatgatgctgggagatctggctagctatatgcagaaaattgaaactggaccccttccttacagcttatacaaaattaaccaaggtgtattaaagacttaaatgtaaaacccaaaactataaaaaccctaggagaaaatctaggcagtaccattcaggacatagtcacgggcaaagattttatgacagaaatgccaaaagcaattgcaacaagcaaaaattgacaaatgggatctaattaaactaaagagtttctgcacagcaaaagaaactattgacaaagtgaacagacaacctacagaatgagagaaaatgtttgcaatctgtccatctgacaaaggtgtaatatccagagtctacaagaacttaaacaaatttacaagaaaaaaatacccattaaaaagtgggcaaaggacatgaacagacacgtcttaaaagaaaacatccatgcagccaacaaacttatgaaaaaatgctcaccatcactggtcattagagaaatgcaaatcggaaaccacaatgagataccatctcacacccatcagaatggccattattaaaaagtcaaaaaacaacagatgctggccaggttgcggagaaagaggaatgcttttacactgttggtgggagtataaattaattcaaccattgtgaaagacattaaggatgacaattaaggacctagatgcaggaataccatttgacccagcaatctcattactgggtacatacccaaaggaatataaatcattctattataaacatatatgcatgtgtatgttcattgctgcactattcactatagcaaagacatggaatcaacctaaatgcccatcagtaatagactggataaagaaaatgtggtacatatataccacagaatagtatacagccataaaaaggaacaagatcatctcctttgcagggacatggatagagctggaatccattatcctcatcaaactaatgcaggaacagaaaatcaaacactacatgttctgacttataagtgacagctgaatgatgagaatacatggacacatggtgggagggaacagcacacactgaaaccttctggaggagggggtagggggagtgagagcatcaggaagaatagctaatggacgctgggtttaatagctgggtgatggaatgatctgtgcagcaaaccaccatggcatgtgtttacctatataacatatctgcacatcctgcaaatgtaccccagaatttaaaataaaatttgaaggaaaaaaaaaaagtctagcagcctcaagtgctttggtgatctgtaaagtactattatacttaaaaatattttgtatcttactacccatggttttattattttataattaaccgtgagtcgcaatataatatctcctggcctgtatacttgtgaaagttgtttttaaggaatctgggtaagtactaccactaacaataatgtagtagtagtgtttctttctttcttttttttttttttttttgagagacggagtcgctttgtcacccaggctggagcacagcagcgtgatctcggctcactgcaacctccacctcctgggttcaagcgattctcctgcctcagcttcccaagtagctgggactacaggcatgctcaaccacgcccatctaattttgtatttttagtagagatggggttccactagatgttggccacgctggtcaaaaactcctgacctcaagtgagccactcatctcggcctcccaaagtgctgggattacaaacatgagccacagcacccagccagtagtagtatatattttagagcctttgctgtttcaaattattataaaaattattgatatgtcttctaacatttttctgacagactttgattacggttgattactagtgaggcagagcaaatgttcttatttttcaactgtgtgtgtgtgtgtgtgtgtgtgtgtgtgtgtgtaaagatgttcctgttaacaaagatccttccccccactttacttattttttgataaacagaaaatgacttttatttcataggtcttttggcctgtttattggccatagaattattatacctactaaatgtttgatggacatcggtaaatcctctcataccacttatcacagtatctagcatgtagtagagattcagtacgtaggttgaatttgtaagtggaaatgcattgatccatttagagcttagatgaagcaataattcatccattatatgaatctgtatacccttgttatcaagagggtcctttggttgataaatacgtgttagtgtggttcatgagaagaagtttttatgtataaattatatgtgctgtggtgcccagttaacaccatagacatttatttagtacgagctgtgcctaaagcactgaggtagagagacacaaagattagtgatatgacccctgagagtttctgaaagccctggaaaggggacaaaagggcattcaagtgttacataactagatggttatatggcagggttcttgactgaggatacaaaggaaactttccctccaaagatgggagggaggttagggataggaaattacttaacgggtacaatgtatactatttgggtgattattacactaaaagcccaggcttcattactacacaatgtattcatgcagcaaaattgcacttacactgcctaaatttatataaataaaaaaaatgaatgcatagacctatttctccccatttttcctggaagtttacatatcactttcttttgccaactccccattgttcaaatgtggaaaacaatgaggtgcctttgaccctgtcttctcactgtcctctgttccttttcaaccctagatggaaaggaagaccctactattagaaacacatctcagtaataggcagagagtgggatttttattctgggacatattgttttgtggctgccatgttgaaaagtagcagttaaatatgatgccttaggaggtttgttcctgtatttgacaacctattagggaattagaaaggggatgggatgtttcaaaataaattcctgtatttagaagtttttaaaagcagctgcagggatttcattttcagatgaggaatcattttcatttaagcccatcagctaaaatgagtgcttagtgaatagaaagcctgtaacataaggcctcgagggcattacccccactccactgaactctgagattaagattctgtattccccttcaaccactttcttcatatacccaagagaaggaatcatttaaaatgcatcggtcacctttttaaaagcgtattgactttagaaataatttggcatttgctgtttgtagatgggaatacaaattgaaatcaagtgctatgttctacattgaggattgctatgttccattgctgtgtttctgacccattggtttttacctagggtttttaactggttttccagcttcctcaccaggcagggatctaggcttctcctctatgccttcgactggtaaaatcagagagagagcctccatcagggccccttgccaatcttccaggtatctacagttgcttagagatctgagactctctctttcctcacagggaaaggctattccaaccccagggactgctggccagtcacttcccactcctctctccttaaaagcaaggtcctcaaataacaactactcatgctgcactcatttccttacctttgaaaggacatgaggatcagatgaaaaaagcttctgaaaggtggctctcccggctgtctgaggaagtggaagtatgaagatggatctaagaatttactcgaactccttttaacttcactgtggatggtggtagtgttacttatacgcagtgctggcacttggcttctgtgtcaatcatttttctgttggtttgaggattctctccatgcacagagtctaatagatatccaaaggcagtgcattacaaaccagagtcactcctaaaagaagctttactgtaaaaagaccattttcttaaaatgagttgtagcaatataatgttgctcaaaaagaaaactttttcactccatgagaaagattcactatcagttaccaaacctgatgttttctttgctaaagtgaaaaatataaatacaaacttgggcccatagtttagtgtaattctaaagctcatccttattgtaaatctaatgattgagagaactttaacattcattatctctaactttctgatgttccagaaaactgcagtcctatgaggttagctaatcacttcaacctgacttggttagtgcaaagtcaagtacgtagaacccggttatcaatctcagctcattgttttgtcttccgcactacactgcctttcttaaaaagttatcttcctccacctagcaccccagtaacctgtggctctctttgtgaaatatcctttttccatcacttaaaagaattaaatggaacaacttcttatagtaagtaatccaaaagcccaagtgaaagctgtgggtcatcagatcccatagtgtgagcaaggaagaagacagaatctgcccttgctggccctttatcagctcccaggatttgttgaagactttcatcaagaaagcaagtgactagattaagtatccatgcctttcatcagctgctgtaggtcttggcagtgttactgcagtgctttcacccttctcatttgtcccatccatttgaaatacagtgtacttaaatttccaacaaaatcataacgtagactccgtcagttaattaaagtatactaacaagcatacaaattgctaagtcattctgggaggctatcagtgctggatgtacttatacattcagcactggaaacatgcccttccagtagtgcacagccagaaataccaagcaggcttgcaaaggacaagattaaccttggcctcatggtattttgtctttctgcagggaaaggaagatcatggagacaacaattgcaatacacggtggagaactcaacaccccttgattaaaaaaaaaaaatagttgaataaaaaagaagtttcctgaaggagtaagatagaatttaccacagaaagaaagtggtagtatctccctatttcaatttaagtgttgttcccaggcaggtacaagtacttctaaaaaggcatagattaaagaaaaatggtatttggagtcatggttactaaatgaagctacagctcaccatgatccttgggatgaagactatgacccccagcaaagttacaaaggattctgctctggaatttatcaactgctttgtttgttctcttaacaggtaaaaaatgcagctgccaatgtactcagggaaacatggctaatttacaaaaatacaaagctagtgaaaaagatagatcatgcaaaagtaagaaaacatcaacgaaaattcctgcaagctattcatcagtaagtatcatttttcatttttatcctgttgttgtgtccttggctttcaatttttgcacttgtttattcttgtttcataaggaaggaaaaaagaaaacattgtcatgtttattcccagaagatgttatctggcaatctaatcattccacaataagatcctgagaataacctcagttcctttaatgattaaaaatcacttattagtactagaatatttattaaaatatcttctcagtttctttttagaataacttctgctgaaattgtatttcttaatttgacctatttattcagatagtttgctctaggattttttcagctttattttctaaacatagcttcaaacatatttatatgaaagtagtgcatataactgatttagtacttgaattttaagttagtttttaatcagaattttggctgtgttcattttaaattttccagtttgtgtagaccttttactctcttatcattattttaactttatccagaccactattatggtttaagtccttcgttctgttccattgttatataattagcatacgcttttaaagtaacaatctatatctagtaagatgcactgataatttgaaagcacaggatctttctcctccgggctggcataatccttactgtaagtattattcatgtgggtatcgattgtgatgccatgcagacttgctcttaattctatatggagaagagcagatatggtcacatctgtggctcagaaaagtagctttccttatgaaacctacgagggtagtaatggaaaggtgggtaaatacaagatgctttggctatccaatgagatttgtctctcagagccaactagtataacaggcaagaaaactcagaggctgcaatttttattttgcatgttcaggtaattcatatgtaatatggtaccactaacattctataggaaattactaagcattcatcttctaccctagaatacaaaacctgtccattgaactgccctgcttaaatagatatcactgaaaatgtagaatatgtaattctggacagattcatacttccatagaaattaaaactcaagtatcctgagatttatagtagaggcaggctctgcacgtatggtagagtatctggccttcattgctactcatggtctttccccagctttactaacacactttcctaagatagtgatgctatttcctctgtagctcagtgacttgacacaccactatgctttttctccctttgtaaggaaaacacaaggttagagttttcaaataatactcttaaaataaggaaaaacacagaaaggaacattatattccatctggctcacaagagggaacttgctccctagacttacagttacccttataacccagaaccaccatccaggagcccttgcctagaaatcttgattccttgaagtttagattgaagagaatgagaaccctccctttctcccaacccagagatgctgagctttcgcctctgtgttccttaacctattttcctgtggaacaggcatcttcctcaaggcactcacctcacacaactctcctattagagtggtcttcccctgctaaaaccatactacacagtaaccccaacacattcatacaggaggtccagaggccataccatgcatggcaaaatcattttttctacctttaatattttggtattaacctatatttagtatgttaaaaagaaaccttaccttggtgcatgtgagaaggtatgtatgtccagggtggaagggtatgagatgacacggcagtgagcaagtgtggtcggtctgtgttgagcagccacacatcccattgcctccaggatcttatctgggtcctttcctgtcagtcagacctatcaaatgggtaattacatgtgatttacctttaatcaattttcatataataacaaatccaagaaaatgctgtgatagtttttatagtacggttctgtagccatgtgcagtggggatttgtattacatcttgtaatataagactcttctggactattatgttcagaatacattcacattcaaaagcctgggggagaatttaggggtttttaccgtaaaatgctttcaactttgccgttaggttattacgtttttacattaaaacattagaaaaaaagtatttggggaagtttaaaaactgtccctaagcaagttgcaaatgcaccctacaaggcatgtcggccctttcttaagggtgggtactgtggagtcgcttgcacggggtctcttagcatattgtgtttggatagagtgacagaggaagctacttgtgatttttctgcttctgtcagacatttcttattctgtttcttctgtagcaatgtgtacttctaaagtagataagcttcaggcaactcagaaatgctctgaattgctttataaattcatctaggggttaccgggtttccattacagtgggggacatttatacttctaaaagtgtaactgagtacgtttattcatgcaagctttgtttggctagatcattctaatcatgcatacttacctttcattttagcttagtgttggaagttagggagtgaagtcataggggaagcacacagggctcgattcctaagggcaaggcttccattgcccactgtgcagatccagtgagaccctcggccttatctgtcggcactgggtacaatcagaccttactagctgaagaaaaatgttaaaattcattcgatagatcactcctggcctctcctactctctgatttatcctgagcactttttcagcagctctctgcttctaccagtccatgctatctcaactctgtttctcttttccaaacttcatagcctctctactctgttggatgctgaactgtccaggcctgtgccctcttttcagtaattgtctttttagattgtcacttagtgtcgtgaagtgttctctttctctaacttttaacgctttttctggtagcaactttacctttaaagtttatcattcttttatctcaactatggaccaacatgaatttgtttcagaaccaagaaatccaatctacttgatttgtatatcatgagagttggattacctgcctttcagaaaccccaggcttctgagttgtcctaatttggaaaagatgtacccccccaaaaaaattacaatgcctttgtttcaaatattgttcttttaaccatatcacattcatattaggcaaaaatatttcttgttgtttacttgaacatcaaatatcaagaggccatgatgactttatgcatgctcttccttctgaactcttattcaggaggaagctgagtgcttacagatgggaaagtatagtagcaatgaagaaggataattggatagtgtttctctttggccaatatttcaaaatcctgcagaaccataacaggatcttccagctaatgaatcgagccccttgtgcacaactgaacaccacattgtgttattttgttccagaatattttacagtttcttttcttttgttttgtctttttatttcaacaaaatgaaaatagagctcggaagtaagttgtgtgagccgctcctttcaacatttgcagaattttctactggctgcatgcacccagcagatcctttatttgtgaattttagtagtctgattgctgctatggaaatgtgatccaaaatcatgatattttcctgtgataagtgaagttcacaaggaagaaatcaacatatgtttctttttcttttttggggggaaaagtgtaatacacatctgcatgttaccttttattctggcagctgcagcttaagcaggctttttctatcagctctcctacattacaggcagtataagaaacaaacaacaagacaagatgattcaagttccgatagctaaaggagttccaatcaaataaggctactgtatgtcagctttccagattagtagaaaataaaatgggcaaaattctactgtcagacatagtatagtaatccaagagaagtaaattaggccccgttgtttataagatgaagtacccacttaagctaagaaactgccactggcccttctagcctgacttacagaattcaggactttctctgtactcattacttgctggaggcatctggtccagagcccaaacttcagtcatttctgtgccactaatactataacttacttaaatttgaacatgaaactttatacaaattcctttatacaaatgttaatccatttttatacaaatggattaaaaaatattacgaagaaaggtaaaggtaatcgtcaattgatagttgaaacaccgatattgaattctagccataggctgttgcctgcagaaagctctgagctgagattctgctttttcttttttttttttttttaaaaaaagaaaaaaaaaaaaaaagcaggtgttaggagataaagacagagtaggaccagactatgatgtttttcttgcagtaatgaagaattagaagagaactaaaaggattaactgttttccatcttaagtatcacttaaaggcatctagaatacctctgttggtatgaatccagcagtgcagaaacatttctctaatctaacacacttcatttcatatgtgaggaaactaaaggtccagttagagtaaggatggaatccactgttgtacactgctctttctttagtacacttctgcgtaatgacccacggatgtctaagtgttctttttagggggtgtagggtgggggcagttgcctgtttttcaaaggcacacatcaaaaattgtaaccctattaattactgagagaaatctttctcaacaatatattggatctaaatacatgcttgtaaattttagactaggacatattccatctctgtaatagcataaaaaggagccaattaacttcgttccagcattctaataaatacatagtcacaatgagaagttataaccttaaactgttgtagattgttaaagatcgtgttgtaggtatgtgtcagctaaacttactggcagaaggcactacatcttcactgtagagcagatttggtgacatattggatatcctagtttcggaacaaaatcactgaacattatgaacgtattacaaaatctccctggcagtaaaatcttgccctgtgagtttttattccttctacataattacctttcatttcaattgaaaaataataaaaaattctctctctagcattaaaactatactttgtaaaatgacttgtcatcaaagcaaaataagattggcatgactttttgtttgttttcattaaatagtttagaagaacctacttctcttttgggaaaaagcttttaattgttagcttaaggaacaataaaccacacttctcttattggaaaatctttcttggtacatagtaaacactgaataaatatttgttgaaaaataatatagtaaataaagttaaagaatagcagagttcttacctacaagtgtttttttaataccgttttttgactcttaattgactcttcatcaggtatatacaatgatatttaacagtagctaaacataatcttacaagtagagattccatctgccagatactataattgtcctctgacttttatctacactgaaaatgggaatttttcctaggaaatggtctggcctccctacaaatttaatggcagttcaagataaaagttaaatgaaatacaatgaagaataagataataattatgtgttttgtgttatattgctgctggttgaataaaagtttttttttttgttaataagaatctcacttatcactgtgttttcatcaggttcaaatacctaacccaatccatttcggactaaacagggctaatacctgtatctagtcatgtaggcataggaaggtgctcattgctccaacatcaatgaaattccagttgctttgcatatttcttcctatgtctatgtgtcatgatactggggctttaaggaatgttttggctttttctcatatggttaaatccttatgagtctttctgaattcaactttacctggtaaatagttgtcctaaggacatctcatctcttgctctcactctctcctttcttttttgcggtgttggggaagcatgcttctcattgtaccagacacataaccagtttggacttaccccaaatgttcaaggcattatccatgcagttatttgctcttgtcaattttgtgcatgctctttggaaggcataagattgccataggaagaagggaacctttctgataccagattctatcttttagattaagaagtgtaaaaatggagcagaggaaactgaatgaccaagcaaacactttggtggacttggcaaaggtaagcctgaggtgcttagccctcctagttgcatctgttgaaatcaaccacttcacagtcactaatcatgaatgtttcaagaggatcccaacccaaatctaattaataaatcaaaccagcaaagcaccctaaaatgatggtccaacttaaaagaatgtttctgtaactctcatttaatgtactctttccctattacgttattcagccccattctgaaaacattcctagttacagtgatttggaagtaccataagaagcttaagtggaataggagacaatacatgcgggatttttatttgcatgtaaatctcatctcaatgagagcagaactgcatcctaggtgtgactgtgatattcaggaatgaataggactcatcaattaaattttgtcctatgtattttaagcaaactcaaaagaatgtaaagttgaaataaaaataaaagataccagaaattacatcctagaatgaaagttatcaccctaaagtgatcacttttttatggttctttctccatttcattatttcaaaatcataccactttttaaaaagtacattaacagtctccaaattattctaccttatttataatatttatctgatcaatgtttagttgtttctccccacataaaacccattcttaaaacataaatatttgtcaataatcaaaacattgcattttcctgggtgaattctaaaggtggtattagaatagcatttatataattgttcagccttttacccaaatgctttgaaagaggcaactctcagttgcatcttacaaactgttttttttttgtttgataaatcagacatgactttgctaaagcctcaagtataatccataaaaattacaagtatttgtcctagtctcattaaataatgcatctaaattacattcattttaatgtatagcagtaacacatactagatgttgaagacagtaagtatttaatgacttaccctaggagagcatatatcatgcatataaactggacagcacacatataaaaagtatgaggacatcctcgattaacgtgtataaatgtggctgttacttggacatatgaaaaaaagatagggcaagctccatcactcctaggttaaatgatttttaatgggtatttttatgaaaaaatgaacagaccacattgaaatatgatgtggagatgtaattttacttcaagagtaccactgtgaggcaagatgctgtttctttattaatgtacttattatgaccacgggactgtacataccataaaggctcagtattttcttaaatgaatggatgctgttcacatattctcaagactatgtagtaaaattaagtgtatgcactctgtctctggtcaaactgaaacaaggtgcgctatattctgaataataactcccttatcagttcatttaccatctttaaaagattgttaagcagaagaagagcatatgatagaagggaaatgcagtaggagggacggcttaaataaagggatctcagacttgggaaagtctgcactaaactaagattaaaaccttttcctccctctttgccagccttttccctgtctagctctgagctgatcagtcctctctctttgtctcttggctactcaggaaatatacctagaaatcagagttatggataccctgtgatcaagacaatcaatttcaaggttcactaggaatccagaaacattttcctgttttaaccacttagctttgattaagccatagccaggaggtcagagccatggccaacaaggtagactggtaacttcagtatctcccttaactaatattctctcaatgggttatctgtaaaaattccatttgacccaatggagagaggcctgtaatttggaacaaaggataacaaacaatctttaggaatttattgctttaaattacaaaattatcaaaccagttaatcctaaacttcatttatattctaccctcaacatttctgctacatcccaatgccatctgtattattatttatccctctgtattatttattgttctttgcctctgcccattttttaaaaattacccttgccctaattaacaaacatgttgcaaaatgaatttgatgtactaacctttgtgacaacctttaaaatacatatataaatattcaattgaaatgtttttgtctatcctgataccacctaaaatcaatgggcatgccaccagtagcagtacctgctccacattttctgcaactgaaccaaagatcttatatttcgattataaatcctggcattgaacacatacaatgagttggctttgcaagatgagctgttcagttagctgacacccctgttacactgaatgccaccagcaagagaccagagctaaacctctgagaggtggacagtttgtgttcagggcaagtataattaaccttcttctcaatcctgtttttcagacccagaacatcatgtatgatatgatttctgacttaaacgaaaggagtgaagacttcgagaagaggattgttaccctggaaacaaaactagagactttgattggtagcatccacgccctccctgggctcataagccagaccatcaggcagcagcagagagatttcattgaggctcagatggagagctacgacaagcacgtcacttacaatgctgagcggtcccggtcctcgtccaggaggcggcggtcctcttccacagcaccaccaacttcatcagagagtagctagaagagaataagttaaccacaaaataagactttttgccatcatatggtcaatattttagcttttattgtaaagcccctatggttctaatcagcgttatccgggttctgatgtcagaatcctgggaacctgaacactaagttttaggccaaaatgagtgaaaactctttttttttctttcagatgcacagggaatgcacctattattgctatatagattgttcctcctgtaatttcactaactttttattcatgcacttcaaacaaactttactactacattatatgatatataataaaaaaagttaatttctgcacatactcgtttggtcacttgacatttctaaagcttcacttctcatattattttcaaggtaaaatagcgggttatcatctgatgcacactgataattttgatagccaaaagtttggctggttggaaaaaaagactttcaattcctctataccctactcctaagatttttctcttgttatgaattatttgcatcaatcatttgaaccagcatagcttattatttttttgtttgcagtgtctcatttttaattcaatttttttcaaaatgtagaaagtcttttatcagaacatatacaaataaggaggagagatgctttcaagaattttttaattcccagtttacaccactgggtacacccagtggtacaccactgtctgtaaacagatggtgcagaattttagttctaaactagttatttcatatctttccctttatttattatgaaaggccaagcatgcactttttgaatgtttggggcccacctgtgtatattcatagatacatgttggcatacaacagcatagtgaatatacataagcctaactcctaacatatcctctagtaagtgatctcctcttggtctgtacgtacatatttaacacatgtcaatagcatctagtaaatttcacgtgttttaggacacttgtttcatggatggttaaggtcagtttgtgtgaaagagaactgagtggttattgctacaaacctatctgtttgcaaatttgctctaagaatccactgggtttagaagaaccgtgtgtgagatgatagcaatacggaatttcctcatgtggtgttattcccaagagtgtacaagaaagcttatggtggtagggataatgcgtcttaaaaataaggcttcgtttggacagctctgaaagcaatctgcttgtatcagcctaaacctaaaaatactccattttcagggcaatctgtttcagaagcttttgtccccccgccctccacttcatttgataccataccctttggtgtcagccttacaacattgcaagttgctagtataatatgtttttccttctttagcacaaactggagtgatatatttgatccaccctacatagtccaatggataaaataacattcataacattcttcataattaattaaaaaaccaaacagttcctttcaatatcaaggatataaaactgattgctttagattgcatgagaaccacttgccatttactatctatccaaaatggctgaaactgaagcccattcatgtggcttatatatgcctgtgttggatagaatgaggcctggaatttttatttatttatttattttttttgataataagtggaagaaaaacagaacactggttatagaaacatactgccaggttaaatgaacatcaagatcctactttatcaagatttctacttcatggatgaaattaaaatctcattttatgtattttgggttacatgcaagaatatatcaagcatttgttataaacactggatgtaaggagaaattttggaaaaaaatattaatttgttcttacaatttatgtagttaattcttgtatcttctacctttgttgtgactaaaaggcagagtagcagctgaagtttatcatcttacagatcaatgaacactatcaccccagaacactaggggactagggaaaaaataatgtattgcttctctgtcaaagatgagagaagacaaagattttaatttatatttctttgccttgcatttattctcttctttttaactgtagctcttctagaataagttactctgttatccttcaaaatcaattttacatttcctattctatgcagagtatatgaaaactggtaaatattaaatcttttatttctattttttaaatgctaaataaccacagttttaaaaggaggaggggacccctcggttacatagacattctggcctgtgacttgctgaatcaaccccactttaggcagagctaccaagtctcctcccaaatggctttgaacattaggcag

SEQ ID NO: 15967 - DNA, 10610 bp, Human
gctgcttcaccttgcacttttatgttatatgttatggagatggattctttcttaaacctcctgaaccaccctctactagcttcccacttctgaagcttcctcacctttctcagccttcacagaattgaagggagttagggccttgctcggattaggctttgggttaaaggaatgttgtgactggtttgagcttctatccaaacccctaaaactttctccatatcagcaataaggttgttttgctttctgatcatttgtgtgtttattgaagtaatttccttttaattccttcaagaattttgtctttgtatttacaacttggctgttaggtgccaagaggcctagctttcagcctatcttggcttacatatgccttcctcactaagcttaatcatttccatcttttgacatgtgagacgtgtgactcttcctttcacttgaatacttagaggccattgtagggttactaactggcctaatttcaacattgttgtgtttcagggaatagggactccagaagagggagagagatgggaaatggccagttggtcgaacagttaaaacatacacaacatttatccattaagttccccatcttatctgggcatggttcatggtgccccaaaacattattattatttgagacggagtcttgcactgtcgccaggctggagtgcagtggtgtgatcttggctcactgcaacctccacctcctgggttcaagagattcccctgcctcccgagtagctgggactaaaggcctgtgccaccatgcctggcttattttttatattttagtagagatggggtttcaccatgttggccaagatggtgtctatctcctgacctcgtgatccacctgcctcggcctcccaaagtgctgggattacaggcgtgagccaccgcacccggccttaaaactattacaatagtaacagcaaacatcactgatcaccgatcaccataacagaaataatgaaaaggtttgaaatattgcaagaattaccaaatgtgacacaaagtatacgctgctggaaaaatggcaccaagcaacttctttcaggcggatttgccaaaaaccttccatttgtaaaaaggcagtatctactcgcagcagcaagtgaagtgcaataatgaagtatgcctgtagtgatggcacatggtatccttcagaagttttaaaaggtgaatagttttgtttcgtttttcctagacggagtcttgctctgttacgcaggctggagtgcagtggtgtgatctcagctcactgcaacctccacctcctgggttcaagtgattctcctgtctcagcctccgagtagctgggattacaggcgtgtgccaccacactcggctaatttttgtatttttagtacagacggggtttcagcatgttggccaggctgctctccaactcctgacctcatgatccacctgcctcagtctcccaaagtgctgggatacaggcgtgagccaccgcacccggcctaaaaggtgaatagctaagtttctaacgcagagcacactgaaacacaacgtctataactttgctagttctaccactacaaaaatccattttgccaaactgaaagcaagctctagagcccaggaacggagaaaaattaaacgtaaggagtatttccttccctgtctaacatatatttgcatcctgaaccacacagattcccctcgtggcacagtcttcgccccttaacagagagtagctagtaccacccatactcgctgagaaactggaaacgagggagggtcgaagttaaaccctttttagtggcggtgcatgcgccccacatggtcttcccggcttgggaaaggaatgagaagctttcatgattctctcgcgagaagggaagtcttcatgccacgtcagagactagagatcctggcgccgagcgacaggtgccggaacaaacaggcgatgagaaatcgcggacgcggcaccatttcttgggcaggacttccggcggaaaagcgggctgtctcggaaactcagagccgggttcctcccgggtttctgccgggtttctccctgcggctcctgggttgttgagactcttgtgaagatggcttgcgctgccgcgcggtccccggccgaccaggacaggtgggttctgaggcggtgggtcctccgaaaggaaggggcttgctgtggtgctgcaggtgctacaccgcgcttctccgctccgcggcctccagaatggcctagctgatccaactcgctctgtacgggccccgcgcctctccctggcagctcgtttttctgaatcctgcagcagccaccaggctcttctcagggctcctgaaattccgaccataggtagcctagtgtttatctgtacgcgagacaaggattttgggtgctacgtggacatgatatcaagtaatataatcacagtgtgagaaatgtgttctttttaagtattgttgcgttcagaaaggctcatttgtgaaattttaaggtttttaatacctcggacactttatataagagggcgggcccattctcaggaacttttgacgggctgctctgtctaatgtaacagttacccaagtcgttttgtttctattcctgtggtttttttccatccaaggtagtggataaagtttatttttaaataagttaaagggaggtaatttaaagaaataacattaagcaaataatagcataggtgtaccagcaatgatgacgactaccacggaccgaaagaatgtatttttgaaaatacttgttatctgttgagtgtagttgtccaggttcttggcgttttgaataaggaattgaacaaaacacacaaagcaaggcagcgaaagcagatttattttaaacaaaagtacactccacagggtgggagccggctccagcaagctacccaagagctgttggttacagaattttctagggtttaaataccctctagacgtttcccattgacctgtgccagtctgattggttgagggagggggatcaatcagaatgaggagtaggcccgcggccagtctgattggttgctcgaggggaccactccgaggtactttgatttttcaactgccacgcagaaaaaggggttgaaaagggagtacccatctgatatctaggcagcatgaattggcctttggttccctgccacccgacccttttctcctgcctcttactgctctagtgataccacttatgctattgtctatggcaggtttatttgtatctatcctgcttatttaaataataagaagaccatcgcagagggaaggcgaatccccataagtaaggtaagcaagatggctggcaccttgatcctcgagggaatggggggtgtcatcctggtcgggccacgtaatcttgttagagccgcagggggttctcttcactgcatttatttagggcttgagaacacagccaagaattggggtgcgttcctcagtgttggtgaaaccagaaaggcattaattcatagctgaagggatatttttttaacgtctcttaatgagcctttgtttgtaaaggagtgggggcagagtgtagagttcacatgtttttaaaacaaaggttatgacggtgtttcccttgatataggaaatcaaaattatgacattgtacgatacattaataatgttcagaatgtagttgagatttttttaagtgtgtgaagaagacatgcagaaagttcagccctgttgagttttattaaagtgtcatttgtattttgtaatatgacagatttaagacacctaggtttgatgcagtgaattctcccatgatgagtacatctgggtggtaacaagcactcaaaaaagaaaacactacaagcatccaggaagattgctttatgttccctctcagtcactgtcgcctccgcatatgctcaaaaataccaggatgaccaccgttatgacttcaacaccatagattacttttgctgctttttcagttttctgtaaatggaattacacactatgtaattttgtatctttttttcactgaactttaagcttttgagatttacctacatatttgaatgtagttgaattttcattgctctataacagggtttgtcaatagcagcaccattgccgatttgagctagataattgttgttgggggttgttctgtgcattttaagatgttcagcagtatccctggcctctacccactagatgacaggtcagccccctccagccccccatcccctagttgtgacaatcaaaaatgtctccaagcattgctagatgtcttttgtgtgtgggtaggggtagggaggctgaggacagaatttccctgctcaaaactactgccctgtctcctctatagtatcgcatggtgtgagtatgccaaagtcttttctaccttcttttttgtttgtttttttaagagacagggtctggctctgtcacccaggctggagtgcggcagtgtagtctcagcgcactgcaggctccacctcctggactcaagccatcctccaacctcagccttctgagtagctgggactacaggcacatgccaccatgtccggctactttggtatttttttgtagcaatgagatttctccatgttgtccaggcttgtctcaaactcctgagctgaagtgatctgctgggattacaggtgtgagccaccacacctggccctttctactctggatggaaaattggattatttctattaatagtttgaggctattataaatagatgttttttagagaacatatttttgcttttttgtagaacgcatctgggaatggaattgcagggccatagagaatgcatatattcagctttagtagatactagcagttttctaaagtgtttgtatgtgtaattgtttaagcagtcaataatcattgagcacctactatgttgagagtaccatgctaggtgctggggaatacactggttaacaaaacaaagcccctgccctcagaagtttatgttctgttggaggggagatgggcacacagttacgcattagtgttattcctaggaatttttaaaattacaatagaagcatctgtacttaatgaaaaaggaaacctagggttttggtacttgtttgattatagtatttgaaattatttacccaacactatggcagtgtccacttaaagcacatatatttagtgtttatgtttttaactgttcaggctgttgaaaatcctacagctacagagattcaagatgtatgttcagcagttggacttaacgtatttcttgaggtatgacgtggttcttcactattttccatactcatctaattgatgtaataactttcttaagtcctgtttttcttttgtttcgtttatgttagaaaaataaaatgtactctagagaatggaatcgtgatgtccaatacagaggcagagtccgggtccagctcaaacaggaagatgggagcctctgccttgtacagttcccatcacgtaagcttgtttaaatgaatcagtggggctcagggataggtttctcctacacaacacaaaaaaggttctaaaactgaaaggtaaaagtcagaatttgcattctgaagattaatttaaagacaggactactgctcatggagagaagcagtagttctaatttctttgaggtgaatgacctctttgaaaatgtaatgagacccactaaacatttttcaaaaaaattgttgtgtgaacattttataaacctctggaagtctgtcattgctcccaggttaagaatataaaattattaaatcgttggatgttaattgccatttcagatcctagaggtccttgaggtctgttaatatctataatatctaatgattctatcattaataaatctgaaaagcaatattgactgaaaaaagcaagagatatacatagtgtggtaccacttaggtaaatttaaatacaaaatattactatttattgatagatgcatatgtaatgttgcttattggcatttttttgaaatgctctgtaaggaaacactcattcttaagagagtagtcacctaatggtgagcggggtagagagtagagacacgggttgatggtcatagaagactgttgcatcatctctggtgttttattttatgaaaaacaatagcaaaacgacatcagtataacagaatgttctgaatattaggaagataagtttttgtttgcatgttgtttatttttctgaattttcatctctgaaaattttaattttttaaaacagagctattaattttttctttcagtttaataaccccctcagtttaattaaactgtcattaaatttacttaaaaataatgaaatcgtcagacaaactgacagcttgtttgattttttttttttttgagatggagtctcgctctggctggagtacagtggcgcgatctcagctcactgcaacctccgactccctggttcaagcgattctcctgtctcagcctcccaagtagctgggactacaggcatgtgccatcacacccagctaacttttgtatttttgatagagatggggtttcgccatgttggccagaatggtctcgatctcttgacctcgtgatccacccacctcggcctcccaaagtgctgggattacaggcataagccactgcccccggcctgatttttttaaaatagagagacaagggtctcactgtgttgcccaggctagtctcaaactcaagcaatcttcccatcttggggagatcccaaaatgctgagattacaggcgtttgccaccatgcccagcctgcatgtttgaacttttatttttaaagacaaggtctcactctgtcatcgaggttgagtgcagtggcacgattatggcacactgcagtcttttttctttttttttttttttctgagacagagttttgctcttgttgcccaggctgcagtgcaatggcgtgatcttggctcaccgcaacctccgcctcccgggttcaagtgattctcctgcctcagcctcctgagtagctgggatttcaggcatgagccaccagacccggctaattttgtatttttagtagagatggagtttctccatcttggtcaggctggtctcgaactctcgacctcaggtgatccgcccaccttggcctcccagaatgttgggattataggcgtgagccactgcgcccagccaacacactgcagtcttgacctcttgggctcaagcaaccctcctgcctcagcctcccaagtagctgggaatatcggcacatgattttttattttttctagagatggggttttgctatgtttcctaagccagtctcaaactcgtggacacaagtgatcctcctgcctcagcctcccaaagagctgagattacagacatgacccactgggctcagcctaaaatagattgttttttatatactaaaacccatcaggattggtaggtattgctagatgcttcaggttgtgactaaggagtgacatcatattctgatatgttttttctccttaacattttcctatattatatctcaaaagaccaaaaacaaacaaaaacttgtaattaactagtagataaaataggggtagaagttgtggtgagaacatgtcacttcctatttccagtaagacccaagtaagatagtaaaaagaaagcagagctgaggaacttggtctgttgggggtgaaggtagctggttgtaggtgtgcagagcaggaatgcatgtaagtgtagatcatctgatcttacccatcggatcgcttgtaacttgatgatactgtttttttgttgtaagactgagaaaaccctgtatttcagtgtcttaagatacagtgatattctgactctgtttctacctgaggtatatttggatacatactccttagatcttcaagctgattactaggaccaaaccaaaatttttgtttcatacttagtgttttgccttttgattttattcatttaaatattttcagcattattctcactctcagtacatttcccccgacttgagctagtcagtgtcttcagtcatttgatttttgattttttaaaaaagttattttccattttcttgatgtgatagtttcttacactttgtgatattcaatttgatgactttttatgtcttatttctcagattatacactaagcctaacttctggttcctaggtaagtcagtaatgttgtatgcagcagaaatgatacctaaactaaaaacaaggacacaaaaaacaggaggtgctgaccaaagtcttcaacaaggagagggaagtaaaaaagggaaaggaaagaaaaagaagtaacctagtatcagcatcaagtatgtggtactactgtaagagacatgaatggagacttctaatttgtatcggagggaaacagaagctttttgtttgcatcatttaactgaactgtgaacccttgtgcctctcatctttatcatcggagttgacagtgaaacaaatttacatcagaagtttgcatctcgcgtatatgccgtataaaagaatttttttgtctttcaatgcagttttttggaagaaaatatttttaaatggacaatggactgtacaataagttacttgaaataagttgtttcagataaatttcaattagatttaaaataaacattatgtccaccttttaagttaatgaaataaaatttgaaactgacttttgcagcttttgcttatatactaatgctaggagaggagggataattaagaataaaatatgtagtgaaagtttccatagtgtgaggctaaaactagaagaaactgtggtaggtccttttgtgggtgggggacaggggagtctgtaaaaagccagtctgtagatgatattttaatatattattgtaatcgaatcgttcagttgttttttgacatggaaagtcctggattttaagctttaaatttgcttattttgtaggtttaagaacatgattttcatgggagttgtaaaattaactgtgctttagcaccttgaggtacactttccttcaacaaatgaaattggattggtgctccagaatttcagagcggtttctgaaagtagtgattttgagctatcccaattcctgttcttcctgaggcctggtttagctcttccttgaattctgcaagctatctcatattttcagtaaattccattttttttaagtttgtttgtttgtttgtttttgagatggagtttcactcttgttgcctaggctggagtgcaatggcacgatatcggcgtaccacaacctctgcatcccaggttcaagagattcttctgcctcagcctccctaggagctgggattacaggcatgtgccaccacacccggctaattttgtatttttagtagagacagggtttttccatgttggtcaggctggtctcgaactcccgacctcaggtgatctgcccacctcagcctcccaaagtgctgggattacaggcatgagccaccgtgcccggccttctttacatttttattgctcacagtcaaacattcctattgattgtaaaataagcaaacctagagttgtggagatttatatgtatttatttatttgaattgagacagggtcttaaactcccaggctcaagtgatcctcctgcctcaacctcccaaagtgctgggattacaggcatgagctagctggcctgttgactttttttttttaactctaacaatttctgttttatagtgaacataatagtataagacttagtttatatatttgacttacaaataaatcctggggagaggggagtatgtgtaaaacataattcagagcagccttctttgagaaagtgggtgtgtttggctgtgtaacaaaacaataaggggatgtgtttgctgtgtaacaaaacaatgaaggatttaagcaggatatttttgcctcatatgttaaatccaagtgaggttgctgtggtggttggtttagctctcagtgatgccttttttgtatttttacgctctgctgtccatgacatatttctaacacctttatgattattgttcctgcttgtaaaagggctgatatttacatgagtgcaaggcaggaagaaaaggtagctgtgccagccacttctggcaagcagttctcccaccttagcctcccaagtagctgagaccataggcatgagatttctcaaaattcctcccagcaggctttcacttagtttcattgttgagaactgtgacaggtccatctctagctgcaaaggaggctgagaaagtgaacacagcagtcctccttatccttggggaatacattccaagactggatccctgaaacagcagatagtactgaaccctatatatactatgtttttgcctatgtatatatacttgatatggtttggctgctacccaacccaaaatctcatcttgaattataatccccaaatccctatgtgttaagggtgggaccaggtggagataattggatcatgggggcaatttcccctgtgctgttcttgagataatgagtgactctcaggagatctgttggttttataagtgcctggcgtttcccctgcttgcagtcactccatcttgctgccctgtgaaggtgcctgcttctccttgccttctgccatgattgtaagtttcctgaggccttcccagcaatgcggaactgtgagtcagttaaacctgtttcctttataattaatcagtt

SEQ ID NO: 15968 - DNA, 17607 bp, Human
  misc_feature (1)...(17607): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggcggatcacaaggtcaggagtttaagaccagcctgaccaaaatggtgaaaccccgtctctactaaagataaaaaattagctgggtgtggtggcggacgcctgtagtcccagctactggggaggctgaggcaggagaataatttgaaccctggaggcggaggttgcagtgagccaagatctcgccaccgcattccagcttgtgtgacaggatgagactccatctcaaaaaaaaaagaaagaaatgttttgagacttgatttttttcagtgaactatgtgctttagagatctttccatgtcagtagctatagatctgattcttttcaactccatcgaatataaacatttaaatttcctattttcaaacttaaagtgatgtgtcttgcctttacatcactgcacatacaattttgtttcatacatgaatatttaagtttttggaagcaatattttgggttaaaaggtgagtacctgaatttaaaacaaaatatttctcatttcagcccaaaggtgcagacagaaagcaaaaaacggatagggaaaaaatggagaaacgaacacctcatgaaaaggagaaatatcagccttcctatgagacaaccatactcacagaggtaaaaagatttcttttggtgacaatttcagttcataatttttaatcttaaaaattcatcacttccaaactggtcagaatttacttctcctaagccttgagggacacagtatcacatggattctgtgtccagcggccttaacaggaagattgctttagaatttggcacgaaccatgccactgtctctgtgtccaagttatctttccccaaattactctggtttggtttggtttgctgcaggagctattgtggtgttctttgctttgtatacataagcacatctcttgcccaaatagaattcagtttcatcttgggcataaaccaccttcaattttaggaagagctgtgtgctgcctttggttctggaacccacttataaccaacaaaaatggcctgggaccgtagttttctagacttatttctttttagaagtcctattctcagcaggcctccccacaggctccaagatggcggaaagagaagcagtgttctctattgcttatgggagtctctgaggaattaagatttactaatcaagatgtgctattcaagtaacaatgttttagtcaaatcctggggtcatatgtgctcgttcattatctaacttatcctttgtttttagtgttctccatggcccgagatcacgtatgtcaataactccccatcacctggcttcaacagttcccatagcagtttttctcttggggaagggtaagtctgggaaataaaattggcttatatttgtccaaaatatatattctttcattacctgttcataaacaagatcttttttaaatcaataagtatatctatttggtcgttctttgatggatttatatattaactgagatttggagtagcttcaaaagagatcgaaagagttttatatagccctttcttctctttgtgttctcccctctccctcctcctcgtcttttttccccccactagaaagtagcatttatggtcaatttttagtggttcagggactgatgatctgggctttttgcctctccctattactgcacatcttgtggttatttcatttcctgatcatacttgcaccagacagtggtctttgggaactggaaacaattgtacaaacactaaaatttgttttgttacttgttaggaatacttctaacacctaattattatgaatctttgataattggggaaataagtttgaagatgatggctaaaatgaagttttggaattatttatgggatacatttaatcttgccttattatcttttaccataagagataattgaaagttggtacagatgcctactccaattttaaaaagtagctgtattatagtccaagcatttaacatgtatttcacatagccatattgaaacttgaaatagttaggctaccaaatgtgcgagtatattgtttggttgcaatgtttgtggttttggatttatttaggctctatgtctgacctactttttaaaggatttaattaaggtagcttaaatatttaaaacgtaacaattaagaataaaagtaggtattagttgtagagggaatacatataagtagggccctaagataagttaattactaagttcgaataccaaatttgaattttgcagctaaggctaaaaaaggaaaaagatctttttttaaaagaaaaaaaaatcttaacatccacatagatgatacattctacttataggtaattccaaatatgatatagggtttaagagctgtgtttaaaaatttttctcttctctttgtcgtgtacttcatactagttaaactttttcttccataaaagtaggcattagggaagagggacaattcatagacaaagaacgtataaagaaaaacaggctgggcgcggtggctcacacctgcaatcccagcactttgggaagccaaggtgggcagattacgatgtcaggagttcgagaccagcctggccaacatggtgaaaccccgtctctactaaaaataaaaaaattagccaggtgtggcggcgggcgcctgtaatcccagctacttgggaggctgaggcaggagaatcgcttgaaaccagagggcagaggttgcagtgagctgacatcatgccactgcgctccagcctgggcaaacgagtgaaactccgtctcaaaaaaaaaaagaaaaagaaaaactggagtgtggagataacccttggatcataaattaggcagcactaatttttggggctactttaaaaataattttttttgccgggcgcggtggctcacgcctgtaatcccagcactttgggaggcggaggcgggcggatcacaaggtcaggagatcgagaccatcctggctaacacagtgaaaccctgtctctactaaaaatataaaaaaattagccgggtgtagtggcaggcgcctgtagtcccagctactcggtaggctgaggcaggagaatggcatgaacccgggaggcagaggttgcagtgagccgagatcatgccactgcactccggcctgggcaagagagcgagactccgtctcaaaaaaaaaaaaaaaattgttttttattttaaatctgtgtgatgatattgcattgcataaattttcttccaatatttttcttgtatatgtgtgcatatttatgtatttcctacagtagtaatgtattgataaaattttttatcctgatatttttcattttatttttaaatttttttcttgataattattctttcataatttttcatcttagtaaatttatggttaaatatttttatgccataatttatctcatcagtcccaatttattgaaatgttgatattttcttcagtttcctcaataataagaaaatattgctaatgacatagtttctccccctcctcataaagtctttaggttaaactaatagaaaattaaagtattgggtcaaagaataagaatgtgttatgagagagcacagatttttttttaatctctagcatgagatttattgtgaagctgaggaatgaaataatgagccccagcatgtgtcatggactcatcctttcattttaaatgtttctttagaaatggttcaccaaaccaccagccagagccaccccctccagtcacagatgtaagtctaaagttgaatgtcagttacttgcaatgtctggtaatactttgatgactgtccaattcagtagaaatgcccaacttttagggagtattattcattcattcattaaacaaacatttattgaattttgactatgaaccagatactgtgctagggactaaagatatgaaacaagtaatgcaggacctttccatttgagcagcttatagtctagtggggaagaaaaggatggaactccttgagcatcttgcatggttggagaaagagaaaacaactttcacaaactaggcctgagtatggggttgtgtggggtgtttggctatgtgttacctaatggggtaacagacaaatctatttggttatctaaaaaacgtgctctccctttcagaacctcttaccaacaaccacacctcaggaagctcagcagtggttgcatcgaaatcgtttttctacattcacaaggcttttcacaaacttctcaggttaaattttctttttcttttgttttccctagcatgaaattttcctttgcattctagggcctcctggtatccatgggagagttgtgtgtgtatatgtgtatgagagatcttactgcatttttctgatgaaatgaatttcatagaacccttaagactttctcactagctgcagctgtgctgtgaaatacttaaaaacaaacactttttagtttaaattcaatttaatttaaaaatgcttatttcatacaacgctttttaaaatgtatatttcgtagagttttatcaagggggcatttgcaggtagtctgaaattttccccttgatatcactataatttatttcatttacacaatacacttttatttagctttttttttctttttctttgagatggaatctcactctgtcacccaggctggagtgcagttgcatgatctcggctcactgcaccctccgtctcccaggttcaagtgattctcctgccttagcctcctgattagctgggattataggcacctaccatcacacccagctaatttatgtatttttagtagagacagggtttcaccatattggccaggctggtctcgaactcctgacctcaagtgatccacccttcttggcctcccaaagtgctgggattacaggtatgagctgcggcatctggcctatttagcactttttgatgtggtaggaatacacaaatggatgaggcatacttcctgatcaaatagcccattaatcatctggtatccaaaaaaaaaaaagcaccgaaacaaaacacaactaatcgaatcaaaataaaactctgaaaaaatgataaatagttgtgattttgtagataagtgttctgatagtgacagtaagacgttcatgggaggattggtgttagggaacatgtgtgacacatgaggtgaatccaggatttatttatatatttattttttgagacggagtctcactgtcacccaggctggagtgcagaagcacaatcttagctcactgcaacctctacctcctgggttcaagcgattctcctgcctcagcccccgagtagctgggattacaggcacccaccaccacacccgactaatttttgtatttttaatagagacagggtctcaccatgttggccaggctggtctcgaactcctgacctcaaatgatccaccctcctcgacatcccaaagtgctgggattacaggcgtgagtcactgctcctggcccaggattttttttttaagagatggggtcttgctatgttgcccacgcctaacagtcttgaactcctaacagtcgattggcctcaacaatcctcctacctcagcttctcgagtagctgggactacaggcatgttgtgcccagcttagatagtggaaggttatttcaggcagaaagaacaacttgctcattagacatcatcagtatgatgaaagcatagggttaagtggggaggttaattggggggaattgagacgggagaggagctaggagccaggtcatgaagggccttatatgccatgaagaaaattatggattgtaacattctggtaatgaggtgtccttataatacagcccattttaatagtcattaacaaagagaatctttgcctttatcatccattttcttatatttattccaggggcagatttattgaaattaactagagatgatgtgatccaaatctgtggccctgcagatggaatcagactttttaatgcattaaaaggccggtatgtaattagtgttaaaatatcaataaggttgggattccaaatggatttggattcaggaattcttcacaatactctacacagctaaatacaccttctcaaaacatttgttttaaatgtcagctatgtaccaaataaagattttagaaaaatgttttcttgcactttgtccaaggaattccccatgatattccatttttcatttccaggtgaatgaattttccaatgaaaattcatcatccttttcatgagccaggtactattgtaggctctgggaatattaatatattggtgagcaaaacagggtgcccattgttagggagtttactttctaatggggagtaagataataaatattgtggatagtgataagagctttgaaggaaaacaaaacaaataagcaaaaaacaaggttgtgggctatagggtgcccagaatatggtcaggaagggcctctccaaggaggggatacttaagctgagttctgagaaagatgcagctctggagtcacaggaagggagactgttctaggcagaaggaacaacaggtgcaaaggtcccaagttggttttaactggagaagtggtcattcttaaatgtgggtgggaattacttttttttaatttttttgaaaacagagtctcactctttcgcccagactggagtacagtggagcaatcttggctcactgcaagctccacctcccgggttcacgccattctcctgcctcagcctcccgagtagctgggactacaggcgcctgccaccatgcccagctaattttttgtatttttttagtagagacagggtttcaccgtgttagccaggatggtctcgatctcctgatctcgtgatccacccgccttggcctcccaaagtgctgggattacaggcgtgagccaccgcacccggcaaatgtgggtaggaagtgtctgcctgcaattgttaaaatacatagtaatttgtggtccttttttgggatttacaattttaaataggtagtagtaactgatgaaaaaagcatttaggtcaatggcaacagaactaaatcagtgactacatagtaaaacagagtgtgcagtatttatttttggtttgcttttgttttggggtttttttcttcagacagggtcttgctctgtcacccagcctggagtgcagcaatgcaatcatggctcactgcagcctcgatttcctgggctcaagccatcctcctgcctagatccctgagcagctgggactacaggcacgcaccaccacgcccgcctaattttgtactttttgtagaggcggggttttgccgtgttcccctggctggtctcaaactcctgagctcaagcaatccttctgactcgccttcctaaagtgctgggattacagatgtgagccaccgtgcctggtcatatttgtttttgtctacatcataagggatgttgaatcttggaaaattttaaggaaggaagtgaaatcaggggttgatgacttgtggaaaaataattgatctttcattttttcaagcatattatctaaagggtgtttagaaattggaaggagtaagatgatcagatcaagaggtagttgaatacctttctctaagaagaacagagaaaggacttaggctagttaggagaaggtaatgagagaaataagatgatctagtttactgtgttggcattttttagtaaaaagtatatcttgaacctgacccattagacggtggcttttatattttgactatttctaacttttacaccaaaggccacaaactcaaatgactatagagtacatacaggtaatgtaagtgaatggcagtcaagactggggtatagtgaagaatatatgcatcatgtaagaagaacggctgattgttttcatgtgagaatgcaggcctaagattgctagatctgagtcttcaggaaaagccaaaagttcagaggtttatatgatgtctcatattggaactaattccacttaaggaaaaaaaaaaccctactactggggaactaataaaacatagcaaattaattgcatttggccaatgagcttccaattttcatctgctctatacgattaatgtagaaacacaatttctcccttctttttattgtgcttaccataaagaatgtaagactaattagcctttttcctccccttaggatggtgcgtccaaggttaaccatttatgtttgtcaggaatcactgcagttgagggagcagcaacaacagcagcagcaacagcagcagaagcatgaggatggagactcaaatggtactttcttcggtaggttgttctggacacactaggacagatatgaagaaaggtgaagagataacttatgggcatgtgtgatgggaaactatcaaacagcagatttagtatttgctagaagtaacaataatcactagcatttattaagttcctaatacatggcaggtgccattcttttttttttttttgagacagagtctcactcagttacccaggctgaagtacagtggcacaatcatgactcattgcagccttgaccacctgggctcaagtgattctctcccctcagcctaccgagtagctagaactaaagctactcatttgcctaattgttttatttattgtagagatgggatctccctatgttgcccaggctggtcttgaactcctgggctcaagcgatctccctgcctcagcctcccaaattgctgggactataggtgtaaaccactacacccagccaggtactattcttaacactttttatatgctttaatatttacaactaatatctcctctttgcggaggattttactgttatctccggtatttatgcaagaaaaatcaggcctaggaatgttaaataacttgccctaggtcacacagctgcaagtggttgagccaggatttgaacttaggcagtgtgatttctgagtccttcagaaaagtgggcattcctagtgatcaagttacctgtaagagtggacaaactttgtactgactgctgttgctctctcccttttgcagtttaccatgctatctatctagaagaactaacagctgttgaattgacagaaaaaattgctcagcttttcagcatttccccttgccagatcagccagatttacaagcaggggccaacaggaattcatgtgctcatcagtgatgaggtagatttttcagtacagttgaattaccagatgatgattaatttgtcagcgcatggagcaagagcagttctcctggggcagagtgttctgttttctagatcagagggtttcatacttttttgcttgctttcctcctaattttttttttttttgaaacagtctctctctgttgcccaggccggagtgcagtggcccaatctcaggtcactgcgacctcctcctcctggattcaagtgattctcctgtctcagcttcccaaatagtgggaattacaggcgtgcgccaccacgcctggctaatttttgtatttttagtagagatggggttttgccatgttggccaggttggtctcaaactcctggcctcaagtgatccacccgcctcggcctcccaaagtggtgggattccagatgtgagccactgcgcctggtcctaaaatattttaaaaaccacatattcccatgcacatttttaggttgacttaaaattttttgttaaagtttaaatagttgtaaaagatgtcatttctgggcatatataatgacatttttaagtgaaatggttacatcattattctaattgcatcccatgtaaccttaatacaaaaatgatttaataccaccaccatccattaaaaaaaaatacatgattgtgcttttctttaacagttagaattcttatactattcctctgtttccttgaactcttattttcatttacttcccccggtgaattttatcttactgtaactttttttttttgagacagagtctcactctgtcgcccaggctgttgtgtggtggtgtgatctcggctcactgcaaccccgcctcctaggttcaagcaattctcctgcctcagcctcccaagtagctggtattacaggcacccaccaccatgcctggctaatttttgtatttttagtagaggctgggtttcaccatgtggccagtctggtctcgaactcctggcctcaagtgatcaacccgcctcagcctcccgaagtgctgggattacagatgtgaaccaccacgcctggccatcttaccataacatatttttatgcacaaacatcttttattgattatcctactatatttgtttgaaataaagtttttaaataaaaatttaaaaattattataatggaattatcataattatacaattgattaaaataatgtaaatatgctacatgttttaataagtaattattaaagattaagaaggctgcccaggcgcaatggctcatgcctgtaaacccagcactttgggaggctgagacgggtggatcacaaggtcagaagttcaagaccatcgtgtccaagatggtgaaaccccatctctactaaaaatacaaaaattagctgggcatgatggcaggtgcctataatcccagctacttgggaggctgaggcagagaactgcttgaacccgagaggcagaggttgcggtgagccaagattgcgccaccgcactccagcctaggcgacagagcgagacttcatccaaaaaaagaaaaaaagaaggccaggcacagtggctcacacctgtaatcccagcactttgggaggccgaggcaagcagatcacctgaggtcaggagtttgaccaacatagagaaaccctgtctctactaaaatacaaaattagccgggtgtggtggcacgtgcctataatcccacctactcaggaggctgaggcaggagaatcccttgaacccaggaggcggaggttgcgtgagccgagatgggggcattgcgctccagcctgggcaacaagagcaaaactctgtctcagaaaaaaaaaaaaaaattaagaaaaaattattacaggtatatctatgaatgagttcgatgaaattgtttcgttccctacccgtacccttgcacataattatttcctttgtagctgaatactgcctattgattgctagaatgacacaggatttcagcatcaattccattctgtttttttcctctagatataaatgctgagggacttgattcccataaattgataggaatggatggaattttgtaatgacaatgtcattagattatacttcagaattatataccagaaattacatagtgatattaccaaaaaatcattttgaatcctctgtcttacgacaatttgtgattaggttattctttaattctggtgaaaggaaagagttagaaaccatgtggctcataaaagggtctattgctcagttattagcgttcaccttcgccattccactttgccacctgaagctttcacatcatgggccaccttattaggatcctgggagggtgaaactcatgcctttatcttgggagaagggagtttatccctgggagaagggagtttgagaagggaaagtggggaaggaaaattaaagaggttttaggaaagagcacatatgggagttgaagacacggaagtcagttctcctgtatgcacatatttgtgtccgtgtgctccttggagagtcttggggttaacccagggaaatgcataccaggctttaaaacaactcttccaatctgcttagttttttaatatttaaaaaccaaatgggaggggaggaaaaaacttttatgatcctagatattcaagaaatacattatttgtgacctgtaaagcctcccatataaatccctctggatgtggggtagtccttagggacacaggaatataaaggggttgtttttcatttaaataatcacaaattttcttgcatttttcagatgatacagaactttcaggaagaagcatgttttattctggacacaatgaaaggtaatagtaagacaaacatctttctctaagcagtttaacagctttactactactaggcaaagtacatacttctttgaggagagataggaaaagtaaccatatttgggtaaagaaagtgacaatattagagattgttcctttttttaagttggctttttttttttttttttttttttgaaacagagtctcgatctgttgcccaggctggagtgcagtggcatgatctcggctcactacaaccttcgcttcccaagttcaagtgattctcctccctctgcctcccaagtagctgggattacaggcacgtgccaccatgtctggctaatttttgtatttttagtagagatgggtttcaccttgttggccaggctggtctcgaactcctgacctcaagcgatccacccaccttggcctcccaaagtgctgggattacagacatgagccactgtgcctggcccagctttttgccattctcttccatcttccattacagatgaggaaattgaggcatgttgtttttataatgcattttttttgagacagaatttcgctcttgttgcccaagctggagtccagtggcgtgatctcagctcactgcaacctccacctcccttttctccccttctcacgagaatcttaccatactttttttctcctgctgtgttttagaggtgactaaagatgattctctctctctcttttttttaacagcagaaaccaatgatagctatcatatcatactgaagtaggagtgcggcgtttcgtgcccagtggctgctccttccttcacctctgaaaacggccctcttgaagggggatatgaatggagatttgaaggtctgcaagaacctgactcgtctgactgtgtgtggaggagtccaggccatggaggcagaatcctggccctctgtgttggcccaagctcttgtggtacacacagattactgcccaatatgcagttctgcagctgttttagttaaatttctggaccttgttgttgttaaatatcagtagaaactctacataatttagagtgtatgtagggcataatgatgatgggaattgtgtgatgtttaacaggaagatcttaaattttgtgatatggagccctgtaatttttttcttatataaaaatgggtatctatattcataagactaggtcttcaatctctttgtactggtctcaaatgtactggtatctctgctttttgccacagtttgtccctgaaaactttatcagtgaggagaaatacagaattttccttttggttcccctgtaataccacaactaatagtattttcagctaacatttattgaccaggcagtgtgataaattttttgaatgaccagcttgtttaaccccctaatcacactatctgaagtaggtgctatagtgacccccaaccgaagatgaggaaatggagacacacagtggctaagtagcttgctaggtgccaggagctggcaggcagtgatgctgaaatccaaaccaggcaatctggccctccttattcaccctctcataccaccagtgccacccattataacctgtgttcacttcgcttattactgtggcccttctggtgactacaacataacactgagtatgaactgaggaattaaccactgaaagagacaaagcacacctaaataatgatgaacaaatcaagacctacaagaaatgaacacatagatgctttttaagtgtcattagttatcggaatcaaagaatttgaggtggtgacaactggggattatctgtaactccccaaatttactgttcttgaatgacattctcaaactatttattaatgagttagtctcatccctgctttctgtttcctctctctgcatcttctcttggcataggaagttattttactcatgctatgttttttaatataagctttacaaaaaaagatgcattcccttcctgttcacactcttaccatgtttttgttcttccttaagaatgattgtgtgtgtgtgtgtgtgtgtgtgtaagtgtgtaagtgtaacatcatgggttttctttcttcacttgtaaagttttatctagaaatacttttacaggttatgttgaggtacacaaagataatgttctaagattgtgtattggatttggatttgtgtgtgtgtgtgtgtgtgtgtgtttaaagcatttgataaggtttaaatgttttttatacagagatttttgttcattaaactcaatctgcatcatggtctaatttctcttggtttgaaacaaattgaaaactttgaaaccaaaaaattaagtcaatgacttgtttaaaactgacctgagcaacttgttatattacaccaaaatgcttcttagtgaatgattaccaggtgtctccattttgaggaggagacgtatctggttgtcttatattcctagtactggttctcaacctcagttctttcctcagcaggctgctattggtttggattttttttttttttttttttttttttatgtctaggtgtttgggtaggaaagttggactagatgcctttttctttttttttttttttaatatagaaatgagtctgggcaccgtggcttatgcctgtaatcccaacaatttgggaggctgaggcaagcagatcacttgaggcctggagattaagaccagcctggccaacatggtgaaaccctgtctctactaaaaatacaaaattagctgggcgtggtggcacacacctgtaatcccagctacttgggagtctaagacatgagaattgcttaaacctgggaggtggggttgcaatgagttgagatcaggctgctgcactccaggctgggtgacagagcaagactgtctcaaaaaaattttttttaataaaataaaatatagaaatgaggtctcactgtgttgcctgccaggttggtcttgaactcctgggctcaagtgatcccccgtctcatcttccaaagtgctgggagtacaggtgtgagccaccgtgcctggccaagactaggtgacttttttgttttgagacggagtctcactctgttgcccaggctggagttaaatggcctgatctcagctcacttgcaacctctgcctcccgggttcaagcaattctcctgcctcagcctcctgagtagctgggactacaggcacggaccaccatgccatgctaatttttctatttttagtagagatggggttttactatgttggccaggctggtcttgaactcctgacctcatgatccacccaccttggcctcccaaagtgctgggattacaggtgtgagccaccgcacctggcccaaggctaggtannnnnnnnnnnnnnnnnnnngccaaaatgggaggatcactttaagccaggtcaggagttcaagaccagcctggcaaacaaagtgagacccgcccccccatctatacaaagagttaaaaaaattagccaggtatgacagtgattacttgagcatagggttggaggccacagtgagctgtgatcacgccactgcagtgtagcttaagtgacaaagtaagacccccatctcaaagaacacaacacaagaattatatctccctctgtcacccaggctggagtgcagtgccagttatagctcactgcagcctcaaactcccaggctcaagtgatcctcctgcctcagcctcccaagtagctaggactacaggcacacaccacgaagccctgctaatgtttttttgtagagacaggatcttaccatgttgccaacctagtcttgaactcctggcctcaagcagtcctcctgccttggcctcccaaagtgttgagattacaggcatgagccaccacgcctggcctttattaatatattgactataaattacacttaactatttttacctgaagtcagggttttttagagtagtcttcgaatttatggaaatgaacttatacaactttgaaattatagatccttaaatttaccagaaaatctcttaggctttctttagctacaaaaaatttttattgtgccagtgatgtataattggtaagaattggcatagtgctagaacactgtaattattcagtttgctttaaaacattgcatatgttcactaataatcctttcaattaagtgaaaattttatactagctttttcattatgaaagtaatacacagaatgataaattcaaacaataaagaatggtatcatataactttcccccttacctcttagtcccactctgtagaggtaatcattgcaaagaatttcccccat

SEQ ID NO: 15969 - DNA, 44378 bp, Human
tgaaattccttgctcgtctttagaaagctgtgttgcttagagcacccaaaagtgccctttatctaactgagggaggcgcacttgtcttcatatatagaggcaggagctggcattgggaaagtcaaactagttctgcaccatgaggaagaagcagctgaagacggaggcagctccacactgtgaactaagtaagtagcccagggaagctgcccagctgagcagacctgaaagggtgacaagtacagctctagcaattttattttctagttataatagaagttgccaaaggaaaggttccgatctggaggaacttcatcaaacctttctgaaactccacagatgtactgtagcgagaatctcagaactaatttgtgcattttcttttttctccaggagaaattctgtatgaaaaccaacctgctccaggaagccaagcccccccgccttttttttggtccccgagtttgtttttacttcgcactttatttggatttttctctttgcagttcacgctcctttcctcatttcttggtctctcttactaatgaaattttctcctagctgtttttacgtgaataaagaagctcaattacctttaatgctgtaagcagtgcgaggggtcggggagtgagggtggcgggaggatctaatgtttttggtggctgtaaacgacattgcagaaaattacggtaatttgttaggccatttattccctcttcaccagtttggcagtctcatcttcagagcaaaagatacggtgtgaggctgaaactggcgatagagtgggattgcttttgggtaggtaggatgaagtctggggagaatcgagtcagctgggcgaggaggaaaacaattcactacggaggcttgggaggacacctaaggcggtcaaactggctgcactagctgatgtttctcggttcctcccaggtgtggggtgctcttggtggggcagcagatactatgatgtggctctgggggcgcgaggaaatgttccttccaggtggctatcctttttttttgagacagggttttgctctgccacccaggctggagtgcagtggcacgatcttgtctcaccgcagcctccacctcccaggcccaagtgattctcccacctcagcccccgagtagctgggaccacaggcgggcgccgtgatgcctggctaattttttttttttttagacggagttttcgctcttgtttccaaggctggagtgcaatggcgcgatctcggctcaccgcacctccgcctcccgggttcaagcgattctcttgcctcagcctcccgagtagctgggattacaggcatgcgccaccacgcccggctaattttgtatttttagtaaagacggggtttctccatgttggtcaggctggtctcaaactcccgatctcaggtgattcgcccgcctgggccctccaaagtgctgggagtacaggcgtgagccaccgcgcccggcctttgcttggctaattttaaaattttttgtagagaccgggtctcactatgttgcccaggctggtatcgaactcctggactcaagtgatcctcccgcctcggtctcccaaagtgctgggcattacaagtgtgagcctccgcgcctggcctggctaccctttacaggatagagctatacctcgtagcttgattgtcagtacctaacgtggcgccacggcgaactagggcaggaatcttatctgtccccagactgctagcggactggagctccccagtccaggggctgtgtgggtctggccaacgcaagcagcaactaggcagcatgcagctcccgccgggtgccccaggggccgccgcgtgccccaggggccgccgcatccagactccgcgtgggcggagcctaggtccctggtctgcgggccacgcatcccggccgctgcagggactccagccaatagggatgtgcggctgccgtcctgtcgaccaatcgcggggaggggagggcgttagccagcttggcgctggctcccggaatatggagccctgggcgcgggggcggcgtgtcaggtggttgcggagctggtaaggtgaggggaaggcaaggtcaggggtcacggcattccgctcgctggcagggaggggcgcggggcggctcgagggcctgtgtcgggggtcaggctccggggctaggatgcgacaccggctcgccgtgcggggctgtgaggggaggtgtggccagggagggcctcaggcccagagtccaggactgatggagtcgcgccattcagagaaagacccaaagatgggggcagggagggaacgccggaggtcgcgggggtctcgccccttccccgccgcggcctaggacacatggcccagctcccagctgcaccggatggcgcgcccggcctgtgtcggggtgcgctgacctgcttcgacgcctcgaaagaggccgacgggcacagggcaaggtctttcgtggcctcttcgtcggcgccgcagggggccgggctgctctccggggcctcccgccgccccgcttcaacaaaagactcattataacctaaccgacttcagggagcgccttctgtgtgaatagcctgcatacgcggctcagtaattgtgggtagattggttttaaggctgtttgtgtagctctcagggaccctctggattccaggctccaatgagcagggtttttctacagggggatattgcacatatgtaagtgggctggatggctctcccagctgtgcgtttcatgtgtccccacttttaaagctaccgcttaaatgtgatatctcttgcaaaagcaaaaattatatggaaggagagtttgcaaggggagataggcttctaaaaacttgctggcctcaattttagtgactgttggtgaaaaatggagaagctatgtttacattgacttctggaacccgaagccccaccagttcgcatgatttcttggctttgtaaatctttgagcatgttgtttgcctctttcttcttttgttccacgtacttaaaatggggattgataatatcagtcttacagggttgttggtatgaaattagttaataaacaacaaagtacttagaactcttgatgtggaggagtttttgttgttgttaccttctttccccttaacacttctaaagaattctaaccttattacttattctttgctcagagtctcatgacttatcaccagtgaacccgccggcctatactttccattgacatcattaactttgatctgagggtatagtgtagttatatgtgactagaggatttctgctgcgtgtttgttttattaaatacggttggaaactatcattatactaggtcatttattgtgatacctgtgttgggtaaatgaaacctgaaaccttcggctgtttattttttcattggacagtatttcattgacagtcttgcttggcctactcagtttattttggagccagtactaaaaaggccatgattgcagcatacttggtttctcatgtttccggaatggcagtgggactcgggaggggaatttctgggtagcctggcagcacttcttgttaaggaatggggaagcttcttatgaatctaatcttactctaatgttaggaaatcagcagtggtcccttggattactctacaaagctagtaggcagctttggttcagttatgactcagtgaaggttagagaattatatctacaaagtaggatctttttctttctttctttcgttttttgatacggagtttcgctcttgttgcccaggctggaatgtaatagcgcgatctcggctcactgcaacctctgcctcccgggttcaagcgattctcctgcctcagcctcttgatgcctggcgaattttttttgtatttttagtagtgacggggtttcaccatgttggccaggctggtctggaactcctgacctcaagtgatccacctgtatcggccttccgaagtgctggggtggtgtgagccaccgcgccctgccagatctttcttgtttgactttcattgctaagaatttgggtgagtgttgttgaatcaaagacatctttattctctgcctcctcaccatgcacatacgtacaaatgtctgctgacagatatctgcccttcctatggccttaaaaagccttctcatattctcgtggtgctatctgggatacaccagtggaagactgctttgtcttctaattcttcccttcaaagaagcggctatttatacacatagcattattaggaactagtcagaaaatgagaaactttaagtttatgaaaaaaaacattgcttacttcagctgcatgctggccaaatttagttgaagtgcagttggtataagtttagttgtttagttttggaataagagagttcaagacttcccctcccaccccccacaagacaaggtctggctctgtaacccaggttggagtgcagtggcatgatcacagctcactgcagggttgacctcccaggctcaagtgattctcctgccacagcctccctagtagctgggagtacaagtgcatgccaccacccctaatttttaaaaatttttttgtggagatggagtcttactaggttgcccaggttgtcttgagcccctgggtgccagccaccgtgcccaaccagtttaatacttctttaggatttaaagttggaagttggcctggtaagagtgaaggacaatgtctttgtaatctgtttttccctgagaggcatgggaatgacacctttaaagaactgagtgtgtttgaggcagaaagggaagtctgctgccctaatattgtcattattatcatctctctgaggctctgtagtttgagtaaaacattctgggaaaaaaggtaggggcatttgaatgagcggaatataatgaattagaagatgcagaccatgtctcacttactggctgccatttattctttatttttatatttttgagacagggtctcgctctcttgcccaggctggagtgcagtggttcagtcttggttcactgcaacctccacattccaggcttaagcgatcctcccactagagcctcctgagttgctgggactacaggcttgcgccaccatgctcagctaatttttaatttttttgtagagttgagttctcactatattgcccaggctggtcttgaactcctaggttcaagcaatcttcctgccttggcctcccaaagtgctgggattacaggcatgagccactgcgcccagccttgccatttattctttttataatttaacaaatatttatggagcaatttacattaattggccccttgagacacaaagaagagccttcaaggcatcatcaggaatattctagatacaataaaatgacatgtatataataaggtatattttaatgaaatcataatggaatataaaacaattggccagcaatgatcaaaatggcctaacttctcttccacttttaatttcaggttaaagtaatttatattttttggcataaggaacaaattagggtttttagtcttgttttggtgcttattgccgataagtcattttgtgtcaggtttgtgtttgttttggtctcatctctactaagctgatagctgttaaaactcctaggaaatgaaagaagaaagctacaagttaattattaaaactttaccaggtttcaaagagcagaaagaggcttgttaaaggctggagaatcttgtagtatatattgtcttaatttttctttgcttttaggaaaagaaacttggaggacaatatttacttaaagttgttaaggtcaatctacatcatttgggagccaatatccatcattaggaaaaatgggttgaatgtaatctaatgaaaattcttcatatttgccagagaaaagctacttaagtgtgaggacaaaacatattttctgaggcaagaagtaggtataggctggtttaataggggatttttttttttttttttggaaaaaagtaatttttttttttttttaatggagactgggtttcttgctatgttgcccaggctggtctcaagcttttgggctcacgcaatcctcccgcctcagcctcccaaagtgctaagggattacagatgtgagccaccatggccagtctaatagggaattttcttattccaatagaaaggggtctttgaaattgttcacagagcttggcattgtgttccatgatagaggtgtcagatcaggaggccaggtttgtcccccaaaaggaaacacactgctgtaaacttctggttaggaggaagtttagaggaagctcacacagagttgggaagaacaaagacgaagctatagtcactggaagtaagactttagtgaccctgacttgtgagcattcagggagatttggaagctggttaagcctcaagagtgctgatgggagaaggtgaagagttgtatttaatgggtaccagccccttctaattctgatgtctctggttgatgtgtgatatttttgtttaaaagataagtactccttgacagcctggccacatttctcccaactgttatcgtttttgacacccaggcagctggtttcattatcagctgtactcttcctccttacatcttcctcccccctcctcttcttgcttcctaacattttctccactttctctttttcttttttctttatcttaagatggtctcaatgtcaggtttttcattcaactacaaaacacttaaaagtccagctcaggtgagaaacagcaaacttggtgttgagttgaagttgtggttgtctttttttttttttgagacagggtctcactatgtcacccaggctggagagcagtggtgtgatctcagctcaccgcaacctctgcctcccaggctcaagcgattctcctgcctcagcctcccaagtagctgggattacaggcacgtgccactactgcctggctaattattgtatttttagtagagatggggttttgccatgttggcaaggctggtcttgaactcctgacctcaaatgatccacctgcctctgcctcccaaagtgctggcattatgggtgtgagccaccgcgcctggcccgaaattgtggttttgtaagttaaataggatgtctccaattttgagattattactagggcatgcaaagtatggtttggtatctgtaggggattggttccaggacctcactcacatgcataccaaaatcctgggatgatgcttaagtccctataaaatggtgtagtatttgcatttaacttatgtacatcgtcccatgtacttaaaatcacctctagattagttatatcaattataatccccctctttttcttctagacagggtctcgctttgtcatccagcctggagcgtagtggtgcaatcatggttcgctgcagctttgacttcctgggctcaagggatcctcccaccttagcctcctgagtagttgggactacaggagtgtggccatcacacatggctaattcttaaattttttgtagagacaatgtctcactatgtcgcccaggctggtctcaaatttctgggctgcctcagcctcccaaagtgctgggattacaggtgtgagcaactgcactgggtctataatacttaatacaatgtaattgctatgtaaataattgttctgtattgtttagggaataataccaagaaaaaaatggtgtatatgttcagtacaggcacaagcaaccgttttttcccccaaatctttttgatctgcagttgtttgaaaccacaaatgtggaacccagggttacagaggcctgactgtatctcagtggccattatgccagagagagagagagagactggttcatgttaagcgcattgtataatagcagctctgtttgtactttataaactgagtgtgtttgtgtggcttttggttgaagacattctaatattacccacttgagtagaggggattagagttttgaggcctttttctaaaatgaatacttaccacaggggcttttcactgtttaccatgaagtacacataatcagtcttcaacctgactttttttttctgtgtatcattttatatcaaattcattttaataagaggaaaacaggataaacttactccagtgtaaaaaataatacctcacttgagcccaggagtttgagaccagcctgagtaacatagcaagaccccacctttacaaaaaaaaaaaaaagccagctgtggtggtacgtgcctgtagtctcagctacttgggaacttgggaggctgaggtgggaggatcacttgagcctgggattgtgcaactgcactgtagcctgggaggctagaaatatgtaaataattgttctgtaagaccctgtctcaaaaaataaaataaaaaacaataccagactttataccttcaagaacaatttggaaattcacatgtctattctaagctgtttctttccccacacctcgaatgggagcagattgagttttagaactaattgggctgggcatggtagctcatacctgtaatcccagcactttggaaggctgaggtggatggatcctttgaccccaggagttcaagaccagcctgggcaacatggtgaaaccatgtctctacaacaaatacaaaaattggcagggcatggcacacgcctctagtcccagctacttgggaggctgaggcgggaggatcacttgagcccaggaggttgaagctacagtgagctgagaccacgccactgcactccagcctgggtgacagagcaagacactatctcaaaaaaaaaaaaaaaaaaaaagttggatggatatttttgatagactcagaaaatgctgcttcttcatgacctagaatggaaaaatagagggagagtaataatctcttattttaaaaaagtgattaataaccttcctcattaaaatacatagggttcagaaaataattagctctgtttgagctgctagaatatttcagaaagttttgttgactgtcagtcatccaaatggcaggagcccaccttcatgaagagcacctggtacaacaaggtgttgtgttaataatacagtaatggtttagtagaactgtcaagtactttggccttgaagtagaccattagggaaaagagaattttagaagaatctagaaaccttttcattttctttaggacaaatataatttttttaaaaaatgagaattctttgttattctctaataaacactttgggtgtcgctaagccttgatctgtgcacctagcagtttctcttttgtcactagcatgtctctggcactgaacagtgcctgaggaagaatgaactgaacagtgtcaagaggaagaggtggctttgccatgtagcttgaacgcattcttgctagcatttatttcatcagttacttccatgaagacacctttctggctgcttctatgaaagttttttcctatttaatgttgtctttgattttattgagatgaggaaggtgatgaaaaaaaaggaggaaagaattaagggactgtatttaaaaacattcctctctaaacctacaattaattttagggagaccttttcagctgtaagactagtgaaatggttttgagtacctttattctctataggggaattttatatgaaaacgaattatttcaaacccaaactatttatttatttatttatttgtttatgacagacagggtcttgctctgtagcccaggctggggtgccctgatcatggctcactgcagccacaacctcccaggctcaagcagtctgcccacctcagtctcccaagtagcacgcactaccacacccagctaatttttgtatattttttgtagggatggggttttgccctgttgcccaggctggcattgaactctgctcgcctcggccttccaaaatgctaggattacaggcttgagccaccgcactcggcccaaacttttgttttaaccgtagattaaaaaaaaaaaagttgaagttgtatatattaatactcagtatttcaaactttcttaggggcagttttctgttttgtgttttttgttttttttttgagatggggtcttgcttggttgcccaggctggagtgcagtggcatgatctcggctcactgcaacctccacttcccaggttcaagcgtttctcctgcctcagcctcccaatagctgggattacaggcacccacaaccacgcccggctaatttttgtatttttagtagagacggggttttgtcatgttggccaggctggtctcgacctcctgacctcaagtgatccacccaccttggcttcccaaagtgctgggattacaggtgtgaaccaccccacccagccaggggcagtttttaaaacaggtttgggctatccaaattgttcttccagagttcttataaatgctaagagaatatacagaattactgttaattagatgttagaatttattatagctagtatgtgttttggggggtaacttaattttcatataatttcaaacttgcagaaaagttgtaagagtagtaccagggaatggacaattttcaagaaaatgacagtggtaagcagtgggtgccttgagggaacacggagaagccacttaagccaaattagggagtcaggaatgctttcctgagaggggatttttaatattttacatttaggtggcactaagacaaactagtagtaagttaggctgaaggcaataaatacctgccaattagacagctgtagacttctgattatctattgcagaagctttatcagagagttcaactgaacatccctaaaatgtttgttgagaagctgagtgaatctatatgaccttgacattttttataaggcaaataatacatgtatctggtaaaacttctttttatgtgcaaaaggtatacagtgtatattcagtgagaggttttcccttcacatgacctcatttgggctctcctactccttccttctctcagggatggcctttattaccagtttttggtgtgtcctttggagattgtacgtgtacgtgtgtgttttctcttttttctttttgctacatacatgatagcatgctgctcaacaaattggtcttttgacttgacaacatgtaatattttagagattgtatcctatctatacatgatagatcgtcttatttatagtggttgcatggtattctgtccaatgaatgtgcacagtttattcaaccagtcctctactaatatcaaggttgtttacagtcttttcatactacaaacaatgctgtgggaaatatccttgtacatatttccttgatgagtactttttgctttttttttttaaagaatacatttttaggagtaaaattgctagatcaaagaatatgtagacttttgaaattttagacagaaaataaaattttgttagcatttttatcttgtaaaacagtcttacaacactttttttttgagacagggtcttgctttgtcacccaggctggaatgcagtggcctgatcaacactcactgcagccttgacctcccagactcaggtgatcctcccaccttagcctcccgggactacagacgcccaccaccacacccaactaattttttttttttttttttttttttgagacagagttttgctcttgtcacccaggctggagtgcagtggcgcgatctcggcttattgcaacctccgcctcccaggttcaagcaattctcctgcctcagcctccccagtagctgggattacaggtgttcaccaccacacccggctaacttttttttttttttttgagatggagtctccccctgccacccaggctggagtgcaatggtgcgatctcaacccactgcaacctctgcctctcaggttccagtgaatctcctgcctcagcctcctgagtagctgggattacaggcatgcgccactacactggctaattttttgtatctttagtaaagatggggtctcaccatgttggccaggctggtctcaagctctcgacctcacgatctgcccgcctcagcctcccaaagtgctgggattacaggcgtgagccactgcacctagctttaatttttgtattattagtagagatggggtttcaccatattggccaggctggtctcgaactcctgacctcaggtgatctacctgcctcagcctccgaaagtgctgggattacaggtgtgagccaccgtgtccggcctccacctagctaatttttgtatattttgtagagatggggtttctctatgttgcccaggctggtcttgaactcctgggcttaagcaatctgcctgccttggcctcccgaagtgttaggattacaggcatgagccactacagccagccagttttacaacttttgttagagaatgggataaaataggctgggcatggtaggctcacgcctgtaatcccagcactttggggaggctgaggtgggcagatcacaaggtcaggagatcgagaccatcctggccaacacggtgaaaccccgtctttactaaaatacaaaaattagccgggcatggctgcatgcgcctgtaatcccagctactagggaggctgaggcaggagaatgggataacatagtcatattacatttaaccatgagtgccattttttttctgtcaattgctgttcgataggaagaaacttaatgggtttaagagaaggtgacactttatggttaggggtaagctggaatatcaaagcaatgttaatcataattgtgatggttacttatcaaagtattgctgggttgattctagttgtttgtgtcctaactctggatcttttccttaatgtgacgaagtaactgaaacaacctggtgctacagccctggagagcaaaactgtcttaatattaacttactgcttccatatgggtcataaattttcatggagacttgaatgctgtgcataactggcctggccctttctattcctccctagttttttttttttttaactatttaattatttattttttataagatggagtcttgctctgttgcccaggctggagtgcagtggcgcaatctcagctcactgcaacctccacctcccaggtttaagcgattctcccgcctcagcctcctgagtagctgggattacaggcatgcaccatgatgcctggctaattttgtatttttagtagaggcggggtttctccatgttggtcaggcttgtcttgaactcccgacctcaggtgatccgcctgcctcagcctcccaaagtgctgggattacaggtgtgagccactgcgcccggcccctccctagttttattaattttttttttttaatgagacggagtcttgctctgttgcccaggctggagtgcagtggtgcaatattggctcaccgcaacctccacctcccgggttcaagcgattctcccgctttagcgttccgagtagctgggattacaggcatgcgccaccacgctggctaacttttgtatttttagtagagatggggtttcaccatgttggccaggctggtctcgaactcctgacctcaggtgatctgcctgcctcagcctcccgaagtgatgagattacaggcgtgagccaccacgcctgacctcttttattttattttattttattttgagacagagttttactctgtcgcccaggctggagttcagtggcatgatctcggctcactgcaacctctacctcctgggttcaaacgattctcctgcttctgccaccctagtagttggaattacaggcacctaccaccacgcctggctaatgtttgtatttttagtagagacggggtttcacccatgttggccaggctggtattgaatttctgacctcaggtgatccgcccacttcagcctcccaaagtggtgggattagagacgtgagccaccgcctccggccccaagttttattctgtaggcactgtaatgaaacatgtagtttgttgactaaaagctttgttgaaaaggctggagactggaatctagaatttgttttctttcttgaaataattcattcttgagatttcagatagaagacgaaactttttgtatttgaacggctctgtatgtacttggtataggaatgaacttagaatatcactaataattatttaaaattttatcatgaaatatttctgtctaaaaatatttgcagactacagtcctgggaagatcacgctattaccttaattgtttgcttttaaaatataacttaaaagcctattttggtgcttgcttcggcagcacgtatactaaattggaacaatcaagagaagattagcatggcctctctgcacaaggatgacacgcaaatttgtgaagtgttccatattaaaagaaaaatttttgtccaggggcagtggctcatgcctgtaatcccagcactttgggaggccgtggtgggtggatcacctgaggtcaggagtttcagaccagcctggccaacatggcaaaaccccatctctactaaaaatagaaaaattagctgggtgtggtggcacgtgcctgtaatcccagctactcgggaggctgaggtaggagaatcgcttgaacccgggaggcggaggttgcagtgagccaagatcgcaccactacactccagcctgagtgacggagtgagactccatctcaaaaaaaaataaaaacttttaaggcctgttttgcctattctggataaaaatcttcctcagatgtagacgagacatttctgtgtcttctttttcttcttttttagacaaggcctcgctgtgtcacccaggctggagtgcagtggtgcgatcatggctcaccgcagccttgaccccagggctcaagcagttctcctagttcagtctcccaagtagctggcaccacagacatgcactaccacgcccaggtgattttccagtgccttaaacagtgcccagctgattttccagtgccttaatgatattaatcatcattacaaaagtgatttacagcctggccaacatgatgaaaccctgtctgtactgaaaaaaaaaaatacaaaaattagccgggctcggtggtgggcgcctgtaatcctagctacttcggaggctgaggcaggagaatcacttgaacctaggaagcagaggttgtagcgagctgagatcatgccattgcactccagcctaggtgacaagagtgaaactctgtctcaaaaaaaaaaaaaaaaaagcaatttaattcattcagctcattttgatcagggccacaattggaaacttgagttattatacttgcagtaatattctcagaactgattgacgcataaggaaggactgtttgcctcatatcaaatagcccaagactaattgatgtacttgagttttttgattcctcagtgtgccaagttcctcttttcctggaagagctatgcatagttccagatctgatttgtggtttccaatttattgtgggttaagacaatctgataacattagtttgttacaattatatgtaaaacaaaagtaaaaaggctttgccgggaacgtcggggctgtgctgtgattggaatccaagtgagtactgctactctgagtggtcaaatatttaaatcccatttaggtgaggtgctattgtcattgactgaaagaggggttgaatttagtcagtattattgggggctgttggctgatgtttagtcatctggtggcttaaaacctgacaggagacacatggctagttgtccgttgtaatataatacttggcattggtgactctagagaggaaggattatgttttccaaattagcaggtggtggtatatatgccccagaagacagatgaaacctaaaaagaaaagaaaagctcctttctggtctgaattctgtaattctataagtacagaatatgttggtagatagaaagattacccaaaacctgaaacagcaagtagaagattgttcatgtaggaacaacatataagggacaagggtggaaaaaagactagatttaagcagtaaaagatcattaagcgaggcttcatcacttcttcagtaggacagttattattgggattcaaagaggggcttatcaatgaatactatgttgtccttccccttctaaatttgaaatcaactgagaagtagataagaagattgaaacatttttttttttaatagccttattggtaaggctcaatggagaatatgccatagatctgttcccaagtgagcttgctaaaatcctccctcccaattaaacttaacaggatgatggacatctggaacttccaccccacccctgactccacccgccccactgcgggttgcttagtacaggacctgtagacaaaggctggcatcccacacgctatgcttaatcctgctggtgcttcagctctcttggagagcttgggaggggctgggccacgggtgactagtttcttctagttgtcagagggttgaggaatgaggtctagaacattatggctgcagactttactttcttaggaagatttgaggctgccaaatagtggccttccactaccagtatgcttgtatggtgctttttcctaccctttctagaagattgaaccatgagcttaaattacatattttagaccaaagagaattacagatttctgtccttaaaaactcataaaataggctgggtgtggtggctcatgcctgtaatcccagcactttgggaagtggggtgggcggatcatgaggtcaggactttgagaccagcgtggccaacatggtcaaaccgtgtctctactaaaaatacaaaaattagccaggcatggtggcacacgcctgtaatctcagctattctggaggctgaggcaggggaatcgcttgaacccaggaggcagaggttgcagcgagctgagattgtgccactgcactccagcctggacaacagagtgagactccgtctaaaaaaactaaaaaaaaaaaaaaaaaaaacaactcataaaatagggggaaatgtgtctggctttagacacttgggataatttggaggcaaaggcagagaatggatacttgcctagcagcctctgtgtagatgcttattaaaaaagtatttgcctggccaggtgcgttggctcatgcctataatcccagcactatgggaggctgaggcgggcggatcacgaggtcagcagatcgagaccatcctggctaacacggtgaaaccctgtctctactaaaaatacaaaaaattggctgggcgtggtggcgggcacctgtaatcccagctactcgggaggctgaggcaggagaatcacttgaacccaggaggcagaggttgcagtgagctgagattgcaccactgcactccagcctgggcgacagagcaagactccgactcaaagactcaaaaaaaaaaaaaaatggtatttgctgtctcactaaaatacctcctgttcaatttgtccaccaccccctgccatccgtgaagggtttcacagtgaaagccagaaagcctgctagacacattctaaaagagctgtaacacttcaatttggttttgaagtcttgccagcaaaatcttgactaagacttttctttttttgttaaatatctgtcagtcatattctgaaaactgtaattattttcaaggttacctaattcagtagaaaaattactcttttcatagtaaggattcagtcatacagagtaacaaactgctggttctgaacttgttagtttgttcttcctaattcttctccctcacttttctcctttccagaatcatattctaagaactcagccactcaggtatccaccatggtgctgggtcctgaacagaagatgtcagatggtaatttaccgctttgtgttattgtctaattttatttgtaattaggtttatgttggtaacagaaatttatcatatttttcctcttgtcatcatctgtcatcatctattctaacaactccattcaaaagtcaccatctggtgacttaggctgtaaatgaaaatggattttttttttttttttgaggtggagtctctgtcacccaggttggagtgcagtggcacaatctcggctcactgcaacctccgcctcatgggttcaagtgatgctcctgcttcagcctcccgagtagctgtgactaaaggcacacgccacaatgcccggctaatttttgtatttttggtagagacagggtttcgccatgttggccaggctgttcgcaaatgcctgacctcaagtgatccgcccgtctcagcctcccaaagtgctgggattacaagcatgagctaccgcgcccatcctgaaaacagaatgttttttttttgtttgtttgtttggttttttttttgaggcggagttttgctctagttgcccaggctagttagtgttcagtggcactgtgtcggctcactgcaacctccgcctccccggttcaatggattctcctgcctcagcatcacgagcacctgggattacaggcacctgccgccacgcccggctaatgtttttgtatttttagtagagatggggttttgctatgttggtcagggtggtcttgaactcctgacctcaggtggtccacccgtctcggcctcccaaaatgctgggattacaggcatgagccactgtgcccggccctgaaaacagatttttaaccagagacctgcttcatatcttttttacaattctgagttgagccaagattagctgaaatttggtttctggcagtaatgcttgcaagggcaatgttattcccagacccaggataaaaacctctggagtgttttggctactcatgatgcttcctggtgtttcagatgtgtatggagcagtaaaatacagggcgagtaccttacgctctgtatttgattggagcttcttgagtgctttgactattccttcctaaatctgagcttctttggaatttctgttccttttctataaatttcttcattaattcaaagctgcttaattaagatgatatgagtcagctccctatggaaagaaagctcttatttgtttaaattagaggttgtaaggatttattgcaaacacagagattagagctttgtgattcaaaatagccatttgatggctgaagcaaactaggctctgtgtatttctggcagggtatcccttttctcccagaccttctgcttcccaatatttaagattgactgcaaaatgcagaactcagggaaacgctgatatcagtctgagatgagccctgctatcacgagggtgccagtaccccgtgaccggcggcactttactgcaagccttagtcagagtacaaagggttcctgcttggtggttttgctgcagcttcagagtttagcctgaactgtggcaggattttgtaacttgcacattttttgagaagtctgatggaggtataatgtccacggtcgattctttgagtaagtcctaccaaatataggaggtggggaggacatttcgctagacaggcctagttcttttcttttaaaagctaggattttaggttaccaggagctggtctgggaatatgatattttgagcccatatgtcagtgtttttagaggaaaatgaaatggctctaaaaattcccaagtaggagtagaagtgtggaagtaggaaaaccattgtgagttaaaactgatctagagaattgagtgactgggggagggggagggagataacttttttagtgtaggctaaattttttacttcctgaatttttaaccatgtgaatgtattacttattctaaaatgtacattaaaaataaactattcaaaataaattgagctagagtcaggttggtctcttgtgcatttagatattaaactatttaatttcagtatactaaggatgaattgttagtgtattttgttcattttttactaatttattttcaaatctgttaattcagacagtgtttctggagatcatggggagtctgccagtcttggtaacatcaaccctgcctatagtaatccctctctttcacagtcccctggggactcagaggagtacttcgccacttactttaatgagaagatctccattcctgaggaggaggttagtatcaggtccttggaggagaacactattgtctggggaaaacctgtgagtgaaagatctgctggatggctcaagttcagcagcctcaggtttaattttggctggcaatctctgaagactatatctatatatctatatatatatacacacacacacacacacacacacaccccatctatatctatctatctctgtctgtctgtctgtctgtccgtctatctatctatctatctatctatctatctgtctatctaatcttttttacagacagggtcttgctctgtcatctaggctccagtgcagtggcacaaccatagcccactgtagccttgaattcctggggtcaagtgattctcccacttcagcctccccagtagctgggactatagatggcatgccaccatgccaggctcattatttttatttttatttttagagacagggtctcactatgttgcccaggctggtcttgaactcctggcctcaagctatccttcctcttgtttgttgatgaaaaagagtcaaactctggctgagcccaggctcacacctgtaatcccagcactttgggaggctaaggcaggaggatcacttgagcccaggagtttaagacccgcctggccaatatggcgaaaccctgtctctacaaaaaatacaaaaattagctgggcatggtggtatgcacctgtagtcccagctactcgggaggctgaggtggaaggatcacttgagcctaggaggcagaagttgcagtgagccaagatcatgccatggtactccactctgggtaacagaatgagacctcctctcaaaaacgaaaaccaaaacaaaacaggccgggcgtggtggctcacacctgtaatcccagcactttgggaggccgagatgggcagatcacctgaggttaggagttcaagaccagcttggttaacatggtgaaaccctgtctttactaaagatacaaaagttagctgggcgtagtggtgggtgcctgtaatcccagctactcgggagactgaggcaggagaatcacttgaacctaggaggcagaggctgcagtgagccaagatcgcgccactgcactccggcctgagtgacagagtgagactctgtctcaaaaccaaacaaacaaacaagagtcaaactctgtaaaatgtttaaagaggtttattctgagccaaatatgagtgaccaaggcccgtgacacagccccaggaagtcccgagaacatgtgcccaaggtggttgggttacagcttgattttatacgttttaggggtcagaagttacaggcagacatcagccaatatatttaagatgtacattggttccatcaggaaaggtgggacaacttgaagtggggagggggcacctttcaggtcaaaggtggatttaaagattttctgattggaaattgattgacactgggtgcagtggctcatgcatgtaatcccagcactttgggaggctgaggcgggtggatcgcttgagcccaggagttcgagaccaaccagcttgggcaatgtgacaagaccttgtctccaagtaaaaaaaataaaataaaattagttgggtgtggtggtgcacacctgtggtcccagctactttggaggctgaagtgggaggattgcttaagcccaggagttcaagaccagcctgggcaacatggcaaaaccctgtctctacaaaaataaaaataaataaaaaaagaaattggttgaaagagttattttctaaagacctggtctaaaatgaggggctgtggagtgtctaaaatgaggggttgtgaagaccaaggtttttattatgtaggtgaagcctctaggtaacaagcttcagagaaaatagatgtaaatgtcttttatcagacttaaaaaggtaccggactcctagttaattctctccgggatcaggaaaagacctgaaaagggaaggagattctatatattctaggttttgctcataagagacagctttgcagggtcatttcaaaatatacaaagaaatatatcttggagtaaaatactttgatttctttcagggcctgttatctgtcatgtgatgctatgctagagtcaggttggaatttagcatgttattgctacaaggaatctgttttgtcagttttaagatctctggtttttgtttgtttgtttgtttgtttttgagacggagtttcactcttgtcgcccaggctagagtgcaatggtgcaatcctggctcaccgcaacctcctcctcccgcattcaagcgattctcctgcctcagcctcccgagtagctgggattacaggcatgtgccgttacgcccacctgtttttgtatttttagtagagacagggtttctctactaaagtgttggtcagactggtctcgaactcccaacctcaggtgatctgcccgccttggcctcccaaagtgctgggattacatgcaggaaccactgtgcctggccaagatctctgttttaatgctggtcatttgtgtctgaattccaaagggacgggagtataatgaggtttgtctgacccctccctcccatcatggcctgaactagtttttcaggttttctttggaatgcccttggtcaagaagaggatccgttcagttggttgggggagcttagaattttatttttgtttgctctcctcagtgtcccaagtagttggactataggcacacaccacacagcaccacacctggcttgtttcctttttaaaatggtggctcttgtcctttttgggaagtgtttgggcacagaggtactgatactgttattctggttttagaataagaggctgatggaacctgcaggtaagggaagagctttgacttggacagagaagtggccagcttcttaataaaaagtgggtaagatggaggtgaaacttggacacatgcaatatctgacattgtaaatccttttttcttgtgaggctggattttgttgcttcatatgtgataacagaccaattatatcagtagttcaatggtgatgttcagtttaatctcttttcctctcttgtacagtactcttgttttagctttcgtaaactctgggctttcaccggaccaggttttcttatgagcattgcctacctggatccaggaaatattgaatccgatttgcagtctggagcagtggctggatttaaggtgaacatctagtcctacccctgtccttttaagcacataatacactctcacatccttttctccaccctgcatgttggatagtagcctcaggggctacatgcagatacttcattggcagtggctcttatgtgtaaagtactttccatttggtcttatttttatccacatagtttccttgaacaaaggagaaactacatataggagaaactgaggctcagaaaggtacaaggtgacttagcaggtcatgtgcaaaatctgttatagaactcaagtcatttgattcttgacctgggctcttttctgaatgcagtatttaccactcatgttgccaaacaactaaacaaacaaacagacaaaaactcagttgttcaatgagtgttacaggagattttgttcttcttagttgctctggatccttctgttggccacccttgtggggctgctgctccagcggcttgcagctagactgggagtggttactgggctgcatcttgctgaagtatgtcaccgtcagtatcccaaggtgagcaatgtattgtcctgtttgtctctcacccatgccataggaatctgtgtgtctggcggtatgtgctggcctcattctatagtgagacagtcaaggacttgggggtcagtggccctgaagacagacggtaccaacggaaatactgtagctcctcctgctgccaggccatgttttccccctctttcaaaatctaacttgagactcgcatttcctagaaggttttcttagaaaaactgtgttaccattcactctggcttccagtatctagcaatgcccagcccaaggggaggaggatgctctctctaagcacttttattcatacctccatgttactccatcagtttgcattttatatatgttctttttttgtttgactttgccatcactttgaaaaagtaattttttttctttttagtacaaactatatgtggcaagatctttggatttgctaataattatttttcagtttcccctcccaccgggggctacactgtcctctgcagcttcttctggacattttgggcctttcttaccgttgcctaaggcaagaatgaacactatgtctggaagatatttttaacttagttttgtctcttgttttgtttcttttcctgggtgtgagcaaaaagtatccttatctgcttttcaaaaaaataaaaaaatcttgataatatccccatttactctgatgtgattattacacattttatgcctatatcaaaatatcccatatgccccataatatatacacctactatgtacccataaaatttttaaaaaacaaacaaaaccttggtaatttataatccttctagcttctttttctttctttcttcttattttttgagacggagtctcactctgtcacccatggtggagtgcagtgatgtgatcatggctcactgcagccttgacctcccaggctcaagcgattctcccatctcagcctcccaagtagctgggaccacaggcgagcacgaccacacccagctaattaaaattttttttttttttttttttgtggagatgaggtattgctatgttgtctaggctggtctcaaactcctgggctcaggcagtcctcccaccacagcttctcaaagtgctgggacgacaggcatgagccactgcaccaagcctagcttctctttcttcatacacgttaatagttattttgtaataataattatatatatatatatttgtttgtttgtttgttttgttttgttttttgagacagaatctcactctgttgcccaggctggagttcagagttcagtggtgtgatctcagctcactacagcctctgcttcttgcagtgaggcgattccagggattctcctgcctcagcctcctgactagcttggattacagccacgtgccaccatctggctaatttttgtatttttagtagagatgaggttttaccatgttggtcaggctggtcttgaactcctggccttaggtgatctgccagccttcgcctcccaaagtgctgggattacaggcatgagccaccgtgcccagcctgcttttttgtttgtttgtttgagacggagtttcactctttcacccaggctggagtgcagtggcgtgatctcagctcactgcaacctccgccttcagtttcaagtgattctcctgcctcagcctcccgagtagctgggattacaggtgcctgccaccatgcctggctaatttttgtatttttagtagagacggggtttcaccatgttggccaggctggtctcgaactcctgaccttgtgatctgcccacctcggccttccaaagtgctgggattacagacgtgagccactgcgcctggccttgttttggtatttttgagatggagtctcactctgttgcccagcctggagtacagtggcgtgatctcagctcaccacaacctccgcctcttgggttcaagctattctcctgcctcagcctcctgagtagctgggactacaggcgtgcatcaccacgcctggccaatttttgtatttttagtagagatgaggtttcactatgttggccagactggtctcaaactcctgacctcgtgatctgcccgccttggcctcccaaagtgctgggattacaggcgtgagctactgcgcctggctctgccctttttttttttttttttttttttttgagaccaagtctcgctttgtcacccaggctcgggtacagtggtgtgatcttggcttactataacctcaacctcccaggttcaagcgattctcctgtctcagcttcccgagtagctgggattacaggtgcgcaccaccacacccagctaatttttgtatttttagtagagacagggtttcaccatgttggccaggctgatctcaaactccagacctcaagtgatccacttgccttagcctctcaaagtgctgggattacagatgtgagatactgtgcctggcctgtttttttgagataggatcttgctctattacccagactagagttcagtggcacaatcatggctcactatacccttgacctcccaggcgcaagcagccttcctacctctgtctcttgaatagttgggaccacaggtgtgcaccatgatacccagctatttttaaaattttttgtagagacagggttttgccatgttgccaaggctgggcttgaactcctgggctcaagtaatcctcccacctctgcctcccaaagttcagggattataggtgtgaactaccatgggtgacctgacaaattttttggatgctagctatctggaggtgtttttttctggcttcagtgagtcagcataactaaatctgattttcagctgtattgtttggccagataagtttctgactttgttatatgccacccagttccaaccatcttcccttgagtccttttgcatacgtgggcattattattacattaaaggtgactccaaccttttctgttgttgtggtggtggtttgttgagacagtcttgctcttgtttgttgcccactctggagtgcagtggcatgatcatagctcactgcagccttgaccactggggcttaggctgtcctcctgcctcagcctcccaagtagttgggactacaggtgtatgccatcatgcctggatacttttgtactttttttttttcctataatttttattttaggtttggagatggatacatgtgaaggttttttctttctttctttctttcttttttttttttttgtgaaagcaagtttattaagaacgtaaaggaataaagaaaggctattccgtaggcagagcagtcacatgtgaaggtttgttacatagataaacacgtgtcatgggggtttgttgtacatattattacatcaccccgatattaagcccaatacacaatagttaacttttctgcttctctctctccttccaccctcccccatcaagtagaccccagtgtctgttgtttctgtctgtgtgttcataagttcttatcattttgctcccaatttttatactttttgtagagatggggttttgccatgttgcccaggctggtctcaaactcctgggcttaagggatctacgttggcatcccaaagtgctgagattacaggaatgagccactgtgcctggtccaccccaaccttttttttttttttttgagatggagtctcgctttgttgtccaggctggagtgcagtggcgcaatctcggctcactgcaaccttcgcctcccgggttcaagcaattctcctgcctcagccccctgagtagctgggattacaggcatgtgccaccatgcccagctaatttttgtatttttagtagagacggggtttcgccatgttggccaggctgatcttgaaccctgtcctcaggtgatccacctgcctcagcctcccaaagtgctgggattacaggtgtgagccaccgcgcccagcctgaccccaaccttttcatgtttgttttgtcttcccagctatggtcaggatagatatgttcttctgcaatcatttaatattctttcttgacccatatttggaccgtattagcatccttattctcctctaaactttttaggattgtttttaggaaattaagtggaagttagtaaatggcaattatattcttctcaagtagaaaggaaaaagaaaaaagtaagatcaattactgccttgaccttcgttcacaggttctgccacgtggtagcacacttttccttctccaggtgagagccacagtgcagtgatcggccaagtggaggcacgttctggtatttcttctctagtctggaggcttataaaggactgtttatggtttagtgccaaaatgtgaattccaaattgtggaggaattttttagaaatgattaatcagaaccgtgtctttctactgtttgatgtttaggtcccacgagtcatcctgtggctgatggtggagttggctatcatcggctcagacatgcaagaagtcattggctcagccattgctatcaatcttctgtctgtaggaaggtgaggggttttcctctagaaagtcatcagtgttttgctggatttccaagcagagataaaaacaaaaacccaattcatttttaattttgaagactcaactcaattgttatttcttctgtggaacctttctggaaacaatttcttctcccctggtagatgtagactctacatcttccgtttcccatggtgggttatgcttacctttattagaatgtgtggcgttttgtatcgcaattattgatttgtatgtcattttatcccgctagatactatctttttattttattttatttatttatttttttgagacagagtctttctccgtcacccaggctggagtgcagtggtatgatcttggctcactgcaacctccgcctcccaggttcaagcaattcttgtgcctcagtctcctgagtagctgggattacaggcacctgccaccatgtccagctaatttttgtatttttagtagagacgggatttcaccatgttggccaggctggtctctaactcctgacctcaggtctaggaatgcccgcctcagcctcccaaagtgctggtattacaggcgtgagccactacacccagcccccactagatactatctatctaatcctataaaattctatctgtctaactccatgagggtaagacccaaacttttcagctttgtatcctaagagtgacatagtagactctcaaagtttaaatgaatgtaattaagttgatgctgttaccctactttacccaaggcctagttttctgccattgtccctcctccctcaagtcctagcttctccaagtgttctttatctggagagctgttgggaagagagtgtttttcaatgtttcctttctttccgtctctctgacttccatatctcatctctgacctagaattcctctgtggggtggcgttctcatcaccattgcagatacttttgtatttctcttcttggacaaatatggtaaggagagcgggaatgggagggtcaaaggagctgctctctgtcatgtggcagatggggaagtctaccttctctgagctcactgctgccttttttcctttaggcttgcggaagctagaagcattttttggctttctcatcactattatggccctcacatttggatatgaggcaagtggtacaggatattcattagcttcttaaaataagtttttgtggtttttttttttagccttttattataaaagacagtaataatgctagtatgattcacttatagtgggtgtatcaacaaaaagccaatttttccctgggccaattttaaaggaatatgatctatagcaaagattagcatgcagaaaggcctgcaggggctcccaggtttaaaatgactagatattttagggctttccagactagattctttggtcccaagttgaccatctgacaacagaacagccatggatagtgttaattaaggagggggttgcagggttattcttgggtgttaacttagaggagttctgcttttgttcatcctggtttatattaattgcagcttgaactttcccaatattaaaacagttaatgaattatatgaaatatactggatatttcctggtttgtgccccaacccagaaactccttagagtcactaatattatttgcagtactagcacctttctttgtacaattcttataaactgatttctgcttactggtctggctgaactttaaaaaatatatgtaatctatgggttgattatgcctcttggcctaaggcttccaagagaaatactgaaccggggaagagtatatatgagagtgtttaaggatgagtctctcattacacacgtactagtggcaaacagcaagtgatttttaaatgaacatgggtgaacagaagtatgctcagtatggataataaaaattgattctatattcttttttaatttttagatttttatttatttatttatttttgagccagagcgttgctctgtcatgtaggctagagtgcagtgggtgtgatcttggctcacttgcagcctccgcctcccaggttcaagtggttcttgtgcctcagcctcccaagtagctgggattattggcgtgtaccaccatgcctggctaactttttgtatttttagtagagatggggtttctctatgttggccaggctggtcttgaactgctgacctcaagtaatctgcccatcttggcctcccaaagtgctaggatttcagctgtgagccactgtgcctggccctggttgtatatttttgagccttgtggaattactaataaccacaagtcccttagcagctttttcttttttcttttcttttttttttttgagatggagtctccctctttcgcccaggctggagtgcagtggtgcgatctctgctcactgcaacttccacccccaggttcaagcgattctcctgcctcagcctcccacgtagctgggattacgggtgcccgccaccgtgcctggttaatttttgtatttttcgtagagacggggtttcactatgtttgccaggctggtcttgaactcctgacctcaggtgatccacccgccttgacctgctaaagtgctaggattacaggcgtgagccaccatgcctggccttttttttttttttttttttttttttttgagacagagtctcacactattgcctatgctggagttcagtggcacgatctcagctcacctcctgggctcaagtgatccttccacctcagcctccctagtagctagtactataggtatgcaccaccacaccgaggtaatttttgtagagataaggttttgttgtgttgtcaggctgctcttgaactcctgggctcaagcaatgcgcctgccttggtctcctaaagtgctgggattataggcgtgagccaccgcacccagccctttctttagaaattaattatgtatcatacacatctgtttcatatatctaagatgtgttgtaaactatccggatactcagtcttgaattctctggcccctaatagtaagccccttatgttgcttggtcctatgatgattctgtattcctcattatcttaggtagttgcagaagaaaagattttggccaggtgtggtggcctgtaatcccagcactttgggtggctgaggtgggaagattgcttgtacttgggagattgaggtttcagtgagctgtgatcatgccactgcattccagcctgggtgacagagcaagatcctatctcaaaaaatataaaaataaggaagaaggcattgtaagggataaaggatgctaactgttccctggtactatgttactcccgtttcacgttcctgtaaaggctaatcattgttatgttggtatgtagtatgttacagtgaaacccagccagagccaggtactcaagggcatgttcgtaccatcctgttcaggctgtcgcactccacagattgaacaggctgtgggcatcgtgggagctgtcatcatgccacacaacatgtacctgcattctgccttagtcaaggtgagcaaggcccttatctccttcacctcctagacagttcatgggatcttttccttcaattgcaagggacacaaagttagtttacaattattaggaccatgaaggagcaaggtattttccaagcctggacatttataaactccatatacttagatgctgtttttatcaccaaattgaccagagattactaactgcataaagcaggtggggctaaagttctttttttttttttttttaaattgagatggagtctcactctattgcccaggctggagtgcagtggcgtgatctctactcactgcaaacctctccctcccgggttcaagtgattctcgtgcctcagcctcctgagtacctgggattataggcgtgcaccaccatgcctggctaatttttctatttttagtagagatgtggtttcaccatgttggccaggctggtctcgaactcctgagctcaagcaatccacccgccttggcctcccaaagtgctgggattacaggcgtgagctactgcacccagctgggactaaagttcttcataaaaggttggaagtgcatcaagtctcttgtgtttaaatttcaaaagctcgagtggccttatggaggtcaggagtaaaggagcccaaacaggcttttactgtcagtattatgtaatagtttgctgggagattttagaaacctttataaataggtatatgcacaccttaggactgaaatcaggtcgtttttataggtcagtggtccttccagccactgagagtaactgagagctcagtagtcatttagtctctgttccctatttggggaatgtacagttcaacgaaagggcatgaagttcttttttctccccccatatgaagttcttaattgctcagtgaactaggatgtaggtgagtgttggatctctcacttttcgtctggtcaacttttgtcccctaaatctctcagctgactccaaactcctgaaatgtcacaaggaaacttgttctaactggtcaaaaagtgactgctgttgttatctttctagtctagacaggtaaaccggaacaataagcaggaagttcgagaagccaataagtactttttcattgaatcctgcattgcactctttgtttccttcatcatcaatgtctttgttgtctcagtctttgctgaagcattttttgggaaaaccaacgagcaggtggtgagtaagccagggttatgggtggtagtgaatgtgagggtaaagtgaagactgcaatgggatggggaaggaaaatacctcatcctagtgttaatgttcaggagaaataatctctagcttctcgtctgccccccaaaatcactgtgcaccagtcagagtctacagtatggggctgaccaagcctggaccctctttctcagcttttgtttgggagtagtcaacaaacagaaaacagaaactgtgatgatgacagactttgtcttgtcattttgaattctgtatcaatcttgatttctgattacctatgtagtgttttttttgagacggagtcttgcactgtcatccaagctggagtgcagtggcacagtcttggctcactgcctccacctcctgggttcaagcgattctcctgcctcagcctcctgagtagctgggattacaggtgcctgccaccacacccagctaattttttgtaattttagtagagatggggtttcaccatgttggccaggctggtctcaaactcctgacctcaagtgatccacctgcctcggcctctcaaagtacagggattacaggcgtgagctcctgtgcctggcctgcctgtgtagttttgatcaccatttgtttcccgtctatggaacctctgactcctctgtctgctttgactgaggattctattctgggtgttctctcatgtctgaagccttcttcagagcctctcctcttgtcatcatttaaagtaccccagcgtttgtacattattaccatgcacactgtaactcagtaaagatttttgatgacctgtgggtgtagaaggattatagaggaagatcctagataacattgctgctagtctctgcccacatcacagcatatgtccagtgttttccctccagcctacctcttatagatgattgtgtatgatatgtaggagagctcttatttggtccttgcttctgaaacaaaagttgctgttgaattgctttgggttctaggttgaagtctgtacaaataccagcagtcctcatgctggcctctttcctaaagataactcgacactggctgtggacatctacaaaggggtaagcatgtttggatttgtgatctttgttcctgaatcagtatttttagcatagtatgtggtcttttttgtgacttcacttcagatatgagcatatctcctctggagtgtcatttatttcagagttccagacaccagacaagcattttggattaaatgggaaggaatagaggatcagttgaaaagatatataatacaggccgggtgcggtggttcacgcctgtaatcccagcactttgggaggctgaggcgggtggatcacttgagctcaggagttcaagaccagcgtgaccaacatggtgaaacctgtctctactaaaaacaaaaatacaaaaattagctggatgtggtggtgggcacctgtaatctcagctactcaggaggctgaaacacgagaatcgcttgaacctggaaggcagaggttgcagtgagccgagattgggccactgcacctcccagcctgggcgacagaataagactctgtctttaaaaaaaaaaggaaaaaaaagatgcagtatacaccccagctttttttttttttttttttttttttttttttttttggagacaaggtcttgctctgttgcccaggctggggtacagtggctcgatcatggctcactgcagcctccacctacctggtccaagtgattttcccatctcagtcttttgggtaatgggactgcaggcaagcaccaccatgcttggctattttttttttctttttgagatggagttttgttcttgttgcccaggctggagtgcactggcgtgatcttggctcactgcaatctctgccttccgggttcaagtgcttctcctgcctcagcctcccaagtagataggattacaggtgtgtaccaccacacctggctaattttgtatttttagtagagatgggggtctctccatgttggtcaggctggtctcgaactcctgacctcaggtgatccacccccccctcggcctcccaaagtgctgggattacaggtgtgagccaccatgcctggccttgtattttttttgtagagtcagggtatttgccatgttgcctaggcttgtctcaaactcctgggctcaagggattctccaaccctggcctcccaaagtgctgggattacaagcgtgagccaccctacccagccccaagaaagtgttcttagtaaagtgtttttactggagtctctcagttcttttatgctggttacattgtgatcctccaacagtagaatatatagtgtgtagcatttcaccaatttatttgatatttccctgtacttctattgccattttccagaatagtgtgtaaaggaatataatttggggaaagtggtgtagacctcttttttttttttttttttaatatttaagatggaggtttaggagcttggagaagagaaaggactaggcagagaaacgaaggagcatccagtaaagtttagactgaaagcttctggaatgaggtccggacttgagcctagcttctggcacagtgcccagcacagcacttggtgttggtggtgcatagcaaagaagggagaaatgccacagggaactgctgttttggatattgtctgagcagattattgccacaatcatatccttcctcttggcctctcacagggtgttgtgctgggatgttactttgggcctgctgcactctacatttgggcagtggggatcctggctgcaggacagagctccaccatgacaggaacctattctggccagtttgtcatggaggtacgtgctggtataggatagagggagataacacaacccttttgttacttcttcttcttcttcttttttttttttttttgagatggagtctcactcgtcgcccaagttggagtgtaatggcatgatctcggctcactgcaacctccacctcccgggttcaagtgattctcctgactcagcctcccgagtagctaggattacaggctctggccaccatactcggctaattttttgtatttttagtagagatggcgtttcaccatgttggccaggcaggtcttgaactcctgacctcaagtgatctacccgccttggcctctcaaagtgctgggattacaggcgtgagccactgcgcctggccccttttgtcacttcttaatcccattcttctgaggtctctcctgaacctccccaaaacttttttttgtttcctgttgcagacagtcatctgctcctatgttttcttccagggattcctgaacctaaagtggtcacgctttgcccgagtggttctgactcgctctattgccatcatccccactctgcttgttgctgtcttccaagatgtagagcatctaacagggatgaatgactttctgaatgttctacagagcttacaggtgaggaggaagctgaggaaacacatcctagttattcaggtagcattatgtactgcccttgggtaccaagcctagctgagtgctggggggatattgagaggaagacagaggcatggttgtggtctgcagtaaatgtatatgaaatccttggcatctaaaaggattttagaaatggttggttttttaaacctgttgaatgggaactatgaactttacttacatatgggacacaaaattgtagttcattaatgcaagcaaacattaaatgaacatataggacactgtgctaggtcctgtggaggttaagaagacaagtcacatacaaaggtttgtatgctaggttaatgacagctctgcagaattcagcataatgcccaagcatgttgggatgataggaataattatttctcatggagtagttgaggcagcatttatgtttccctttcattaattgtgctgttctctagggtgatacaaggacccatagtaatcccatctgatcttctttcttttccagcttccctttgctctcatacccatcctcacatttacgagcttgcggccagtaatgagtgactttgccaatggactgtgagtgtactcctcttcgttcccaaaggggatgctgatatggggaaagggtatcttcatgcagtaggccagtcagacgtgagacacagagggaagcgatatgctttgagaggtgattgctagctgcttcctctttggcttagagaatggaaactgtgaatatagtaaaggaagagaaagcacgtctttcatatgaaggggagagaaagttcagcttttacagcataactcttcagcttcagccactgaagtttgaggcaccttaattctttgttaaatgatcttaacaaaaaaggcataagttagtaccttttatatatatctttaaaggatatgaggtatctgaagtgacttgttgcatttttgggaacgttaataaaatggctcattgcgtttctaggccttgttgcatctctagggacttaaatattagggattatttgttggtgtcttttcccccctctttctccctgtctaccagtatctaactttgggtgatttaacttagacttatgaagaatcattttttttcaaattaagaacaatttttccattcattttgaactgcctctaattcccatcctgtttccttttctgtctgtggccaagttggattattccatcagtgactgtgctgatttcttttacagaggctggcggattgcaggaggaatcttggtccttatcatctgttccatcaatatgtactttgtagtggtttatgtccgggacctagggcatgtggcattatatgtggtggctgctgtggtcagcgtggcttatctgggctttgtgttctacttggtaagtctagcctggaagagcaggggcataggtatcagggatggttgaggtggggttcactgacattcagaaatgaacagacccaggctgggcacagtggctcatgcctataatcccagtactttgggaggctgaggcgggaggattgcttgaatccaggagttagagaccaatctgggcaacatagtaagactccatctctacaaaaaaagagaaatgaacagacccaaaagagcacataacaatctacctccaggtgatcgagacaatgtatatggaattgtcaaatcagctgtttacaaaataatatttctaaccataaaattcactttggttactaagatttgtcatttttcaatttctgtcacttctgtagtttccattcttagtaattcctaacaagagagtatagtatgtttgaggaactaaaagaagggtagcagtacagagagtggagaacggtacaaaacagaggtggagaatagggcatgcagtgtgatttagagattcggggtgggacacatgtggcacacagccccactcagctccatcacttactagctgtccaaggaaataagtaaatagtgatagtctccccttgactctcattctagagtcattttttaaaaatcatggttataaaactatagctacatgaaaaaggtatgtaaaatttatatttcaattataaaaaattttttaagaagtctagaattatataaaaatggcaatatagttgttgtaggaagctaggattatagatatattcttctctattttccaaatcttctttagcattgcttatattaatgaaaaacagccaaaataacaacagatccatttccctgttctatacaggtttctttgaaaagacacaggggttagggataaggaatagtagaatttataccatttttgctgcagagaatggctacagatggaggctggaaacctgctgttaatctctagaacacttccccacaccagtgtgccacacattagatactttattaagaaaatcacttcagtaaatgttgaaaaattatttcctagatctcttctttttttcttcccaataaactttgtgcacacaaagactgtactgaccctatgatctaggaacttaacttcaaggaaaaccaagtaactgaatgtgtccttgacaggaattgtttttaaaaattcactatagaagttagggggatcctttcagaatgcaaattggatatgaacatgccagtttgtcctcagtcagcctaaggctaatgagcttgttgaagacccattattattattatttttgagacagagtttttctctatcgcccaagctagggtatagtggcatgatcttagctcactgcaacctctgcctcctgggttcaagtgattcgcctgccttagcctcctgagtagttgggactacagccatgtgctaaccatgcctggctaatttttgtatttttagtagagatggggttttgccatgttggccaggctggtctcaaactcttgacctcaggtgatccacctgcctcagcctcctgaagtgttgggattacaggcatgagccaccgtgtctggcttgaagacccattttgagaggagagggctgattctagagtgggttactgttgtttaacttcaaaacaggaacttcatagagcagcttaggagactacaccaattgtattagtctgttagtcattcttatcatggggaggactgaggaaaagtggacttccgagaacttacagttgggtaaaagaaacaaacaacaggctggacgaggtggctcacgcttgtaatttcagtgctttgggaggccgagccaggaggattgcttgaggttaggagtttcagaccagcttgagaaatatagcaagacaccttgtctctacaaaaaaaaataaattagctgggcatggtggtgtgcgtctgtaatcctggcaactcaggaggctgaggagggaggattgcttgagcccaggaattcgaggcttcagtgagctatgattgcaccactatactccagcctgagcaatagagggagaccttgtctctaaaatgtaaaataataataaagattttaaaaaaaaggaaaaccacagacacaaagcagtaagaacagagaaattcaatatttaaaatagtatggacaaactttgttgaggaaggcagctgattttttgaagggggagtggggttgagagaatgacttgtgcaacccttggtggtagaagatgggcacagctggatgttcaaggaagggagcaggtttgcatttgagaagtgctgtgtgagcagtcatggctcttcaaagagcctggtgagtgatgaccatgttttgtctttcagggttggcaatgtttgattgcactgggcatgtccttcctggactgtgggcatacggtaagcatctctaaaggcctgctgacagaagaagccacccgtggctacgttaaataacactggattagtctgtcttctgcaggtagccatcagagccagtgtgtttctatggtttactgtgtgaacatagccaaaagtatgtgccgttgcacagactgtgtttatgactcaaccgttggttggaaaagactttgtttcatgtgtatttgaaagatggaattattttttccttcctgacctaaccttagaactggattagggtgggatctttgaaaagctgacatttgctgctatcattccaacactaaattcttaagtagttgcccaagggccagctcagtttatccttcggagagacaaggatatgcatgattcttaaccaggctatatgttaaaaaaaaattggaaaatgcaatacattttttattatacaaactacagaatgagtatgcaagttttatttatcaaaatgtaatggatttttaaaggctgagaaattttccttatacctaccttttcagttattttaattataccaaattatcaactagaatagcttcatccatatgaaatataaaatgaagagacacctagctctatcaggcttaggattctttgaacttatttccactttaatttctcagtggaagttaagaggggtgagaaaacaaagaaggggaaaaactgacaactaacaaaaccagcaccacatcgctaggtggtgcttactaattaccttctcaggattttcctcagattgaaaagcttatgaggatttcttgggagtcttaataacctgcctgttagtacagagctttcctgatgatatttactcttgagcacatgtggttgtaaaaccttaactttctttctccaggagggtggtgatagaaacagatggtagtatttatgaactgatgttctcgtgaaatgttgagggtggggagaaaagactttaagggaggagagccatctattttgttcctaaagccacctctcagcagaatcgtcatgtttttctgatgcaccgctctgcttcatgcccaagatgacttgcgaggcaatctcaggagctgtggacttaaccattgcaaagcacactgtctttctcagcgttctctgcaagtcagtaggtgttagtatggttgcaaagttcactgtctcagcaaagttgaactgggctacctctctacagctgtttcctcagagggaaaaatcttgagaccagatggtggagctctggagtcagaggaaatgggtgtcttcagcacaaagctgctgcttttacttcagccacttctgacatttttacataccgagcctgagattgtgtgattatctcaaatcaaatcactttgatggagataaataatcaaaactgttttatagtcattgatttggtgagaacagtaatggaaaatggtgttgaaggacttctcatttttggagctttccttccagagtcctggctgattggtgttcgctgttcatctgagcccccaaaagcattattactgatacttgcacacagtcaaaagcgcagactggatggatggtcttttataaggcatttaagggtacactactgtgtttcactgaccatacatttttcttagcccctcaagtaatatagcacagagttatgaatgacaattcccctaaccattcctcttcatatctgcctcttccccttaccatcgtaattctccaaactggtcataaaggcactctgtgaagatattggggactgacatcttaagctctcacctggctgcagtaggaaaggccaaactgacgacaaaaaaaaaattctttataaagatgatatggtaacatgtatctttgccctgggtctgggtgggtccagtcagtctcagatttacaagcatttaggagcctaggtaaaagctgctagtattcttttaaaagttatatttatgacttgcaatgatagaaaactccttccaattaaatggcattttataatattatgtgtgtacttcacagtgttaaaaataccctcatacgttattgcatttgatcttcacagaaagtgcattttaaccagtactctgggtgcaataaataatatgtagaaatttaagtcctccaattccagcatatccagtgagttttgacagtgtgtttatgtggaatgtttaaggatatacaattgtactttatataaattggttcttgttcttcttaaatgtgacatgaaataattgtgctgctacattatactggaaattaacaggggaaaagggaagagctcttggctcccttgaggttctgctagtggtgttaggagtggttacaactgagcttttagtaaccatttaaccgtatgtaaacttggtttctaattaaaaaaaaatttctttttccaatttggtttcctgggtatttttttaaccttgaaataatttattaatagggttacaacaactttgatacaaaaatactgaaacagcaactaccacctggaatggcacactaagtccacactgttaggattttctccttagaaaggatagagaaataaatggatttagtcctcagaaagcttggattaattgcagataccaggatattaatttccatttacccacttagtcaaatagttttaccatagctaaaggtcacatcattaccatgttgaaacttgggaaaaaaattttattctgcttttctctaagctgactattttctacctgtagcttatttcactgtttcacttttacattctatatgtgctgccaatgaaaaattagtatttgaagagaaaccaaactcatttagcttaaagaccaaggagcattttggcagacctgatataaatggaaatattgacaccatttattaaaaacaaaggcagagctcaggcacagtgaactttactaggcacatgacaggaaaacttgagtcagcacttgatttgtcccaggagtgtcaccagaacttcattttccctttctctgttgcaaggcttccctgtgagtaacacagtggaattcatctaggaagaattttgttctccatgttgtccttcctcatttagtgctctctctttactttggatttaatttcagaactaaaataggattcaaaacaatgtgaggatcctgttttgaaacatttcctttagctctgccctctggaataccttctgctccttcattggtaggaccaatgaatctaaatctgtcagcttctctaagtcccttagcttatgaatttaaaaatggctaactcagtactgtgttctaaggcctggcctgaacagttgtattatctcatttaatccttgtaacaacaagaggatcagcctctatgtagatgagtcaactggaaggccaaaagtaacttgcccacatttacattactaatgaaatgtgcagttggcatttgaactcgcatagcttaactccagaacccatgttttcattcccaaactatcctgtgtaatatatagtatacccttcatgttgggttgtcaccaagctttgttgtttagcagcacaaggaacataacacactgaagcatttgtttcatactctgattagtgctagaatatgcattaggcagaagttgccaactggtagattttggtccctgtgcagaatttttaaaagtaagtttgaatgcttttggcaagtgtagagaatggacagggccctctatggtcctatcccagcaatagccaagagttactagttaataagttcactcatttgcattagctctctgcccctggaagtattttagcctatttccaggccatttagtctcatttctcaatgtctcagaacaatataacaaacatctccaatgaaagtggtctatcaactaagtcatctaagtgacactctgtgggcatcacaggaccaatactgcaacccttgcttactacgtattgaagaagtctaccaccattgctcacttgggaaaggcttcaatgaattgtcaatatatttaattgctgttatttacttaagcctaaattaagcaagctgatgtctgaagagctgtttccatgtcctaaagccagtgtaatacagtgttttcctagcccactagttggaaatagttttatcctgggcatcatttggtctaatctgtcttcacacagtcatcactgcaagcctgtgaggttatacactgcagtttgtaatgtgttaaatatatgtgtcgaagactcacatgagatagtatattggtgtacttggcattttctttttttttttttctgagatggagtcgagctttgtcacccaggctggagtgcagtgctatgatctcgtctcactgccacctctgcctcccaggttcaagcaattctcctgcctcagcctcccgagtagctgggattacaggtgcccaccacc

SEQ ID NO: 15970 - DNA, 181251 bp, Human
ggaattctgcagaatatctctggttctcataccataactctgagagttaaaaaacctgtgcttgtcatttctctttataaccactcaaaagcacgcaaaagaatccatcccacaccagtctttctagtcatctttataaccatagcagtcaagtgtagcagccacttggggccccaaggcacaggcttcagttggcacttcatcaggatcaaccacaggtaattgcttaattgagatgcccagcatgtcatgaattacatttccctttggcaaggagctaaagctcaaaacctcaatcaaactgacctttaatcccatctttgcaggtctatttcttgggactactcccgggacagggaaggcttaataaaaagaattgttaactataatagaggattagagtaatgaaggattcactagcaagaagagaactttaaagaatatagcaacagcagctataaggagctaaccttataactaactcttgggttgagagacagagtgcccaatgaagaacctccccaattcctcccagggctaagatctagacgtttttggagagggcatgacctggctcactgaatggcagagaagtcaccattgggctacgtctgcaaagcttgtggaagatgtgccctctgcaacttgctgcaaatgcctctagggtgccagggaagttattcatggggtagtgtctcacctcctctacaaagctcctagagttgggcatgtgagaggaaattgctagttactgagcactataggaccttggcagtggagaaagccaggtatgctgcaaaagcttatcaatacacagaaatcaggaagcaaaatcctttttttctgtaatgtctcttcagcgccctctgctgataaagcttcagtcccagaaggcaaacgaaaaactgtttaaaaggctcagatccgtttttacagtgcagtcaaaaagggcgaatttggagctgagaggcaataaatcaataactggcagaagcatcacttctcagattacactcatggatttcgtagtcagatgtttctacatgtgcctggacggccctttgtcagtctcctttcccccaggttttaacaggctgtcaccaaaggaggaaatagtgagcccgaagagaatgtgcaagccctcttctcttgcatttcctccagcccgtcaccaagtactcttccaggcacgccaggcccgagtgtcctaggataggaaacctgagcaacaaagggaagtggggtgtaagctcaacccctgttggacgtgggggtgctggcgcctgaacgcccccgaaggcctcaactcccagaaagctgcctgccaggtcacaagagccctgtgaggtcttcctatcgccgggacactgggaggcaggcgcggggcgggtccgccgggcgacgcgctgtgattgggcgccgtggggcccgccccctcatctcggagcgtcgggagggggcggggccagccgcccgctcggctcaggcgctgcgggcgcctattgacccagcggctgctgcgccgccgctgtctcctcctgctcgtggcgggcggtgctggagcgccaagtggcgctggagaaccggcgcttcctttcgccgcttccgccgccatctccgcgtttgtggggcgggaaagagggagggggctagcggctgcagctggagcgggcttctctccggggacggtcctttcctccctgctctccttttccttctttccgcgttgccgccgcccgccccctgcgcctccccgcggagcctgggtccgggagggggaaggtaggggcggcggggggcgggagagtctggcgagcggacgctagctctgaggaaactcatcaatccgtgagccccggagtccggggtgcacatcggcccagccgcagcgtcggcggcggcggcggcagcagcacgaaggggctcagtcggggtaggcgggggcggtgccggtgccgcgggggcgggcccgaccgtcccgcccagaagttgtagggcttggctcctcgcgatcttgttcctttcccctccgcttctctgacctagctgcgcggccccggcccgggagctgccgaacccgcgcctcccctgggtgaggaggacacgcctgccctcgtcgagaaaacttttcctgccgactcagttggggcggcggtggcaggaagtgcgggcagcgacctctcctccgcctgccccgcgcgccctgccggaggtcggcgctgagcttgcgatcaagtttgtgggggccccccttcccagttgccggcgagtctcgcctcgagaggggcgcccgaccccggggagggcggcaggccagggcgaaggccaagggcgtgtggtggcgccggagactaggtgcggagcaaggcggggactcgcacccgcatccgagagcgcggaggtcgcgcagcccgggagaagggagcctccggcggctgcttcctagagtccacagtgcgctgtctcctttggctgaggagagtgtcctggccccgagtctatcgaggaaaatgaagttaagccgccagttcaccgtgttcggcagtgcgatcttctgtgtggtgattttctcgctctacctgatgctggaccggggtcacttagactaccccaggaacccgcgccgcgagggctccttccctcaggtaagcacctgggaagggggcgcggggctccgaggggccaggcgtgcgggcccctggttagcggctgctacccaacctcttcctcccgccgcggccccacacccgtgctgggcgaggccaggggctctgtagctctcggacggcaatgatcacctcctgggagccacctcgcccgggcgcgccaagttaacaaagtgctgggcggcgtgcggcggcggcggcggcatcatcccgctcaggaaagtggccatgttccggcattcgcacccggcctgttggggtggcttcgggcacctgctggcgggggaacgggcgcggcgtgaggcaccccccgccagcccggggcccgcgtatcccggtggggtcgttctcggctctcacagggttaagccgcccgcaccagcccagagcccctgagcgcacggagtcgcggaaatggatcaaaccgaacccacctaggcttttttttctttttcttccccgctgcctctgaagagagagaagtttatttcgtgttgcggcccttttagatgtgaatctctaggttgattttagtgtcgtcattcttcagctattacatctggtttgtttgtggcagacagggggaaccgagtggggaagcgcgtgttatactccggccgaaagctgtggggcgctcagtcctgcgtccagtggttaaattggtaaatgagttgggaagacgacccatccaaagtcttatttaaagttaccaaaaataagcaaagcggacacagtctgttccctttggaagggtatccaccgcgcggcatgtgcgagttcagtttcaagttacttgccaatataacccgtgcacttcagaaattgcggtgaaactgggtattgtgtagtgtgtagtgtgctctgtaacgaatgaacctgaagaactcaaaccctgacagggcaatctaactattcctacttgacttacgagaaagagaagcctagacgtgaagttgatatatatttttttctcttttgtgataacttaaatgaccaaagaatatccttgccattttttttgtgttatgctagagcaaatggcttgaatttaattgagattaaagtaaaaactttactggaattattgtgaaagtgaaaaaagacccttttatggatgctgtcatcaatacagagcactcaacatgttttgtcggtgagaggttttaaaaatcttgctgcagagagatgtatcaaaattttaaaagcctctgcttcccctaggtagtatgacagagaaaatagaaacaagcactgagggcatctttaaatcttgagctcagagcttgtccagtgcttcttgatgaggttgaagaaaacagttggaaaaaggtaaggagttttaagcttagcttgatatgttgtgtaattttggggttgaaattactgtaatttttttccctccagtaacctcattttcagattttcctccattacaggaaaatcataaaaagtgatatttttacttaaagtgttttctaaaataatgtcctttggctttggcttgatgatcacttgaaaatggtttatgcaaacatctggacctgggttttctggcaaccttgacattttctctgttcagaatctaaagacatgagtgactcattcagttactgagaaatcttaggcaaagctaattccagtattgtaatatctatccttagtcctcaatgagaggctgaagttctgctttaagcgtaaagcatttgatgaaaggtcaaagtggctgctggaggggaaggctgttggtactcaactgggaggtggaacattttgcatttaagattgcctttctcagattttctgtactggattttcactgcagaaagaaggtattctttaagtgcttggacggccactgaatcctcaagcagatagacattctaagacccctctgtaagcttaaccgttatgtgtgtgacattagccttcgtatcttacagggtaaaacttaagtggcgaggggactgaggcactgaggcacggagagattaattagcttgcccaagatcacacagctgcaagctgagatttgaacaggtagcctttgtagcccaggctcccagccactgagttgtcttgcctcttaggaatctgttgcctactgtttaggctgccatttgcttatggaaagatctgatgtaaaatatagagcagtgatcctcaacctttttggtaccagggactggtttcctggaagacagtttttccacagacaggggtggggatggggggagtcgggggtttcgggggatggtttggggatgaagctgttccacctcagatcatcaggcgttagattctcataaggaccatgcagcctagatccctggcatgcgcagttcacaataaggttcgtgctcctatgagaatctaatgctgctgctgatctgacaggaggtggagctcaggcggtaatgcttgctgacctgctatgccactcacctcctgctgtgtggcctggttcctaacaggtccatggccctggggttggttgccccctgtatagagcatgttgctctctggtaccttagcttatgactaaaggaacttttattttgaagccataatgaatatggtcctttttctgaaacatttactgctagagatttatacccttcccagaatgtctttgagctcatttcagagctaaacattataatgaaaaccattgtgtagtccagcatccagaacttgagttgattcttttttttttcactgcttctaacttattcttaataataccaaacatagcaaaaggaggttgcaatacatttgtttggcaagtttgggtattgaattcttgagttttagtagagccaagcaggtcggtcactatgtgtcattttttggtatctagtagaacggtttatttagataggtattgggttcctctaaattgcccatttagttggtttcagttgatacggaaccttcactaggctttaggtctatcttgtaaacaagatatttttaaagaccatcctagattgagagcaatctatttgttgtttttttggagagcgggggtttgttctttttctcttctctcacaactctggtgttttccaccatttggctggactctggggcaagagtgggctggccgagggtgctccagtttctctcaccccggaacagctgcctgcctctaagatattctttggaagtctatcctgaagcactccgaagccttgcttctgcttctgggaggaattccttggaggactagaggcaacagggggcctaatctgttgaaacttgtgtgtatatttcagggttaataaatctcagctaagaaaattaataaaaattccactgtgaatgagaggttggtcagagactaatgtcttgaaaatgctttatgataacttggaagaatttgagcagatggaaaggagaaactttgttaaggtctccctgaaattagtcatcacttcttacaagcagatttcacaaggtgcttactatctatggtgtgtataatagggttgtcttattaattagtctgatgtttggatctggagaagtaaattaatgagtcaggttttgtataacaaatgatcactttttaagtaattagtgtagcatatgaccgtagagattaatattaactcttaaaatatggaaattgagactccgatggaaaatgtgaaagtgaagttaaaactttatctttttgcctatgtaacatttatcaagtgagaaagtgagaatgcctttaaataagcatttgattgaaagccattagaaggtgagaacttgtatacctttttttttttttctttgggatagggttttgctctgtcatccaggctggagtgcagtgatggaatcacagcttactgcagtggccttgaattcttgggcccaagccattctcccacctcagccttctgagtagctgggactacaggtgtgtatgccactgtgcccagccagttttaaaatttttattttgtggagacggggtcttactatgttgaccaactggtttcaaattcttggccttaagctattctcctgcctcagccttccaaagtgctgggattataggtgtgattcactgctcccagttgccttttgtgtttttttttttttaacttactgtaatacacatacagaaatgtgcttacatactttacatcagtagtacttaagagtccagcatagtagatgttattaatgaaagttgactcatggcaatacatataactaggactttgattccccagtttttttcttgctttcataaatctgtaaatcttacttaagaatgacatataaggaaaatatgatctccttccccttccttgagtgcagtctatttataaacaatagcacttggtgctggggtttgttcacgtttgtatgagggagattgtcttattttctgggatataatgcggagatctgtgctttttgggaagtgatggaacgttgatagtgcatccagcatttaggaatgcaagaacaaacattagagccttttgaggatggtgtcctctaactcctcttcagtccaacagccctgtgggtctcttcctgatcagcatttttcactaagacccaaacttatttcctgtaaaccaactgggccagatactcatgactgtctgtggtctgaagatagtagtttatgttttgttttttgttttttttaaattgaattgggtgtgttgttcccagatgaacactgttatcagggcctaaacaaatatttttgtcagggagatgtcacaattgtattattggaaggggattttctctcttagcttttaatttgcattaagaggtgtctgggctgtgggcaaaatagtggctaaaatgaccacttttatttgtttttgagtcagctattgctttttgtgataactgaaaactttagtcttttttgaaggactgaagtgttgagagtttcctggaatgagtggttcactagctgttgctgatcacctggtttattcttagctttttttgcattcaggagtcttagttttcccttgttctccaacttctgtaatctttaagaaaatgaaaggatatttagcagctctgatgacctgtatttgctggattgtaaaggccttattgcattttttatcccttctgtcttggtaaaagttcctgatagcagcagcttttataaaagtttgagcagaactaaggcaaggaggaagaactctaaaatagtgatttttgcttctcagttgttattagtaggttaatcaggagaggaagtaggacattttaactaaaatgggtttctgtttcagttatcaagccaagctgctatttttaagtttgaaaccatttttaaattcagacaggtttgaggattaattgtactgaaatggagctcacatctagtgctttagtgagtatagctaaatgtgcctataatagggaggaagtaaatcatttggtttgatgaactctgtcacttgaggtcatatcatagcttttctgaaagagtgccctgtttaaggtaattatattttatgcagacaggtggatagtaggtatctagtatatatcttttttttttttgagacggagtctcactatgttggcagactggagtgcagtggtgcaatctcagctcactgcaatctccacctcccgggttcaagcgattctcctgcctcagcctcccgagtagctgggattacaggcacaagccaccatgcccagctaatttttgtatttttagtagagacggggtttcaccatgttggccaggatggtctcgatctcctgatctcgtgatctgcccgccttgacctcccaacatgttgggattacaggcgtgagcctctgcgcctggttggtatctcttaaatatcttaatgttaaatttctaaatctaacatactgttttctaaagaagagaaagtactttagtttaaaactggacatactctaccatttgctgcctctatccaggctttgtaacctctttgctgttgacattttgggccagagaattctttcgtgttaagggctgtcctgtgcgttgtagggtgtctagcagcatccttgctgtctacccgatatctgccaacatcactgttctctctctgtacccctagttgtaggaaccaacaatgtctccagacactgctctcaatatcctctgggagtgggaatcatccctgttgaaactgtgttggctgtggcctcttctttatacccagtacatgtcgttagcacttctgtgttttaggaaggattgatcaaaaggccgaagctcaaaaagccaattagcattttttgatgggtgaactctattctttctcaggatgcctgaaattcacttacacatttaggattctagattgtagtatgttacaaaaaatttcaaggatagattatgttcataggtaagttgaaggaaaaaatggaagattcttataatggaacgtaaaaaaattcttttccaattggacgtgtgtattctgagaaaaacattagggtcaggtcattgtaaatagatcatcttttactttcttccagctgaattacaggttggcacttatccagatttattcctcttagcataggaagataagatatattgattaataaggtagtataaaaattgtctgcaaaaatgttttgaaatgtctgcagttttctcaggcagactgtttacttttcagtgtattgtttttatttctgttaattttgatgattctggttacaacattttaaatatcttcttgagatgagaaaaagcagggaaagaaactggaaaataaggagagtggatagagactttcctcctgatcatttcattttgtcctctaaatagcattttttacgaaagtggggtggaggtgggaggttagggaaagaatgaagttcttgacaaataatcttccttcttttgtctccaaggcctctggttttgaactctgctgagtcagctaactatgagtgaaatctgtctgccacctgtctttatagggccatgtgctaagaatggtttttacatttttaagtggtttaataatgtttcatgacatagccatggtcattcatctaccaattgtctctgaccactttcacacaacagtggcatagtttagtagttaagacagaaactggctcacaaaacctaaaatatttactctctggcccttttcagagtttgccaatccctagtttaaactatatttctctattgttaatattggaggcaaatagtattgttagatctgttaaagtagatgtgagttaattaaagacaaacaaaattctcgtaaattggttattagataagcattggtcaaactttgtgtttttagagagtggtttaaaacttgtgttatctacatgtttcatagatttccaggtatccttggggaactttgatgctagagcatcgacatgcttgatgagtttgtttctcttctttcacctgaaggttttgcactgtaggactgctctgggaaggaaggttctgggccatgaactaggcaaaattgatccatagcttcaagactgaaaaccatgactttatgactttttggatctgctgtaattcacagatgggcttaattctgagcccagtctgattgcttgggttagttagtcctgagaagggagagctcaggtataggtatcttcttcataagctgtaaatagaagatggaactcagccggtctctgggatcctgagcgttgctcagcttggaggcagggtactttcaggttgtcagcagaggtactggcctgctcttctgcttatcaaagagcagttcttgctaattttcatcattttcttcacttttaaagattatatgtcactttctttgctgtgttgctgtgacacaggctaacaccccatttgtgtcctcacagattttagtatcatctttaaattgcagtatactgagtccgaacaaaatgggggtaatgcgtctcatcgagtagtattaaggttagtgttaagtagagttttttaagtatttgtttttttgcatttaaaaatgtatgcatttgtgtatttttcacatgtaaatggatttaccactggcctcctttgcaggtggtgcctttggaagtccagagaaattaaatgctttttccaagagcagagaagactctaaatttgaccctgtcctatgttcttgctggtgcacttcattggcttcagtgaggagtccggagagctgggactttaccaatgattttttttttcttttaaacatgtaaaaggtataaatgcacatagaaataattcaaatgacatagaaaggtacacattgacaatagaatccctctcccttttttccccatctttagtccactcttctctgagtcccacttctgaccatttctttatgttccatgtgtggttccttctttaaatatatgcatatacctctgttttgatttttgtttcaattttgagctattgtttccctttataagagatgaagaatttaactcaataccccctactcttcccagtttttaaaaaagttttgtattcaatttctgtttgatatacattaacagctttcaatgatgtaattgcatttgttttcttgattcatcaactttaggcctaaagtgactccccactctgtcagtcaaggaatttggtacttctcagccttctcccactcaatttctcttccttctcatttctcaccctccctcagccatcagtttttttacatcaacataccttatatcatctacatttcattctgtgactgaatgtgttatgtactctgactataggttggttacaaaaattgaaaaccagtaaacaaggatacggaattttaggtaggaggaataagttcaagagatctattgtacaacatactgattataattaataataaagcattgtagttttgaaaattgcaaagagtagattttaagtgttctcaccacaaaaaagaataaataagtgatgtaatgcatatgttaattagcttgatttagcattctacaatgtatgcatttttcaaaatgatatacttgataaatatatacaatttttatttgtcagttagagctcgtttggaggttccagcaggggagtgcagctccttgtatacccttgaccgaagacccgtcctccatcagggatggtcatcctctacgactgagcatgcagcttcaggaggggctcacatagagtggtgagggaggaaggggacacccgcctagccagccagatcagccgaatcaaccctggcgatcaatggggtgacagatttcgcagccagatcgccctcacatcctatttgtcagttaaagaaataaaaaatgttaaaaaaaagaaaaccagtacatagtgttttcaattttatgatattaaataccatgcagtatatgtcaggtagtttggcttcataagaaggagggataatcttgataattacacctgtgccacttgaaggaaatattctgagcattagagcaagtggagtctcttatattccagctggtgagaatcatgctatatttcagtttccttaacttctggaccatgacttcctgatatgtagtttttgttttttctgtctatttctaattcctttccctttttgttagcgtcagaggaaatagaagttattgattcctgtctcttgaatctcattatttaaaaaatcattttacaactcattatgcaccaacattttggtcccttgtgcctactcaggattgaaagtatgaagttttgccggttttttttttttttttggtcgttcacaattactgtttcctcaaactgccatgcttcttctagaactgatagtgctttgtttcctttgtgatgagaagcctttcccttcagggtgaggacttcggggctgaagatgtactttgcagcagttcccttctgtttcttcataccacagatgtagaggaatgtggcatttatgggtcctggccttggtggtaacattttacctgtagagcatcggaacattgaagcctgagaatgtgaatcattcttagaatcattttctacataaagtcctgaattggtgtttttagaatccagtgaagcagtcattcttttaacagtcaccagcattccagaaaagtcatgaaaaattcaggcacagaattgtagagtaggctgggtccttccaggtcaggtaatttttagtctttgatttttcagataagggcaccgagtcacacataaactagacctcagcaatttgcccagtcacaggatacctgggacatgcatcctgacttataattcactggccttccactgtactatacccatatccaacatatatttgaaaatttactgggttaggtaatatggaaattgtggtagacatatgttacttgttttgaaagaactttttagttatttagggaaacaaaactgccgtttgtgaaactattagagccagttaagtgctattattcattagaagttaaagaggttagaatgttgcctggcatatagtaagtgctcagtaaatgctagttgttaccaatggacagagatttgtagcatacctattatgtagcaggcactgttctaggttctgggaatacaggagctaagactaaaacaagagtcaatgatattattttacattcctgatataaagacaaaggccttaaagagaactcaaaaacagaaacaagttttggtgatggcctggcttaagttgactaaaggagagggtaaagaagctaagctttccctatgggacgatactttgaagggagaaagaaaattgctagtgtaaagtacggtgcttatgaaggctttgaatcctggaggagattggcttgatttagaatctttggtgcctgtgaagagtagttgggaaaacactgtaggtagttcaggatcagattgcaaattgccctgagagtttgtctgaagagttatgagttagatggtagtgaatcactccaagttattgaatataccaggaagctgcttgagaaaagcagtgtgagagaattaattttgtagaaaatttcagacctggaaaggagctaagagaatattcaatctagattattctggtagctgtgtgtaggaagattcaagtaggaaggcagctgagaatctgtttgaggtaatatagacataaggcagtaaatccctgtaccagtattgaattggctagaatcgggaggatgaaaaatgtggagacattttgtaaagagaaagaccaaagctttttaacaggtttgatcaagggtaatgatgagtggcttgaatcagaaaatttctcctacctttttccattggggtgttggagactggttgtactatttgcagaaggagatagggacaagctgatctggaaagtcaagttcatttcatttatgatgacgtggatgttagtggaaataatcaagtgggctggaaagccagtgagagatcagggaagggagatgctgatctggtagtcatcagcatagccgagaatgaatgagctcacttggggactgtgcttagtgagggcagggccaagtacatttctgataaccaaaagctgcacatcttacattaagaatattttgtagcagatgttaatgaaataaagcagcttgtgttcaaattgtcagaaaccagcagctcatggatcagcttacctaagaaaagataagatgatcagaaggaaggatttcaaagaagcgttttagtagagtttaaaaaagacccttctcatctttggcacaaatgataagactaaattattttttttctgggttaagacagaacataaattgtgtgtgtgtgtgtgtgtgtgtgtgtgtgtgtgtgtctgtgtgtgtagggaggatgggcagccaggtggtggagagggagagagagatttattaaggatcaaaatgcaacaccccaaatagggggctgaagtttgaaagttgttctgaaagtcagacagatttctgagaataccctccaaactgcctcttgttgatagtaaagaaaaactcccttctgttgggctggtaggtgaccccatgaactggagaagtaaaaactgtctttgaccctgggctacctctggaaaatttgtagggtcaaataacaacacttgatgtataggatatttcttgctacttttaggtagaagatccaaccaataattgttttaaacaaaagagatttgagaagaactccagaaatttgtatccttaactcatctttgataaccaatggtatgatatttagaagtttgctattaatgtatttttatgtattatgttatgtcttactactgcatttgttgcttctgtgtctcaccttgcccttgtagaccagttgttacagatggatttttataaagaaaggcaataggaaagaatttgtaaaactttagagtctgtagtgcttgtataaagagtagtttggaaattcagaatttataataattcagatgagacttgcctaaatacctgtcccctgtcaataagaaatagaagggacttattcaggagatgattagtataaataaggttgaaggggggttgattatctacttaatacaaccctgccttcagaggctttccaaaactatttctgtatgaaaaacgatctcagacatgtcagttgcatttattttaataggccaacactgtttaggttgattactgacaattattttctttttgttttgaaattgtttgtcaaaattacttgtttaaaattataagatgttgacagaacttttgttagcatatcctaacatgcaatacatggcattaattcatggtaaatgtgtttaggtagtgtgaatggatagtgcctagtaaccttgtgtacaaagataagcatttgtcaaacatgtaagacagattaccaacatagaccagcaaccattgcctatatgatgtgttaacaacatgaccctgtttagctagctgagaattgttaaggcctgaaagcatatcacatgaaccttcatgcaagttcttgggtgggatacactgttgacagattctgtcagagtgctaagcataagaatataaattaaaaataagttttagaagtaaagtcggtgtggtttttaaaaaaaaatcctgcaaagaatagtgttccatagaacagattgggaagtgctgaattaaagaaagagttctgttagtcaacagttaatatgtttagtgccacttaattgcagttattaaatggatttgtaagtaataaaactgcattttattaaaattttataatctacacattttgccctagttatacacccttcttccactcacttttaagtggttatctgttttgcatagtctcattttatgtaatagcttgatgtctaaaatgttgcctcaacaggaggtagtttctgtgcagccatattgggctggtgcagatagggccatatggttctaatctaaacatacatctggaaactcatagggtggagctggtgctgtctcctggaacctgtagaaaacgtcagcaactggagtcctgaccacatttttggaggagggtggtgagggaatgagatgctattatttgaggtcagggcttggatcctgtgtagtgattctggcagctactaagttggtggcccagctgcagtagtcatgagtcccttgagtgctctgccagaacaagggatgttgggcttggagtcccagcttttcccttcacagtcatttggcactcttacctgcatctgagcagcctctgttactgtcatacctaggcaggtgtgagatttatgaaaaatgatttgcctgggcaaagagtatattgcttctgcaatttggtaaggtattctgtagctacgtattttttgtgctcacatcgtgagggcatttatttctttgaatggacaagtggctgcacaaagacaaattgcacaatttggaagaaattcaggcatgttaggctctgagtctggaaaataccattaaaaggttatttataactggcttgtggctcattgacagacaggtggagatacatacagaatcgtggccacagccccagttcacactctttttggcctcagcactacacatcttaaggggtggagtgggcgcttggagggttacctgtcattttatcaagcccaaaagccttcctgttaagttccagagatctgactaaaggcagggtttttctgtagagattgaatagtggttgactgaccagggactgcagcaataacgatgacacccctgctggaaatacagactctcttttaccaaatcgcagttcctatatttagctttaatgcggcgcttcttaactggggatgtgtgagaatcgcctggtgagccattttaaattataaaaggcagatctctgcgcttttctaggtaatcccatttgttcccattgcttgaaattcatatttattctggccactcaagtttatatatttagccctgacttctctcttgagttccagacttgcatgttcactgacaccaccattcagctatctaatagtttcagaatataacatttgcccttctgtctcctccccaataactggcttgtgggcctgttcctctaaaatgccacccataatcctcccccttgccctagcaaaaaactcaatgccaattttttttcctttcctgcccctcccattcctaactcatctttcttgtcattctttcatgttccttcccttcctgtccaagctaccatggcttttacctggcaaactgcagtcttttactccatatgccctactgtggctccagaatggcttaaaattttttaattgattgattctaaaactcagtctaagataaagatgttgatgctgctttttctgaaaattactttgaaccataaagggtgactctgtcttttcttaactcctttattcaaagttaggtgtagagccttgttagaccaaattatgcccctggaagacagtttatgaggttgcacggcctcaccctccattgcttgggctcacagctccttagggtcatggctctccagctctgatgatggagatttgggcaagaatttctctaaaaaggactaagcataagaatataagctttatttttatagggccaactatttgctaagtatattagtttcttattgctgctatcaccacaaacttagtggcgtaaaacaagaaaaatgtgttatcatacagatctttaggtcagaagtctgaaacaggccctactggactaaaataaagatgtctgcagagctgcattccttctggagctccaggggagaatctgtttccctgccttttccagcttctggaggctgagtgcattccttggctcaaggctgccttccagcaatagcatcattctgatttcttgtgtcctcacatctccctctctggcctgactcttccattttcctcttttccttatgattacattgggcctactcagatattctagggttttcttcccatctgcaaagccttaaaattaattacatcagtgaaattccttttgtcatgtaaggcaaggtattcacagatttcagggattattaggacagggatatctttgactaaacattattctgcttactgcaccaggcgctatttaaatttacttgcatatactaactaatcctcataacaaccctatgagttaggtattattctccccattttacagatgaggaaactgcagcacagagaagttatgtaactttgaacttgcccagagttacatagccagtaagtagtggtgccagaattcaaattttggttggcttcagagtctgttcttaattatgacacatactatctggaggtgcatattgtagtacccttcaaagtgatttttcaaaagccatacttttactatgtagcagcagctgcaataatactttcttcactgcttacttgttggcaggtcctgtgctaaattctttcacagccagtccaagcaatggatattagtatctgcattttgcccatagaaactgaggcccaggattaagttacttccccaagatcacatggccaataagtgcggaaactagtattggaagccagatagcctgaacaggagccaatgcttagccattaagctgaattgcttccacctttatctggtgaaggatgtcattaaagataaaggtaatctttgctcttacatggtgggcacatttgatgacataatcagagtccagaaagaacttgatgtgttggagtgatatgttgaatctaacacaattagatttgaaggaaaaaaaaaacataaatgaaaggtggtatagatcctaagtttcagatacatgcatacactttggggtaaagttttgtttcttttgaatgctgctatcggtgggtatattataaacatatatatcttctacagctcttataactagaaacttgatttggttgagtgcagatcttatatcactaccatgataggaaatagtccagaattatcttggggttctttttccaaacttccttcactccccacaagaggtgaaaataatagtctcttgagccaggttagtgatggtagtgaaaatggaaaacttttgattggactgtacagaatccataatctttgctctagaaagggagccacatattgtattctattcaccaggtcatggttgtcatcctgtggccaacgtgggtcccattctatgttatttcccaaacagcccatgaaaaccaccctattaattagctctttccttcccattcttacctactttttgggatgcagtgaagacttcttttggattttctttcttcaaaaatggtgtgttttgtttttatttgtattatttttggtgtgggtttgtatgccaaaacattgaatacttagaaaaaaatgttacatgccatttttctttctttccttcctttttttctcccaataaatacctaaggtcctgctgtgtgctaggtaggtaggcatcagggtacagtacattgagtaaaacagctatggtgcctgttgtcaatatagggattcatttagtgaggaaaagagggaagcaatacatgaataaaatagataattgtaataacactgtggaggaaacaagaaataaattgagataaaccataacatgaggaggcctgttttagactggctggggaaggctatgcagaggtgacgtttggcatgagagttgaagcattatgtaaacagagaccatgtacaaaggttttagggtagggtggggaggagctggcttggaacggagataagatgaaggtgaagctaagttgagagaaagagatattcagtccttactgactgtggtgtacaatgttttgattttgagggtgcctaactaggtagagattaaagccctttactggagatctgaggactgtaggtgtctttttgaggaggatgatttttggacttaagtttgaaagccaatttgaggcatcaggcaggtatttgaatatatgggtctgtttttcaggggtgaggtttcagcgggagatacaaatatgggagacatcatggaatttaaatcatggagtggatgagatcatgtaagagagtatagagaggtaagaggctcaagaagctaaccttgaggtgctctaacatttagagcttgggagagaaggagccagcaaaggagactgataaacagttggcaggaggaaaacctagggcatgttgtattgggaatgagtaaagaaaacatttccagagggaaggagtgctccattgtgcctaatactccctgagatgacggataaggtaagggcagagtgcttttcatcaggcttgaaacatgggagcctctgggaactttacaaggtcagttttggtggagtggtgagcagatgctgattgtaatgggcagatgaatgaatgggagtttgtaaggaagggggataatgagtagagagaaacttttgataatcccggtacatgaagtgggtggggccctggaggggaatgggaatgtaagatgttttattcagggttctccagaaagacagaactgataggacacacacacacacacacacacacacacacacacacacacacacatgagaagggagttattaggagaattggcttatttgattatggagactgagaagttccactattggccatctgcatctgcatgctggagaaccagagaagctggtagcaggacttagtctaagtctgaaggccttagaaccagagaagccaatagtggagctcagtccaaggtggaaggtgcaagagcccagggaccactggtgtgagtctggagtctaaaggctggagaacctggagttctgacatccaatggcaggagaggaaaagcggccaggctcttagagaggatgagaatttgccctttctctgccttttaattccatctgggctcccagttgattggatggtgactaccacatttagggcacatcttctccacttagtccactcacacaccgtctcctctggaaacactctcacagatacacctggggcagctcaataattctaatcaattgctaaaccacctgggtttcactttgagtagataaaggatgggcccagtgcctactgaagccctgaagaataatcagtgtttgaccagctatctggatattcattaatctagtcaagttgaaccccaaattaaccatcacatggggttaagcacaggagggtggaagcacaggagtttgacttttttagatgtatatagcatataataaatattaagttcaaccttacgaaattggtgatatttgactatgttttacctatgagaatggcattttcgtatagtttgatctaatagaacatgttacattactgagaatgagttgcttttagaagtggaacttgattgagcaatattgagagggtttaatcaaaagggcaaagaacaaagccttggagcagttgagataaatgggattgttgctcggcagagggttggcctttgaagcagggagaaggaaaggcacacagttttccaggaaggcaggagaagatacacagattcagccatgctggaaggatcacagtgaggccaataccagcgggtagtgtcctatttgaggcaaataattatgtaataaatttacggatttagctgtagatacacattgattgattttgttcataggactgagtggtaactgagcctgttctaccttgtggtagactctaaatttgttctctcaaaggtatttgatatgtgattttttgcttggtttttctctttcactaaaagcggagtaaatcaaatatcatgacctccttccccactcctgagcggtgcaatgctgtggcctccctgtagaactgattagcaaatcaaagaataaagtagttttctcataagtgattttcttgccctacagaaaattgtctttttcaatgttactataagtattctttgacttctcagcataattgaagcattatctatgatttctgtttctttaatgcagactacaagtgcatccttttaaggtcattccactcttctctgtcacatgtacagaatttgcttatgagggtgttcatttcaagaatttcacctgtttggagggagactttattccaccgcataatataattttaaaaatgatgttctttagaccattgtgtgcatatatccctaggccataattttctccatgtacttaattcagtacagaattccaggtactgatcattaatgatatctttaaagctaaatgagattgaaagtcatctttaatggctgtaggatccttttttcatgaactaactcctctagctaatgtttattttgaataatactcttatccatggattatgggaccaaagccataataaaaatattcccaggaagggttgtcttcttattcagtgtgtacttgttgagctataggcagttttgctgtgtatatggctctaaaatgatcttttcctcaaagtacagaaagatctggagaaatgtgggcactcatgtattaagtttgtagtattataatattgtaagtataagataaaatgtggtatttttttttttttgagacggagtctcgctttatcgcctatgttggagtgcagtgatgcgatcttggttcactgcaacctctgcttcccaggttcaagcaattcttctgcgtcagccttccgagtatctgggactacaggtgcatgccaccacacccagctaatttttatttttttattatttacctatttttttttttgagaccaagtttcgctcttgttgccgagcctggggtgcaatggtgcgatcttggctcaccacaacctccgcctcccgggttcaagtggctctcctgcctcagccttccaagtagctgggattataggcgcctgccaccatgtccagctaattttgtatttttagtagagacggggtttctccatgttggctaggctagtctcaaactcccgaactcaggtgatccgcccgcttcggactcccaaagtgctgggattacaggcgtgagccaccgcgctcagccgctaatttttgtatttttagtagagatggggtttcaccatgttggccaggctggtctggagctcctgaccaggtgatccacccatctcagcctaccaaagtgctgggattacaggcatgagccaccgtgcccggacaaaatgtggtatctttaaaagctctgtggtgatggcattttagattaaggtaatgttttattttatgaagatgtgtagctgtactgctggcgagatgaatcaacatgttctaatactgcttgtaataagagtaacttgatttaccattacctgctgtggtaaatttgtatcttcagtattggaattattcaacagaatctatcagaagggatttcaaaagctgcagtctgtggtgttgtgataagtgaagaaaagcatttcccctatttcagacagcctttgatagcatatgtatttaggaaaatatatacagattcatcaactgtgtacctgactcaaatatttttagcttctttgggttgaactttgggttatgccaagggatcccctttcgtcttttcatggagaatcacttgtaaccaatgttgatgtgcacttacaaagaagggtgtaaaggtttataggacgatactactcgacagctttgaggatctggaatctacatggttcaactagcttctctatttgagccctgaactagtgttgcactcatctcccatttcctttgctttgccatttccagttgtaaagtgatgtgtgctccctctcttgcctttcactggtgcagtggggcttgtctttcaggatgggacctgtgctaaaactttttcttgtctctgtgtatgctgataaacaggctttagagttctatcttgtggtgacttatcaccccaccccatcttagagatgacaattgcctttaaaggactatagttttaatgtgtagagggctctttctgttatgtgcttctaagtagagaggcctgtgagagcatctttcaggtctgagaaggtacatggctgtcttgtgctcctttcttctctaacatcaggctgtagatattcacccctagtgttgtattgcccccaaccactgccacccccagtgatttgctgctaattttggctactttttttttttttttaattccaaaatctgttgcagtctcttcggacttctgccaattctggcatagtttgctcaaatgattggccttttcttggtagatctcagtctcttaacttctccctttccccttgttgaactgaccaataacctgtgagtataaaccttatatcttgtgtgttatatggtctttcatattttttcctaaagcatatcatgtcatacatactatttttaaactgccttttcaccacttctgaaaatacctttccttactttatcttctgaaaatacctttccttacatttctattttaaaacaatttatatttctaaattttcagtggctgacatcccttccatgataatgaatctatcgtttgaccagtcccctacttttgggcgtttggatattttctatccttttctcttttctcttcttccttctttcctttctgctttcctgttatttcctggtaatgagtatccagagttgtttgttcaccatgcatgtagttttttaaaaccttaatgtgggttttttgaggcttttgctagttataacatcaccttgtgtgttcaaagacaggggcccgtatcttatgcatgtcttcctagcatacatgcctgacacagtggccattcactaaagaattattgttgagtttcagaaatatgagggccatttgacaaataaatgagtaccttctatgtacttggaacccaggatataggggtgaacaaggtaaagattgtccctgctctcataaggtgaggtattattttgtataacgaggtttatgttacagagatggcaaccctcttaatgtgaggatcaatgaaaaaaatttaagacacacagtatagcaaaagcagactgaatgacttcgggtatggttacttgggagatgttcatgcttatggctgaattgactaattgatttttccatagatgatatttcttatttaggattatccactagtgttaagggattgagatggaatgatctttttcaagttcatacttttttgacccttgtgagtaactccagtcaattatacttaaattaaaaatttcatacctgaatataatatgctgttgtacagtgattccagggacccaaagatattttaggactgagtttggggggaacagaaatatttcccaaaatatttttggtctttctgttgcacgtcttaaaatatgattaagcaaagattgcagccgcggagaagattttctgctgtaaattggtgtttcaaccctgccagctgttcatgctttctgcgatcccacttataaaagtggaaagtgaagggtgagtggctgccctcgtaggcaaccacataatttaaaaaaaaaaatgtgtatgcctcagcagatctatattagtatttcatatagctgcctttttcttttttattgtagggccagctctcaatgttgcaagaaaaaatagaccatttggagcgtttgctagctgagaataatgagatcatctcaaatattagagactcagtcatcaatttgagtgagtctgtggaggatggtccgaaaagttcacaaagcaatttcagccaaggtgctggctcacatcttctgccctcacaattatccctctcagttgacactgcagactgtctgtttgcttcacaaagtggaagtcacaattcagatgtgcaggtaatgtatacattcgttaataatcactggcctttttttttttttgttctttttaagatttgacctgatgtctgttctgacttggtaagttgcttaaactctttggattctagtttctctttttgtaaagtattttgattagtcacatgaacattaatgttctgtttagtgataaaattccataattctatttctctcagtttatcttactattttatacttacgtgaatacagtctttttgtatgcttttcaggtcttattttctgtaatagttgaaaacctttaaaggtttaaattttgccagagatttttttttaccttcctttggagaatacaagaaaatccatgttcttattatatatcagttgtacattatagattttgtacaaagtaaggttagactttttttttttttttcttaatatccttttgcaagagggaagggaaatattctagagctgtactttccagtatggaagcccctgtctgcgtgtggctactgagcacttgaaatgtgactaatgtggcttgagatgtgctgtaagtgtaatgtacacacacagtgtttcaaacttagtgtgcaagatatcttaattcatttatatattgattatgagttaagataatattttggatatactggattaatgaaattttaaaattaatttcaactgctttgttttactagaaaattaaaaatttggtttgtattatatttctcttggacagcgctattatagagggcaatggagtcgaaaaccagcattggaaaggacttctgcctttcttaaactcagagtgtttcactcacattggctctgcaaattagggcaaggctgtgtttaaccttgtgccttagaccagaaactggattttgggggaaggatcctaaggggtaaatattttaaagttggacaaaattatttggcttctggcctcgttttcgaatatgtactttccactaactgctgagggcagagaacatgatatgatcttgaggtcgtggctcacaggccaagctggaagctggggacagtggagctggccaggtcttgcacctgcaacctcatcagctagagtgtagccagattctgataggatcagaatcctgtgcttacagggatagctgtttctgtgaggtttggctttatttagttttttgttgagtacttcttgagtacctagccttgttgtcatccatgataagggaacagcaaaaaaaaaaaaaaaaaattatttttgttgtgtggtctaaatctgggctggacagaaaggagttgcagagcaaccatggaagtcaggcagagcaagtcaggagggtactgggagagctgcaggactgaaggaagaaacagacactgctaacacatcctcctgcccagcttgtttccaaagatttgtcagcttatccttgagaagattttattttatttattaaactcatatattccatagggagataaatattattggcttaaaatactttgtattgactttcatataatttgtttggcctttaaattttttttataacttatatttggatgtgatttttgcagtctagttttaacataatttaaattttacaaaaggttgtttggttgtgttgtcacatttaatattatagagactatgaagaacaaaagtaaagttttagtttttttcccaccgttttttcctttgcatcccaacattattagccagaaggaatgctgcattgaaaagctagaaaacaataggatacataaaagctaaatctcaattttaaaatttttctcaatttttagatgattatgcctggttgaccctgttgtagttttacttctaggataagataggtagatataacatatgctacatggaagaatagctatagatagatatatttttgttcaggcatagatttttaatatacatgagatttactataaaataaagatagcgcaaagtaaaatatcattttcagaactgtttttgaaaatgctgaaatatctggtcataatcaaatttcatcagaaatttttttcatggttctttttctataaatttctattaaattgttttggaagtaaagtaggagaagaaggaatagaatgaacttttttttttattagaagcggatgggagggattatttgtcagggtagttttgtagcacaaatagcatttcaagcctttgaatggtgatggaatattttctactctaaactcctcaatgtctacagaaatagttttattttataaaatacatatgcagagtatagcagtgaataattttgagcaaatatttaccaacattaaattaataattgttaaactttaattttttttcttttacatttttagatgttggatgtttacagtctaatttcttttgacaatccagatggtggagtttggaagcaaggatttgacattacttatgaatctaatgaatgggacactgaaccccttcaagtctttgtggtgcctcattcccataacgacccaggtaaaatttgcacttcaaaaagacaggaggttattaagtttctttaggcctagagtcttttaatgagaatctggtagaggccacttctcaaatttttgagacattattctctgacttttaacattaatatattccttttatgtgtcattatgttttagtgttctcattttatcagtttatgtgccattcaaggatagtatctgtgcagtatgaaatggtaataaacaaaaaagaagggcttgcctttggggacaaaacagtatatagttttaagagactgcttgttcattttagtaactttttaaaaaatattgcataggaaaattatttcatgtctatgaggtctacttttagaaaaggcagaatactcatgggaaagtttgaatctttaaaataaagaagcagtattaaatgctttaagaaccttggtgttgattggtttcaggcacatacgaatgtgagtctcagctctctgtatttatcagtgttagatgactttaggcaagttacttaatccctctgagaccaagttttttccctggtagaatgaggatagtagtatctgtttcaatagggtgcaaagtgaaagaatcatgtatggcacaacagtagctgctatcattattgttactgcatatgatggcgtttatttattgggaccacagattcctcccttcccccacccctgaccccgccctgccaagatgaggggaagttgtttcaattataatgggacataggatttgatatacatatttgttggtttgagtacccagtcacagataatttagttgcagcatttttttttttgtggggattggagaggggggtgtatttccaaagacttattttgaaggagtgtgttacttttcttaatatctcgatttcatgattactgtcagaagcactggtaacctaataatttgaaggtttttttctttgcttccagcattcatttatcttctacttacattttttccccattagtttattggcagatattcctatttttctattttgaagacaacaaaatatgttactttaggtctggacacatgatttagtgaagcattttttttgtgcgtgtgtgctgcttttggatgtgagaggtagtctgcaagcttggatattgaaatgcttggatttctagactacagtgcaatatttagtgtgcactgacatgtaaaatatatgaaatcaatattctggaaatttgtgatgagcagttattacacctcaccttctgacttgatttccctatctttgatcttaatgtctttatcttttcctacatatacctgttagtgttatgttttcctcatatatattttagattgtctttctccttaatcttagcctgtaccttttaaatcaaaactcagggaaggctgggcatcatggaaggacttcagggatttggagctaggcagaatgaggcaggtatcttggctctgcggtgtattgcctgtgtgtccttgggcacattgatttgtgtatctgtaaaatggagatcatacaggtggagtaacatcttaagccagggttagttataaagtaattataaaaggtgatgaaaattacatgtaatccaaatttctttgctatttattcacttgagtgcagattagttagtatatttgcatttaggggatgcatatgaaaaacacgtatctttgattactagactcacactcagtgaggtgaggtgctcccacttaatgtaggatctagatggcttatggcactgcagattttttttctctataaatctcataatcacttgactattcaattattgagtgaaatggtggcagagccacttgtaatatctaagttgttctcccttctctttctgccaatcatgtttagtttaattcttgttacttaattgggagagtgatgtgattccatagtgtaatcttccttgtaggcttataaatatacttcaaagtgtgtcttgtgagtcttcctcatatgaagcccacttcttcccttttcttgattttttaaaagacctttattcttttcctttttctgcaacttttaattctcaccaatctcatttcttgttattccatacatgggcacttaactgtaataataaaatccatggtttactgggcagaatgccaaatgttttacaaacatttagtgcatacgcatgaaggttagtgccatgattcacgatgaaggtgttaccaggttacatagctaacaaggggcaccagaatactttcctgacaatttacctggatctcccactaaagtaaattctagcggcaaagaacatatgcctcctattaaacacactctcctcatggcctagctgaacacttggcatatagaataattgccaaataaataagacctctttgacctttctcaaagcccctccaccacatactcatactgcacacacacgcctccacgcttgcaggtcttcgcagatgtaaacatttacagcacttttacttggtctcctcactagaatgttagctcattaagggctggaactttgttttattcactgctgtgttgggaatgcctagaatcataactggcacatggtactgagtcattagagtttggttaaataagttaatgagctaatgaatctgactcttcaaactaggatgaaacatttgacttattctttggcgtaggcttttcttttaagttccctccttcctgatggctacttatttctattcttaaaaaaaaaaaaacttatttaaagtactcttttgtaattttatgtactaaaaacaggcaataataagctctttgagggcagggattgccctcgatttttagattttttgtttgtttgtttgcattactattcctgcttagttagtaggtcatcttctgagtagacatccctagtaagtattcctgactataatctcttttggtatcctagtaactatagctgaatctttttgtcttagtaaaagatgttaatgaccctgactctcaaacccttctccacttggaaaaaataattgtcagaaacaaacattttaaaactacagtgatttttgctgtcaagcaaaatgctagagagaagaatccactgacttaataattttcactattccttaacttaacaaaagtaaaatattgacaaataaattattctgtgaaaaactgaattattcacatcatgaaaagccattcttttttaatagaggaaaaagagaaaagtgtgttcacatacactgcaagtcaaaatgtgacactataatgggaaatctttgtataatactcctaaatgaatgtgcaattaggcagtgttctttctaaatgagatttatagagatttgtttgcattttctgcagcaacaatttaaaacaagctttagcatagtagtttgtttcatcggtggattttcgtctattgggaatagaaatatttgaaatagatttttaaaaattttctatatttagttccccaactttgtgaatttatgttgctgtgtttttctatatatagatatttttctttttggactgagttggtaatatctctcaagaaaaggtaaatttcaaaatatgtttgtattttaataaaattccaaattatgttacagtctgaaaagatctaacaattgtcataaaatatttaagtgttttacatgagtaaaaactgaattggaaaagaattgtgaagtaaatgctgataactttgtactgttatgcttttgaaagttttgaatcatagaccatgaaattaaatgttagttgattgatacatgttcatgttgtatttaataagctgattaaaacacaattacagcacctctgtatctataatcttaattctttgcttcccactagttaaactgctgaaatatttggttaattttacttcaaagaagtcacagtgtgtggagagaagataaggtatactaaatgaaagattggacagcatattgttagttaagcaatttgtgaaatgaacattagaaaataatcccccttgtggtatgactctaaaatagtaggaagacctaggcccaagagttacactggaaaataattttcttttgtacatttgcaattcttttgtagaactttttattgactcagagggtgattaggactttttgcttttttgtgtgtgtaaaattaagaaacagatgtttgcatttagtattatgataattatgtatcctctaaaaaagtttgtaaaaaaagaataaaaacatgaggaaatcagtgtaatatttccaaatatttctattcaaatattttcaagtatagttagaatttgaaaatagttctggtcagtcatagttggctaatatctctattaggggtgtccaatcttttggcttccctgggccacattggaagaaaaattgtcttgggccacacataaaatacactaacaataggtgatgagctaaaaaataaaatcgcaaaaaaatttcaaaatattttgagaaagtttagaaattcatgttgagatgcattcaaagccgtcctgggccacatgcagcccgtgggctgcaggttggacaaacttgatgagaggtggtggagacttagaagtctggttgctaaaggaactttactgatcagaatgagatggtcatcggaaggagaagttgtacgtgaacactgtttggagagtactttatttggtttagctactgcaggataaagtggattgtttgattttggctgccatgatgggaaattttagtttctggagctaaaatcgtatgcggaacaactgagttctggcatttattgcctgtacggcatcaggggagttgcaggtctttgttattttttactttgtgtgattttttaaccctgaaaagtggtaaatgaagccacatttaacaggtgagggcagcgaggctaagttagggtaatttgttcaaagtcagttaatttaattataaattctcagaggttggtgaattgaagctcaggattgcctgattgtaaaatctgtgttttttccatttacctctttttattgcctcttaagatactttatttagttcaaattattctatttcttttcttcttgtgttgtaggcattagctaatttaacacatttatctggactttgggttattaatagggttgtcagatttagcaaacaaaaatatagaatgctcagttaaacttgaattttcaataacaatgaatagtttgtgtgtgtgtgtttgtagtttgtgtgtgtgtgtttgtgtgtcccaaatatcacatgcagcatgcttatactaaacatttatttgttgtttatctgaaattcagattcaacttggctgtgcattttatctgacaaccttaattgttaagaaaattgtagcacttgagttaaatggcgctgtatggctatttagaattctgtttttagagatctctaaaatatgtgtattgagattctgttttagaggaagaatagatggtttggtctctcattggactttattctttgaggagcacatatgttaagcagctgctgagaaatttagatgatcattaaatagctcttctttctcctcagtttcagttacctttgtctgtctttcaagcctgggtgcttcaaaactctccagtgccctggtaatacaaataattactaacacttagggaattattatgttctgtgcactattctaggcattttacatatatcacatccattactcctttcagcaacttcatgacagagtctgtaattaccctcccttcatagatgtgggagaagtggcaggagagagcataagtgatctgttcatggcagggctaggtttgaaatcaagtgatctttttccagaaccagtacttgtaacagtttttaacatattgcgttttttggataattcttctgaaaccacaggctgagcatataggagggaagtcttttaagtatttccaagccaaatgtcaactactttagtattattaaccataaaaaagatttttttcagctatcttgcaaaagtggacatctcactgcactatctcctatccttcttttccttctgatttatcttaattgaaatgaatgtctctgtccctaaatactatattagtacatgagatagtgagtgattttcctgattgccacattttctacaattagaaagtgatttacaagcaatattttccagcttttgttttgttttgttttgttttttgagatggagtcttgctctgttgcccaggctggagtgcagtggtgcaatctcagttcactgcaacttctgcctcccaggttcaagcaattctcctgcctcagccacctgagtagctgggattacaggcacacgccacagtgcctagctatttttttgtatttttagtagagatggggtttcaccatgttggccaggctggtctagaactcctgacctcaagtgatccgtccgccttggcctcccaaagtgctgggattacagacttaagccaccgtacctagcaatattttccagcctttaagttggtttcttttagagactttgataatttgcccagtatttgtctaaagctaagtagccccctcgtgtaccctaagagtaacccaccaaagaaagtcacttttctttctaacagtgtctgtcatattttagacagttttctcattatttcaaataaccaagctctgtttggggaagacttactatgcctgaagtattgtcagtcagtgttagatgctcatagatgggatcattaatgagggaggggagaagctttagcacagatttagaaattatcttggagattgatcacacaattgcagctatgagaaaaagtatgcaggtcttctaaggggcacttagaaaagcaatataataaggggtcacagttgtacattgtacgtatagggctgcaggatgaacaaaacgcctgctgtcctaacaataatgcaaataggttcctctggtgtggggtaaaatttccagtgacagcatcttcatatggattcaaaaaatgatctctctcaaatatcttcattgaattaaagctgatatgcttagaaaactattaaatgacactgaatcaactgagaaaaacaggttagattattttggaaacctgggttcaaaagcatttagaggcatcagcaggtttctaggttttccaagtctcacagatctctggaagcctcagcttcatctgtgactgtcttcttaccctctcttggaaacttagtcgattactaagttctcttcattttgtctccttgacctcttatttccctctgtttatttcaactgcagtccataaccattttttacagaattttgcagtggtctcattttctgtttctctgcttctactttgcctttttagtcttcacactcttagtacagttatttttgaaagcacaggtcagaaaaccctcatgtcctccctccaaagttctctgtaagaaacaggaatggtttagaaggttttcaataatctgtctcccacttctatttttatatttatttctcaccatatttgcatcatgtaccctgcaatgcagccataaccaacttcctgtcttttccatatgctcttccctctatttggaactaccaccctttttctctctccagatgatgactaatctaagaatctttcttcttttcttttggtaagactttaccatttctttatttccatggcattttattcatattttcactgtagaatctgttttcatttagctttattgctttgcccttattagatgcaaggtacatgtttgaatgaataaatcagaacgttaattaaaactctttcacagtttatcagggaggaaaagcaagcttaacttataatagaagtgttggaattaaaattaatcagcagcgtatttgagtaatagtaataccatttaagattgtatgttaccccataagtatatgactagaagttgcagttgaatattgaaggattaaggagtgatggaagaaacctgttcgtcattttttcatagaaaataccttaattactagatgagaacaataaacactgaggattctgaaaggagggagagagggaagggggaaagggttgaaaaactacctgttgggcactgtgttcactatttgggtgatgggatcaatagaagcccaaacctcaacatcatgcaatatacccgtggaacaaacctgcaaatatacctcttgaatctaaaattaaaaaaaagaaaataaattattagatgaaaggatatttctgtttttaatgaactttattttaaaatttgagaatatttatcacattgaaatggaaaaaaaatcttgaggcttaagttgcatgtgttgtttattaccaatgtattatttatctggatataattattttttattcaaaaacttttcatgttttcctgaagattggtgcttatttaacttttgagtggaattaatatacttaaaaaatcgttattaataaaaataaaaagaaaagaaaaaatcattattatagcaatcaaaaccatagcagtgtaacagtgctttgtggagcggggtgccttcttagggatgggtgttttaatcatcttagggctcacagatcctcttaaaatataagtattttggaaacttaaagataatggacaatgattattaggtatagcatcagaacagagagtgaacatattaaagctaatatggttgtattattttatctttagtttcatttctagctgaagtaataaatttgcatttgtacttttttcctagtccttttggctatacctttcattcatcttattaagtacttattgaactcttgctcttatatgtttgcagtagatactagattaagtttgagtggtatgtgtgctcaggcctgcttctaaaatttgcaggatctggggcaaagtacacagaggcccacataccctgtgtttaaacatttaagttataaatcaaagaaataaattactaaagaaaaataggtcttctcctcttgcctggagaaatagctcagtgatctagaagaccaaatgtaggtttagattgctgttgctctagttccccactggaatatggtggtgtgtatggggagagccagcctgtggggcaggccagctgccttctcctcccaggcctggccctgtcccaaaccaggaaggaccttgattgaagcggtcctggtgccaggtctacacccctacaaactacagcctcttggccactgtttaggctagagagggtcggtcccatttgttagggttaagtgccctgatggggagagacttataagaatcccagtaggcttccagtctggggctgtttagacagatttctggaccctggtactcagaagggcagggcaggctctgggtcagtttgtcctgtggatttatccaattgaaaggggtgtagtcagaagaatagggaggtccttctagagtccagggctcagggccaggtaactcttgcccacatcctcatggtggtacttagtgtatatgcccttgaaccaaataaaactaaatgttcctgaagagcatcagaactccacataatctctagatttccaacctatggctgagagctcaaaattttaaaaataaattgtgatttgtgaacagttactaggtgcttaattgttcatgaacattgaatgtagacaatagagtttccagctttattggctttttttattttagaacttaaaaaaaaatagtggtatcgaatttgggtttatgcctgctttgtggaacttgtaattatgcactctttgttttaaatatttccccacttatttaaaatagctattagcttttttatgggtggtaatagtgttagaatggaaaagaataaattgaaaggtattcttaatgctgttctagccctcgttcaattttcagggatattccaacagaaagaaaaaaagctgtgaattgaccacttaagtaaatcagtttgcaactcagtgtcctaagattattaaatctagaggtaggaatataattttatgtcatgaaaattcatcccctaccactttttataaaatactatatttctggttggtctcatgttaatatacaattgtagtttttacagtaatttagaaaacgaaagaaccaattcagtgtaaaaggaaatacttgattactctgttgtataagagcaataaaagctaatttactgttatattactcagtactgaaagctgcaagaggctatctttcagttcattcttcattaattatgctgtatggtggtgatatcagtatgagttttatggaacgctttcaggttgacctctctgagcttgtattttggctcatgtgaatgtctttaccatattttcctcatgattgttgaggggtgaatgaagtgttgaaggcaaaatggactaatcaatcactgtgattcctctgtgaaaactcccatgataaactcttttttgaaatggccttagttcattcatcacagattataactgttgaaaataaatagttgtgcttaacaaaaaacacacaaaaaaacttttacttatcaatcttcataaagactaacccttaaaaatttgccttttatgctagattactggagttttattatcaaattaatttggaggcatttcactatttatagttctttagctagtagccagataattaggaattagtttgaacctttaaatttaggtaaaagatatcatgtgatatcttaaagacgataattctaatagaaccatttcatttacatggtccttgttgcacgtgtataataaaagcacggtacagaaatagatttacttacgtacatttgaatttagctcagttttgcaatatgtaggtagatatagtatattcagttaaatattatgttgatatttgataaaataaattcttcccacattgcaatctttatttcttggatggtaatgacgctgatttgttctagggctgaataagtttgctagggctgccatagcaaagtaccagactaagtggcttaaacaacagaaatttgtttttttcacagttcgaggctagaagtccaagatcaaggtgttggcagggttgatttcttttgaggtcatctctccttggcttgttgatggctgtcttctccttgtgtctttgcatggtcttccttgtgtatctgtgttctaatctccttttgttataagtacatcaatagtcatgtaggattagggcgtatcttcatgacctcattttaccttaattacctctttaaagacctgtctccaaatacagtcacattctgaggtggtgagacttcagcatatgacacagatctgtccataacaagggcatagagtgaattcagtgcaaactgaaattttgggtaaccaatatatgttttaagatgtggagcagtttatataagtgttttaattgtatactttacaaattgggtgttcagaatattttttatttcccctttacctaatttaattgtacagatgtgggaaagggcagttaaagactgatgatgatatcagttctgagcacttgatgttttttaacttggtagtgttggtatggtcatcagggagttagggcatctgggttggttggactttctgggctattccctgggaatccagaggtggatcctggctcagtgctctgggggcagtgttccaggttagtactttggtgaagctaggtgggattctttgcagaccaccatttcatgaaatatctttgaggttttaaaaatagacacagttttttttagttaaatgtggaaaaattgaagtatccaggaggtgttctttggtaccaaatcaggttaaaagtgccccagatcaagaaagtcctataaagactatttgacattatatttctatttggcctatagcttcatacgtgccacattgtaggtgctcagtaaataattgtaggatggatgagtagatttcaattaaagcaagaggaataaataagtcatagctgcagtgctcttttcaaaagctcatattcacattgtcagaatagttttgtcttctctgccctggcaggcttttattttttatttatttatttattttttgccagcaaatatagtatacatattaatttaactatatacagataagaaacagccatttggaccctcttactctttaattctctcacatgtaagtttggaaacaatagaccaatagttcagcttggatatacaggaacttctccttatacgattttttagatgggaacgggttattttttagggggtctgctttgcctgccaccagtagacagaattggtggctgtgtacgtttttgcttggccgttttagtagtctgccttgtggtgctatgtttgcacctgttggtgttaaaaatgtttcttatagccaaattgcaactatctttagataaaatttccaggatatttggaaagtagaggaaaaaacaggagaagcaaactgtcaacatctacagttctctttttgaaaaattttacctatatgcattcgcatttgttgtttgattagtgttactttgtgcttctaaggaattgaataatgaacagcttttgggaacaaatgcctgtattttgcagaattctacctctcagtgttcatatttatggtgtaattaccttattggtctgctgaaagcttttaggtatagtttatacttgcaatctcttttttcttagtttaacttatttaatgggtgaagaattttagatgtggcatgagaggataaaatttggatcccctattaggataacagtactgccaacttgtaaacagtgtttagatttttaaaattcaaaaaaaattccttagagataaaaaattgaattagatactataattattaaaatataaataactgctttttggccttaggtcatctatcttatttttctcatttctatctgaatttgtgcagttttcagagtgttttcattgttttaatattagtgggtttctgagtcccatgacaactaaaatggagtttcattaattgaaaacacctgttaaatttaaaaatatgtctatgaatgaaaattctaacgatgtccaaagtaatgcaatggaatgtgactgagttgaaatcagccatacgaattagacctttgtggtatatttgtgtcttgatttaggttggttgaagactttcaatgactactttagagacaagactcagtatatttttaataacatggtcctaaagctgaaagaagactcacggaggaagtttatttggtctgagatctcttacctttcaaagtggtgggatattatagatattcagaagaaggatgctgttaaaaggtttgttttaaaacttttttggaatttggtaatattaaagcttaattgtacaatgaactaagtattgaatttttagatggtgaaaattcttagctttatatttgaaacttaaaatatttcttcacataccgttttcgttgattttggttcatctctgaaaaagccatttgaaacttttccatttaaatcctgtgttccactggaagcagtggcttactgctgtaatcctagcactttgggaggccgaggtgggcggatcacctgagggcaggagttcaagaccactctggccaacatggtgaaaccttgtctctactaaaaatacaaaaaaattagccaggtggtgctcacgcctgtaattccaactactcaggaggctcaggcacgacaatgcttggacccagaaggcagagggttgtagtgagccaatatagtgccactgcactccagcctgggtaacagtgcaagactctgccttgggggaaaaaaatcctatgttacaactttgtcccacaaatggaattactaggtcaaagtggcttaatagtttaaaagttttttttaagtatataattaaagtgacacctgtatagtttgtttcaatgtatatttcaatcttccatatagaaagtatcaatttatttgctttttagtcagcaatataatttttgaagttgttggccaatttgatggttgaaaagtttaattttaattttaatttttgattggtaacagtgttgcatattttctcatacaggttaaggtttttgtgacttgcttattgtactttttcttactgatttgtaggagtatttatacatatactccttaactcatatttttcctcagatttttattttcatcttttagtgtttgatatacaaaattttaacatatttatctactcaaatctgttattctgttttcttcagatattgcttttgctgtcatgttttaaaaagttttctccaatctagaggtcaaataaatagtgctttttttcttcctaatttcattttttaccattcactttttaaaaaactgattaaaaaaaaatacgttacgatgggaggttttctgatctccatgtatcccctggagttaagaattatcttataatgaattgttttctttaatttatttaatgtcacttatacagcgcttactgtattagtccctgttctaagcactttacaaattgtaactaataatcttctaaacaattctgtgaaataggtacaattgttatcattgttttacacataaggacactgagtcgtccaggatcacagggcagcctggcattccatgtagtccaggctgtccacctccagaggctgtcttctttgcacactgcgccatcctgccttcccaagattgaattagtccatccttttctagtgatttgaagtgcaatctttattatatttaaatatgcattagtttctgggcattttgacttgtttcatggacttttctgtttgactgtaattgttgtgcctttataatatacttcgttaactgacagttgacgttccttctcatctttttgtttttaatatttttagttattatggatacataatagttgtacatgtttatggggtacatctggtattttaatataagcatataatatataatcagatcagggtcattgggatatctgtcacctcaaacatttatcattttcttgtcttaggaatgttggaattctcctcttttagttattttgaaatatatgatacattattctttttttttttaagcaattgaccaatcaattttaattaactcattctgtatgactatcataggctattaaaaataggaaagcgtgtttcttttttttattattattattatactttaagttttagggtacatgtgcacaatgttcaggttagttacatatgtatacatgtgctatgctggtgtgctgcacccattaactcgtcatttagcattaggtatatcacctaatgctatccctcccccctccccccaccccacaacagtccccagagtgtgatgttccccttcctgtgtccatgtgttctcattgttcaattcccacctatgagtgagaacatgtggtgtttggttttttgtccttgcgataatttgctgagaatgatggtttccagcttcatccatgtccctacaaaggacatgaactcatccttttttatggctgcataggattccatggtgtacatgtgccacattttcttaatgcagtctatcattgttggacatttggattggctccaagtctttgctattgtgaatagtgccgcaataaacatacatgtgcatgtgtctttatagcagcatgatttatagtcctttgggtatatacccagtaatgggatggctgggtcaaatggtatttctagttctggatccctgaggaatcgccacactgacttccacgatggttgaactagtttacagtcccaccaatagtgtaaaagtgttcccatttctccacatcctctccagcacctgttgtttcctgactttttaatgattgccattctaactggagtgagatggtatctcattgtggttttgatttgcatttctctgatggccagtgatggtgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcagaagctctttaatttaattagatcccatttgtcaattttgacttttgtttccattgcttttggtgttttagacatgaagtccttgctcatgcctatgtcctgaatggtaatgcctaggttttcttctagggtttttatgattttaggtctaacgtttaagtctttaatccatcttgaattaatttttgtataaggtttaaggaagggatccagtttcagctttctgcttatggctagccagttttgccagcaccatttattaaatagggaatcctttccccattgcttgtttttctcaggtttgtcaaagatcagatagttgcagatatgtggcattatttctgagggctgtgttctgttccattgatgtatatctctgttctggtaccagtcccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaaatcattggtagcttgatggggatggcattgaatctataaattaccttgggcagtatggccattttcacaatattgattctttctacccatgagcatggaatgttcttccatttgtttgtatcctcttttatttcattgagcagtggtttgtagttttccttgaagaggtccttcacatcccttgtaagttggattcctaggtattttattctctttgaagcaattgtgaatgggagttcactcatgatttggctctctgtttgtctgttattggtgtataagaatgcttgtgatttttgtacgttgattttgtatcctgagacttgctgaagttgcttatcagcttaaggagattttggattgagacgatggggttttctagatatacaatcatgtcgtctgcaaacagggacaatgtgacttcctcttttcctaattgaatgccctttatttccttctcctgcctaatttccctggccagaacttccaacactatgttgaataggagtggtgagagagggcatccctgtcttgtgcccattttcaaagggaatgcttccagtttttcccattcagtatgatattggctgtaggtttgtcatagaaagctcttattattttgagatacgtcccatcaatacctaatttattgagagtttttagcatgaagtgttgttgaattttgtcaaaggccttttctgcatctattgagataatcatgtggtttttgtctttggttctgtttatatgctggattacatttattgattagcgtatattgaaccagccttgcatcccagggatgaagcccacttgatcatggtggataagctttttgatgtgctgcttgattcggtttgccagtattttattgaggatttttgcatcattgttcatcaaggatattggtctaaaattctcttttttggttgtgtctctgtcaggctttggtatcaggatgatgctggcctcataaaatgagttagggaggattccctctttttctattgattggaatagtttcagaaggaatggtaccagttcctccttgtacttctggtagaattcggctgtgaatccatctggtcctggactctttttggttggtaagctattgattattgccacaatttcagctcctgttattggtctattcagagattcaactttttcctggtttagtcttgggagggtgtatgtgtccaggaatttatccatttcttctagattttctagtttatttgcgtagaggtgtttgtagtattctctgatggtagtttgtatttctgtgggatcggtggtgatatcccctttatcattttttattgcgtctatttgattcttctctcttttcttctttattagtcttgctagcggtctatcaattttgttgatcttttgaaaaaaaaaaaaaccagctgctggattcattgatttttttgaagagttttttgtgtctctatctccttcagttctgctctgatgttagttatttcttgccttctgctagcttttgaatgtgtttgctcttgtttctctagttcttttaattgtgatgttagggtgtcaattttggatctttcctgctgtctcttgtgggcatttagtgctataaatttccctctacacactgctttgaatgtgtcccagagattctggtatgttgtgtctttcttctcattggtttcaaagaacatctttatttctgccttcattttgttatgtacccagtagtcattcaggaacaggttgttcagtttccatgtagttgagtggttttgagtgagtttcttaatcctgagttctagtttgattgcactgtggtctgagagacagtttgttataatttctgttcttttacgtttgctgaggagggctttacttccaactatgtggtcaattttggaataggtgtggtgcggtgctgaaaaaaatgtatattctgttgatttggggtggagagttctgtagatgtctgttaggtccacttggtgcagagctgagttcaattcctgggtatccttgttaactttctgcctcattgatctgtctaatgttgacagtggggtgttaaagtctcccattattattgtgtgggagtcttaagtctctttataggtcactcatgacttgctttgtgaaactgggtgctcctgtattgggtgcatgtatatttaggatagttagctcttcttgttgaattgatccctttaccattaagtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaattttccagtctgtgtcttttaattggagcatttagtctatttacatttaaagttaatattgttatgtgtgaatttgatcctgtcattttgatgttagctggttattttgctcgttagttgatgcagtttcttcctagcctcgatggtctttacaatttggcatgattttgcagtggctggtaccggttgttcctttccatgtttagtgcttccttcaggagcccactgtctggcactctctagtgagatgaacccggtacctcagatggaaatgcagaaatcacccatcttctgtgttgctcacactgggagctgtagaccggagctgttcctatttggccatcttggctgctccctgcacattattcttaactatattaaaaagttctttcaatgagtgaacattgaattttgccaaagtgctttgtaattaatttgttaaattcttcgtactccatcaaaaaagtaatctttttggattttgatgaaaattgatgtaaacatttaaagataatttggggagaattgactttttataatttccattggagtttttttttttttttttttttttccctcttgataggaggcttaaaatgcttacaggtttgactaggaagtgaagggtatattttctaccagtactgggattaattaactacctcatccaaaggggctagccacatccactctaggcatgtgctgctactggaaccagagttgtcaggatatccctccagttactcaagacaaactagaattccaaaatattacgtaaaatacctagagtttttacactgaaatgttagctattaatttagattaatataccaggatatgcacacatatgcatgcataaacacacacacacagagttgcagacacactcacacagtgctaaacagatcacatcagcatttctgaatctgtagtttagatacactagtttgcaaccttttaaacattaataactgtcttggaaaaccacataagcattgatatttgttttataaaggcaattttttgattaagttttaaattttttgtcaagtgcagtggctaatggctataatctcagtgacctgggaggctgaggtaggaggatcaactgaacccaagaattggaggctatagtgagctgtgatcatgcccctgcactccagcctgggtgactgggcaagaccggaactctaaaaaaaaagttttttttaggtctttaggtgttaccttacttcttgagcatgaaaaatatttcgtattttctaagaaaataattttatagttactcagattgtttctgattttaagaatttatcccatgtgtagttatttttgcttttttgttacttgttttgggaatctgatttttttcttcattttgatttacttaattttgttggtttttgcccaccttaccctcctagaacctgtttatattttaccagtttttactcttgacctatctgctttcatctttcctaattccttctactcactttcactaatgctaaatgagccagtccacttaataagttcatctgtgtgtttaccttttagcaatagtctgactagcttttatgtttttatatgctattttctcattattgtatttttcctacatatttaataactgtactactgttttctttttgacttaggtatgttagaaaaataattttcaatttgcaagtgctattttttcccagttatactttattataaactagctttaatgtcttatggccatagaatatggactgtatactcttttttttttttttttttttgagactgagtctcgctctgtcacccaggctgaagtgcactggtgtggtctcagctcactgcaacctctgcctcccagttcaagcggttctcctccttcagtctcctgagtagctgggattaaggcacctgccaccatgcctggctaatttttgtatttttagtagagacagggtttcaccatgttggccaggctggtcttgaactcctgacacctgccttgaactctggtcttgaactcttgaacacctgcctcagcctcccaaagttctgggatcacaggcatgagccactgtccctggcctgtatactttttattctttagagatttttgaatttttttttttttgttacttaatgtgtgatcaatgttgatgaagcttctactggtgtttgaaaaggtggggtttgtagaatatagagtttggtatctgctaattccgtattttacaactactgtttttatcttcgtacagtcagttttgctgtcatattgcatacacgttcttaaaaataatgttatgcaaaattgtgcaatattaaacccagggctcatgaaaaagtatcgttagagtgtagcactctaaaacttcattagtgatgtagacacacacagaacatggaaacctaataaagatgctaatccagttttacctgtgttaaattggttaaaaaatgcataaatatatatgtcagtttaccttgaaaaaggcctaaagtttgcttgtggaagggtgtattggaaggagtatagattcgagttattactgagaagtgatggcaagtaggttagctgaaatcttttggaaagttgaatagcagatgtggatgactgtggctcataacccttgatgaactgagggagctggtagatgtttgaggtgtgtgcgtgtgctttgtgcattccttatacagctttgttcagctgcgtgaagttttgtaccttcatctaatgtttcttggagactaaattgtgcataagcaaggcaaaatttatttcctcatgtaatcaatcacctgggaactcattcccatttttgaaacaagtgtttatggcagaactgactgtacttattttttgctactgttcccctatcagcttttattttttgggtattttatgttttttttttttttttttccattcttgcctgatctttgttggcttctgtattagctcattcattcattcaacagacacttcccgaacgtctactatgggacagggactgcaaggtgggcactcctagactaagatttatttttcttcattgtaaactgtatgtatcatcattgataccatcttttctcttttttataattaatattgttatactaccactcttttgttgttcgtttgcttgagtttgctgtcctttttacttgaaggacagtcagcttggtggttctaaaggctgggaactggaaccagtccgcctaggttcaaattctgccaagtcccatctactgtgtggctttgagcaagttatttaacttctctatacctcagtttcttcatttgtcaaatgaggataatattgaaaccaattttatttggtttttgtgaggattgaattaattcagacaacatgcttagcacaatgcctggcacattttaaaaccccaataaacattagtgcttttttaacttttatttgagactttgagtatttctcctggataccatatgtaatttttaatgctgaagtcttctataatgggagacttttcttttagtttttgtttttttttgaaacagggtcccactctgttctcaggctggagtgcagtggtatgatcacagctcactgcagtctcaacctcctgggctcaggtgatcctcccacttcagctttccagtagctgggactacaggcgcacaccaccacggtggctcatttttgtattttttgtagagatgagattttgccatgttgcgcaggctggtcttgaacccttgggcccaagtgatccacctgcctcagcctcccaaagtgctgggattacaggcatcagccactgtgctcagtccgtataatgggaagattttaactgtaatttttttttctcttctctcttaaagctttcttatataatgcttcattgaaggtaactttttccccatgctcacttactttatttatgaaatttcaaattttcactaagttatatatctaggtagtataacttttcattaagatttccacctatcaattcaaatgtttctttagcttatgtgttctgtacttactgatttactactgcttttgtttcatttgttttagaattcaagtacgttgttattgtgtctctagtctctctttttcatatgcatttttaatttgttgtatttactgtgttttgggagatttttcccaagagtcttccctgccactccctcggttcagtactctggtattgagtcttttctggctttgagtatttggttctaactttacttctgtgctttttgtattgttgtccgtaagtccaagtatttccctccttttttatttatccgtgagcagcaacagctgtatccacacctggaatttgtcccaaaacatggtgtaacttgccttgaatccctttcttttctaaccatatactttcagtttccttgctgtgggtactagttattactggctgaccagcatccacttcacctgatttccttttgggaagtggtctctcacccaaggaagtcagctcctcttccttgttgcctagcccagacaagtcagctgtgacctgagctcagttaatcagcatattatttcccagggctttgaatctttagagagcgaagtgagggctgacagatggagggagggaagcagacacagaagaatgtttactggtcattcctcacagcaccttgcatttgcaagactcttcctgtaataagatccctgtgttccctgcagcatgatttctcattttcctccagccctttgttaagcctggacttttagcctgtcttcagttctgtgtgttcaagacagtatccagcatcagtttgtattgcttgcaaaccagaaagctagctgataggaacttacaacgtctccttagttcctctgttggagaattacatcctgcaagattatatgagaatcagggatcagcagttggggaaggtgtcctggttgtaaataggacagagtgagagaagagaggagctggggctatgagaagatctggaaaaggagtgccccatctatgaaaggttttctgtttctttggtgtagctgctgagcctggggctggctttctccctctagctttgtttttgtgtggcctgtaagccaggtaggagatgtgtgtctgaatgtgctgcttcacagagtccagccacctcagaaggaaactgggtctgctgctggctgcttgtggtcaggtgaggccagccatgcttggctctctcccagcatggcttcattaaggagactgcctctgcagcagtcacagtgcatgggcagagagacttctgcagagggggactcacacaagtgccatgagggtgaagagtctgtgattagtatctgtcccaagactcagctttgcctcagcccttggcccttcagtttaggagctgttgaccgaatctctcagaatcttcttatttatgctgggattccatgctgatttttcatgcagggcagttgcaggtcagtacttgaattatttcagttttacttttaccatatctgtcagaaatgctgccaattttatggcctgcggatggcctgtttctcctgactctacctggatgcaaattttcctcccctctctcttttttttattctgttggttatttttcttaggttgaaccatataaaattgccaatatttgactacttttgatatacaaaaatggcaatttcatgcatcagtccaatattacacataaaatatggtaagatattggaggggactgcagattagaatctagtgctcaatctttgtctcactcagatttgtctcactcagattccttctgagtgagaacagcttttttggcattggaaaatattctggaatacaggcttgatcgtgaacagtatcattttgcttgaaggaaaaatggttttatagccagattagtgcagatgaattctgtttctggtcaagatttgctaaagttctctctcttctagctgtaataattcacttttattcacttattacatttgtttttagaactagggtaatagcattcccccccacttacttgaacaaaacattcttagtgttagttgcttaaatgtatgtttttggaggaaaacttaatagatatttaagtttgctcctgttatttaaattctgagcttgtactaagtggcattactaatagatttttttgtgtgacttctagtgtaatgcttatgcagtggcttttctctttttgaagatgagctatggattaaatctgtacctaaatttgcaagctagctgttgcagagcagaacctgttaattccagcagagttccacgtaagctttcattgtccctgaagaataccaattgattgtgggaacttaacagaaacaaaactcaaatgatccttataatctattctagcagtgacttgtttgattcttatcccctcccccagcagcattattattcaactctataagcttttaaaagtgaaaatctagttaactaaagagagatctacgtaaacaacatctatattttctgtttttttgtgtgatctgaaataatttaatcaattataatcatagtacctactggtaatacatatccagtggatttaaaagaagctgccttccattaaataatcagtgtattgttttctatgcttgttttattttgaaaatgactggtggtgtaattttttaaaactttttaggcttcacatttgaatattttttggctaaatgcagttaaatactgcatgatgtttataatacatcaaaatgtgaacccttattgagagtcaggcagctgaaacattagccttagcatttcctttgactagcacacagcatgttacatattcattgttcctctctgggctctgagatattggaacagcttttatattgcatctgctcttgctattgagaccagtgttgagtggagaaacccacgaattattagaacctaagaacagtttatatattcaccaaagtcttgaccagtttctctttgtggatcttttagtgtgaaaaggggctccaaatgtgtgctgagatgaaagtaccatcagttagtatagattttttatcttcaccaaattggtgggtttcattgctttagcaagaatgcaaactctttatttatataatctttgtactatcttcttacaatttttcccctaggtttatatttaagtgaaccttccactgtcttctcaactatctctgcttgcttcttgaaatcagagaaatatttgatgttacatttttaaataagaatccaaacttaactaatgtgcatcttgggttttctaagaaattggactattaatcttcctaaacagactaattcattatacgttttatacaggttggattttatggtatttaactgaaggttgctgtaaaatttatagagcaatgggaagttacagtgtgtcttgtgatattcagagtcatttgcagatttggattgagtttagaatctaaagatatttagcatttcatcaaagcactgaaagcaatgcaccagggtctaaaataactttagttctaatagttgaagcagtggtttacgtttattttagaaagcatatgttctatccctaccttttcaattccagttcgtcttgagtgagacggctatccttccacctctcattcccttcaaccactggcatctatttatgtcatggagacctgtaaaagccatgagggacttctcaggtgctctgcccatcccttggatactttctcaagcctcagagaggatttttttgcagcattgacatcgatcactccattctcctcgaaattctgtcctcttttggctttgaagtgaccttgagctctttcactttcgggtctattctggcactgctgaccattcatttttcatcacctctctgatttcctcttctgcttacttccccaatgttcctgttctcgcctgttggggaacactgcttagttttcttcattttgcatgcttttccacactgttgttttaattaccaggcatttggactacttccagatctaaagatccaacctggacttcttgttctctagttagtggcaatagtaagagataagcactcgtttaattattcagccaatcctgtagcattctcttgagttaaggttctttatcatcttcattctcctgttgaggaatctgaagcagaggtgttaaggaaagtgcctaaggtcacccagctagtaagtgtggaaataggacccaagccaggcagtcttgccccagaaatagtgggcaaataatcttcacctctgtggtgctctgcctttccacctccctttcctgtgacatccagttagtccctaaactctgtgacttctgcctcttcagtgtctccagactctgacccctgcttttcgtctccattgctcttgtctcgtactattgtgaaaacctccaaatggcctttccatttccagctgtgccacttctaagtgtctgccatttcatcaacagagttagttttctaatatgtgagtcccaccatgtttgctttaaaatgctttgtggtgcttcagtctcaaaaggcacaggccactatcctttgcctgacacatactgactttttctgtctgattcctcccgacttgctcatccttatctccagtcacttcctgcttcacactctactcaggcattctgagccacgggtgtcctcagacacatgccgttttgtgcttcttaggaatttgcctgtgttcagcttggatttttatttttttccttttgtgcagtggataatttcagtcttactcatttttaacactcagctgaaatattacctcatctctgaaaccttcccttatttacttctaccattcattcagcaaatatttattgtgttatgctccagaaatgtaggaggtaagcaagactgacctggtcccagccctcagaaaacagcagggaagacatgtaattaaacacagtataataataaagggttttcttctatagaggcaagaagggggtcttggaaggcctcctgaagcaaatgatattcaagcttaaacctgaatgatgactagaactagccagtcaagaagtgggtgtcagagggcagagaaggaattttaggttgtgagaagagaatggtgattatgggccagggattaacaagggcatgtttgaacatctgaaagatgtttattagacagcagcagttggggagggtgggcagcgagggtgtgtgtgtagaagctgggtaaatcttggccatcagggagatacatatcaaaacttctagaagatactgtttccaacccttttagaatggctaaaataaaaaagatgacaacgtcaaaagttggcaagaatgtgtagcaacagaaactcatatgttgcgggtgggaatgcaaaatgggggcgactttctgaaaagcctccaaagagttttccaaacttaaaatatataccatgtgatctgggggctccactcctagcaatttacccaagagaaatgaaaaaatgttcacaaaaagacttgtacagacattttcatacaggctttttcctagtaacttcaaactgcaagcagtttaaatgtccttcagcaggtgatggattaaaaaattgttgtatattcatacaacagaatacctagcagtaaaaaaatgataaattactgaaatacacagtaatatggatgagtctcacaaatgttcagcagaagaagagagacagaagagtaaatattgtttgatttccattttatgaattctgagaggagactcaactgatctattgtgatagaaatggaatgtcagagtgttttttgggggcagggtgagtgggcgagcatggattggaacggggcatgagggaactctctgaattggtggaagtagtctatattattttggatagtgattacagttgtcacaattcatgagactgaaaatatgtgtattgtatattgttatatctcaattaaaatattttagaaaatgtaatacaatataaacatacaatacaataaatacaataatataatacaatacagtaaacataatgatatatgtctctcttgatatggaaagatgctcatggtataatgttaagtaaattaacttggttaaaaactctggctcccataaccctttgtgcatatatatcaaggtagtgagtttttaaattttattctttaacgtctttcacatttttcaacttattttgaatgagtattttatgaataaagtattgtttactatacagtgaaagatttaaagtacatcccctgcttattaaaactttgcagaaattattgaaccatatgagaaatttatttttatttctattaaattaaattaattaattaattttagagacagggtctttgtcactcaggctggagtgcagtggtactatcatagctcactgcaacctcaaactccgggctcaagtgatactctacctcagactcctgagtagctaggatctacaggtgcaggccaccatgcctagccaatttttataattttgtagagataggttttactatatttcacaggctggtcctcaaacccctggcctgaggtgatcctcctgcattggtctcccaaagcacagggattataggtgtgagccactgcacttggtcccaagacatttttaaataaattttcatgactatttttaagctacagttctgttacttttttttgtttgttttgttttgagacagatctttactctgttgcctaggctgagtgcagtattgcagtcttggctcactgccacctctgcctcccaggttcaagcagttctcgtgcctcagcctcccgagtagctgggattacaggcatgtgccgccacacccagctaatttttgtattttttgtggagatggggtttcgccatgttggccaggctggtcttgaactcctgacctcaagtgatctggcagccttggcttcccaaagtgctgagattacagatgtgaaccaccgcgtctggcctcagttttgttagttttcagtgcttaggagacacaggttatagcatttatagttcagaaaaaaatttagtttaatttactttttaatatatgccccaatatatacaaaggatacacaatgaaaagtaaggtactcagccactcctgtctccttgtcattttgctcttttcacaggaggtaactactatgaccaggctcttatttattttatggatgtatgggaaaacatatgcacatgtacataaaggcataggcatatatattatacaatgatagcatgccatgcacattgtgctggttttttttttttttttttgagtgggtctattttttaaattgtaaataagcataacataaaatttactattttaacaatttttaagtgtacagtagcattacaacatttacatcattgtgcagctgttactaccatccatctctagaactttgtcatcaccccaaatgcaaactttgtacctgttgaacagtaattcccgttcctcttgctcctggcaaccactgttctgttttctgtctctacaagtttgactactctattaggtgccttatgtacgtagaatcatataatttttgtccttttctgtctgccttacttcattcagcatagtatcttcaaggctcattcatgttgtagcatgtatcagaatttctttcctttttaaggctacatgatattcccctgtatgtattgaaagtagtgacaaaaaccacaattacttttgcaccaacctaatacataccacagcttatttatccattcatcctttgatggacatttgggtggtttctacgttttggccactgtgaataatgctgctgtgaatatgagtgtgcagatatctgtccaggtcccttctttccatctccagaaatggaactgctggatcacataataattctatgtttaatttttttttaatcactgtcatttaggtgtatttttttggcagagtaaaacatttaaatattttacatagacataaatatgagcatgataagcattgacatgaaaatggcagtaattctgtatgtgtgcttcttgtatttttgttatatttttatgtcatgcttttttgcaaaatacattataaacatttatgaatttcactagttttctgtgatatcgtttttaatggctgaataatgttctgtcactgtatggatgagttaacttgactaatctcttacttttggagatctaggtaattttttaacttttatctttgaaaacatctgtttgtatccatgatctctatttataatctaattttatacaaaggtaacaaagagctggggggagagggtgggtacagcagtttcatttgactgacaatataatcaacatttagctgtatgattttgtcctctttgttgcctaaaacattattctctagggctttccccaaattgttttagaacaagcaagttgacatgctttttctatagggtatactgcctgggaataatgtggaattgcaccaaggaatcaaagggcagtataaggacatgtgtaatacaagattcgtgcataattttttcatcaccatgctgttttccatactactgtaccattttacatcccaccagcaatgcacagatttctagtttcctcacatccttatcaacacttatttgctgttttattattttaagtaataggcatccctaatgggtgttgtaccgtgctttttaaacatgtatcttggagaatcttttagtaaagtctgttatgtgaatgggacttgttatttaactactcccgattttctggcctcttggtaatatatttagtgtatcttttgtctttagtatatataatgctcttattttaaaatacaatattttctgacttattttcagtgagcatggatgaaagtacatatgcattttacagtttgatagttattgccagcagtatgtgagactacttatgtctacatccttaacatcacagtatgttatacaactttttgatcttcttatctgataggtgaaaagtggcatcttaatgaagttttaacttgcatttccttatgagtgagattaaatttcttgtcatttttatgagccagttatttctgaaatatctgcattgtatcttttgccttttttttttttttgcattatcagtacccatttcttacaattttatgctaataggaacaatcagtgttaaatgatgaacaaaactgatgtgattcctgcgctcatggtacttacagcctgttggaatagaaagatagtagacatacaaatatgcaattaaattttgttgtaaatgttatggaagaaaagttagattttctgtaagataacagttcaggctggatttgggtggaatgtggtggccagtaacagcccctaatgaacctgtaagaaccaatgaggcaaatatttgaagggaaaacattccaggcagatagacagcatggacagctagctgaaagaagggcatgtggctggattgcaatgaggaagaaatgatgagagatgactgatttgccctctgttcctcatacactaatctgtatagatatgtgtcaacaatgttcaaaagtatacagtgagtttctcctatcattatataaggggctttaaaacaaatctttttccctgcctactagatattctccaggaaaggaatatgaatcagacaatctgattagcagaatgtctttaggatataagttgattcattgggagcttctgtgtttttgaatttttcatttaaaatttttttaaaatttaagaatgaaatactgtatgtcatcttgtattatttcctgtttctccagatgtgtcattagaaattcagctggttttctcatgtgaaattaatttgtgattctttgaagcttgctaaatgatgcattgtttgctactaagttgtctgtaacaatttccccattagggagaaaagctctttgagtgtgtccttctgtgtgtgaccaaattccaaatgtctgatgattctacataggggaaaaagtgacactcagagaaaatgatttgcagcttgttgtgctttgcagtaaattctgcattttaggtaaaatgcggaatgacagatatgctcagcttagttttgatcagtaattttcttaagctttctgtatcaaatttctcatcattgaaatagaaacatggtggtattttaatgtcttttaccattagttacaagtcaactcagtgtaaaaagtgaaagacaagtattgttaattttgaaaattagttcctggtttcttagtttctggatttgttagataaacatatacctttgtttcccttacttacccaatatcctttcactttggcctttaggtttcatgtttattaggaaatatcatgaagtgtacatgtaaaatagacagagaatgtcttggtagaaattaagcaatagaccctgtggtgtgggcacatcttttttttaaattttaattaaattttaatttaaattctaatgtttttaattaactttctccactaatattcccctgcttgtcagagaaatagttcaattgatacctgttgaacactgtgaatggaaagacttggaagtgcctgtattcattctaagtaaatttttttatagatacgggtatttctcattacttttaaaaaattgttagtcttgaatgtacagctacaatccatcttcatcttatttttatcatcactaacaacagtggctttaagtatggtccttttttaggttaacatagcttttctgttattgcttgtaaatattttttaaagtatttccagacatattgtttctgttaagacttttagtcctaggttttgtagttatcactaaatgatgatggttattgctatgcttctcagtaattaggttgacaattttctttgttttttggggactatttcttgtttttctttcactcatcagatgcttccttaagtgcttatcatgtatgttctagaattcagggcaaatttgtgtccttctgatgtttttgggttttgttgttgttaatggcaagtgtttttgctcaacacagtaaatattttatatcagaccaaatcttcctgcttgtaagaatcttctggtttattatctgtttttctattcttgtggatggattagagggtaataccctaggaaaaacaggcagttcaatgaaataggagtactcactaacctgattattctaccaggtatcatactattacaatatggtccatattaaaataatgttgtctcttttcttccatgggatgttttgttctatcttataaaagaaactatgctaagaggaactaaaagctatgtgctttctggcctactattatgatgtcatttatatatgatatgatatatttgcctatttttgacctagtcatgcaatttttctgaaaaacctgtatgagcatagtattttgaaatatgaatcccttggcttccatgacataatatcttggcattttcttatgagctggttttaagtcactctgattgagtcttaaaaagaaaaaatataactcattctttctccactaaatcaatggctgttttattgtatttttatatttttaattgatgcaaatatttgtacatatttatggggtataggtgatattttgttacatgcatggaatgtgtaatgatcaagtcagggttggggcgtccatcaccttgagtatcatttctaagtgttgggaacatttccagtcctcttttagctgttttgaaacatacagtacattgttgttaactatagtcaccctactctgctgtcgaacattagaacttactccttttatctaactgcatgtttgtacccattaaacaacttctcttaacccctcttcccaatcgctaccctaagtcaaatactcttcccagcctctggtgtctgtccttctactctccacttctgtgagatcaactttttttttttttagctcccaaatatgagtgagaacataggatatttgtctttctgtgcctggcttattttgcttaatagaatgacctccagtttcattcatgttgctacaaatgatatgatttcataggtttttatgactaaatagtattccattgtttatatatataccacattttctttttccattcatctaaatcaacacttaggttgattccgatctttggtgttgtgaatagtgctgcaataaacatgagagtccaaacagtacatccctttggtgtactgatttttttccttggtatacttgagtttttcccagtagtgggatggctggatcataaggtagttctatttttagtttttttttttaaataaatcttcaatgcctattttaataatgtaaatgttttttaaaaatctatttttcaacttcctattctgactcactgatgtgtttatttctaagtcacagttatggtagctttttaatggcttacaccaactggaaggacagattgctctttattactcttctctagactgtttcaggctaaattcagatttattatttttgtcatttaacatttcttatctccatttctcttatattttccttcagcttgatctttgactctccttttgcttgttttttgttaacttctcatcattccctattttctcttttgttaatagttctttgaaacttaactttttaattggccccttttcttaaacttactcttctttttcacttaactccttttggatgtcacactgtcatcaaaaagccctgtccaaatttgtatgcattactacaaagtgacttcctttctcaacgcaattgcactgtttgtgtattaatactaccattccgttagacacctggaattaaaactgtaagtcatatttgcattaatcttttcatctatcttcagtcattttctaattaccattgatactttttcatgtgatgtctcccgtcttcctcctcctccatatttcataattactactaccatgttctagatcatatcatctcatacctagataattgaaacttcattctgactgacctttctctttctattttattttgcaaatatctgtgagcttcttctaatataaaaactgtaggtaaatactaatattaaactgatggccttattcattaattcctcatttatgtaataaatatttgaatgaccattatctgccaagcaagcttctgagtgccggacgtgccaacgtgaacaaaacacattctagtccatgctctcttggagcttacattctaatggtgggtagaggtcgggagggaaagagtggagatctgacaatgaacaaggtaattttggtttctgataaagactgtgatggatagatagaatggggggtacagtgggagtgttagtttagcttgggtgcacatgaagacatctctgagctgagctatgagggcagttgagaccagccagactgggaaagatagggtagaagaaaatagataaatgctggaaaacattttaataagtgggaagtttttcatgcctcctcaaaattaatagacagaatagtctttaacctttaagtacagataagaattcagtctttgatgaaagtagcatcccaggcatcatggaggagaaatggattattaacaaatggagctgggaaaattagttactgtatatactgtaattcttggctggttgactttcttgaagaccattgatgcctgtgggacaggaattatgttgtaaattaaaactaatatagatgaaaaaagttctatcattggagtaaattttttccacttaatttttagttttcttaatctgcagtttttttctctattcaacatcagcgaagagtttatttttgatttatatctgaacttatgtctgaaattttccaaaagatctatttattgatatattgaaataatgaagtcaagtttccgtatttgataattagataataaatctcatactgtcctgacatctcaggctgcgaagcataacgcataaggggcaggtttggtccatagcctctagactgtggctaaatcaggcaatcaccagaaagataagaaaaagaactaattgtatgcataggtctattgacagtaaaggtgggaccggtagccttgaatttagttgtgttcttaaagaagggcgttttttagaaatttccagcttcttcattgtagattcttgatttgggcctttgagaatctgaagtttgattggatattgtgtttctttagacattctaatgagtcatcatattctccatgtgaaattatattagttggtgatccccatggcaacataaatttatttctttaatttttgcagggaatttattatttgattgttttttagaaattacgtccattatccactctgttactggttatatgatcatgcatatgtttgaattacatgttgtgttaatgttgtggcttctatcatatgctttgtaggaaaatagttattcatcctctgtgcctctggtctgcttcaactaaatttggcttgagagttggctgttagctgtaggcatccagtgatgtatgtcctttttaaagctgctttgcttctttctgaaattttaccccattttccaaaccatcttgttgcaggctggcaagtctgtggcacttaagatagatacttgctcaatttttttttcttttttctttttctttttttttttgacacaatgtctcactctgtctcccaggctggagtgcagtggcgtaatcatagctcactgcagcctcaaactcacaggctcaagcaatcctcccacctcagccttccaagtagctgggactacaggcatgcaccaccacacctggctaactttttaattttattttgtaaatatgggatctccttatgttgcccaggctggtctagaattccttacctcaagcaatcctcctgtcttggcttcccagagtgcatgaactacagggctgagccactgtgccagaccttgcttaaattcttgacttttatgcttccttgggcactatttcaaatttttaatagttaatgattttttttttcttctcaggggaaagtatcttctcaaaacaattttattaggattagggatcttgttacctggtatggtattatggcaaaggaatacccaatagacaagtaatgaagctgttagagcctttcactcaataatgaaaaataaactgtatagcctatatttcaactgaatctggggcaaagtactttatgatgttatctgtattcccagagtcatgtggtatttactagctttacccttgttattttttagggtagtttgcatgatcaacttatcagtgtcagaaggactaaagtaaatattgattttttgataaaagtatattgaaataaataatgtgcttaaagtgacagccctccaataaacactcatcaagcatatagtctgtgtaaaacacctttctaggtgctctgcaagattcagaaataaactagatatgggctgggcgtggtggctcacgcctgtaatcccagcactttgggaagctgaggcgggcaaatcacctgaggctgggggttcaagaccagcctgaccaacatggagaaaccacgtctctaccaaaaatacaaaattagccaggcatggtggcgcatgcctgtaatcccggttactcgggaggctgaggcaggagaatcgcttgaacctgggaggcggaggttgcagtgagccgagattgcaccattgcacttcagcctgggcaacaagagtgaaactctgtctcaaataaataaataaataaaccaaccagatgtggcttttgacattaagaatctttgaggctgtatgggagtttatacccatgtggaaggaacctccagaatgacctgcgtggcttttcctgcagaagggcaggggttacctgagacaccgggtgctatcatgaggtcttgaagttgaaattcattcactggtttaaacacattttttgacaactagtatacatactggttatatttaaaggctgttcttaatgtttatgcttgtttagtttttcatttgaacttttcttaacatttattaatgtagactcttgttattttctctctagtttaatagaaaatggtcagcttgaaattgtgacaggtggctgggttatgcctgatgaagctactccacattattttgccttaattgatcaactaattgaaggacatcagtggctggaaaataatataggtatgtattggtatattctttatttgggctattttggacagttaattttcgggatgtgaagtgaggctctgttcttttttcgagtaactattttccctgttagtcattattgttgaataatttattcttcattaatttatgatatttcttagctcataaactgagttacagagatttactatagtcacttttaggatcatctaccttgtttaatgtattatttatctatatttttattggttttgggattattttaattgtatgttaagacttgatgacaagaggcaaaaacctaattatggtagcttaagttttttttttcagcaaaaaaaggaaagaaagatattcattatgtcactgagtgttccagagatatggtagcttcaggtattgctgtatccagggatccaggggacttaaattatgttgtctgggcactgtatctttgggctctgcttgttttgctgggtttcttcacaaggtgagtaagatggctctaggcagccgagactaatttttccaacctagcaaccaggaattctctttaatactttatctagttggcccaacttgagtcagttccttatgtctgagccagttactgtgtccagaggtataggagttcaaatcactaaggtctagtcattttggtggaaatggtcttgggggaaagggaattgtggagagcagggtcagctgcacctaaaggcatgagaatgggtcctccatatgagtggcctcatggaatgggtccagttcaacagaataattctgttgctacaagaaatgggaaaaaagatgctagactgatagaatcagatgtccactataaaaacttgggactaatagaaaactatgtgatatttaatatttgcattttgtaacatggtatgtaaatcctttcaaatattttatatctcagtataataatgtagttttttatgtaagtatatgtgttttttattgaagttatttttagatatttccttattttaaaaaattgtcccttagagataaaattcttaatccctattttttctttactttttattttgagataattgcaaatttgaagaaatgtataagaatactgcaaaatattctcataaacccttcacccagatttaccagttgttaacattttgacacatttacttaattttttctgtttccgtgttgttgtagtggtgctggtatttcttattatcagaaccatttggaagcatgttgcaggtatcatgcccgtgtagaaaatagttagcatagcaggtctgctatctttagaaaggccttgcttgcaagattggcccttggttagtgtctgggaacatggatatcctaacgataagagtggctcactgtttttaatctgtttgtacaaacaaaatagtttgtgctaaacaattgctttccttctgggagtctgaattcttagtatgtgctgaacagagggtgcctacatgaccagcccccaacattggacactgagtctgtaatgagtttcctggtcaacagcacttcacacatactgtcacagtttcgtgctggagcatttaaacacatcctgtatgactccatggggagaggacgcttagaagcttgcacctggtttcctctggacttactctgtatgctttttccttttgcagatttttttttctcatttcactgtaataaattataggtgtgagtacgacaatatgttgagacctgtgatttttcttaacaaatcaccaaacctgaaggtggtcttggggaccctctctacacaatgccctttttcttaaatacttgatatgctaacccaagaatattcacttcataaacctccgttatgaatgttttttatgtttttattgaagtgtaatttacatgcagtggaatatataaatcttaaatgtagaggtcagtgagttttaacaatgtacatacccatttaatctatacatttattacccaaggtctctcatcccctcatctttccacttgcagccaactgctctttgatttctgtcattgtccatgagttttgtttgaagaagaatttattagtatatgaactcacataatattattttgggtcttgtgtcttttgcccagtgtaattttttcttacaactttattgagatatatttcacataaattcatagatttgtgcaaccatcaccacagtctatttttagaacttttttcaacatcccccaaagaaaccttatacccagtagtagtcactccccttcctagcttcacccttccctgccccagtctcaggctatcactagtctttctgtatatatggattggactattctggacatttcacatagatggaagcatgtaatgtatggcctttggtgattggattcttggcataatattttcaaggctcatcatgtattatagcatatatcagtgcttcattcctttttatagctgaataatattctgttgtatggatataccagatttgtttatcccttattcagttgatgggcacttaggttgtattttgcttttggctgctgtgaataatgctgttatacacatttgtttaaaagtttttgtgtgactctacctttcttcctaggagtagaattgctgagttatatggtaaaaatgtttagcattttgagaaactgtcaaacttttccaaaagagcggtatcgttctaccttcccaccagcaatgtgtgaggtttctattttctccgtatcttcaccaacatttgttactgtctctcttttttattgtagtcattctaatatgtgtgaaatggtaatctcattgtgattttgatttgcattttcctaaagactagtggtactaagaatcttttcatgtgtatatcagctgcgtatagatcttttaaggataaatgtctattctaattattttcctatttttcagtagagttatttatctttttattattgacttagaattttttttatatattgtggttaaaagttctttgttggatagtgatttacaaatttattttctcattctgtggttttttcactttcttgaaggtgtcttttagtgcacaagttttaattttgaggaagtttttcttctgttgcttgtgcttttgatgccatagtaagaaactgttgtttaatcctgaattataaagatgtactactgtctttaaactagttttatggttttagctcttacatttatgtcagtgattaaattaactaaatattatatttagttaatattatatagttaatatataatagttaatataactattaatataattgttatattaactaaaatattaatttttagttaatatttgtatatgatgtgaggtagagtttcatatttattttttttgcatgttgatacccagttattccaatgccacttattggaaaagatgattctttcctcactgaattgtcctggcacacttgttaacagttagttaaccataattatgagagtttattcctggactctcagttctgtttccttgacttatatttatgccagtaccgtactgtcttgattactatagcttgtataagcttgacattgggaagtctgagttctgcaacttccgttctttttttaaacttgttttttccatgtgaattttaggccagtttatcaatttctgcaaaaatatcagctagaattttgctagtggttgtattaaatctgtaggtcaatctgggggaatattgccgttttaacaatgtcacatcttctgatatagcaacatgggatggctttccatttaagtagatcatcattaatttctttcaacagtgttttatagctttcagtgtaaaagtcctgtactttttttgttaaatatgttcctaggcattttgtttgttttactgccattataaatgggattgttttcttaatttcattttaggattattcattgctagtatgtagaaatacaattgatttttgttagtgatcttatatcctgtcaccagcatgaagtttttgggattcattcttgttgtgtatgttggtaatccatttccttttattattaatccagtttcctgttgaacatttgggttgctttcagttttgagctatggtgaatcatactgtgataaacatttgtgcacaggtctttttatgggcatatgttttccttctcttggagtgaaatgtttactagcactagaattgctgggctataggataagtttatgttgcagcttatgtgaactttgaaagagttttccaaagtggtggtgctattttatattccaccaacaacgaatgagagttctgattgttccacatttttgccagtgtttgctgtgtgagtcttttttcttagaaccatgctagtgggtatatagtgatatttcactgttattttaacatgcatttctatgaggactaatgatgctgagtatgttttgttgtgcttattggccagtggtataccctattttcaagtttctaagtcttttacccattctttttatttgaattgttgctatatatatatagatagatagatagatagatagatagatagatagatagatactttaagttctgggatacatgtgcagaacatgcaggtttgttacataggtttacaacatgccatagtggtttgctgcacccatcaacctgtcatctatgttaggtatttctcctaatgctatcccttccctagcctcccagcccctgacgcccctgtgtgtcgtgttcccctctctgtgtccatgtgttctcattgttcgactcccacttatgagtgagaacatgcggtgtttggttttctgttcctgtgttagtttgctgagaatgatggtttccagcttcattcatatccctgcaaagacatgaactcatcctttttatggctgcataatattccatggtgtatatgtgccatattttctttatccagtttatcattgatgggcatttgggttggttccaagtctttgctactgtgaatagtgctgcaataaacatacatgtgcatgtgtctttatggttgaatgatttataatcctttgggtatatacccagtaatgggattgctgtgtcaaatggtatttctggttctaggtacttgaggaatcaccacaccgtcttccacaatggttgatttatactcccaccaacaatgtaaaagcattcctatttctccacatcctgtcccgcatctgttgtttcctcactttttaatgatcgcttttctaactggggtgagatggtatctcattgtggttttgatttgtatttctctaatgaccagtgatgatgagctttttttcacgtttgttggctgcataaatgtcttcttttgagaagtgtctgttcatatctttcgcccactttttggtgatatcccctttatcattttttattgtgtctatttgattcttttctcttttattctttattagtcttactagctatactagtaaagggttgttgccttttttaaaatttgtagatattctttgtatgttctaaatatgagcactttgtcacatatatgctatatgaatatttttaccagtttatggttattcgtttgtttttagtggtatctttttcatttctcttaatcatttaataccagtatataagaaaatttttcatatgcatgtgtatatgtgtggtctaaagttgtataaatcctatctttttattataaatattttatataatttcttattagttataaatatgtaataaaatcataaaatgaaaattatctttttaaatacttatagtatttagactatatgtctgtttagtattttattgcatagataacatctcttatagtaatgacatagggtagtggtctttcttgttccagatttttaatagaaattgtttagctgttctgtattaagtatcatattatatagtatttttatggtaggtgctatttatagtgtttagaaaattattttcttcttagtatttttcacttaacagtgaatacgtaatattactggttttcttatagccgtctatcaatactgtatggtttttctcatgtttccgtggatgtgacagcagtttgttcagttaaaaagtcattgacttcctggaataaatcccttttggttttggtactattgaatttaatttatttagtggttttatgattttatatccattttcatgagtaagattagttttcttttttaatgtactacatttgtattttttttattggtttgtgatacttaataaaatgaattaggtagtactgaattcttccttgtattacgtgacagcttatgtacattagaaataatttattgctcagatcctaggcttagaggggtcttttattggaggtagattttttgataatgttaaaaatttctccaaagttattaatatccaatttacatctaaaatgtaaattgtattatttttgttagaaacccagccttcttatcaacattttaattacttggagtataaagtaagaattgtatatagtattctttgttttaaacagtattttattaaataacatgcagtcagtgtgggaaaataggaaaaaataatatactagcagaaagtaaggagaaatccttctgtaccctttagagataacctgttttgtgatatataacattatagcattctggactttttcatatgtatatttaaacacagtataagtttttttccacaaggataggatagtattttaaaacaaatttattagagatagtaaagtgtttaaagctatcttctctacaacttttgtatctatcttctttatagttttctgtagggcatttttatttgactgttagtctgtgttatttattttttaaagagcaggttaaaattttttaagctaaaaggtattttgtgtttcttcatactaccttatctttattttcctctttctttgctccttttgtctgttttttgtttctttttctctcaaggagttggcaacaggtgcatgtgcacacatacatacattttggctcatttgttctttttctacaacgtgaaggtgagtggcagcgaggcctcttgtgagagagcatacccatccatctcactcatcctgtggagtcagcataggcaaactgctgaaatggagttggagctcatttctgcagtccaggcagaggacaatggcaatgtggcagggtcagtctgagaatgtatgttcctcctacctcaaggtgccttggagaagatcagtgctggccttcgatgtgctcaggggatgtacttatgactcttagcatgtgatatgaggtatctcactacttcactctttcctccatcccaaatagtgaacacacttaacaacacttacaacatcataaaactgttcagttttagaggtataattgtcaaaagcacaatgtgaacaaatgcagcttaaagattgaattggctttattaagcaattcatgaacagggcaacatcccatctaaaaaataatattctgatgagcaaagcagagaagactggctttataggcagcaaaaggctgcaaaagcagaaataggaaacaaaaagtaggttggttatttcaaagttacttcccttacagggttacaacagaggagacttcgttatcatgctggctcaagtagaccaggccccttctgattgtggatcagattgcttcaaatctcctggtttttgttgttgttttttaaactggtacatattcaagttcagtttgattatgtggcacctagcacaagtgactgtattctggtttgatgtggtcttttggggtgtactgcagctgctcagcctaatacagtggccttccataaattttatttaacatagacctctatgaatttaattagtaggcttttgagcatcagagtgagactcactacatgttccataaagctgagaaaagccaggttcagggagattttcccttggcccagttactttctttttaaatataaggaacatatctgaggatatgacatttctttgtattgtagctttggctgcatcttatgaattagtgtccttggttttgttttcttttttttttatttttaagttttttttaaaatttattttagtattattattatactttaagttttagggtacatgtgcacaatgtgcaggttagttacatatgtatacatgtgccatgctggtgtgctgcacccatgtagggacatggatgaaattggaaatcatcattctcactaaacttggttttgttttctaaagaatttaggacatgttattttggagactgtttttacatttgattatgggatgcatttttagttgtttaatctttggctattaatgtctgcttttaactttattataaaaattgaccattataactttttttttttttttgagacggagtctcactctatctcccaggctggagcacactggcgccatctcagcttactgcaacctccgcctgctgggttcaagtgaccctcctgcctcagcctccctagtagctaggattacaggtgcttgtcaccgcacctggctaattttgtgtttttaatagagacagggttttaccatgttggtcaggctggtctcgaactcctgacctcaggtgatccacccacctctgcctcccaaagtgctgggattacaggcatgagccaccgtgtccggcctattataacttttttgagcttttaaagttgtcttttgactaccatatccatattacaaatatatttcctgattcctcttaaactatagtattaaatatacttagaataatccagttttattaggtactattcgtattactaatgttctaatttttaaacctattaggtttgccaaaaattgactgatgttaattcttcttaatgttttccatactttgttcttgtattttgaacagtttttacttttatacttttacttttgataatcttgttcttgcatgaaggcatgaaatctttttgatgagctttccagttttattagcaaatgtgccctctttataaaattttggatttttcttatattgtactttttcctaagtttgccccttaccctccttttaaaaagtattgccaagaaaaaccctagcaggacactaggttcctttttaagtctatccctagttctccactcctttcatatcaaagttttaaaaaatatagtttacactttctcttttctacattatttagtctcagggactctttattccattgcagctaggttgctacccctctggatccaacggttttgatgtggaaaagattaccagtgatgttataattgttaaattgaatggacactataaactctttgacatcactgcagtgtttgatactgatttttatctttttttgtaagcttattctgtccttgttatttggacaatacatactccttttttaattttataacttaattttgatataatttttaacttataagtggcatcatagtacttgggaaggactcccatgtatcttgtacattgattcatatgtatatttttctgaatcatttgagagtaagttggaggtaccctgtacccttatctctaaatacttcattgcatatttcctaagaaataaggacacttttatacgtaaatataataaagttatcaaatcaggaatgttaacagtgatacagtaggacagtgtagtccacaggctgtattcagattttgtcaattatttcaataatgtcttttataaaagccgcttttccccccacccagtcaagaatggaatccatggtcgtacattgcatttagttgtcatgtctctttagtttccttttatttgaaactgttccttagtctttttttggggatttcttgatctttatatttttgaagagtagatccacttttgtagaagtctctctatttgactttgtcagtttcttgatgatgggattcaagttatttatgtattcttcctatctacctgtttgtctgtctagttacaatatcactgcagtaatgtgatgtcccattgtcctcactgcatcatatcaggaggcatgtgatgtctctgtcctagtactggtaatactgggaacaactagttaaggtttgtctgctaagtttctccactgtgttaaatttttgccctttctaattaatatgtgggagatacattgggaataaatattctatacctcagccatctctcatgtttatgttttagtgtccattgatgattttctaattccttctataattgctagttggcattctactaaagagaagagctttccttcttattttctgtttatttatttatatcagtatgggctcatggttaatattcaatgggttataatgcattatttattttcacacctcagttgtcccagatttggccattagaagcctctttggtcttttcctgagttattttaatatgcccccatgatttcttgactgtctctttgctttatgacgcaagaatatattccaggctatcatgtactttcctggcttcagccttggaataagctatttctttcaggtttttttttctttgtaaaatgattggtatgtagaggccaagatgtgagagctaaggtgtggtcattggtactgaggttttattgcatctaggtccttcaagtgcactgagttggaaaatttgtgtatgtttgtgaatatacatacagatacctgtatctatatttttatatttcctcatgaaaaaccataagttagtaccgatatctcctgttgtaatgcaatatcatagggtacattccagtcttccacatttgtagttacttatcttactgtgaaaattctggctcccttgttctcatttgttcaatcttagaatacatgaaagctgccttcagaattgttaaatccgtgctaccacaaaaaccaaagttactaaatagagttcaatatttctttttaatttttggatgtaaattacatatgtgaaatgcacaaatcttatgtggtcagttcttttagttttgacatatgctctttttgagttttgactgtatactcttggtcccctgtagatcctgacttttccttattgtcctttactggctccccatgtctatgttcttctttagtgttgtttacaaagttctagttctctttgttgtcttgtgtgttactttgtgttacacttatttgaatgacagcctctgcaaactagagtcaagatctaatttaactcgtttttgtaactgtggggtctttcatcatcttaggtaaggtgcttaaaaggtgtttgaatgaaaaaaaatacacacagcaatattacttatgtcagtttataagttgtaagtagacactttatttgagaatcccaaataattaaaacatcagatttttataatgctagatgaacaatcttattctaaccagtacatttattatctttttcatttttatttttttacattttatcctctgtgaaattgagatatatctttagtcagtagttcacattattggtgtgagccagctatgagaaatcactggcacctttgtaggtagagtgaaagcaccagcatcataatgacttaagatttaatgaaatatggtatagttattttggcctgttctgccactgtatcataagatgatttggggcttttgtaatgtgtaaaagacagactaaaaaagtccttaatgttggtgttgggaaatgtaagttgaaataggtacgttacttttctttatcatgtaatagttccagagttatccagctccacagatcacaggactgtgatatccttccaggaagggccctggtcctgtttattctctacctctagttaatggcagtggctttataataggtaaaagatgttaatggctaaaagatggcagtatttatttcaactctaactgattaatttcagtgagcatcctctgcctatgtggataggcagtggcacaatcctcccttcatgatatcttgctgggaatacttggcagaggataatgctgggtagatccttggtctgatatctctaggagactatacaatgacaatgagtctgaatgtgttgtgacttctttttatttcatatatcaattaaaaaaattaacacttatcatctttatccacaggagtgaaacctcggtccggctgggctattgatccctttggacactcaccaacaatggcttatcttctaaaccgtgctggactttctcacatgcttatccagagagttcattatgcagttaaaaaacactttgcactgcataaaacattggagtttttttggagacagaattggggtatgtagggtttgatgaaagttgatcccatttggcctagatactatttcacaagggttatgaactcatgccactgtgggttttgttcactgtcagtcttgaaaaatcaggtggcctaaagatagtcactctcgtaattatttttcccatgtgcctgtgtcaagattcttttaagtaataatgcagatatttatagagcataggagaatctttttatgtttaaagaaagtagataaatataaggagttagtattttgccaataatgctttcacttgcttctgttttagaaagcacgttttatcacaaatttgaacatgcattagaactgatatccagtcatatatcttatattcagccagtgttccttccttctgtctctcgtctctacatcttgtaagaattgctttttaaagccttaatcctgtcctcctaaaacagccctaatgtcaaaataccacctgtcttcacagtgtgttctgtggccacgcaggcattctaaggatatacttgtgcagctctttattaggagagaggagaaaagatctaggcctcttgggaggcctttgcctttctcaacccctatttaattcagaccaccttattttctatttatttatcgagcctttattatgggccatgtattatgttacctctgctttatattcattctcatttaatctttttaatattattctttttttatggtgaagcaatggaggcttagatatgagaagccatttgccaaaagtcatataggtcatgcatagagagcagagatttgaatgtagttctgtgtagttcctgaagcccaggctcctaacctctgtcattgtgttctcagtaaactttcatctgaaagaaatattttgtttataaaacagtgtttgagaaattactgcattacattatacttgttttcttgtgtaatctagaccccttaagtgtttcagaaaaatcatttgtaaatttagaccgtaactttcttatatgtactcctgtttttttcagtaaggaaagcattagctatacagtttcttaattctagaaaattaaacctgtagggagaacaagaacttgtaggggattgcattccatatagtttgatcaaatgctaaggagcatattaatttgaaaaacaaagaatttgaagaagccctacttaaacaattgcccataaatatcagttagtatgaaattattgagtacttttatgtatttcagtattgtgctaggaagaaatgttgaaaacatccttgcttatagggaaattccagtctaatttgataaaatacggatacagccaaatgtagcagataaaattaagtatgcaaattagctgcaaaagagtagcgcataaggagaattagtggggtatggagtatgtccttatccataggagagaagagttttaggacttgtgacaaccttttgtggcgactatatgctcatagcaagcattagtgaccagcatctacagtgtcaccgttgtgaatatgattcagtgaaacagctgacagcactgaagtacatagattttaatagttttaaatttggaaaataacagttaactaaattgataaaactggaatattttaggacttacctgataaatttgaacatgttgctttttaaaaaatgttttcgaattaagttgagcttgttcacgtgttcgagttcttaatgaagcagttattttcacttattaaaaatgtaaatttttttgtctttctgttacgtaagcagtacatactcattgctgaaaattggaaatccatacataaataaagggcgggggctatttaaaagctcaggatcatattcgcaaagatagcttttaactactaggtaggtcctccagtctcacttgttggtaggcttctcacctctccaggccaacatgtgataacattgtagttttaattaaaagtaattctgcatcaggaatcagtgctcattttccatatcttattcgttttgtttttatttttgtttcgctttttgaaaattactttttcttttcctgtgcttctttgttggtgaaaagtcccattgactgactcattcttggtaaacatggggtgagactgtagattctcctgggttgcacatcctctcctcaccataagaggaaattttctccaagagtgaatttctccagtgtttttataagtctatgctccacacttcctttgttcttccatcccttttttactccgttcttctcacccagcctctgcagctaatatcatggtatctctcagtgaattctgttacctgaattgggaacagttacggcaggaactggcagccagggatggacatagttttggatgagccagctgtaacttttacggctgctcagtttgtatccctcctggtcagctggcgctggttcatgctggggctttcctgtctctgctatgcttagatagaagaggtagatagagactgagatgtgtgagtatcttccttcagacaggtggccattaaataccgctggggtatatgtactggaagttaaaggggctgctgatttagcacagagctaaatcagcattactttgtgtaaagtaatgacattttgaatattttttgggaaaacagattttataaatgcaggtttgtgtgttggctctttattttagatctgggatctgtcacagatattttatgccacatgatgcccttctacagctatgacatccctcacacttgtggacctgatcctaaaatatgctgccagtttgattttaaacgtcttcctggaggcagatttggttgtccctggggagtccccccagaaacaatacatcctggaaatgtccaaagcaggtatgaaaatgcgtatttcataagacaacatcttgaataaagtagccacttagctgctagttgctgaagggttgaacaaatgggctttattagccaacattatccttgtttgaagtattcattcaaaccagatctaaagcaacttaaaaatgccagagccttgactatgccggttatgtgttacattttaatggaaagtgaacaatactagatcaatatacaatggataacctataatacactattattaccatctcctttgccctcattataaaagccttctactgtgtttgattgatttcatatacttttgttgaataaaacttctggtccctattgtacaaattggtaagaaaagcaattcaactgcaaaaacacatttattgaaatggagcacataaagagtgtaattatctgttcccttaataacaatttcaataatagtgaatgcttcccagctctggtgtatacacatctttgcatcattctgatgtttttgacttacagtaaactttaattaggaatatttatacttaaatacatttaaataaaaatcaaaggtatgaatcatttctttagaagaaaattgtgctaatgatggaagcatctcattaaaccaacttacatgtagtttctaatattggtacttttaaagtttaatttcttcacttaaaaattagtagtgtattaaaatgaaacattgtggtgtaatataaaaacactaaactctgctaggaaaataatatagcccattaaataaattaaataaatttatttttgcactattaaatcagtttattttcaaaagagaagtcacttaaaaaaaagtgtgtgaggaagaaggtggaatgagatctttttaccttcaatgagtccttagaatcacaaagattttctttgtgagcctctcactgtggcagacatgaaggtgttttagcatggcagccttcttaaagtcatggagcccttctatcaaaatgtgactttaatagttatttagaaaaactgcccaaggttagggattgacttgatttcattttcttggttcctacagccatgagaaccactgaggaattctgaacaacctgctttctagctagggttgggttaagtaggcataagagaataagccagtatattgtgtggtggaaggtgtaataaaaaggaagggttgagtgtgggggcaccctggcctgtgtaggtgggcaaatagctgtttatatttacaggtatttacactactctctgctcaggtgaccagggatggggaagttcttaaaagtgaacaagatgtttcagctggggagtcccagtgcattcatagtattgtgagccctttgttctttttttggggggtgctactgagactacctgaggcacattattgaggaaaaaaaggcttttttataatccttttgctatgtcatctaacctttcaacaattgcccctcaggatgataccttgtgctcatttagttccagtggttttgaaagtgatttccaggcacctgggggcatactgttgaatgagtctatataatacttagagattttttctttttaaacttcttggccgggcgcagtggcccatgcctgtaatcctagcactttgggaggccgaggcaggcggattttctgagctcaggagtttgagaccagcctgggcaacatggtaaaaccccatttctatggcggagtgtgcctgtaatcccagctactcaggaggctgaggtaggagaactaatagaacctgggaggcagagcttgcagtgagccgagatctctccactgcactccagcctgggtgacagagtgagacttcgtctctaaaataaacaaacaaacaaacttcttacaagtattgaaatgttaactctactggttacctcagatccatatatcaccttcgttttgacctgatgatgaattgagatcaaacacaggcattccagctcattggcccctttcaagctccccactttttttgagacaggttctctttctgtcacccaggctgaagtacaatgacacaatagctcactggagcctccatcacctgggctcatgcaattctcccacctcagcctcctgagtaactgggaccacaggtacatgccacaatgctcgactaattgttttaaaaaattttgtagtgacgaggtctccctgtgttgcccaggatggtcttgaactcctggggtcaaatgatcctcctgcctcgccctcccaaagtgctgggattacaggtatgagccaccatgcctagccctgttcaatttgttaacgtcccaaagaaaatgaaatttaaccataatgtacagatggcatcttttgatatgtccagctcagcaggttcttctactttgcaagtaaagaaatatcattctttgtcaagttcatttttggtcaagtactatatattttaagttggctttttctattgaccgtcacgtgatttgatgtttcggggattttatttttcttggttacagttaagttgacatttcttacctggtaaaataaatcaggagcaaattgcatctgtatgttttcaaatgtgatgttgggtcaattgatttgttattggttccatatatttaccatattaccatttaccaattaccattggaccatatatttagtgagtgtcttcttcctgccaggcgttacaggctggttacttggctttcccagtgttgacactttctggacaggcttgagagttaggatagatgtgaagtgttaaaggcatgccattaacgtttgtgatttcttttctttatatgtgctttacacatatgtatacaagatactctatatctaatagtaaacccttttttatgctggctgcctaggaaatctagttggagctcaattatatcttatatctatgatttatatatttgattatttttactcatttttttttggtagccttctttctatgtggtcaatctcattcttcatgtgttttttatcgtaagtaacctaaaagtgttttggcaaatgtggaatgttagtaaattactagtaaagataaagtaatgtgctaatgtcagaaaactaagcattatatgttacataaggacgctgtggttatattttactcaccaaggtattatgttactgctaaaattttatatttgcaaagcaatttcagagattacaaatgtaaaaaggaccatatgagatttaaatttagttaaatgtttataatttttataagatgcttcattctgtcattggtgttctttgagatactttcgtaagtttttatattgtgaattagaatttacttttggatgatccttgaagtgaaaattataaaaatacttgtcgtttaatcactgatttcttaagctttgtctttgtaaatattgtgaactgctttgggttcatccacttgtataatttcattttcacaagccctttgtcttagtttgtattctcagactttcttaaatgatgccctaattcagtgatttccaaaggacattctgcagaatactataatagaatatgaaatacaaaagctattccatcaagctattggttagagtccagagaagtagaaaccaaaataactaattcaactcctaatccttatctgatggtcagtattgaaaaggacactgtgacaaatactcagattattggtggcaggtgacaagtgtgtggatttttttttctttagaagaggaaatatgactctataaaatgttacagattaacatttattcccttttggttttgttcaaagtacacttttttctatgtttaatcagataattttagattagagaaaggaatattaagacaaagcaaacttcaaagtctgtatatgtgggaagtccttattgtcttactagataaatcattttaacacctgggctatctggtattcaatctctgtggctgggctttaggaagtcattggtaccccacttattatatgccaagttggtacatgaccatatttctccaaagataatccattggaaacctatgagtttttccttctgataagaatttatgaatatttttaaaggataatgaaaattagtatgatagttttaaaaaaatctgtctttaaattatactaaccttgcagatagataaaatatacagtttcttttaataaaatgtacttttgaatttggttatttcctttttaatcaattgtcacattcactttttcttagtcaaattcatatttgctgtttttttgtgtttgttttttttgtagggctcggatgctactagatcagtaccgaaagaagtcaaagctttttcgtaccaaagttctcctggctccactaggagatgatttccgctactgtgaatacacggaatgggatttacagtttaagaattatcagcagctttttgattatatgaattctcagtccaagtttaaagttaaggtaaggagaaaatatttatgattccgtatttgaaattgaacctttattattaaatgagactataaacagaaatccttagcttctttgtcctacatcacagtgcttcttagaatatataattcttgtgtaaaatataatccattaggaagaaaattattatatgctgtagttccatatctaaagttgtcccgttcctaacactccttgaggattaaagaggaatttacttttatgtgattgaaaatatgtacctaccaagttgtgatatttagtcttcagggacttactgtttttgttgtgcttgttttgttttgttttgtttttttaccaacattgaaagtctgttatttctctctgacagctgcatccttgtgatttagtagcatgactggcagatgcagatgaacatgtcatgaattttgcaaacaaatgtcctatgtccagagaatacactaacatttttttttaagtgagaagacttctaaaattaatcgtttgcctatggttcttactcttttttttttcttatggaaaatttaaaatgtactgtaaagttctgaaaatagcaaaaattgttccccttctccccatatccatggctcagctgcagcattcttcaactcaagaccactcttgtttcagccatgccacactgctgtctcactcctccccataggattatattgaagccaatctcaggtttcatatagtttcacctgtaaatatttcagtatgtatctctaaattataaaagttctgtttaaaaatataacgataataccattatcacacctaaaaaactaacaataatttcatgatacatatctggacagattcaaattttcctcatctcataaaaaacaattcttttaacacatgctttgtttgagtcaaaattcaagcaataatcatatattgcatttgatcaagtttttaattacaaaattgattttttattgatacataattatatatatttatgggacacctatgaattttgatacatgcggagaatgtataatgatcaaatcagggtatttaggatatctaccacttcaaacttttatcatttgtttgtgttgggacaacaggcttttaaagtcttttttttttttttctttttaaatgtgtcttagagactctacataagaagattaattattcagcatgtttattatttcacatattgacatgtaaaagtagaacatctgtgaaaatactatagaaaggaagtgatattactgtttaggaaatttgaaagctgatggtgaactatagtttagtaagaattcaagtttattaaataaacctaagtaatatcaaatagataaataaacctaataaaatatcaagtttattcaggattgttacagctgaatttttatcagattatgaactcggatcctaggggtatgtttaaattatccgtgtattttcctgagagatgatgctcatacatgaatatgtgatcagaggaagggatatatatatgagtatcttatctgtaattacatcttactaggaagtgattttggttcatagaagcatctggtctcctgtctgactgaaaaaattagaccctgattttagtattctacctatttcatcctttgcctactagaacagttttttaaaagtcatttaaaaaattgaagtgccacatacatagaagaagtggacaaaccataagtgtgcatagaattttgcaagtttaaaagtctccatgtaaccatcatccagattaaggcttagaacttttattgtccctcagatctctttccagtcatcaccaactgccgcaaaagcaaccactactttcacatctgtcaccatgattactgttgcctgttcttgaattttatacgatggggaccatacacatgtactttgtgtctggctttttcttttcacattatgtttgcgagagtcatccattctgttgcaggtagcagtagttcattcctttttagtactgtgtagtatctctagtattcattttttgatgaatataccacagtttattcattgtattgttattgggtatttgggattgttcccagtttttgtctatcacaaataagtctgctttgaatattttgtccatgttttggttacttgttatgagtttacatgggtataaaatgggatgtaattttttggccattgagtatgcacatgttcagctttagtatatattgccaaactgttccaaaatagatgcatcaattgtgttgtacaagaggttcagttgttccacaccctttctcagtttgtattgtcaggatttttgttttccatttttatccttttgatagatgggatggttttattttttatttctcctgtggttaatgaggttgagtctcttttcatatgtttattgccatttgagtatcctcttttgtgaagtacctatttaagtcttttgatgattttttaattaaattggggttgtctttttcttactgtttatagctctttggtacattttgaattctatcttttttcatataaaagttatgcaaatgttgtctcctactatgtagcctgcattttcactttctcatgctgtcttttgatgaacagaaatttttaattttaattaatcaaatataactatttttctttatgtttagaacttgttctgtttgaaaaatttttgtttatcatttggttctgaagctacattcttatgaagctatcctctagaagcttaattgtcttgccttcaacatttaggtctataatctatctgaaatggattgctgtgaattgtgtgagggtagggatcaagatacattttggcttatatagatatccagcaccatttattgaaaagaccatactttcttccacagcaccacagtgtcatctttgtcattaatcatgaatgagactgcatttgtgtgtgggtctgtgtctacactctctattcacttttgttggtctgtttgactcatctcacactgtcttaattattaacactacagttttataataggttttaatatctgatagtaaaagtcttccagtttgttctccttcccaaaattgcattggttactgttagtcctttgtaattctacataggtgtaggtcatcttttaaatttctaccaaaaaaaaaaaaattgaaggggattttgagtgggattgcattgaatctttggtttgatttgagcacaaataactacaattattgggccatctaatcgatgaacgtggtgtattttgtgtattaatgcaattgatttttgcattttagccttgtatccagtaactttgttaaatttatttattatttttagttatttgtggattctttatggatttcctatatatgagtaatggcatatatatgtcttcctttccaaagctttaaatctttccatctactttcttaccatgtacaatggctgtgtcctctagtataatgttgagtaggcgtggtgaaagcagacataattttctaagagagaaaacattcgttagtcataatgtttgctgtagaattttgtagattccctttatcagattatggaattttccttatattcctcatttacagagtgttttttcatgaccagatactaaattttattattttcttcttctaggacattgctttgtgttaggcctttatgtcttgtgcaatgattgaaccagtaccccaagatgaaaatttggtagagtatagggtccaccttaatgcattttctttctctccaacatttttatcccttaagttctggctgctttagttctttaatgtcttcaaagctttttctttctacagtttatctagttatatctgtttcttgtgggatacttaaagttactttgtctgaactggaagcataaatttaatattttcttttaatgaactggagaacaaaagtaaataactgagttcagatggctgaaaaattgacgtggaatagccaagacagtcattttgccatttgatcatcatttaacaatttttgtaatttttcttatgtgttgtcctgatagaattcttacatttaagattaaagttgttgccttttaatgtaaaaaccatgtgaatatttttatttggttattcttaaaggtgtcctaaatatttactttttatgagctaccaagagactttctagagaaatttactttaaataattactttaaaaaatactctagcacaggtactgagttatttttctacccttaaagattgaattaagtttttgagaaagcctactaggctacttatctaaactgctctgggacattgccaagaaggaagtatttttatcttggctcataccaaaaactaattgaaatattttcaaaggctatactttattgttaatactaattctgtagcatgctatagatttctaaactttgaagttcaaaatggtttttattgtctaaataaaatcctttgttttatgtttgaggaaagtgagactcagaaatatttagatcgtagactattttgtcactcttattatttatactttcctgagctcatctgtatctgctggatatgaagttaatgccatatttccttctattcgtgactcatttcttttatggttacacacacacacgcgtgcacacacacacacacacacacacagtcttcttcctagtaatgcttgtgagtaataatactcttagtgttagctaaaacatattgagtgcgtattatttgctgtaaattgcttaaagtactttatttaacttatttagttatctgaacattttctggtaggtcctatgattgttcccattgtagatgaggaaattgaggcacaaatagattaacttgcccaagatcactctctgtttggtgaagccaagatacattggctacaccaaattgaatacagttgaaaattgcttatctttaatataaacataaggatttagaaataatcatctattttgctgtaaaaatatattgcaccacaactagattacagtcacttatatttgccttatcagtatcattgttgtaaatgttccagtcgcaattttgtctttgcagtgaataagtgatagctaaatttataccattattggccagtcatggttgtaagtttttttttgtttgtttttgagatggagtctcgctctgtcacccaggctggaatgcagtggcgtgatctctgctcactgcaaggtcggcctcctgggttcacgccattctcctgcctcagcctcccgagtagctgggactacaggtgcctgccaccacacccagctaatttttttttgtatttttagtagagacggggtttactgtgttagccaggatggtctccatctcctgacctcatgatccacccgcctcagcttcccaaagtgctaggattacaggcgtgagccaccacacccggccagttgtaagcttttttcttagagccctattcactgtaacgtggatagacagagaagttatgtaatatgctcaaaacacatgtcagataagtggtagagatggaattcaaagctatgctattgctaccttgaatcaaaatgacttgcaatatctgtgtgtgtgtgtgtgtgtgtgtgtgtgtgtgtgtgtgtatgtgtgtaggaaacaacaaaatccgcatctttcttttaaaaggaacacattccctgttaaataatctgtttatttttgacaggactgccttttaatatctgtttacaagatttggtatcgtgtttctttttgtctttgatttgtagaatagtttgaactcataaaaacgaatttcttactgctgatttaaatcattagtcagaaagaccggtgtgtttaagcagccagacttgccattcttagcactccttggatttaacttctactcagtgttacctactggtagagtaagttcatttttttaaaatgacctgctgttcttaaagtcccttctccttcacaagaactcaactgggggaaaacggagatagaggagggtatgatatatgaaataccttatggctaacagaattattcttctagactttatggctaataaaactgttattgtagacttctggaacactttaatatgtcttttatttttgctgctgccctcatctttcatttatgtggattaatccatgcccaaatcattgtacactttgaaattctagagatatgtaggagttttcatattcactgatttgtagatctaaatagctctccttttaactgctgaagtgtataagttttcccttagtttaatttgggccttaatgtaagtaaaaaaaaagtcactattattttcttccctgcttctgatttttataaaatctgagctatgtattcatcttaacttggaaacacatgttaaatatttattattaactttccctaacagtgtaagaagtaaataattttaagatagaatgaataattgaagtgcatttttttaaaactagatacagtttggaactttatcagatttttttgatgcgctggataaagcagatgaaactcagagagacaagggccaatcgatgttccctgttttaagtggagattttttcacttatgccgatcgagatgatcattactggagtggctattttacatccagacccttttacaaacgaatggacagaatcatggaatctcatttaaggtacttttacctttctatagctacatgtattttttcactttatattatcataatctttttgtagagttttacgtaatatacatcattcatgtagtacattatgtagtgttaagctctaattaagcacttagtgtaattgtgaaattttaatgcaatcagaaatacgtctccaaactacaatcaaattattacatgggtttttgttctggaagaaaaaatagtttatttaaattagatttttaaggagttgtattctacattttgtatttttctaattaatttacctgtgttatttgcacaccatattaatattcagtgacaccatcatgagtgtctgcaggctggtaatctgataggcttctcattggaaacataggtgagcatcaaagaaggaaatagggcctcccagcagccaaacgtgagcttcaaagttcacagtccaaaactaatgtattttgtatgtgggagaactttagactaggcttcatctcagttcttacatacttatttgaagcacatttctataggcacagtcatctgcatagaagaacaacatttgaaaaaatgatgactgatgggtcagatagtgattgaaaatgtaaatggatacagagaagacagaaaagtctgtagaagacataaaaacactaaactgacactatccaggagaactttcaatcactgatagaatgttctatagtgataggttctatttctgcactgtccaaaatatagtcattaggtacatgtgactattgagcacttgaaatgtgcccatttaattttaattaatttaaatgtcaatagccatgtgtggctatggctaccatattggagagcatggtcctaagtaactaacggaggctggttgttgataaagttaaaactactccagaggctcccaaagttttctctatgtatagaccagtaaagtaattcattttcatgatgaatcttgatgtttgagttagattgtacttaccgtcttttatatactagtggacattggttacattttggaaaggctttttattaaaaattatgaatttaagagttgtatttttatatggtagttttttattgttaatattgtgctgctattaaatactatttcaaaagcctaaccttttactgttactcgtaatatgccagaaaaatgtctcattttaaaaaattattttcattattatagatacatattagttgtacatatttatggagtacatgtgatattttgatataagcatacagtatataatcaaatcgtaatttgtatattcatcatttatgtgtttcaaaataactaaaagtagaattggaatgtttcttacaaagaaataactgcttgaggtaatggaatatatcttattaaatttaaaataatgtttacatattatagtgactatccattcttaccctacagaatatcaaccagttatctcttatactattctaaacttttctgttataaagtgggttatattctcaataatgtagagatcgttttggaccactgaattagtgatttttaagtgccaaaaagaatattggtttatcttaatttattgaacatattcaaggcattgtggttactgctagtaatatatttggaaaatcctgctgcattaaaacaaaccaaaaaaccatacaatagttatgactttccaaatgtatttatttatacataagtttgtctgaaaatagtaatatttcatctctctgctcatttgcaaaatgtggataaaatataaaagtatagggaagacaatatttcccaaatcttctttttaacattttagggtgtctggatatgcatatgtactccttttaaaaccaggaatatttgccatggatatacgttaacatagatacacaatttagttaattcaagcttagtgattgttacttcatgatttttggaaggattagaatttaaaagtggagattgtttactctcctttgattatttctacagtttagagaaatgcatcattttacaaacaaagtatttctagtgtctcctcttttctgaatcttgataacattttcaagttgccttgattctgtctgcattgtccttaaaacatgtttcgtgtatagaaccttcttatactttttacttcatcaagccatgtctccttttaaataagtttttaagaaaaacttatcttgagccatatcctctgatgaaaaaacataaaaggtggaaattatagcccccatgttcttcttagactgaaggttttttcctttaaaatatactacaaaggacattttttttttaagagacagagtcttgctctgttgcccaggctggagtgtagtagtgtgatcctagttcactgcggcctcaaactcttgggctcaagtgatcctcccacctcagcctcctgagtagttaggactataggtgcatgtcactacacctggctaagatagagtctctctatgttgtccaggctggtcttgaactcctgggttcaagtgattttcctgccttggtctcccaagatgctaggattacaggcataagccaccatgcccagccgacatactgtttatcatctttcagtttgtattgttaaattctctgtatttgttatatgttatcattcaaaactgaaactaaccctttcccctgaactattcttgggccattattttctgcctctcctctcctctgagtgtcccgctcaccgaccatgcctttctttctcatttctcttaatgtgtatatgtgagagtaaatgatattctggtgatgttcatggtctatgtgtgtgttgctcttggagagaagaaaggacagagaaatttatccaatttttcagatttttttcactgtgctattcataaataagcctgtcttgctgccaacaggttctggcttctttttcaggatcatctagaacaaggactcctgataccagtgtagacatggtattctttgatgattgagaacgtaaatgtgttatacgggatacattggttgttttatatgaactattattaccaatatctttttcataaattgcttgtactgcaattatggattaaaaaatttgtaaagtatcaatgtcacaagttttagattataagctaaagtgtttgttttaaaataaaaatatgacttttatgcaattagggctgctgaaattctttactatttcgccctgagacaagctcacaaatacaagataaataaatttctctcatcatcactttacacggcactgacagaagccagaaggaatttgggactgtttcaacatcatgatgctatcacaggaactgcaaaagactgggtggttgtggattatggtaccaggtaatctaattatagaaaaatcatctttaaaaaaatcattaaaattatgggtaataagattatatcttttggtgaagttgttagtgtatatcaaaccacattaacaatgatatccctcataagtattactgtatcaaaacagcactgatattcaaatattaagaaatctgttgacagagtcccagctgcaccaactttttattgcaatgcatttctgcaaatagggtagtaaaatattattactactgtttaaagctgatcctattttcttctaaataacagtgtggagactggagttatcttcttgaccaaggacttggcatcaaataaaacatagttataatgtagagagataaagattcctacttcattgtatgtcagtttaatctcatcctatttcatatccaattgttcttgtatacttctttttttttttttaagaggcatattgacataataagctgagaagcatagccaggaaggaaaaagacctataaaccttatcatatgtggatgatataagccattgggaatgagaaaggatgacctgggtgttggtatcaaagccatctttaactcattgaagggctctcagatgggcaagggagtagaagctaagttatttctatattaaagactttgaaacaatgagtataggcatggtctgagataacagaggacttggcaaacagagcttcctaataagggggaagaaatcttaccttttgtagtagggagttctctatcctcacgccagcctttggatgaccattcattcattaggatcagtgcagggggcattcctagattggggaaggagttttgactattttatttactgtagtttagactattcttcctgatactgtttatcagcagtgttgtgctttgataacattttaaagtcatttaaaatatactgtgattttcttaaagaatagattttaaaagtgaatatccttagtactactccttgatgagaaaagcgtatacaacacataaaatcaatgttaaaaaattgactcacgacttatattactaattgtagtaaatgttaattaaatttttagttacaatattttgactggctttctagaaattgggggaaaaagatattcttgggttttcattagttgatttcagtccttaaaaaatgcattcaaagtagtatcttgaatatcttctccattttttaatggcaaatatatatgacacccacctgtcgaggttgatctggggttaaagtagaaaaccctcattagatgataaagatggtatttctcccacagaaaccatttttgaaagtaaggtcagatcctccttttttccttcttacctgctcctggcctgcttggtttgttgagagtttaaaagtgagactgcttagaatcagaccagggtagagctcctaagaggacatagaaaagtcattttcctacaccgcccacttgctatctctggctgtcatatcgaaagagatttgcttataggtcattgagctttggctacagaagattttttgtatcttgacctgtctggaagagctatcattggttcctccatatgttttgtgttgcttttagcttataaaaacttccccgtgtagaattgcgtgttagagaaaaaaaggtagtaagtctcaaactgtacttggcatttgtaaatttgctatgttagtacttcacagttcattgaaaagtcataaacaattaccaagtcattagcacagacattttaaggaggaaatttcaaaacataagttagagaattattaacaaagaggtagttagtattgggtgttctcttgaacttggactgatgactactattcattcaaatttggcagaaatatcactgtgaacaagtttatgaattaggggtgcatttggctgcgagtaatagcaaccagaaacagaataaatcctgtcctgcttatttttatgtcatatgaaaaaaatctgtagacaactggttctggtatggcagctctgcagtgtcatcaggcattcaggcccttctttctcctctgccatagtagggggaatctgagagcatgctgtcaacaatagatcgaatgtgtatatagttacaaactggaaagcaagaatacatcatagcatatttggagattaattctaatcatggcatgaaaaaaatgaattagattgggacaatgtttgtaatagtcagcttaaaagtattaatagataatgtggcttatgtagaagggaagaagaaatggtaatgaggtcatttagagaaatgttttagaattccgctaattattcctaacttgtaattaaggtaggtgggagaaaacggaacacagggtgagcgtgagggtcctaaaatgtagacaaactatatagtggcagacatgctaacatctccttaatacaacaaccataacagcaaactaagaaactgtgattcccaagtgatttttcccgaaccgtattccgtattaataggataagtgtatgtttggaaattagaggccctgaaaaaaatcctgtattaatgaaatgttgaaacgtttagaattttgttttacccaatgtttcccaaatgtactgtgtttcattttgttttgttttaagcaaagcagctctatacatcctgagaaaacatttggggagtgatatactgtagtctttagtactcatcttatgagaaggctgcatgtgtgcctttaggatgcagacattgatcctggctttcactcagtttaattaggactctttaatacatctggttttaggtggtggagaacatgactttcactctgcagattcaggctgcctaataaagatagccctgtagacaatagaaaggaacttagattgagggtcttgctgtcataactgaaccatattcgtatggtgttttagtatggtgaaaacacttaatgctgtctaggaaaacatttgaatatgttgggaagtttagttagattatggcatgaactcaaatccataagattttagcattaaaattatagatttgccatgtaaatgtatttaattaataacattgatcatgatcacttacatctctgaaggaaatattaatgctctgcaaaaaagaagttaacttcttttataggttttcttgttgttgttgcatgacaacaaaaatgtcttcaaggcatagatccaaagttgctttctgtattggaaaaaataatataattgaaaacgtgattagcgaggagtttctacgtacttctccaatatgaatttgcctatggatgcctggtctgtagagccttcaagaaacgtaactgaattaggaaaaaaaaaaaaaaaatcttcaagcaagttctttttccatgagtaatgcttcagcagtagcggatgtatttcagaattggtctggaatcagtagacttttgattccttagacataaaaatacaatttgaatatagttagtaattcagtgaccaaaaaatttaacagggataaagacaatttcattattcacatctgtcaaaaactcttgttctggttctcttgaacaagaacatgaaactaaattaaacaaaacatctattttaattcttggggtatgacttgtatacgaattgaattttcttgtgagctgaattatctcatgtttttattcattgttaaaacccttgttagagctttttctaaagtagcaaatcattgtttttttgatagaatgcttcaaagttattggggtgatcctactggatattattatttggtgcgatattcatagaaagtatacatagtttgattatgtttatgtgtttcaggtgtgtccagaaagctttcggttttaaatggattcttgtcagttatatcttctgatgtacttagttctaggggaaaaaagagcaggtttgtcatagattcattataggtttcactttgaatacaagatgaagatactggtggtttggctattagtaatgaaactgaaaatattgtatgcagatttttaaattgtttctcagactaataaaatttttgatttacagactttttcattcgttaatggttttggagaagataattggaaattctgcatttcttcttattttgaaggacaaactcacatacgactcttactctcctgataccttcctggagatggttagtaatttcatctatggtcatcataaaaatgtgtaattccattgttcttgcattagcaaagaggatgagaagcttaatgaaaaaagacattgaaatataattttttgtacattatttgaaagaatttttatcacttaatataaattacctgtatgttcatcttttctataaatatttcaaagtatgtgaaatatgtagggttttagaatactattaagatgttagtaaggcaactggggcattataactagttgttttgcttggctttaattagaaaccccttgatatttaactttttataagtccttaatctgttcctgctaaacttgaatttgaatggtcttctggtttcaggatgagtccatggagtgttaagtaaaattaaaaaattactgttcatttttataggatttgaaacaaaaatcacaagattctctgccacaaaaaaatataataaggctgagtgcggagccaaggtaaattcataatttcttacaaatgtttaccactttctggcttaatagtttttggttttatggttctggtttttagttagcgtatattttgaggcaatcaatttattaattaaaaaactcctaaaaaatggattttctttcatgactgtgttatgctcagtgccaatagctaacacagtgcttagtacattgactgctgaataaattattataacaatatttctcacagatataaggtatagcatgataaatatatagcttataaaacattttcttatctctataaaattttcagattatatcctttcttgattaacctttcatttaactaccttgttttcattaatccctgatcctatttttatatgaaagaagaaactttattattattggaagatcaaggtttctactgtaaattgtttattagataactgtcattttgctggtgaaacagccttgttttagcactattgatttatgctaaagtaaatgggaagggtgttcagtgaccttaaaccagggcatttaattggtggctacctaataattataaagaaatgcattatgttttattggtatttctttaaacagcaaggtatctgtttttaataaccaaatatttgttggtcatttcctagttgacccaggcacacagtggttattttttgtaatataacctttaactgtcagaatcaagatatttagtacctcctcttgccaattataggataaaacaataatttcaaagagtaattcattatttcaactaaatatattttattaaaattatttaaaaataaatggaatgaatgtaaaaagaatttatagttgctagtaaagttgagactttttgttaagcatagactaaagtcttagttgtctaaatttctttagtaagtagagacataaggtgtatacagcttattccttagaacgagataataagtttttttattttagtaatactaatgttctctgtaacacggcagaagccttaggagctttcagattgccaggtcatagttaggatgaaaggataatgacactgaaagaaatatttcttataaaattacaaaatgttttctttgtcttaaaataagttatgttttgatgcatttggggttatatgcctgttccttaaatattgtgttcctagtaaactctggcattagtaaatctatttggctttaggcatagttctctcatctattaacttttctttctttttatattttggtggaggaagatctttgtttttgctggttataagaataatatatgctgatataagtgatttgtgccccatctctgggtgctcttatgctgggtgcagtgaggcagggctggaaccataataggtcagaagaaaagatgttccctttagtttatctccttccttcactgtctttgccttagcaaacaataattgataattttgcctttctaatgccagaagaagaaagttaggaaatatagtatattaatgaaagagaaaaatatttttaagctttcatattgaggagttttaactacaggtaaacataaatggaatttcgggggctattagtaaaatgattgctttttgatatttctttttaaatagtttttatttaaatagtatagggtttatcttcctattacttctttacagttctttttttatcaaatattgacttcctatttctgtaggttggtaaattaggaatacttctgattggcagattcttatttgtttttatgcttattatccattttataggttagggcttcttagattttaggttttaaaatctctattttacttgttagctgcaaattattttagttactgatctgtcagtaaaaatagatgaacaatgaaggaatgatagtggcctttaaaatggaagaatttgattgttttatttagcaggtactgaaagtaaaataattgcccttttcagtttttaaattggaagccttagaggtgtggctgtgagtctttgtcatattcttcatgagtcttctttaatgttgtaagggttggctttttttttagttataaacacagttcctgtttgagtaacaaattatctctctaaataaaccatgcattctcgatgggggagatattttttccaagagagtgaaaattggtttttggggatttgaagaaaatcttactctttttaatatataaagcacagatatagtacgtaacaggtaaacagtttgtgtgtggcattaaaattgtatgtgggtgattagtaaatgtctaaaaagagtccttagggaggtgataatgtaaaaaagattgagaaatactaacttaaacccatagaatataaataatacacgtaaatttgatcatgctgttggcaatattagttatagcaataaacctaacataactttgtaagtatttaaaaagtagtccaagatctgtttaaagtgacattagtacatgttgatatgcctaatttagttcacacagttatgtgagctatatcatgtgtggattcgtagtttttgtgtagaaaacagatacttcagaatatcaactaagatataaaaagaaaagccctcccataacgcattgccattggcttgtttaatggttctccctggatgacctcccagcaccaataatttaagttcctctgattttctccatacatgctttccttttggatgccagtcttgattaaaagtattgttatctttttagttatctaggttctgaaatcccagaacctactttgacctctaccttttattattccttaaatttcatcacttggagagtcttttttttctcatctgtgaaatgcatcttctcttttcctgttactttttggttctaagccatacttcgtgcctgaattacttcaacagcttcttacccttttgtcttcaatttcctatgccccttatttattacatgaagttatcagaggaatctagccaaaaacagagctctgagaaagtcacttctaaattcagcattctctaggtacttcttcttacctattgaggaaagtctgacctgatggtcaaatgttttagtagactattgcctaacaaactaatctaaaacttaatgtcttaaatacaatttattatatttcccacgtttttgtagaactgctggtcagttcttgcttggggtctctcataccattgcaggcaattggagattgggactggagttccccaaagatttgactgggctcagtgtgcaggagggctcatatacattgctgaaagttagtgctccctgttggctgagggttcagttggagctgttagctgccagtacttacacatggcctctccatatgacttgggcttctctaaccatagtggctggttccaagggggagtgttttaagattgaaagtctcaaaagtgagttttctgggtagaaacagcaagacttcttaagacctagctttggaagtcctagaaggccattttcattacattctattggtcaaggaagtcattaaggttagccaagattcaaggggagggaattactctccatttcctgatgtgaggagcatgtataggaagcagtgggaatgatggtagtcatcttcggagactagctatcacagttcacctataggctacctcagttcacatacctttcatgtacggagtaacctcacccacctcccaagatgtccaaagtctcatcccattatgctattagccccaaatttctacctagatcaggccaaaatgggtcactcatatggctggcagttaatgctggcttgtttcttccagtataattatttaaagttaatcacagtagattgtaaactccttgagagtaggaattatttctttatttctagcatcatgcctgtggtattatatgcaacatagcaagagtaattacagattcattgaaatacatttaaatattgactgaagagaatattaagcttcagacaccagatatgcatagaagaacgtggttcacattctatgtgaaaatgtggtatcctggtatatattctcctcaggtggttctttggtctcatatttggaggttgggtgccagagtgcttctaagtaaactttaagaccattacaaataaagataaaccataattcaataaagcttggaatttgtataactgtccatttaagattttagttttataccatgagacctgaaaaatttcagattgcatctcagcatcattgcattcttacagagttaacttcgttaagattggatattgggtgaatgttcagaatggatggatataaaagatagttccaaatagctgaatgaattggctttatcagattggtttttatatgtaagacttattgttatgatcaacatagcctgattctacattttgtatttttaatattgttattgtaaacaattcttctggcactaattatctattagtttaatgggattcaaggctagcttttttcttttcttatgttatcaatatatttttataccaagtaagaatgtgtcttagaaaatatctaatatctctaccagttgtttacacataagttttaaatgaagaagccaaactcgcaaccttatttttattgtttggaaatggaatttctaggaaaatagaattctgaccgctcagattgtggcagcattatttgatagaggcatttggagcttaacggcggaagtgagattccatgacttgaaccaaggcggctctagtctgagaagtgagtctggtgaaagagctgttagtgtacagagggagcgcactttgtgctcaactgtggaggagatggaagtgttagctgcgataattagtccaggaactgtccttaatagctcatggattatgatggtttaagcttaaaccttgacacgtactagaaaactagtatatagaaatgtctttccattagttaacagaaaaatgagtgtaaaaagtcagtaagattaaaggttttctttcttgaaactggtcggctatattttttaattatcctaaagaattcaaggcaataatagaatacaggatttgacatcctggaccctctccagcttctgttattttgagaaaagctgagatatttttaccttttaaataaagctgttttgaacttttcttttggtgagggaattagtaactgatggtcctagagactcttaaacacataaaaactaagctattctgtattccagtctagtttagttgtatctaggcattaatagtacagtgtatttatgaattttattggatttgaaggatgagtttataaactgtcctctaggatgcttttctgtttaaatatatattgcttgtaaaaggtatttgtatgttttcacctatgttctgtctctgttatgtgttaactctgatttttttcaaggtataggttggctagttccctgattatccagaagcacttttcatcttgtctgtagtctactggagtgttttcagaaaggatgctttatccaaaagactgaatggaatatgttatattatgtaaataaccaaaagtttcttaaggaattcaaggtacctgcaagatgctacgttagttaattttatgttaaaaattatttgcattgactagtggttggtactagtgttggagcagtcatggcttggtagcaatacaaaataatcttatttggtgtttgccattccaattcagtcatcacaggattacattttgcctaatttttcaagaaaatataaaggtctcttggggaggaaatgaggagaaaaggctccacctttgttccagtccctcccacccttagcatttctatgtattttatgacatcaggaatgatgagtattaattcctgacatactgtttcaacctcacattgactgaaattaaataacatctattatattaaaaaaatagttgacacttccagtttacgtgatggctgactagagaccatgagactgactcttagtttcccattaaagctcatatgaaaatgtagaagatgatgaacagttgtaggaataccaaaaccttggcttgacagtcagtgtattatcacaatctaagatgtccacaaactacaaagctgatagaactggtctgaaaaatgcaattacttgctgattaatgataagcagttagaaataaaagcaacctgcatgtcttttaaagcaagtatggagaatgattccttttccttttcataatgtctacccccaaggctttcaaattctggtattatatcaactagaaaagtgaacaaatatttttctattggaagagtgctacttttgaggctattaggaagttaggtagcttttcttttttttctcttcttcctccctgcctaaggtctctgttgaccatcttcatttaattgaccaagtagatcaactgacactcttcattccttttcagtgcccatggtaatgtggccttgtagctaacaggctgttagctagcaggccaatgtacttccctccctccagtctttcagttgtgtgattatcatgaatcagttatttattcctaaacaagttgttgttatttttttctcataaaccattttattacgctgttgaattacataaaaacccttttttatgaagttgaggactttggaaatattcagcaaaggtgagtcactgataaatgttggcgagatgactgcaaaagatttgggaagaaatcataaaaatatagaagccggctgcactcagattttcttaacatttttgagtttaagttcttgctatactttagagaaacctaagcttggaaccacagaagattatcacatgtttggttatgcagaaaatatgaaaactccaattactggttccatagtcaaaggatttgcatattttgaatatgatacatgtatatatttcatggtaaagtaaaatattaagaataacacatacatatcataatgatcttctactttaacttttattttcagctcaactttaactctttctgttaatagatctattgccagccttgatcacattgatgaaagggcttccactgtgtccatattttgcaatcaatttggagactaaatctgccagaaataaagtaggcaggaacaaggaaacttacgatagatcattgagctaggaaagtccgctcaaggaaattgctgttggtggtggcatgggcaagaatactgtgatattctttgttgaagaaagaagccttccctttgttcagaatcagagctggtatagaagactgaataccaatcaggcacagccaccttggatattaaaccttttggaaacttgcgatcaggctggatccatgcatgtgagcctattattcacccactctttttctccatcactgaatcctctttacatccttcatgacattattaacaaactggccatgtcatttattccttattgtgtgtctcacttggtagactagcagctccatgagggtagagagcttgtttggttttgcatcccctggcaaatacctggcacacagtaggtgttcaacaaatatttgtcaaataaactaactacgttagagaaggacttcagctaatatcaaaataaaaaggaccaagggtagttttagcaaacacagagtctaggtaaatgtctacttctttgaggataagtgattgaaaggttgtcataggagagctgtgaaaaagctctacagactgattaaaaaatagggtgcagcatgaagactcagaagtgtagcttacttattaaaatgatttattacagagaccagatgaaaattttttaaaaaaaagaggacctggaactctcaaaaagttttgagttataatctctgagaaatatgaaacaaggtgaaacactgaaacaaaaagatgacaaaaaatgaaaatgaaaatatttggaagaggagaggagtgagataaggagagattgttggaggggcaataacagaccatcttcactagtgatgctgaagagtaaagctgacactgaaagagggtatggatgtgaaaaaaaagtccatgagatacttttttaagaatgtagacaaaaggaagacaaatgccaacaatgagaaggaagatgatgatcggtatggaggacaagattccaacaaaagaattaaaaaactttaggaaaaaatacagcagaggcaatgatcaaagatataattgatgaaaagttttctgagctgaaaaggcctccctttatagatgaagagggataagtgctgggtaataaaaatgaaaaaagagccaccccgagtacaccatggtaacttagttcaactaaaaggaaaaaggacatattaaaaaagtgcccaggcagaaagactatattgtataatatagaacaaacgctagactgacttagacaggaagactatgaagttttgaaatcattttatactcaaagttatctttcatatgtgaaggtagtagagagacattttcagatatgaaaacacttataccacaggcacacttcccatatttttaaaaagaaattttaaaaatttcttgatgaggtcagttcagctgactgatagatgaattaaaattagcaattaaaaatgaagaattaaaaaggcattggaaacaattagacgtagtgaaatctaaatcattattgtcaattttattgtcaaactaaaggtagaagtgtccatttagttttgatagaatttaacagcaccatggatctgcagcttcaggttatattaatgcctgaaataggtggagaggcaggagcatataggagatcctaaataatagtttttcttcaagaagatttaaaaaataccaacttctggtgagagtgatatttcgtattccattgccttcacttactatcagtgtactgttaactcctcaaacatctgtctctgctgagaaaagtctcctaagttctagacccactggccaagtggatagctctcttgggatggcccattagcagctccatttcaccgtgtttaaaacggaactcctcttccctgcttgaacctgttctgtggtcccaagctctttcaattttagagtgaccagatatgacagttttttcactattagcctctttcactctcaaaattagtttggacaataaattatgggcctaccctgatcatcttgtcttttttactttcaactcgtatccaaacacatgctagaccttttcattctgtgttttgtttgtttgttttgttttgttttgttttgtttttgagatggagtatcgctctgtcgcccaggctggagtgcagtggcacaatctcggcttactgcaagctccgcctcccaggttcacaccattctcctgcctcagcctcctgagtagctgggactacaggcacccgccaccacactgggccaattttttttgttgttgttgtatttttagtagagactgtgtttcaccgtgttagtcaggatggtctctatctcctgacctcatgatccgcccacctcagcctccaaaagtgctgggattacaggtgtgagccatcgcacccagcctcattctgttttttaaatgtgtctcaaatttgtcctcttcatcttcaatgctactaccctgcttcagactgctactgtccctccactgggtgatgataataaccctgtgacagatgtccctgcctcacacatttgttggcggagtttaatacagttatgtgtatgaacttcatagtatgggacctagcgcttagcaggcacttaactaatattagcaatgatgtaacttagctcaaaacccttcttttttccattaccctaaggataaactctagactctttaacgtggcttgtgtgcctgtatttttgtctctcgcatcatctcttgcatcagctcagtctgcactatgtgctccagccccacaatgactctattcagaacacaaaaattcagagaactatcaattcttggacactccattttttgttatattacctctacatctttactacctggggggttaaaaaaaacaaaaaagcaggccaggcgcagtggctcatgcctgtaatcccagcactttgggaggccaaggcgggcagatcacctgaggtcaggagtttgagaccagcctgaccaatatggagaaaccccatctctactaaaaatacaaaattagctgcgcatggtggcgcatgcctggaatcccagctacttgggaggctaaagcaggagaatcacttgaacccatgaggtggaggttgtggtgagccgaggttgcaccatggcactccagcctaggcaacaagagcaaaactccgtctcaaaaaaaaaaaaaagcgaaagaaccaaatcacaacaaaaaatctccaatcttggccgggcatggtgacttaccctataatcccagcactttgggaggccgaggtgggtggatcccctgaggtcaggagtttgagaccagcctggccaacatggtgaaaccctacctctacagaaaatacaaaaattagccgggagtggtagcatgcacctgtaatccctgctacttgggagactgaggcaggagaattgcttgaaccggggaggtggaggttacagtgagtcaagattgcgccactgcactccagccagggcaacagagtgagactgttgtctcaaaaaaaaaaaaaaaacaacctcagacttcacctctagatgcacccgaatgtgcacacacacagacatgcacatgcacacatacaccatttgcctgataaatttctgattgtcttttagaactcagcttagatgttacatcttacatcctctggaaacttggttgagatccttgaagctaggtagtgttctcatatgactccatgggactgtgtttacccactaaatgcctgcgtaatagtcctctgaagagacttgctataaacctcttgccggtatgggttggtcttgttcattattccaaaatggtgcctagcaaatctttaaggaaaatgacctactgccagtagcatttgagctaggaattgcactagagggaatctgtcctgcagaaataatcagatatggaggtggagagaactctggacaaggacgtgcatttcagctttgtttatcatgtgaacaaatattttaaaatacttaaatgtttatcagtaatgaattggtcaaatattctacatgtgtaagttatatagaaagatttttaaaagatgcctaaattagcatttctttttgtaatagagaacatagggctggtaaattctgggattttaacttaagtttttatgaaatttgtgttttcaagttttatggagtaaatgaagatgacttgtttgaattgaagttgtgaatggttgagtgaaatatggaagaagtgcttggtacataggaggtgtttgctaaactaatagctaaaaattggaggtggagagagtgaaaattatgagaaaaagtcatgtaatcattaggcaattaaataatttatccatagtgatgaacacttatgggaaaagttttgatttagaatcatctcgcattcattgttttcttctttaaaggtgaagttttttgtacttgttggctttcctttgttacccaatatgacttcttgtatgtatagtgtttcattttgtattgcactgaactgcatacaacagaaaccttattacaatggcttctgaagaaagccttttattattcttatggacaagtttcaaggcaggtagttagggctcatgatgggttccatggtgccgtcaaaagtccaggctgcttttacctgttagctctaccactgttagcctgtggctcttgttcttgtgaactcaggatggttcctgcttctacatacagtacatctgtgtttcgtccagaaagagggatgagcaaaggaggaaggtcatggcagttgggataaactggggactcagtaactttgtcagaatttccacatactggaattctaattacatgtcattgtccagaactgtgccacatgtctgcatctagcatggggaagcaggttttttttgttgttcattttgattttgttttttaagctatgactgttgccatcctaaataaaattggctttctatcaataaaggagaaagagataatggttgttgggtaggaaggagcagcatctgcaaattagattcattaactagatcaaaaagcagctaccagattttctgtcagctactcttccttgcccacttcggctcagggactggagttgtgttctgaatactctaggagcaggtctatactgaataaatcagtaatggttgttagaaatgtctttaaaacatgttctcaagacttatcagttaggaaaatcataccaaacacaatgaaactgaaaaattttctacatattctaaaaccaaaacataattagatgctgcaaaattaaaaatttaaagagataaagaaaagctcataaaataagagcatatatatacaattgagatttgggttatttaaatattaagaaaatagaatatttattcttaaacatttcctgtttatttgtaggactatgtgggcctatgttaaaatatagttccttattctttgattcatacattcattcattcagtgacaaatttactttgtatttctgtcttgggcagcactgtactggtatgtgttcatattttcttgcctctttcatttcttcttgattctttcttgctcagaacctacacaggcaaggtctcttttctaagtgacctgtgatttatactgtactgtgtagactgcccataagacaaaccctcagtgccttacctgaaatcttcaggggtagatgtatgtgagggttcagaattctttttaattttaggaaagtactgtgcatatgtggcatattattgcacagtctcctttgaaatttctgaatgttccgatcaaaaaataaagattctataaagcttcatgtcagttctgtttagatttactaccaaatgagttataaaaaagcttttgattttttcagagctttttggatttcacagtttagagattgtagttctgtagagtattggtttgggcgaattatgaaattgcttaaaataattagcaagcttcctaaaaagatgcattatagcagaaaccattttgattcttctaaatggcattgattgttactatcatccatacttgggtgcctcagcttttctttgttctgattcccatcatttcaaaaatctgttcaaaaatgtctgtctcttaagaaatctttgctagctgagcagtgcttttcacccttttgtaccacattctctaaacatgtaggtatttaggtgttgactttttttttctttgcgagaattcattccttgactttactgagtgttgtagcttcctaattatacttcaagcttccctcatcatctgaattcattttttcaaaagatttatcgttctattcttgcatctcctaaaataatgctttttgcatttcttgcatcaggcagtttaaagtttatgataggctacctaatacaatataattaaatatatatttttactgtcatttagaagttcgaagaaaagtgtttgtcattaggctattaccagtctcacacattgatttttaagtgatatgcagtgtgggatttgccttagtgctttaacagcataggattttaaatcattcttttcttcaatttcacatgaactttaaaagaatcttccttaccaggcccttataatttagtctgctatgattttgttcttaggtacaaaattcttttagattttatttgtgaaagtaattaaacagatagattgcatttaaagttatattttttatttttatttcttgaaaaataaaggcagagtagcttaatgttctgagaccacctgctaaattgcctggttagtctgtgttttaattgattttgtttatattttaagtcaaactttcttaattaactaattgcatggttctagtttattgtcagattattatacagtgaattcagtttgcaaagtgtgttttaattgtgtgttttgtgtggtgagattaaacttattttgcttgtttcttataaataacatcttcatccatcaaggaccataatcagaaaatgcaaatgatggggaggaaaaacaggtgctcatatatatagaattatgatgaggtattttgatatattaaaatatgaaggcagaattgtcatggaaagtaccacgtataatggataaaggattataataatttctagttaagatatttggaaatacataactgtatgtaactgaagaaaaactttgaaaagaagacgaggtggtgtcaaagaatagctggtgttagttttggtgtgtttgctagataatataaattttgaatgattctgttttgctattgctgtagcaccaacacttgaagttgtataaagtactgtgaaaatgttaaagtaaactaaatatctggagtatgagtgatttttaaaaaatgatttctattggggtgggagtaattgatggttacgtgagattacttcagtagcttattgttttcagtttcttgcaaacttagttctctgtccactttccacttcttttcctcccagtgtccatcatgtcttctgaaatagtaacataaagctaattattaacccaaagcagttcagaacatagactaaagtgatgtggcatatttcaaagtcttccactcttctgaactagattttttttccttctaaatgcagattaataaagcgtgcacaacaagaggaacaaggaaaaggattttagtgaaggtatcctgatcctgaaaaagtcagggagggcttcaagcccatcttggacttcagaacacctcacaactttgtggtaaaagaaacattttaaatagagcctttggacttatttatttcatccttattcagagagtagcgctttttttaaaatttttattttttttaggcaagacaattgtatgtgaaatcgcgttacttttcaaactgaaacatagggtttcagatttgttgtaggtacttaatatatactcaaaatattacaggtagttggttggcttgtgtgtttttctttgaaatgtgttcttttatcccttgtgacattgtgtttgcattcactgtgagtgatgttttctctagtgttttgtatctttaatcggttcattgggttgtatagtagggagtctttcctaggaccaatattgtttctaaaaatactttgaaagtagaaagtggtttgtgttttattgttttcatattttttaccagtcatatgatggcttactaatgtgaagagatgtagcactagtaaaaatttgttgttttctcctctattcacctggaaacctcacacaggatagatttcatttgtcaacacagatatagacagtgaatacaaacatctttgccatttctgtccttaacaacaaaacagtcttattttactttgttaactttttaaggtcctttttatttgtgaaaattaggttgtttatgtactatgtgttcttccaaagttacagagttatattcattggagaaatgaattttcttccagtagatgaaaattacattttgattgaacatcattccttatgcagtcacccataaatataatgtcttttgctgtcttttcagaaaatggctacagatgtgatttctgaattgacaaggaaatagaacatcttaatgttttaggtaaaacagatggtatttttgtttgaggcaaaactcagagaaagcaacttaattggtgacaagactcttggggtcagccaaattatatacaatttgtgtttgtttttgttgctttaatatcaaaagttttagaatacttggaatatttattcttttatttgactttactattttctgttgtgtactggaaatagttgtaaaatttttcaatcttttctttacaaaaattgtaagtccacatatttattctgcttcggttacatttatggtcttagaaatgctttttgcattgtgaaaagttcctgaaatttgtagttctacttttgagggttaacattttcatttgtagttttaagttgcatttgcaactacaaattctgtggacattgataccaactctgttctttccatgcctttgagctctaggcagatctcactgtcagatgcctggaatttccggagcacagtgttgtgaagggacccttgcatgagagtcagaggactgattctagccccatctctgtcactaaccagctcatatttttggaacttcagtttcatttgctctctatatttggcgggtattaataggtaatccccgaggtcacatccagttaacatttggttttcttgtctaagtattaatcatttataaagcattcatttggataaacaccaggaaaggaagttttgaggaagaaactactgtggacaataaccaagtgtttccagtaactgggacataagataatctgtcttccaaaatatctccagtattccaaaatgaagacctattatgtagcaaattttctttttaccacctcttacagaaattcagaactgggtagtgaaacaaccgcttgtgttgtcatcatagcaaccaggggaagtagcctaatcctcacctccaggaaaactcctttaccccattcctggcactgcaggtggggaggctttggagtgaaggttctctgctggggtgaatatagagcagtctgataaggctctgttcagagaggcagggggagggtaatgggattctgagtgctctagttgctgcatcagtgcttctagcacgtgcaccctgactgccttacccactgaagggagacagcaggtcaccttccctgtctctgactccctgacggattgagtttgaatcctggctgtaccatttctatggctacataaccatgagtaggatacagaaccattctatgcttctgtaaaataggcttgtaaagtaactgctcagcactgttttaaggctaattaagtgctagctgttggtattattatcatcatagctgctaagattaccataacatctgaaaaactctgctacgagctaagtcatttacttaaatatagcaaaaatattcctttaatacagttttatatttgacttactgctttgtctgttagtattataaacaaacataactgtctgccccagtaatattttctaacatagagctttctagaatatttacttaataatatcatactttccttgccattcttagtttagaaactaaaagtttattagtaatattttgtggaattcttgcatttgaggagaataaggtatttgcagcaatcacttagttgccaacagcaattttaggtactgtggtcatactgttttgtgaaggacaactttatatttgcatttgatcacacatgcagcatgcttgtttaccttccttttgaatcttttccttggacaaatggctctccatgggatgataggctcataatattttgtccatgattttaagaatgatttctcctaaatatagagaaaggtgtgaaataaactttcatatattaggaagatagggtagcatttatgtactactatatccaagtaaaattctaatttttattgctgaaagagtgttctgtaccttagcgttgaatttttttttcttgtaagagcaggccatatttgttacttaaccagctagtagcttccagaaaccatcatttaaaatttttcccttgtgaatacaggagagagggcaaagggctagacccacttcatttaatctttgcttggtcccagttccaaggaccccaagctcttcttgcttgttactctttgcccacctccatcctgttttccaggactcaggattttcttttatatatccttggtggtatgaaactggaagttagtcctcattttcaacaggaatagtgtaacctggtatattagtttcctgttgctgctataataaattaccaacaaacttaattctactaaaaaatacacacaaatttattatcttatagatttgggggtcagaagttcaagaccattttcactggattaacaaaatattggtagggctggttccttctggcggctctgaggggagaatcatttctttgccttttccttttctagagatgacctgcattgcttggcctgtggccccttccttgtatatcccatccacttggttctgttgtcacatagtcttcttctctgttggatcgtccctctaataaggacccttgtaaatacattgggcccacctagacagccccgaatgagcttcccataccgtgagctgtaatttaatcacatctgcaaagtcttttctgccatataaggtagcattcataggttatggaattaggacatggacatcttggggtcattatgctccctatcatacctggaaatctgatttttaaatttccagtggaaaaatggatctatctgtcttcacctttcctgcctaagctatcaacttgaagctatctacttcgccgtcctgctttgagccttcaccccttaagttctttctctgcctggcaactagaaataggtattaaaaaggaaaatttgaccatgttaaaccttttccatcaactgcacaaaaagctccaagctccttgtaatgactaaaagacaacccactccccactatgacttgagttttatctacttttctaacttcatataattgcattttagagatgcactttactgtgtagcgtctagtggtagtggcctgtatatcttgaaaataacattatttcccgtatatctgtgtctttattactgaaaaggatttccctgcttcctttgccctttaaaaaatttgtttgtttttgatgttgttattgttctgaatttttctaataaacacgtaacttcctgtagaatagtgtttacatccaaagctattaaaaggatttctagcatattcactgataaccctagaacctagaggaggtaactattaacaacagtttctttttagaattttatatatttttatatttcactgcttattctttgtatataattcagaatattcttttgtatttaataatgcaacaaacattttcttgtatttaaaaaattctttataaatatttaatggctattagtattctagtacgtaagtatacttttaattgttaatgtgttccctcaatttaatattatattgattagctaatataatgttttgaatagtattgtttagatatttacattgcttagctgtggaaatagtttaaatattttttgtttactatatttctgtttttctccttacactaatttttttttttttttttttgagacagagtctcaccctgtcacccaggctggagtgcagtgatacagtctcggctcactgtaacctccacctcctgggttccagtgattcttgtgcctcagcctcctgagtagctgggactacacacacgcaccaccatgctggctaatttttgtatttttagtagagacaggatgtcgccatgtttgccaggctggtctcgaactccttacctcgggtgatctgcctgcctcggcctcccaaagtgctaggattacaggcatgagccaccacatctggcctccttacactaaatttctaaaagtaggaatcattggattgaaagacagactatttctaagttatagttttttctgattataaaattataaatgctagatataagaaatgtataaagtatgaaaaataattataatgctgccacctaacaataagtattgctaatattttggtaagtcatcaagttatttttctcttctttcttgccatcttttatagatgattttaatattcttttagtatttacatagaaaagcatagatgacttattatagtttaattgaaattattacttttgtgtttttttgtgttgtcatttatattttcttatatatttacccctctttgtgctcttcatttttccctgcaatctcatgtttccctctgatattattttctttctgcctgaagacttaacgtttctttcagtacaagtttgctggtaacccatacactcagtttttgtttctctgaaggcatttttatcattttctaaggatatttttgctggatatagatttttaggctggcagtatttttttgtttcctcaccacctcaaatatataattccattttctcctggctttcttaattattttgatatgtcagctgatgatcttattgttgcttctttgaacagtgtaatcttatttttactggctgcttctcagattttgccttttcataggggatttaacatgacacaccaggtgtattttctccgtttggggatcacagagtttttttgtatctgtgggttagtccctttccttagttttgggaaattctcagctattcaggtaattatattgtgctattttctcttttatttccatctacacatatcctatttcacatattagatcttttcactgagttccctgtgtccctaacgttcttttctatattgcatattctttttttcaccacttccatttgtatgttttttattgacttctcttttgctgagttaaatatatttattctgctattgttaaagatatctttggagtttttaactgtaaatatttatccttttagaatttcatttgattattttgtaatgtgttaatttctatggtaaaattctctaccttgtcctctacttgattcatgtttttctctttccttggccatattaattataattttaaagtcatgtcagctaacttcaatatctgggtcatgtatagttctagtttctttttttcttggtgtttagtcacgtggctctgtcttttgtgatgcctcttaatttcatattgagtactagacaattgtgcataaaatttagagagactctagaaaatatcttcttctagatagatgttccaatcaaggactatgttaaattgagactgatttattcaacctgttgttcacctggctttctaagtaatttttcaactaatagcctgcttatattctgtaggccctatcccctggtgggttctggaatgtcatgagatgtctctgctctacttttcagaagctttctgttcaggttttaagcttccctttctgcgcagcctcagtatttggcacttgtcgtaatgaaaaaatcaactgtgtacctgaagcctcccaaagtctccacaaaatgctcttttgatctctttgttccccagtgatttcttccagactttccactaggttttgcatggaactcacagcctctcccttgctgagaattggcatgccccagagtgaaaatgactgcagaaggctggtcacttttctgaagttttttcctctcttcagcagtttttctgttgccctcaggcaaatgattattattttttatctggcttttctagttggctagtagaagtgagagctcttgtttgttgacagctactccatttcccctggaagtggaaacatcatttatttctcaacttcaatttgacaaaaataaagtgctcacctttttttcaaaagagtgtttatatttctgttgatttataagagcactttacaagttttactattttttttttttttagtttttgttctttaatctcatttttaagatagaaaaatttttagttttttgttaccaaatctgtcagccttttacttcattgtatttttcagttatggctagaaagaccttttgtaccacagattatatatttattttttctactaactttgtatcttttttatgtttcaaaatttacatttatctggaatcagtgttgacatattgttttaatgcatctagtaaccatttgtcttgctcatctattattaaggatgtatgtatattatagaattgttttgcccatctcatgatcattttccttccctcacctttcttccaagaaatgaaattcagtgggattttggttggcactgcataagacttacgaatgaattttgggagagttgtgcttttgcattattttagttttcttatttagaaagatatgtctctccattcatttttatgttctactaagtgacattttttcattttctgcgtatattatacattctgctcattttgtataaaattaattttctgttttgattggtctcctgaagattgttaatcttcctaacagccgtgtgtgtgtgtgtgtgtgtgtgtgtgtgtgtgtctgtgtctgtgtgtctgcatgcatacgtatgcatcccatgacatgctattacatacctttgtcttattgcctaccctgttatattgaacttaccagtttgtttctgtgcctctccctcctaaactgtaggtactttgttgactgggattatgtattcatattcataagtttataactacacataccatacagcatctttctctcctttctttgcttgctttttaacttagccataagccatgtggttactttgaatgtgtattctcaccactaccatgttatcagaattcttgtttcaagatatctgtattatcacctgttgttaatttcctttatttagatttatacatgccttacacaaaaaaaggatttatgacagctcattgacctgggtttgttaaatcgttcactgtactacccagtgtgatgatgtgccagggtccttggtcaggataccatgagagtcttgtaagggaaaggagagaagtgaattgttattgagattctttttttgtgcttggtctgagctaggtggttttctaaacattttataatttaacattaacaataatcttgtttcccgattttatagatgaggatattaagtcttggggaagtgaaataacttgtccaaagcctctgaaactctaagtgacatggtggggatttgagtttgaatgtgtctgactcaagagcccaggaatcacacaattgtgatttttgaagatctagtataactcaaaaagacactcttagtttttaaggtcttgaattttttcctgtcaatatggtaagcattatattttaaacctagaaaacaaaatggtatatatcaaaagaacttcaaatctagatattgcaacttttgttaacatgtaaattcatgtttccatattcagaatactgtataaagcttaatgtttttctttaggttatattccactaatgaggctacttagagaagatgaatgcattcttgtttgaaatgatttttttaatatgttgtcattgattaagagtcagacaaaatgagctctaatttttgctttattcttaactttctttgtaatattgaatgtgccatttgccccatctttacaaagggactaattatataatttatattttcgaagaattgaaaagcactttttaaggaattgaaataatcaaaatggaactgctctgataaaactataaagccccacatcagtagatactatttacaagtaataaattctcctagtggtatttttctgcactgatgattcattaactactgaacattattctgtgctaggtacctatagtaagcacatgaaattacagttatttttcatatgccttttggtgtttgcttaactgattttaaagtgcacttataaagaacttgaaaaaatatgtatttttttaatcttcattacacaatcataaaaatatgtaagttgcttttaaaatgtttcctcaaatatcgtttttgcttacttcatgcagtgaggtcatgagatgaactccttagtatatattgcaagtttttttctgttccagtgttccagtatataaattttctttcacaaatataatatacttgaaatgtaaatagcttattgcttatctgagcttcctgaggagagagcctctctggggatattggccttgctaaggagaaagttcttcacatttgaatttggatgcaactaagggaatctccacaggaaacttcagctgtcacaactgtcacaaagatccttatatgcctggcctgtgagtgaagtagttaagaagatgggtgtggaggtgaaattgcattataagccctattgtggcactttttacctgggcctgtcttggcaacattcctgctcttgttgaacctcagtttccttatatgtccagtgagaagaatgaaaggttgccccacaggggttgcccatgcaggtctgaggaccagcccaggcatgcaggatgcactctgaatgaaggtccctctgaccaaggggcatgttccttccactttgtactgcagccagtcctagaaggaagcctgtgtgctcccagtctgttgttcacattttagtgggcactgattagatttacctcaaagagaaaattcagtattccatagttgtcttttttaacatgatatgaattacttctatgaaaggtgaaggaatttttagtatactcatcctcagtagaatcttcaaggacagccacgtttacactgggattcttccataaagtgattcccagtttgataggagcatacagatgttctttcatttttgtccattcgtttttctccagccaaagtagattatcttctgccctctagtttgattggcaggtaacatatgaatgctttttcttcatgaggtgagagtttttccttgtatatggagaactgagataattgctcataaccctgaattatgggggcccaatgtcacagtgagaactaggaggctggacgtgacttggtgacagatgatacgtaagaagctaatgctgatgtggtggaaattggagaagaaaaaagcactgaccttacagctaaaattgaaattaaccctccccattctgaagatataaacataattcttttgttaatgtggatcaaatattgttaattttcagtaagtgagtatgatattatgatatactgaaacctattggtttcattcacaactagagggcctgaaaggactcatgtttggggatattggcagtataacaaatgtttgactaccaaatgtgatgacaatgaaaattaagttatttatgattgtatacttatttccaaaggaaatatctatatatgatcatcctttctctgtactctacttaaaatgtacatagataggagttcgtgtgtcagataaatttgttctgtgatgcacataaaaaacatgctgtgaatctctaattatgttaaaaattattttcttagtgcaacattatactcattatatactctacacatttagtctttgaatagattcctggcatgataattacataatcattcagtacagtagaaacatcgttatggtcaaatactaattagctactaaaatgaaacaaaatagaacctagttcatagcttattataaaaagtgatttaatagggtgcaaaaccaaatatatggttaaaattattgtttgcattaagtatgagtacttttttttcatagaaggaattagtgttctggatgcttattatctaatttattgcttggacacacattatagtatcacagtcttcatgacctttggctgtagtggagcacccaaagaacatgccagtagggattctaggcttagtgtgcctaggtatgcctcagggctactacagaattaggagattggccaaagttttcaggcaccattttctcaagttctttaaatactagctctgtaagcctttgggaacatgggtttcagtagtaaatcactcatttctggggttctgctttgaacatctttggtacagagaatgagtgatccaccactgtttttcttccccattgcaccttagaaatataggacagtcccattggtaataatgaatcctggccgttgcagttagccaggtgtgtttgtgaatggggaacagtcaggcgaaatgtaatctctggtaggagggctgtgggaggctgcaaatagattgacaaatctctgaggtaagtctgttgagtatacctctcaagagggcatcaccctccctcgccttgagaattgcttctgtgcgtaaaatgggattttatctaagtactaggaggattcgttgctctttgtaaatatgtttgtgactatgtggtttcatctgttcatctcttgtatacatatggaatctcagtgaacataagtaatacaagttaggtcctgttatcctgatgcatactgtaagcctaataggaattagagacattcttaatgtcattatcacctttggtatctcagaatgttgctttaacataaatgcttctgatgaacaatttataagtctagtgtcatggattttgtgttatatcctctttctttttcttcatttttcctgttgtcttttttccctttagttttggcccctgtaggtattcattttatttcttaatgaacactttgtaatgcaattaaagcaaaaatatatagaacacatatacaggatggaagaatactggtaagcttggtgctaccatctatagctacaatgtattgggggagaggtggttgttatccaactattcagtgtgttcctgcggttacaaaattgtataggaaaacaaaaatatttcagatcatgaaaatatgcactagtgaatcagtgagttatattattagtccaacatcctctttgaaatactcttcatttgaagacaatatgatgcaaattgattataaattataaaatcataaaccttgcagaggatgcagatttcatgaagtctgcaatgtgatggtctagaacgtctctgctcacaggcaaagccatgaaagaatgacagtctggcagagttatgctagtaagaaaatcaaggctgttgggtacctcaactgagaattatttgaacatcagaactgggagaggattttaggaaaaataaagtccttaaatattttttcaaatacagtttactaataaaaccatcatgtaaaaattaaatgttatgtgaaggatgtcataatatgctggtataaaatattggaaaaattgtgtcccaaatttcagttcatttatgtttttgttcataccaaaagttgcacgtagttgcaaatattgcctaaacttattttaatagtttgcattttcctttttctacctaatcccaatcaattttttttttcaccattacttactataaacatttggggccctgttacaagtggattcacttcaagtgaccttttttagaatcaactttctttaataataaagtcccattgtatataaaatatatgtgtgaattatgtgattttccatatatagccatacattcttagtggtctaaaatgaatattagatttttaactggaactcattgtgatgaaattgcaaacaaattgtgaattttttttattctgtgagattaggtaggaatcagggtattagttgtatggagctcattcttttaaacagatgaataaaaccgtatttatataagtctttttctggggtacagaaaagctttattacacatctatgaatatcttccatttgtaaagcattaattctttagaaagggcttctgaatcattatttaattaccctttgtactgtgtgatatttgttgtgatgaaattgcctgttctctgaaagttctcacagaatattcctgttaattcttctccatgagttgactctatgactgtccatgaactgaagtattatgaagggtttggaaaaaattagccagatgtagtagcatgcactacacctgctactcccagctactcaggagactgaggtgggaggattgcttgagcccaggaggttgagactgcagtgagctataatctccccactgcactccagcctgggtgacagagtgagacgctatctcaaaaatatatatgtatatgtatatgtatatgtatatctacatgtatatgtatatgtaagaagtaaaaatattttgagatcccaataatgaagcagctgtttttgcaggtaccttgtggtctataatcctttagaacaagaccgaatctcgttggtctcagtctatgtgagttccccgacagtgcaagtgttctctgcttcaggaaaacctgtggaagttcaagtcagcgcagtttgggatacagcaaatactatttcagaaacagcctatgaggtatgttgtagccatagaacttaaggaggcattgtaaaacaaacctagccagtatataatttgtgtatgtacagtagcccccatttagccatcatgttggtgtatgtgaggtgatgaaagttgtaaataccagagagtttaactggtgggtcaaatgacactaaaggaaaaatgatcctgtgttccctaaaatgttaatttctttgttagtatatatattgtatcttattatatgttgttcatatgtatattgtatatctttgtaaggatgcatactgtttattctaaggtaatgcagtaattattactcataaaattttgaatgttttgctctaagtgaatttaatgataattatgcatatcgaaagtgagataaataccacccttagtaactttggatagttttaggttttcattgcaaaggtgacataacacaccatggaagagaaatgccctaaaataattaagatgcttcttttgtgagatataattgtggaaaatctgtgctcaagttaataggtattttttgtgccaaagtttcttaaaataagcaatattaaactgatcactgtaccactagaaaggttagacttttaaaatctggaatgtcatttaaacggcatttctggagatacagccataaactaggaactctaagaattgtttctgcttgacagaagctattgctagctacttttattattattattattatttttgaggcagaatttcgctcttgttgcccaggctggagtgcaatggcgcgatctcggcgcaccgcaacctctgtctcccgggttcaagtgattctcctgcctcagcctcctgtaactgggattacaggcatgtgccaccacgcctggctaattttgtatttttagtagagaaggggtttcaccatgttggttgggctggtctcaaactcctgaccccgtgatccaccttctagctactcttaaatatgcatcatcttttagatagaaaggtaaactataataaaaattttggtcagattttacaggaagctttccatctagaaaatggaacagcaacagctcctggaaagcaggggtcatgtcttaaactgtgtgcatcccccatgctctgttcagtgtctgctgaacctcaagcatttgatggctaatgctaacttgtttaatatttatattatgtttatcatttttattaaccgaaatatcataatattgcaaaaaaaattaataattaggaaatggcattgttgtaaagcccttacattcatggaaaatttccttctctaggcattctagagtacagccaaacaattgagaatgatcatacaggttcacatattggataaaaacattagtgcttttgataggcctaccaactttaggttattaggttctctggataaactgagacatgtatggtttacccataagatatcaaacatttatagaatattgttacacagccatgccttggtatctgtagaggactggtcccaggaccctctggggataacaaaatctatggatgctcaagtcctttatataaaatggcatagtacagatgatccctgacttacaatggctcaacctagatttttcaattttataatagcgtgaaagtaatgtgcattcagtagcaaccgtacttcaagtacccatacaactattctatttttcgctttcagtatagtatataataaattacataagctatttatatttagtataaaatatgatttgtgttaggtgattctgcccaactgtgggctaatttaagtgttctgagtacatgaaaggtagactaggctaagctatgattttggataggttaggtgtattaaacacctttttgacttacgatattttcaaattctaattggacataacccaatcatgagttgaggagcatctgcatttgcatataacctgcacacatcctcttgtgtattttaaatcatctctaaattacttgtaacatctgatacaatgtaaatgctatgtaaatagttattatactatagtttttatttgtattttttgttttttgtttttttttcaaacattttttatctgtagttggttgaaactgtggacatggaacctgtggatatggagggccaactggattctctttttaaaaaatatgatagtttgttggttttaccaaaaatataaatggtttgcctctcagtagataacatttatctttaataaattcccttccctatcttttaaagatctcttttcgagcacatataccgccattgggactgaaagtgtataagattttggaatcagcaagttcaaattcacatttagctgattatgtcttgtataagaataaagtagaagatagcggaattttcaccataaagaatatgataaatactgaagaaggtataacactagagaactcctttgttttacttcggtttgatcaaactggacttatgaaggtatgttctgaatagttctaaaattcatagaatgcttatcatttttgctacaatgtgtgtagattaattaggcaaaaggggaaaaaagtcttaagtagagctgtatcaaatactcttgagtaaaaggaagcatgagctttttgcaccttcattgaccacttgctgctcacatgtatagtctgtgggtggcgctactccatggtctgtgtgtcactggtccaccagataagtacagaaattatttttttaaattgtcatatacatagaaccagatgcaacatgcttaacatcttagtggtgagttgcttattattattttttttaatctttagcaaatgatgactaaagaagatggtaaacaccatgaagtaaatgtgcaattttcatggtatggaaccacaattaaaagagacaaaagtggtgcctacctcttcttacctgatggtaatgccaaggtaagtggtactgatgagatgacaaatggaataaacacttattgaaagagtattgaggaaaaagataagtgagtgtcattattttatcatctgttgatttattagggatagatgaacttttggttgcagtattatctatcaccttattgatacttagcaatttgtagtcgaaagttagataaatggttgggcgcagtggctcacacctgtaatcccagcattttgggaggccaaggagggtagattgcttgagctcaggagttcaagaccagcctgggcaacatggcaaaaccccttttctacaaaaaatacaaaaattaggcatggtggcctgcacctacagtcccagttactcaggaaggctgaggtgggaggatggcttgagcccggaaggcagttgcagtgagccaagatcacgccactgcactccagcctgggttgacggagcaagaccccgttagataaatagttttttagagttggaatttgttaagatgctacaatgaacaatgttcagttaggataaacaatgaacatgggaagaaactagattttacgtagagttagggagctttatatgtatgcattttatacagacacaaaacctctagccgtatgggaaaaatagattttccactggaccatttttctccttaactttcagccctttaaaaaacaaatctttctcactcttgactataaaggtagtaatacgcaaactctggcacattttgaaaatgccagaaactaaagaaaacattaaaatttaccaacaggtgcacaatcccatgaaaaccattgccaacatttggatgtatttcttattgtcttttattttatgcatatccttttctccccgttctcaagtcttgacttattgcatgtacatattttgtttttcatttgtgacagtgctcacaatctgatggtatgttttttaaaaatccaattttaatatatactgttgtgtttaagatgttgcttatattctttttctcccgattcttcactaccataacattgtaataagctttctttgtagcattcaaaaagaatgctacaatgcaattctgattaattgctgagaataactttctagaagagtcattttgtatcagtgtctgaagtcttttaaggacttttgctgtgtactgcttatcttccctctagaaagactaggtaaatgttcaatcccaccagcattttttgagattaactctaaaatcccactccaagcactgagaattggccatattacaagctttgcctataatagtaagttagtagaaaaatatttttctgttaagatttttgtggttactagtaaggttgaacgtttttgtaccttcatttatctttcatatttcttttgtgattttcctatttctattctttgactgtttttctgttggtgtgtcctgatgatctctgagcactctatatgtggtaaaattaatccttttccctatatgttgtaaaatttttcttattgtgtcatttagtttgttaattattttattgtatttctcatttatagtggttttaaatttttgtgtagtcatttcttttttttctgtagagtttcttcctttgcttttatacctttataggttttctatacctcaagatcagtgaaatgttatcctaattattgtcttgttagctagggacctatctcctgaaaaagttacttttgttccacaagttatgaaacctgctaactaaaatccaatactggattttaagggattgtgtaggctacagtaaggactctaggttttttgtttgtttttgtttttggttttttttttggctgtttggggtttttctttttttttttttttaagtcagtgaagaattaaagacaaactacaactcatatgaggcattccaggatgggcagtgagtcccaaatatgagctgtttcagtgttttctcattcaccagcttttgtcattggacattttattttgattgactgtatttatacttaaaaaagtagttgtgctatagaatttcatgcgtagataccaataactaatttatttaaaaccattttatctttaaatagctctaatgtcagatagaaagataaaacaattgtcatttttacagagagaaaataaaaaacatcagggaaagaggcagtctagtgcatcagaaaaaggcaagagcccagaactcatcatcccaggttctcatcccctccctcactttctagctatttggtaattaggtacaagaaatttgtaaaccattaagcattttaataactccagaaaattttccctagccaaagaggtaaatttggaagaaaattacacaattctgaaaaaaaaattttttttttttggagacggagtcttgcactttcacccaggctggaatgcagtggcgcgatctcagctcactgcaagctccgcctcctgggttcacgccattttcctgcctcagcctcccgagtagctgggactacaggcacccgccaccaagtctggctaattttttgtctttttagtagagacggggtttcaccatgttagccaggatggtctcgatctcctgaccttgtgatccgcccacctcggcctcccaaagtgctagggttacaaggcgtgagccacggcgcctggccgaaaatcttacactgtttaagtagttcatattgcaagcctaactttctatgctattgttgagctaaggtatctaatactttaaaaatataattactcataaatgttttaaatttgcttccatgtcacataagttatgtgctttattaccattttttaaaatttaaataaaaactaaactagtggtttccaagtagttttttcaagtttgtgaatttatattcagctagttctttcaagtaaaaggacagaatgttttatagtttagtaaaccgagctatgattaaactatgtttctgaatcctgctttcagtttgcttagatgactccctgtagtcatccttgccacctgtcccaaaccctgaacattagggggctgggaccatggttataataattatttacctgggaaaatgtaacttctgtagaatgattgctgtttctaataagtaactatatggacaaatagaaggattttagttagaaatttgtatagctgggaggaatgctttctagaccagtgaagttgtaaacatttttatttcctattttcagcatttttaaaaataaaaaacacgttcagtttttatcacatgcatattttgttaccttgtaagatctggtttacacttaaaattgcaaatatcaggtgatacgtattttctatttttgaaaccataataaacatattcttttaaaagtttggaagccaaaatatttttcttaaatatattattttcttttcagccttatgtttacacaacaccgccctttgtcagagtgacacatggaaggatttattcggaagtgacttgcttttttgaccatgttactcatagagtccgactataccacatacagggtaagaaaataggaatgcagttatgaaacatatgtattatggtttttgaattcttgcttttcttatgccattcttaaattaacagttggtttttgtagatgatgtttttctaaacttgacatttttaatatgatttaaaatatgaaacttaccctttgataataaaaaatggtaaaacatttcaatccctacatatacatgttcctctgtatatcttctcttaattgttgccatattggtcttgagctcattaactggtaactttatttttaacacctgaaaacaatacagtgttttgattttatgaaatggaaattatattaaatacgactttcagttaatagaccacacacatatatggggcctgcttccttaaatatagcctgtatcactggaatgtaactttaagagaaaaatgttctaagctggttctatttgtttacagctctttacccagtagagtataaaacctagcaattgtttatcatttttagaacagtattgagcagcatctttatgaacccaagtgataggaaataggcttttgatccttttgagaacttaaccctgggcaatggaactgattccatggggtctgagtggagctgtggtttccaaagacttgcacatttaggttggttgatttagaattcattgtttgtagaatggtgtgcttttccaactacagatttaatcctaataaccagggtatttaccatattatcaacactcttagaaaaagacctcataaaaatgccatttaaatttatctttgctgttagctaagttgaacaaattagaaaagaaaaaatactatttccctgaatcttcatacaggtaaaaaataaaggatttcacaaactaaagataaatgtataggtaggcacggtttcctttttaggtattgtgggaaagcaaagggatactatgttcagggaatctcttaaatcacagaagttcaattttctgatttcatagttaaatttaattttgcttttatttaacttttttattaacttcaaatttcattagtatttgctttttgttagaatttcaggtatggacaaactttctcatgcaacttctttaggtaataatatgataggtttttcagaataacccatgattcataggatgaatcaagaagtaaaagttctctggcaggtgggaaaaataatgctagacactaattttgtgtcctaaatgtgacttctgaagttatctgtgatcactttgctacctacaggaaaacctgtagttctgaaataatcttctattgagtttctcaaaacttctggtaagtcagaaactgtttttgatcatctgtttgtactcttgtgtaagccattatttaatacccctgagagctctaagttacatcttcaactttatagcattaccccacagaagatatgctgatctatttttaagtttgctttaaactattgttttttagtggaaaagtttttcctggagtacaacatggcacacactttggcacaaacttgtgtcatcaggtttgatttaccattgtttttcatcagttatatttagagatgggctatgtctcagaggaaatgctgtagcaactcttcctaaaattccaacttctcaatcaggtatatttgcataattgcttttgcttttatttaattatgtcactgtatcttctgggttttccttggattatccaggacctctagttctcacatcatagggcagtttgtgtagactagatggccctgttctgctgctagtggctgtagcttagtgcttgacttggaaattaataggctctgacttgcctatttacttatttgagcaaactacactcatcagaactaaatgcttgtcatttttcctttccccctctcttcctgtttccctctgggcagtgaactgtccagtggctaatagtgttaagcaggagcccgggccactgaggtttgactggctcctggccttccaaaggggctctcaatgtagcccatttctatttgctggtcttgcctctgcctcttttctcttttttattctttagttttctttctttctttccttccttttttttttttttttttttttttttgacagagtctcgctctatcgcccaggctggagtgcagtggagcgatctcggctcactgcagcctctgccccactggttcaaggattctcctgcctcagcttcctaggtagctgggactacaggtgtacaccaccacgcctggctaatttttctatttttagtagggatggggtttcgccatgttggtcaggctggtctcgaactcttgacctcaggtaatccacccgccttgtcttcccaaagtgctggtattataggcatgagccactgcacctggcttgattttcttttttcatgtgtttcctttctagattatttgtcttctcttccttggtgttctcgggcatatgaaaaaaataataaatgatggataaataagtgtaatgcaaacttagagcgcctcactgatgagttttacagtagttgcctggattaaatgagaagccgtcatatataaactggacgtaacctgtaaatcttttttcattctagtccggatcattttttttttcaacatgaaagcagttggtaggaaatagagataccagaatcacctgaaatgctttcttccaaactatataccttcccgtgtttgtatttgagctcctcttaacaaatctccctctgggaaaagataagcccggttgtggagagagtctttccttagtaatcttcatgactcacctgtctctcctgtttttcacataccattgcctgaacactcgggttgtctcaatcctggctgattgtggttttaatgaaatcactaatcaaggcccatgatagatatacgaagtcttcagggtatttggctctatcagcgttcacgctgcctgaaagggtgatcagtcttcagggatctgttatttagtgccaagtcttccttattaagaaatactggaaagttgtttaacattctaaactttggcctcctgtaaatcagacacctggatgattgatcaaaatgcatagacaaaatgtggcttttcattttagatgcaaaggaaacgtcagccaacttccatgctgttgtagattggcttttagctagtattgcataaaataacaaaaaatatttattcttgaatttaatttactaaactagttttggatatatgctacttttgtcccccttaaaccaaccagatgcagttatttgcatgagtattaatgaatagagcctatttgttgttagtaccagattttcaatccaggaagaaatgagggtttggggagagagactattaatgttttatgattacatactgtaattgtattaggttactaaaccagttaattatacaaaagattttgtaatctcagcaacaaggaataaagaaacagaaaatgagttagtattaaagattgtctttgttgggtgtctatttttgttaaaccttacaaatccaatttaaaaactaaactaacgcatacctgacaaaatattcttacatttctcagtctctactttagttgttctttgacccttttctccccaaagtaactattgcccaaattaagcttcaggagaaaacaaaatcaagaacgacaagcaacatttccaaaattatataaactttttggtccttaatgattttgaaacagagttgagaggccgtatagttcaacctacttttgtttttggtttggtatttaacttttgtttctctatctgcattctctccagattctgaaaatgatcagaagtgcagttgaagggctctctctttcttaacatcttttaaactaataaaagaacactctgttttccttttcattatcgttcagacatcgcattcaaaaggtttctaaaaatactaaattagaagaaatcttgtgctcactagccttaaaagctctacaagatcagagcagttcagaatttctaatgaaggcgtggcacggtggctcacacctgtaattccagcactttgggaggccaaggcaggcggatcacaaggtcaggagatcaagaccatcctggctaacaaggtgaaagaaaccccgtctctactaaaaatacaaaaagttagctgggtttggtggcacgtgcctgtaatcccagctattcgggagactgaggcaggagaatcgcttcaacgcaggaggcggaggttgcaatgagccgaaatagcgccactgtactccaacctgggcaacagagcgagactctgtctcaaaaaaaaaaaaaagaaaaaaagaaaaaaaatttctaatgaaatatattgttttgcccatgtcaggtttaataaatccattttatagcacccataatttaatgaaatgcaatttatttcatttgtagaaaataacactcttctgggggaaaagttgagggaggtgggaattaatttttcttgcagtataatcatctttcatttaattgaagctttaaacattaccatataggctgctactttagcttttttggttaatctgtgattagaagatagaatataatacaaacagaagctcctgtatcctcttgtgttttatttaatactgcacctacaaggaaagtacataccttgcaataatataataccaataagtgacattgttaactgtggccttatttgtcttcagagctgtaattattggactttagtgtcctagtttctgatatcaacagctactttgaagaattaggtcactgtgggtaacgagtatgtcgtgtacatttcattggcgcaaggactgtgttctcctaggcaggtgtttgttagcgagttagtatgtatgtgtgtgtaaaccatgttttaacccttaggggaaacatcttaaatgcaatacttctgccctgttttccaccaacatattataaagtattatatgtaatggatcttactcaaagaaaacaagcagcctggaggtaaaatgtaatgaactgacatcaaaaagtatggaaggaaagactttcctttgactgaaatgactgattttcttgcatatttagcaatcgaacagagttgcttagtttttctctgagcaattttgaatatataaacataagtggatttataacctgactcttggcttttagagaatcaaaatgagcttcatctagttaaacatattaggggacttcaaaaagtttgtggacaaatggaattaaaagataaaaattaaaaatataaactatttctcaacataagcttcatcaagttcatgacgcttttgtaagcaatgaatccagctactcagtccatccctaaggaacagagggtcctggaaatttaaccatgtcatttcagtctacttatattattaagtaaaatgagtgcccattaaatatttttttaagattaggaaacaaaaagaagtcaggaggagccaaattagcactgtaagtgactgcctaatgattttccattcaaactgtcacaaaattgcccttgtttaatgagaggaatgagcaggagcattatggtggagaagaactctgatgaaactttcctgggtgtttttctgctaaggctttggctaatgttctcaaaacattctcataacaagcagatattactgttctttgggcctccagaaagtcaacacaccaaatgccttgagcatcccaaaaagctgttgccatgacttttactcttggccagtcttcttttgctttgattggaccatttccacctcttggtagccattgttttgattgtactttgtcttcagaatcatactggtaaagctgtattccatctcctgttacaattcttcaaagaaatgtttcaggatcttgatcccacttatttaaaatttccattgaaagccctgctcttgtctgcagctgatctggacgcaatggttttggcacccattgagtggaaagtttcctcaactttaatttttcagtcagaattgtataagctgctaattgttagttctcttcagttagagcaggagcaaacttaatttttttcttgaaaattggtgtagtcttcgtcttctacattgtcccatcccttcttaaaacaatttatctgttttgtaaagtgctgattttcttggaccattgtctccataaacttttcataaagcatcagtgatttcaccatacttccacctaagcttcaccataaatttgatgtttgttcttgtttaaattttagcataatttatattgctctgataggggctcttatcaaatccaagtctcacccttcttagtgctcaaactagatcctgttcagacatgttacaataagtaagtatgagtttattttgatgaaatccatgcatagttttttcatgatatgcattttccatgaaacttttgaagacccctcttataagggaatcacattgggatttggagatccaaatccttagttttgcctctaagcaaactagaggagtatgggtttgtcctttaatttcttagggactcagtttcttaatctataaaaaaggtagatgttcaattaggtataactgtcaaagagtcttcatacaacttagtttcacataaaatctcttgtgcctgactccctgcttctaaattcatcttctacacttggtcttagccaaaaggccaagaagtgattaaattcatcttctaagaatgcctgaatctggggcttccatccctggagtctgccccacttgtaaacaaggtctcagagcttcactgaagttctttttattttcataaaaagattcatgaagacattaagatggtttgcaatcaatctctcatttttttccatagctatattccatatttagtttgatttaaaagtaaaaagcattaagtaagttatagctaggcaggcttaggtaattaaaacatttttggaatatcataatatgcaattgactgctaaggatttttttccctgttaattggaacttttaaaaattgaaataagtagctatgtgacgaatctgattattctctacaggcatgaaagagaaggttattttaagggactgcaagcacattctggttacacagattcagaactcagaggttatctttggggctgtttgagagcagctgattgttgaagccataactccttagcaaagaagcatcatcccctacaaaggtgggttgcactgaactcaggtgaagggcacagggatgggggaaacacaggagatatgtaatggctcagagttgagactccagagccagttctcttgtgttttattcccaggcccatcctaggtctgccacttagcagctgtttgaccttgcacaggttactgccaacctggctttggttttatcatcctgaaatgttgacagtagtaaaatcagcttcagaggatgtttggagtattcaccgagtaaatatacaaggaaccttacccatagtgagtgttgtatctacttacaagagtgagtgagccagatgggttagatagtttactattataagacaaagcatggtcattaaggattgggggaattggggaggatttaatgaaggaagtgagtcactgagaggctaggtcttagagaatgtcacatgaaaggcagaaaggaggaaaagaatatcacaatgtgtgaaataaggttgtttagaaccccactataaggatttgaagaactctttgtcccttatatattttttaattgacttgaagtttttctttatacatttaaataattgcaaaggatgttattttggtgtattgtacatggtgacttttaaaaataagcatatccaatgggcagtggtactaaatcatgtgttttttaaaagcctgcactagctttttctttaactgtcggaaacttcacatcattattttctccttataattacattctatttctccacagaatgttatcttaatgtagtatttttgtggttcagagccttgttattggtcagtctttcattacttctctaaaacaaaaatcatgtgtgtgtgtgtgtgtgtgtgtgtgtatttatgtatacagttttaaaagtctgttataaggctctaagtattttatttcttctggattgagatataaaaattattatttgtatgcagttggtcaaaaaacataaatatgttcctattttaataattttattttataaattttaatgaaaacatttttctcagtgggttgtacctttttaattcctaatggataatgtatccattgatgaatgtcactcattgctagaatgatatatgattttattcttaatttttatttatataaatatcagtgcaaaggaaagttgttcacataaataagtagctggtaatggaaggagttttctttttttttttttttttttttttttagtatttattgatcattcttgggtgtttctcggagagggggatttggcagggtcataggacaatagtggagggaaggtcagcagataaacatgtgaacaagggtctctggttttcctaggcagaggaccctgctgccttctgcagtttttgtgtccctgggtacttgagattagggagtggtgatgactcttaacgagcatgctgccttcaagcatctgtttaacaaaccacatcctgcaccgcccttaatccatttaaccctgagtggacacagcacatgtttcagagagcaaggggttgggggtaaggccatagattaacagcatcccaaggcagaagaatttttcttagtacagcacaaaatggagtctcccatgtctacttctttctacacagacacagcaacaatctgatttctctttcctttccccacacgtcccccccttccactcgacaaaaccgccatcgtcatcatggcccgttctcaatgagctgctaggtacacctcccagacagggtggcggccgggcagaggggcccccccacttccctcccggatggggcggctggccgggccggggctgccccccacctccctcccggacggggcggctggctgggtgggggctgtcccccacctcctggagggggcggctgccgggcggaggggctcctcacttcccagacggggcggctgccgggcggaggggctcctcacttctcagatggggcggcagggcagagacgctcctcacctcccagacggggtggcggtcgggcacagacactcctcagttcccagatggggtcacggccgggcagaggcgctcctcacatcccagatggggcggcagggcagaggcgctccccacatctcagacgatgggtggcggggcagaggcgctccccatatctcagacgatgggtggccgggcagagacgctcctcacttcccagaggggatggcggctgggaagagacgctcctcacttcccagactgggcggccgggcagaggggctcctcacatcccagacgatgggcggccaggcagagacgctcctcgcttcccagacagggtggcggccgggcagaggctgcaatctcggcactttgggaggccaaggcaggcggctgggaggtggaggttgtagcgagccgagatcacgccactgcactccagcctgggcaacattgagcactgagtgagcgagactccatctgcaatcccggcacctcaggaggccgaggctagcagatcactcgtggttaggagctggagaccagcccggccaacacggcaaaaccccgtctccaccaaaaaaatccgaaaaccagtcaggcgtggaggcgtgcgcctgcaatcccaggcactcggcaggctgaagcaggagaatcaggcatggaggttgcagtgagccgagatggcagcactacagtccggcctctgctcggcatcagagggagacggtggagagagagggagagggagagggagactgtggggagggggagggggagggggagagggattgaaggagttttcttataggaatatcattcagtactttgaactcctgagttagatgccataagccacagactgatctatcgtcaaacattaattttaatcaattatttttaaagatctactgcctgacaacctgattaggtatgctttcaattttggtgaaagcaagcaattggaaaccatgtgttttgcagaaatatttgttgcttagtcattaaagtccagtcagacaccaatatgttgaactgtttttgttcagtacccactaaagaaggtgagagatatgctgctgcttgttttattttttttataagttgggagaagaaatagagtggtggaaaagaaacatctgtcatggaggcaggtcattatgaggaatcttttcctgcctaaaggtgccttagaaaggagcatgtttgggaaaacaggaagtaggtaagttcagagtaactgccagtgccacagatgtgcagatcaaatatcatgattagttcagccaacttctctcctctgtcctagaccagcccaagcctgggacacggggaaggcaccaaaaaactccggtgttgtgaggtattttattcacctcgtaggggagtgttttagttagaccttatttattttatctattttgaggttaaaactgatgtcggtattatgatccctccaaaacagagcttccaaaaaattctgttgtttcataacattagtactttaaaaaaaaaccaaaaagcctttcagttttgttttatgtttttcatttattatgtcttcttcaagtatatcatagtttattggtataatctttacccaacatttgcaattcatatgatcaaaatgccatacctttcctattacagatttagtttttgacattttcatgagaattattgaaatgaaaggcataaagtaggtacactagtgcctaactcataagttattggtaagtaatagtagctgtttatctagtagtgttttatgaatggcacaaagcagtatatcatcattttcttaaatttgtgacttggaatgaaatttactaaaatttgtattcatgaaagcagatgttaacattttcacttgtggagaaataatcaatatgaacatttacagacccagaaatcggcagtgactcagacgataaattagatcttataatgaatggtaaattgagtgagtcaacatggaaaaaaagatcatccagtagtgggaattattaccatttttattttggtactttcagatataagtacagttttttttttaaatatggtcacgataatattttctttttagaaacatttagatgttgacttactcagtttgtcattgttgtgagaatttcatataagcatacttatcgaattaagcagtatatgttaattaataaccataagcttgagctttaagctaagttggataaagtttacaaaaacatcactaaagtaagtgcataatagcaaaggtatttttatatttttgatgattaaaatacaaaacaaaatgtttcccatattgaagagggaatattcaaaatcagaagccctagttttttctgatagctattattatcctacttctgcaacaaaatgatgattctgtcatcctctctgctcagacacagattggaggaaaggagatgagagcaacaattagatagataacaaggttccctttgcctgagagccagtatttttaagacactcagacatttctttgaatcttagatgggtgttttggagatttattttatgtgatttgatagctatgttaaatttcagttaaacttttatttgcagacttaaatatgccgcttaggattctcgccatcacttgtctttttcctaggtgaccgtgggccatttgctattgtccctcttgatctaatgagttgtcctaatcacattaggtgccactgataagatactggactttgctgggatatgagtgaggttcttttttgtcgtttttcccaagttgttgcctctcactcctataactggttgagtgtggtgagagtggtgtatgatttatgagtatattccttggaaaagtatactttgcatttcaaaatagctagaataaaatgatctggagaggtggagagggttgagctaactctgagattctgcaattcagggttgaattaggcggcttcagataaattgttgaaggatctgagagagttggtggtacagaggaagtaaaagcctgggattttccaaaggccgtcattagttgttgctcagagctatgactccagggtttccatttgcattttttggagtccttacaccctcatggatgtttcttttacctcatatttcaggcatggcgtgtgtcgggcttgccctccagtttttcttttaataataacaataataataattattgttattattatttttgcgatggagtcccactctgttgccccaggctggagtgcagtggcgcgatcttggcttgctgcaacctctgcctcctaggttcaagtgattctcctgccttagcctctgaagtagctgggattacaggtgcccaccaccacacctggctaatttttgtggggttttttttaagtaaagacagtgtttcgctatgttgggcaggctggtctcaaatcctgacttcacatgatccacccacctcggcctcccaaagtactggaattacaggcatgagccaccgcaccggcatgccctccagtttttctctccccacacgagggagcacgctttttggtttccttagactggtgctaagcaacagttaaaagggtgatgccttttgttttctgttctctctctcctgatccacccagtgggggaaggctctgagaagagcaacatcattttgagagtggtgctaaaaccctgtaagcctgagtgttctgtcctcccaaagctgtgatacggctcagcctcctgacggtgacctacttggttttatttcttcttgctgtctcagaaaatattctaaagatgcttaatattattttacaaatacaggtataaataatatatatgtgtactcttctgacttcacacattacagatataaagtaaaattcctctggcatctgtgtctgtctccatccactcttcaggagaggaattcagatatatgtgcaagcatacatgcaccacacggtcttacaactgtagaaaagtatagtattgtgtttgtgtcgattttcagcatagtttatcatgctatacaaatgctacatttagcttttttcttctgatgtttctctgccaagagagacagttacctcattcttctcatttgtgacacagcattccataacatgggtgtatgtgattttatttattcatttccctgttgaagggcatctagtatgtcttcccatttttttgttcctagtgccagtatgcagtgaacatgctggtgtgtgcctcctgggctcaccattatgtacatctcagctaggtacagtggggaggaactgctgtgcaatagagtatctgtctttaatattaaatatgtattactttcttggcttctaaggtgagtgtgccattttaaaagagagttttgggttgttttaaagagtttttggggtctggaagcctcttgtgctttatttcactcaaatagctcttgcaggatatcagatttcagttcagtgccctctgcccttaaaaacaaaaacaaaatctggaggtcttctctctactcgcttactacaaggcctctcccagcccttggtcccagagtaacttgagccttctccaatagttggtctgccagtgagacatgatgatgtagtagtttagtcctggttctgccagtcttgtccttgggcgagtgatttcttcctcagcttagggtcaggaagaaaggagtcattatatgtaaagcttgtagtaaacatatggtacatagtaagcatcaataactcttggctcctgtcattgcgacatagctgccacccttcactcagcatacgtttaccacccttcactcagtatacgtttattgtacatgtctacgtgctgggaacatgaagataaataagacatggtctctagccttagggaacttatattctaacatgcatgtaacatatatgtaaaatgaaagttcttattctctcatctttccagctacttaaactttatccatagcccagtttactttcctcccatgtcagctaacttctgcatgataaaggacaggctttcatatcttagctatttctgtctaacagtgattcagtacttaccatgtaccccaaatgttgttaagaactggaatgcaaagatggtgtgtaagacagtctgtatctgtgagaagctaacattctgtagggagattaaaaaaaaaaaaaatcctagctccgggtgtgagactggaatctacagcatctatagaacactctgatgtagtgggaccttctgaaggactctttttggcctttttattaccacttttcacctgtgaactggctctgttctaccttgcgttgcctatgcaaataaggataaacaaactccattctctcttccaagggggagagaattagcagcaagagggcacatatttctctttgttaaaacctgggaatggcatcactcctttctttccctagtgactaatcttgtaaagtgttaaagagaagtctaagtcccccagagggacttagaaagccctggccattcatgcccaggtggagccactttagtaaaaaaaatagcatttttgctgccatgtgatgcacaggtaaaacagaccactggatactgctggtttgcattcctgcttcctgggaagttctcccttccatttcatgagcctctttgggaaaggtacaaacttagggaattactgacacagaataggaacaattggcaatcctttcactctttcacatatactgatctttaaaaaaataataaattatcattgagaactcagggatacctccttgcttttatgaccattacaggttttgtttggcttgttcataataagcatattaagtttaatcttattttaaaagtctgtcctgatacaaactttaaattgatatcttgctgaattgtgaatggacataaaggctccttttaaagagctttaagtgtttgttgccacaacagggtctgagtataatactgaggttgagaaagatgattttctcaacagaaatactttattattgctagaggtagtgtgaaattatcattttttccttgaagcatgttcttttataaatgctttctggagatacatgaattaaaattaatgatgttctcttttgttaaggctttatttcatttcatgtattctgttgatctttgagacaatatctaatctagagagaagaaaacataaaatagtactaaaaacccaatgaattcttttagtgaattagagtttacttcttgtcatcagctaagctccctagtattacgtgaatactatcatgcttggtgctacattttgtgttttggatgtttttggttcatttgtagatgcttatcttttgttattaaaattccatatacatttcattttggctttacaaaactattttggttaatgtaagcatactgaaaagagggtttgcatttagagtgatgcatttcgtaggtcagagaagatactgttatttatcatcagctatatgtgtgatttctttttcaacttcccaatagtggtggagatatttgggtcatctatctttgcaggtccttgtaataattgtcatcaggaaatgtacatgtgtaggtaactggcaggggttagtggttcagactatggccattaaaaaaaaaaaaaggcattagctgggtgcagtggcacatgcctgtagtcccagctactcaggaggctgaagtgggaagattgcttgagcccaggagttcgaggccagcctgaacaacatagtgaggccctgtctctcttttttttttttttttttttttaaataacattccgcatttcctcacccatggagatggtactcataatagttttatgaatgtaggaagaaactgaagttagctccattcaagttggaagagcagtatataccggaaagaaattcagtgagcattctgaaaattctgatcctagaggcttcagcccatttaagtgttaatttatcactagattgttatttttattttagaatttccattgtacttttcagataaatctatggtgcctacactaactgcatttacattctttttttttttttttaacagaaatgtcttagcctctggaaggccattttattcactaacacatgctaggaggcttcagcaatatcctgctccattctagaaaacagcaatttgatccttttttcctcctcagtcattaacaagattatgcatttgcggtgagatgatccttcttgaacaagtagccagaaatcatttgttccagtttcttctcaaggtgctgaattaagtctcgtctcataaatcttgtggcttccttgatgatggattcaaaaaatcatttcttgacttctataggtccttgcagtccttcaagcaatttgaagagtttttcatattttcgtctaaagtgttgaatttccttcactaattgacattttatatcagcattaatttcttcttgacattttggaaaagggagtatttctgtgacttttaggtcatctccagagaaattgctggtaatgattcctcctacaggtgcatttctaccaggtttctgcatcagcccatctttgctgcaaccactgaagtcatcaaaccgagaatccaattggcttggtggaataccatctcctgccataagcttcttttccttggacatggcagagcctccaataaggctgtctcctgctctttgtttccttaacaacagggccatcttctgccttttctgagatgaaggagtctcagattccctgggacgtttaaacacattttcaggttctacagcaaccttctctgctttatcagtcattgtttccagaaggaccgatccagtatggcccaagggggatggaagggaaactgcctgctatggcgtgccctgccccagccaaatactgggaacactgggaacctgtgtggtgcgccggagtcctgaggagaagccttgtgttcagtaggatcacgggtgccagccccgacaatcatggggcctgcatttacactctttcccacaaacctcacagagttaaacttcctttctttaactctttgctgtcaccttctgctaagctctggggattctacttgtgtcctaggaaaaagtcttccttactcctttcctaccttatgcatttttccttttttcctttctgaacctcagaaagcgtcagctttattgaatagaatgatgtcactctttcttcttatgaccactttcctaattgctctctttagaaggtcctgtaatatctctctcgcaccgtttttaaaaaaaatttccataggttattggggtacaggtggtatttggttacattagtaagttctttagaggtgatttgtgaaattttggtgcacccatcacctgagcagtatacactgcactctatttgtagtcttttatccctcgcccccctccaacccttcctcccaagtccccaaagtccattctatcattcttatgcctttgcatcctcatagcttagctcccacatatcagtgagaacatacagtgtttggttttccattcctgagttacttcacttagaataatagtctccagtctcatggaggtcgctgcaaatgccattaattcattcctttttatctcatacacccttgatctgtattaagtgtgttggatttcctcttctctatctatgaaattgacccaaggcctcactgaggacctgaagatacaattaaagtagaatgacagaaactagtaaacacttgaggcttatccaaatgaatgtttgatatgttagggactttttaaagctgtcctctgttttacataacaaaggacaaaatggatcatttcataacaaggagtcctaagagataactaaactcaactaaaattgatttaacttctggagagctttccagattatagtccacaaatactaatatgttaatattactttcagccataaaccatctcattagatctcctgtctcttttcctagcaataatacactgtcacttgaaccagcagaatgtaaactttactggctcataatttctggtctataaggagagaatggtgaaaaagtgggctagaatggctctttggggaatggtggtgcagatgagaagtggactggcctgtagctgggcagcccttttttcatttcatgtcctgtttctcctctagaactcagagaatcatttacatgttatacatcatctacatttttctcatcccagctgcttcattctttagatgaataatatgctcccctgaataagtgctatctaccttctgatagtttttaaaaagaaaagttaaattgtcatagcatttattatatgagagatgttaagacaagaagtagaaaacaagaaaatgtaactttggaaagagttctgtatagtatatttcaaaaaggtgaggcaagtaatttctttctattaatccatatatatttttttaaatttaggaatagaaggacagtctgtggaagtttccaatattgtggacatccgaaaagtatataaccgtgagattgcaatgaaaatttcttctgatataaaaagccaaaatagattttatactgacctaaatgggtaccaggtaatttttcctttaaaatgtttaagtaatggttgtattggtgtgtaattcttatatataacaatggcccagttaattttggatcctttgaaaaagtatacttaaagttgcaaattatatctaaaataaaactgaattttgacagaaaatttcgggttctacagttagaagaaatatttgggagaccatttttttagaacatctttttgtaaggatttatttgttcaaagggtaaatttggtgaccactatgaatgttaaatatcttgatgctaaaaaatatatatatgaatttatctaccagaaaggaaacataattagggattgatggattatacttattgggtttttttttttttttttgagaaagagtctcgctctgttgcccaggctggagtgcagtggcatgatctcagctcactgcagcctcttactcccaggttcaagcgactctcctgcctcagcctcccaagtagctggcactacaggcgcacaccactacacccagctaatttttgtatttttagcagagacacggtttcaccatgttggccaggctggtctcgaactcttggactcaagtgatctgcccacctcgccctttcaaagtgctgggattgtgggcatgagccactgtgcccggtctgtttttgtattagcccactctcacactgctatagcgaaatacccaagactgggtaatttataaaggaaagaggtttaattgactcacagttctgtatgactggaggggtagcctcaggaaacttacaatcgtagaggaaggggaagcagacaagtcttacatggctgcaggcaagagagagaaaagcccaggggaactgccatttataaaaccatcagatcttgtgagatctccctcactgtcaaaagaacaccatggggggaaccacccccatgatctagtctctgcccaccaggtctctctctcaacacctggggattacaattcaagatgagatttgggtggggatacaaagtctatattagttgtcctcataaggaattgatccatacctattaagtttgttccctatatattggtttaatgtatgatctaataatgggcccttgtaaatttcaggaaaactcttcctctatatgtgtgtgtgtgtataccattatacatacacagacacacatgtatacatatacataggtatatctattcagaaatgggcaggtatatatttaatcaaaattttcatgaaatgtttcaaattgtagtaaggaaattgatttatacaatcttatcaggttgtcaattctccaatttaatagagcacttttgattgttacctaaatctctgttttctgagtgtatgtgtttgataacatatctttgaaataccattaaaaccatgagcatgtttttaaaacaagtgttttagaaatttctggctgtgaatagaaataattttacaataaacactttgattttcaactgggggtgggtgaaaaagattttaataattttctcttctatgatttcctgcaaaagttaaatttaaactttttccaaaacataaaaattgcagcatacattctgaattagcatgttaattcgactacagccatttggattccagataaaatctcaacttcatggtgattcatttttttatgtacaaaagaaagtattttcttaaaattatacaaaaccagttatttgtatttttgggtgtagacatgaatgagaaacttagtaaaaccgaataactaaaaatgtgaattttctttttgaggatggaacgtttgactaaaaaagaaaatattacttttaagtctgtaatatttctgcttttaaaattgaccattttttaagctttggatatagtagtacttgggcaaaactaggtatctagctccaccagtggggaatcggggtagcaacaacacgattgtggtagttttacattttttaaaataagtttacatttacaagttaattgggtttggaaaggagaaatagagaattcttttaaggtagctttacttttttttttttctttaaacattttacagttgtagctttatcagtttattaatttcccaaggctgccatacaaatggaatcacgtaaaacaacaaaactttattctttcacagttctggagactagatttctaacatcagggtgttggcagggccatattccctccaaaagctatagggaaataaccttccttgccctttcccagcttctagtggttgcctatgcttggcattccttggtttgtgtatgcatcactcccatctctacctcttttgtcatacagcattctccctatgcctcttgtatctgtctgtctgtgtccaaatttctctcttcttgtaaagatgccagtcattaggttaggtcccaacataatccagaatgacctcatctatttctgcagaggctgtatttcaaaataagatcacattcatgggttgtgggtggacaggaatttgagagagggaggcattattcaacctagtacaaccagtaatttgagggagacattgcagggttgctgggaagattaaagatcacatttgtgaaatactccggaccatgcctttcgttaatgggcacttaatacatgttaactattacggtaactttgtacctcttcttttcttcacttttatatccaactttcatgagtttaaatgaggagatgacatttttatgtggtatcattaagattcactgataatagggttctgagcttagagtcagtcactgtgacccagatgggctttggggttaccgacagtctttctcaaaaagtagagtcatatttcaaacattcaggtactaggctgcaaggaattggaatttggaactatctacattgaaactaatcaaaaagagtaagcactgaatggtttttaaatataaatatgcatttgattttaacataatatcttagaagatttggtgcagagacctgtggtatttattaaaaccaattcaagaataataagagatatttcttgaaaggggatagagaggtattatacttagcattcattacaaaagcagtttgttagatttagatgagaaatgaatacttaatacctttataatttgttttatgcaaatattggagagctagaagacttttaagcatttttattctgaatttaaataggaatgcctattttaaaaatctggacaagttctacctttcccacctaaaagttgttttctaatatccttgtggtttttcttcatattgttttaaataatgttttaatttttaaattatttcttccactgaataaaaaggaagctttgtctttttctcttgggaagaaaaatcacctgtcctcaagtttttaaaagaacatatgtaaatatcactttttgtagatggaattgttgtgttttatagattcaacctagaatgacactgagcaaattgcctcttcaagcaaatgtctatcccatgaccacaatggcctatatccaggatgccaaacatcgtttgacactgctctctgctcagtctttaggggtttcgagtttgaatagtggtatgtattgcttacactcttttccactctgaaaggtttcaattccaactgtatactttttctgttggtcagatgtggtataatctctagttaaaacctccctgtcttcttttcagcttttttctttcaacaaccagactattagttaagtttgggttttgtgagaacaacataaaaagatgaatctcctaaatcttcagatgaagaacaggagacctaaaattccatgtcaagatttctttttaaagataatttgcttctcctaatagtatgtattttgcagaggtctccatcatcattatgatttaacggatgtggaaactcagattcagaggtttagataagttgcctacgtttgcaaagttgggaagttgtggttcaaacttaggtccttttctgaatcatggtctttctattctgctaccacctgaaagaaggaagggagtagaaatgatagagatatggggataaagaggtgtggctttgaggattccaaaagagagaaagtgatgcgcagaaagtgagagaaaatagtcaatagacactgattaatttttgcaagtctttctattgagaggctttgatcctttataatacatatttttaattggttatcatacatggtatcattggtcttcttacattctaagagttggtagagatacatatctgaaggagccagataataactgagtgcagattcctggtgtgtcctttgacacaagcccactttttacatgaggcgtatacatgcattctgtatcttacacacacacacaaaaactgctacttctcatttttctttgtggccttcattagataagatcatataaactcatgccataaagacatgaattcgattttgaaagtagtaatggctccacatcagggatccagtagggagggttagagacttgagcaaactgaagagcatgttcccgatgtgcagtggggcagcattgttgctgtgtggttaggggcccagtgttgctaaattcaatttttttttgaagaagagtccagaagtctggaattttacgtgaagttgttcaatctgtaaaatattgatataattttttaaaaaacactatgttgagaaaacataaaacatctttgtgccgtacatgactcttgagccactcatttttaaacactgccttaaattctcaaagctgtgccctaaatagaggactagacagtaagactcaagccgtggttaacaaagcagcattatctcacttcctggaaatgtgatgtacatttcctaataaacctcataagcatttttgattccaaatggtgctactaaaagtttcggagaacttaatttactctttaggttaatgttttggaaaaaaagtttcatttaaattttgatctgtcctgtctcacttttaaatttcttatcagatattgtgaaacattactaaagaaacacagaaatactatcctgttttatgaatttgtagtagctactttgagctactatcaagagaaagcccatggtgtagtgggttgtataaatccacctccttgactagagaggaaatttagagcaatacatcatgactgctacttaagtgatgctcaatgaatgtcagtattaaattattctggtcagttttgcttgtttgtttgtttgtgtgttaggtcagattgaagttatcatggatcgaagactcatgcaagatgataatcgtggccttgagcaaggtatccaggataacaagattacagctaatctatttcgaatactactagaaaaaagaagtgctgttaatacggtatgaaaaaataactagcatgatctgatattgattgttctttgtcacccaaaacttgaaattatgactttccacttttaaaattttaaaaatcatttccaatattgagatttctttatagtagatgtggcccacattcacagaaagagaacttcagttataaatatcgtgtaagatttgcacttaggtctttttattttttatgtttgcttattatgtagataaaaaataatgacaggaaatcactttgggtaaatattcctgaaattattttgaaagacataagaattgaaaaattgagctaaataaaagttaaagaatagaacttagtcatatacttaggagattaaatttggtaaactttatttgaaatcttagtaaaatttatttgaaatcttagtgtacttattctagtcttagactcttcagttgaaaatgtatttatatgtaggttttctatgaggtttactcctcaaagcaaaaatctagtactctgtgttgaatggtctggcaaaagcccagctggacctgaatgacctgacgatatgcttgttcaggcaaagttatcttcagagttctccgtaagttattgatccacccaccttggatagccctgagcatgggctttttctttttgctctattctcctttctgcacctgaccattgcaagtcctttctgctcttttcagccagtgatcgtacctttcactttatagagagaacagccattagacagggctctctgttccagttatctaacatctactcccacccttcccatctttcctcctgttacatttaaaagacactttacagtccatcatcctaggcaggtcccaccacttgtccttggaacttactctcttcacccacctcagcatccttttactgttcattctctccctctctctttctcccttgctcctcatatccaacacttcctgggagattctttctgttagcttttgaacactctgttttcttctattaaaagtagaaatggaatacagccttccttcagactcttatttccatttcctgtaagctgctatcctcttctctcctacccaattgagtcagagtttatgagatgagtttatttcatcacttccttctcacaatccatttgtttcagtctggctttagcctccatcatattctgaaagagctctttccgatgtcagtagatccagtgcatattgactttcgtcatcttacttcacctttcagcagtatttggcactggccattgtcactctctaaaatactgccttgccagggcttctatggagctatgcagtttggttttcctcctacctgtctggcagttctttatctctctaatagttctctactcagccattaaatcttagagctctcaaagcatgtcccctggccttctccttttcttattttttatgctatcccttggcaatctcttctactcctctggttttgtttgcatcttccacacaggtagaagccactaatacatatctccaacttaggcttgtgtctgacctcctgatttatctatctaattgcttcctgatattctctgtttagaaggacacctcaagtttgacatatccaaaacactcataatctctcttctctcccaaacctggcccattttcagtgttccccccagtcaacagccaccgccatccatacaactccaagacagacatgagttctgcctgatagacacttctccccatcagccttttctcacagagtaattgccatcacctatctatctcattgcctgaatatttcaaatttataatcttctttacttccaccaccctaatctaaagtgacttcctgtatttcctgggtctagcctatacacatccaccctgttctctttctgccgtatgtctgttcttaacccagaaggcagaatggtttttttttttgttttttttcaaagccacatctaactttattgcttcctgttgaaccctctgatatcttctcattgctatcagtataaaagtcaaaatttcttaccacggcctccagagcccctcatgatatgggccctgcatgtcccctaggcattggcattggcatgccttttactgtgtctgctttaggcccactggtttcctttaagtcccaagtactttccatcccctcctccccaccgcacttttgcacatggcctgttatcctctgccttagagactcttggtgatagttccggttagtgcttacttcatcagctgcttctggaccaggttaaaagcccttcccctatgctgcctccaaactgtgcatctcaccttcctgcaagtgtgcgattatttgatcctgtcttctcccctcctttggaccataaactccatgagagtggggaatgtgcctttctttgcttctaggattgttcctggcagaggacatgcctaatatatgtcatatgaatgaatatcgaaatgcatagatgaatgagctgttagagtacattttgccactgtatttattgcaatttctgcctattaccttgtcttcatatgcatgttgcattcctcctactagattccagggacttgttgccttcattttcatttgtccttatatttggtagacattctttaaacaaaatactagttgattgaatgaaatagcaacagctaattaaagcaaaaattcttccagtatttagaatattttagaaaaaagaattagtatccactttagatgtcaagagccataccattcttgagactcatattttaaatcaatcactgacaagatagcttagttttaaggactaaatctgcataggaaaatcattgtctgagtgctgacagctactgtcttttgctcctcctgaaaaagtttctcgcttatatgactttatattgacactaatctataaaacttctgttaactgcaataataaaaattttcacatcaaatctataaagctttgacttagaagtgaaataatttgtttattcccattcagaactccttggatagtaattgatttaaatttaatttaatgtttttatgttgattaaatttttcttttactcaagtatagattctgggtcttcaattaatggtttcttttaaataagaaatgaactagagaagagaaaatacattttaatgtctagtgaaaataattaaaaagacacttaattgatgaaagttaataccatgtaacttgaattttctagaaagagttcttaatttcaactcagactcaaatatctaaaataatgatggagggaagtgaagtagggggatactccctgaataggaagagattttaatgggaagccctgagcatgacagagcctcatggaaataatcccgagctgactaagtggaagtaagtcctgtcctcagagaattctgcagagagtcagtaaaaacaaggacttggatgatatccactgtgtaatatgtgcaggtgtccagtgaggactgtggctgcacgaggttgaccatcatttatgctaatcatcctcaaagccaatagaaatggaaaataggattcatctctttggcattgccagggtttgaatgtgtcccccaaaagttcatgtgttgaaaacttggctaccattgtggtaatgttgggagtgggacctttgggaggcttttgggtcatgggggatctgcctcatgaatgaattaatgccattatcatcggaatgggttagttattgcaggagtggctttgttataaaaatgagctctcttgcactctcttgccttttcaccatgtgataatgcagcaagaaggccctcaccagatgccagtgccatgctcttggaattcccagcctccagaactgtgagctgaataaacttcttttatagataaattatccagtctgtggtattctgttatggcagcagaaaatggactaaaaacaggcattgacggctttaggatttgtttctttgacggtttatccttacccctttcctgctactggttggttaatgaggcactgagctaggaaccctgtaagtgttcaaatgttaaaattgtgttgttgtacctttaaatataaggagaagaaattgggagagatcagattaaaatattaaatacttatatggtttagaaaagtgacagcataagggagatcaaccaggtttaagggtaaatacttaggtgaccagaagatctacagtaaacttgaggacatatcccaccaagacccacaactcagctccagctgattgtttccacaataggactgaatgcctgcccagggtgacacagatttccagtttcttgggtaaaaaacaaaaaatgtgttttgggttttttgaggttgcttttttattatgaattttttattaaagagttggcttaaaaacaaaaaaaaaaaaacattttaataccatacagacctaccaaaatgtgttatctacaaatctgccccacagtcttcagctacagatacttacctccaaatgttatgattcaatgtattattcttcattttctctcctccttcctctttgtcttttttactccacccttcctctctagtgttcttctttcatttatttatattgcatttgcttattaaattaatagatttacttcaacagacatttattaagttcccaccatgtttcaagtcaaactgaataaacaagggtaacttaaaaaatggtctcttactatctcaccatgatttaacaggatcgtttaactcaaagtgagcttaataaagggcaccaagaagtctggcaagaagttctgactcatggactaagggctggaacccagtgaggaagagctgtactttgtgtggtttggatcagaaggtgctagaaactttctttaatgtcagacaggctgcagagagaaagctacacttatacagtctgaaaccttccaaccaacaagaaattaaataaggtttatagtactagattagttaagtacaaggctggggtattcatttataacttaaacacataaaatttcctgtagaaaacatgtttttaaaactttgggtttatcatatgatttacagtggaaaggttacctttgtagagattaatttaaatattgatggttcaacagttaatatcttgttgagcctcttgttgctgtaaatatgataagaaagtacatgaatggcagaactctgggtgagactttgccactccaacctggccagcctccagcagtgttattttttcatggtgctcttagggtagtgaaccacaactcttctataaacttccttatctttctaaggacagtaaactacacagtttttaaattcttgaagtccttaatatccatgacattgtttccttttagaagactcccatcaaaatgtctttgaaactgaatcttgtttttctaatgcaaaggtagttaaaaggtaaagtttatcttttgattctaaagggagctctgttttctctataagattggatgtctggggtggcacttcccggcacagggtcatggagcagtgtgcggctaactccatgaaattcacctggggaggcttttcagctttgcattttcaggaccccacctctcaagattgtgtagatttgggataggacccaagaatctatgttgattagaggtgccccaactcattctgttgtgtggttaatttggggaaacaccaacggttaggaagaactaatttggtttggaggattggtatatatgcacgttattgcttctggagtatagaagattaatcaggaagtgttctggctactcactggagtggtgaggaattactccaagagtgtggaacaaagccagagctttctctgaatgtttcttgacctagagtggacttaatacttcccagatttgatgagggaggtgttttcttttctgtttgaatcttttatgttttattactcgtgagtgactttgtcagcaatcctaacttagattatgaagtcctttgatcttggagtacatttaaaatatcttgttgaaattgttccctctctattcatgttattctacgagctgcattaaatttcagtgttgttggagaatattattttatatgctttatttaatctttcttttaatacaattcattcagacccgattttttatcagtatcttaatattgcagtgtccctctgctgtcttaaaattttttttttctctctccatagtctgaaatgtaatgacatctaatgttagcttctggcacgatgctagtcactttttgctagcacccttctgtgcaatgctaatctgacattctgaattttaagctgtatatctctataaatcctgtcttttcacacagatcagtagccaagccttttatctgagccttatattacaaaaaggatgcaaaatcagaagatgtcaatggagtaatcattttaagaaataagatacaaaattaaatttggttcaaatgtaactggtgatcaaaggacctttctgcataaattattttctaagttatttgtgtctgtttttactccttaggttaagattctactcagtcattgatttaattttgcatgtcatctagcatatttaatctaccaacattagtagattatttaatgtttgaacatacagaagtgttgcttttaaccatataccatagcaaaaactaaagcattttaaattatatggaataatcatatactatgtaagtgtgtgataactattcagtaacatatttaacacttctacttttggaataaaaatagtgaaacaattggcaatgatttaccaagttgaaagaaaacaatcagatgatctaggcatgccgcctatgttatttatatttaaaaattggatttattttgagagttttgttttctttaaattctgtcattgggtaacatttagttcctatcatttggtaacatggatggactttagctttgaatcagtatatgcctttatggtcttgttaaggggtataaatgaaactacaagaatatggtggatgaaacctgagaagggagataatatttgatgatgcacaacatataatctatgtacagcccaatccttgtactttgagagttttgtgataggttgagaattttcataaaaaggtatgccttgtcctgaaatgtttgtaggaaatgttttcagtatttttagtattaaatcaatggaagatatattttaaacatatgagttagatgtgtgctgtttattttcttttattgcttacaactaaacttggtagtttatggagtattttctaagactgttatttataaaatgtaataaaaccaaattattcatatatttttatattaaaccctctcagataattctgttaatatgatgagaactggaaatatagacctcttaaacatttttgttttttcttgataggaagaagaaaagaagtcggtcagttatccttctctccttagccacataacttcttctctcatgaatcatccagtcattccaatggcaaataagttctcctcacctacccttgagctgcaaggtgaattctctccattacagtcatctttgccttgtgacattcatctggttaatttgagaacaatacagtcaaaggtatgtctcaaaatatatcttataaaaaattactgtttattatgtacttgttttaagggggtaaggaaaggagaaaaaaataatgtatgctttactatgctttgaggaattattaacagggcttcacctttagccaaaagcttcatgcctttcatttgactattgctgtatattttagagtatatcctgatactaatttactcttaagttctgtatggcgagcaggtcaggaaataccattagtaggtgggcaatctgggccttaagtttagcactagtgacttttcccattcatttctccttgttagacaatatctctcagaagctagagaaatagtacttagttatttctatatcagaggctttgtattttcgtacctttctcttgagaatcactgcaactcagtttcccattagaaaaccaactgtttagaagaaatattagaggaaaagcatggggaagttttattaggtatgaaatttaatttagttagactgcagttatatacatacctgtttttaacatcaaaaagattgcatttggaaagaataagaattagacatttgacattgttcttatgtgttgcaaagctgttttgatattgcaaattgacatagatttagctggaaatagtaagtggttatggattctgtggaaaatatctcatggtaaatggcctaagtatgaaaagaagaggatgctcatgtttaaagacaatataagaggtgagaaatgtttaatgtagaacaaagaactaaagcaataaagtaaggataaatgcctataatttggatattagagatttacaactttatgtctaagatataggagaaaaaatataatttttttttctttatagatttttagttgagacacttttgaaagcaaaggtcagataaacaggggaaaaatagcaatagtatattgtacatgctatacctgtcacttgggagaggcctaagttcaaaagtatttttttcccaaggcagtggttttgggaccttgcctaaataatgttttaacaaagagccataaatcctctagagacaagacaaagaagaaagcaccttcaggcttccaaaaggtaggaaaatgtgggaggataaatttatgggaagagtgaagtctgctcctagatgctctggcactgctgtctcttagctaattagcaagccttgtaaaggggcctgtctttagacaagaaaaggcagagaggaagggatgaagacctcttgtatttgtaaattgctgtcctgccatcaagcaggcagaagaagggacagaatggccccctggtttttttccttcttcagctcaataatcctcagttttttgagagagaagtattttggtttccttcagagataaggaacttatgcttggctatgcaggcaaacatatatgacttataataatgactacaagcaaatgctcgaggcgtgtgtgtgtgtgtgtgtattgaaaggctttttaaaatcattatcagtgaacttgcaggatttatttcctacccactacatgtcagttactgccataaaacacacaaatgcccctgcccttctagagcttagattctaatgggaggagaaaaacaagaaaaagtaagagaaatatgtaatatgttagatggtgttaagtgttatgaaggagtaaaaagggaacagccattcaaaggaggtaacacaattttgattaaggtgtgtagagagggcctcacagaggtgataatggagtaaaaatctgaagaaggtcagagaataagagactcctgcagatttctgggggtagagtgctccaggaaaagagcaagtgtgaaggccctgaggccggagagatatgtggccagaacagaagctccatgagagctatgcttgtcctttattcatggctatatccccgtgaagaagagtgtctgcacataggatctcaaaaactattttgaatcagtgaattgtgtagatgttttttctaggattctgctgtggttttttgtaggtctacattttggctccccgaggtgtcgtgtcataaattcatgagctaaaagaaacagaaagaatagagtggagggcatcaaatactctgggcttgaggttaccaccacccagcatagatggtagaggacatcagcgacctgaagaacccagaggcttctggggaggatgggcggtcaccatcccttagcctcacttctaggtggctcctccactgtagttgttttaaatgtgattgttttctggaagcagctggagctgactagagtcagtgagcatagggttttaccttctgtaaacgaagcctggaacttgttttttatgtcacctttttttgtggttactcacttcttcacatccttcctgcttttgactattttcttgtaatacaaatctaatcacttctcagatgaaaaatcccgttgcctactgaattggttcagacactgagcattcaggtcctctgcagcctggcctctacttactgcagccacctggcttcccgttgctcttcgtgcctttggacaggtgggccaccctccctacctgtgggctgagtgactgctgactcagctaccatttataacatgaggctaatgtcacgtattgctgtgtcaggtcttttgctaaaaacagacgaaatcctattgtgaaagccttttgagaacaaaggcactctgtaaacataccttgttatcctaatgacacttactccaacttggttgcagattagggttttagcagagggaatagagagcaacttaacaacataaagatttgaccaagaagattaaaaactgaaatgttaataatgcctattgataactaccatgctggctcataatcagaactaaatacttggcagttttgcattatcatatcagttggtgccagttcctgtgttagcctttgactcttagcacatatttataacagttgtttaaaagcccactagtaatccaaaggaaggactggtccattcaaaaccacttctttaaagaattccctaacctgataatagaaggataatcattgaagggaactgttgtgggtattgattcaaagaaagctgtacttacaaaatgtccagtgtaattccatgcttatactaaaaaaaaagaccaaaatgactcaatgaataagtacagaagccagacctaagcattttggtttgggttcctgtttctgtgtgctggaagcttccaatgtgcaataatgggctgttcatttggagaatgcaactcatttttccccttgaaataatgtcaaaatagacataggttccaagcaagacctgaagtctgcattggcctgtatttaagtaagcatattcctaaccaccacagtatttcatgagaaatgtgtctgaaggccaccttagcatgataaggacgcatgtcttcctgcctgaccaactccttcagcaccatgatagagagtgcccttgcttggccctctgggccgctgtctaaaggtttctcaattctaaacctcagttggttttcttgactcctgggataaggggttatagattcgaagaacagtgagggaggcgagttgcaggctgcaggtatgacaacccactgaggtggttcagcagttccagctactagtcctcaaattcactgtgcccggatcacacaggggagattttaaacatagagacttttacagatttccagatctctgagattctgattctatagggctggggaggagagcctaggaatttgtaatttttaaaaatgtttctcatgaaattgctgagttatctccatttcctaaattaggaaagtgagagttagagctaagttaaatgataaaaataaaatcacccagtggtaaatggcagaatcaggcgttctgaatctcagtgctgtgtgtggcctcagagggtagcatttgacttttttagaattactaaatttgtttctaaaagtccaagctttcagggattgctctatattagtagatgagtttacattttatatagacatatcttgcttttagacagacatatcttgcttttctgctttatatcaatttttggaaaatgattatatgccgtatatttgtattcagatgaaaaggggaacaaacatctctggaagccctgcctcacagcatgctgcgtggccttgcccattccagccactatctacaaacttacccattagctttcctattctgttggcctgtctttcaactcttttccttgatcacacccttcccctacactatgaagatcttgagatactaaaaagaagcttctgtaaaggtttgaaacctagggaacatgaacaccactgaaatacactacatgcaaaagccttgtcatcaggaaaggaccattatttaagaagaagggagattgggtagagaagatgcagggaggatctcatgggaggacagatgatgagtcaggcttctgaagctggagctgctggttcagcctggaatagagggacaaagaggaagctggataagctcagcttcatggagccattctacttggaatactttagaaatgtgatatgtagttcagcttttttttttttttttagattatttccacagcttttatatttagacatatttattttatataaacatgatatatatatatatcttaactctttctctatgtaatttattttgatttgtgtttaactgtttcttgcaaatagttaaccatcatttcaatatcagcaccacttactgaataagattttctctctccacttgttcattctgcctcttcttttcttataaaaggcagtttgaggattttactttatttgtctttcttataagaattgattggtgctttattgatctccctagcttctggaaaggtgaaaattgtgagaaaaaaaaattcctttgttgtacgtatctcagaacagccatttaccttccctttctttctgtcattttatcttgttgatcaaaacaggatagctattattggacattttaatgagcaccctaaaaaatgaatttctactggttataataccatcttaggacttataatgaagcatgtaattttctaacctttccagctgccagaatgcactagggatgagtgttaggtattttcaaagaatctgagtgggttggagaaattttcccaccagatgtgtagccgtgccttaatctatgtgcaccttactaaccgtgtgaagagggtggggtcccatgcatcctggagaatttggccaaagttatggcccctctcttccccacaaacggtggttgcacacataatgtttactacagtttccaaaagtttactgtttcttttggtgcgagagaggaatgacataactcacatcttaagatcttcagtagaggactattcacctgcttttttccttaaaagagactgtcatgtgtgtataattttcagaatggctcaaatcctatttgaagtggggtgaatggataggtggataggtggtagatggaaggaaattacaatttccaaagcttggtttctgaattgatatattttttgataagttatagttttatctctgctggaaccatcagtcaatactctcctttttcagccataaattggaggggttacctcctttagtttacagtattttgttattttacatcaaaaatattttttatcttttctctcctggctaggtatctatgagcacaaattcatagctagtgcaaaggtaggagaaggaagctgttaaaagcttaaactttggagtcagatgtcctgggtatgagcatgtctcctttgctttctaaccatgagacttagagcaagtcacttaactctctgagtgtcaggctactccttagtaacatggagatggtaataatactcaccttagagatgttctgaggattggagataattttagtgttagtaaagcacttagaacagcatgtggcacatagtaagccctatgagtgcttgacaagtaaaggttctcacctgtgatagttcagtcatgaacaacggcagttgtcactaataatgaggtaaaaacattgccagagtaaatcttgatgtcactttgacttattcctgatattttaggttggtacaaaagtaattgcagtttttgctattaaaagtaatggcaaagctacaattacttttgcaccaacttaatactttgttaataattcctcagatatttaaaaataacatatctaaaattgtctgtttgccaggcattgtgccaagtgctttacatgaactttatttaaagctctcacaacaaccctaagaaggtaggcaatattttcatcccatcttacagaataggaaagtaactgacctagagatatgatagataactgtcaagggcacacagccagtaatgtggtcctgggagcacgctcaggtgtgtctgagtccagatggcttctcagaaccttatactgtcttgcatgggaacaagaagggagagggagcactgaaaatgtgagggaatacactgtctatttttcttgtgtcttcagtaataataggacacctacagaggatatcccatccattggcgggagaagactaagggctaatccaggatcactggtggtcattgctatttgagtataagagagaatgctttgtgatagagattttctcgtatatttacatattttaatacaaacttatatatcacctcaactatttcaaaggttgttgtgcgataaaatgagttaattgatgaaaagcattctgtacaggatatggcacacagcaagtgctcaacaggtattagcaatgactgatattgtcactgcggttgaccctcagtcttcagagggactcttcacaggtccagcttagcttgctgaatttatagaggtttactcaaagtcacataaatggttcatggtagaaaaaatcattggtctgatccagctttctctaagcccagctttatctgatggcttcattctgcaaaccaaatcatctttccccatactccaccaagttgctggaagagcctcagaggcccagcttagtctatgagctgaatgttggttttatcccctgaattaagtttgcaatgggttttctctgtgcaactttagaatacgccagccttacttcagtaattcagcctcgaaagtgatctaatctgttttacaaagatagttacctaccacagtgcttggcacaatttcaaaaattgtaaattttcttccccacatcctcccattttatggggtccagatattactaatgcattaatgaatgtaaaagcagttcttccaaaatctgtttactctcctagagcatacagtgtgactgcttgaaggtatctgttttcctgcatgcatattcaagttaaattcacagtttccctactttgaaaaacagttttcttggaaataaaatgtctagacagactttgaaactgaaaaactgctgctttgcctcaggtatttttgcttgaaaactgatactttcatgaatatttgattttttaaaaacttggacaagatgattgctatttcagttcgtttttacaaaagtgatgtaattttagttttgagagaaagtataactttttctatcagtgaaagttaatttttatgacttttatctctatttttgtattgtcggtttaaatctcttgtagaattcaaatgtagaattccaaaggtgtttccctccccacattttttgtccccttctgttgctataaaggccttacatattcattattccaagagcaaatgtgttgcaggaattttagccatgcatgctatcaagtgatatgtaaggatggacccatgagttaaaatggacaaatgctttaggttagtagtgatatgtgcttttaaaagagcttaatgaagagggtttctaatctgttaatctgaatccagactttgttatgactttgatgtacgactctagacatataatttaggagttccctgagtctttagctacaaagttgtaatgtcaaataaaggaaatttatgctaagggcttcctgtgtgccagacatttggccagatctttgttaagctatttcatttcatttcatcttcattttatggaaaaggaaaacctggttttgctgaaacccacagctagtaaattgcagagcaaggatccagatctccagctgtctgactccccactcaggctctgaaccactcttactacacagctcgtgcactagcgcattctgccctacaaggcagtgtgaagctacttacatagtattttcaacaggttaatccacacagtgactccatgaaggaaataatacaagcattacctccattttacaggcaagaaaatagatatttaggaagaagaaattactatcctaaggtttcacagttggcacatgatagagtcctgtttcttattcttttggagatctaatgataccataaatgaagggttttcctatgtgttatttttatagtacatgggcagggtgttttaaatgtattgaaatgaattagaaatttttatcatatgatttaaaattgctgtgtgtatcatgtggtcttgtgatgactcagaattccttaaatgactcttctcttccttcaaacaaaatcttagcagtacccctacaaaatatcagtgtgaaacatcataacataggttattccagccaagactctgaggtgaggacagctttaaactgttcaggcacattaaaatcaaatcagtggtggagattctggcagctattcaggaaagatgtctctttagtacattaaaaaatcttatcccctagtgaggatgatcaggcgtttgggcatattcctgtctgtggccagagaacagaggaaagaatcagttttatcacaatgtcagtgctgagcagcacatgactcttttcaaaaactgtatgtttcttaatttttccagggatttttaattcatttatcataaacaccttccaactttaggaaacaaaatttattaagataattgtattttaaaatattcagaggcctaaaccattcatgacattgatacttaaatggatatgagaaattttattgcaagaaaaggtatactgaccctcttagctgacttgtcatgtttagtatttttatttttgcctgcctatcaacaatagcttctgcagtatcaatttaaatgatacatcaagctggtaaatgtgagctggcctaccaagtgaaagcataactaaatttaaatagctctgatataaaaataatgaatcagtacatcaaagattaagaatgcagttagcaaaaattaatgttcaataaagaagcatgtgtgacttttaagttagatggtatgtcattcaatgaccagataaggactaagttcaggtgcagtttattcaactgatgtgtgtgtttgaaaaataagacgaaaacataatgctttatttgaataaactttaataaaacaatatataatgtatggacataaggaaacctaagtcctcggggattataggggaaaccaaggcatgaggttacctaacaaggaaccttagaacataatcttacctggctcagtacaagtaggagagaatggtagcaggtgaatgggcagtgagcatggacctgaggagaaatgaatttgcctaactttcttgctaaataaatgtgcttttggatgctgacatcgagagagtggtgtgtgaagtaccataaatatttgctttattgtctgcgcggtgtgactgcattctgctcatttgcaggtgggcaatgggcactccaatgaggcagccttgatcctccacagaaaagggtttgattgtcggttctctagcaaaggcacagggctgttttgttctactactcagggaaaggtaagttgaaaaggttatttttgcttactgttagtgtgctttgaaatcctctttctgcaaaggatcttgacaataagatcatgtttcattgcttctttactgtctcagtttcatcagtctgcaaattagtttgaatctccccatctgaaaaatgcactttctcaaaacttcagcctcctttccttgttgacatcaaaaggcatagctggaatttatgcacatttgaaggcaatgctcttgttatttcctaggccttctatttccagcctacaaagtgccttgctcccagtcccccagttttctcctcccctgaaccacacatgctcacatatcatctagttcagcattggtaaacctaagtcctacagaggccaaggcaagtttataataactgaagcttatagaggtagccataaagaagcaactgggaaaattgagactgtaggctagtgggataatccacccacagcccaggaggcagctgtacgtagcgccaatcagttgttttcccttgggaaataaatgtaggtcttggtcttctgattaatgcagatttgcatatgagtcaacacaccgtgcaggccaaacagatcctcagtctgaacacagcttgctggctgcctattgtttatttctcttcaagttggtctttctggcagttccatcaagcctgtccttgaaaggaaacaaacctccaatctcctgcctctgtcactgaaagggccatgactcagagaaggcagctgggctgatttaggtacacaggcaggtctgcctcaccaggcagctcagctgacccagctttcctccaaaacctcataaataatgctgtagaccagactcaagtgattcagttccaaccctacaaattagcatgtgtgtggggtccaaaaagataagaaaaatgtggtaggagccctgaacctacttagatagattagcttctacatttcttttaccctaccctgcttggagctggtgccaagaaagcactgatatttttattacttttttattatactgtatttgcactctattgtattgttgatgatctaagtttacttggttctgagcattctgacattaaggccttgagtcataagggggttatacgatccagagagacagataacatggcagcggtgagggaaatactttccaaatgacctgtccacctctatagactgggactcaatgacataatgatccctccttgtagtgagcctgtgtgctctctcttaactctgttggaacaggaaaaagtggttgaggactaccattgttaggggtaagtattgactaaaagagaatgaggatgtttttaaagcttcttggccattggaggtcctttcttttattgaaaaagcccctgtgcatgataaaattctcaagcaatacaaaaaggaatgcagaatatgttgctcatgaccattactggtttcctgttcccttccaagcgtagtctgtatgttcaagcatgtatatatgtatatttaattcacccttttttctgtaaaagagaacttatatatgtatatttaataacatatatgtatatttaatccacccttttttcctcaaaagagaacttcaacatactgttttattccttctcatactaattttcacagaatatgtagttgtgctgctaatcttcaaagttgatctaaatatgtaaattttatcatttacttttcagatattggtacagaaacttttaaacaagtttattgtcgaaagtctcacaccttcatcactatccttgatgcattcacctcccggcactcagaatataagtgagatcaacttgagtccaatggaaatcagcacattccgaatccagttgaggtgaacctgactttcacatttggattgagaatcattggcttttatacctttcttggtttgacgtgcaataaagaagcacattattttagcttctggctactgtgagaacatgaattctgtgattctgtgggttttttcttttttcttttaccagtacagtaagaaaaaaaaaaaaaaaaaaaaagccatgctatcaatcaagattctttttttttaaactttctcccatgaactaccaccatcagtatgaattgatgcaacaaatgaagaaatatttaaagacagcctctcaacagattgtatctcaggttaaatgctaactaattatgtctgtgttgggggttgcgaagagattcttaaaagtatctgtgtgttgatcatcagttttacaaaaacacctatttggctgaaatggaataaaatgtttgtgggtaaaagctaatggccaaaatggttgcaatcattcatactagttagaaaaattatgtgttgaaataagtggaaaagtgcaatccatccacccttatgattaacgtagatgatttttatacctttttctgatgtacctcttgaccttctccttcccttcctaccctttctaagtatttccagaaatacctgattttgaatcattcaacagtagaaaaagaggcatattttcattacttgacaatgtgggatgggtgcaatttattccatcttcactaaaatagaagcaattccataggtaccataaacctattttaggtaccacaaggtgtctttttacacagctcatttgaatacaggtgttctgagaaggggtttctattttaaaattaccatatcaaaataaatgtgccttatttttttataagtcttgttaaatcagtgtccatattactgtttggggaagggggaatgttgtggggtctgggagagggtgggtactttctatgacacataaattgtgtaatttttgcctgacaatgctggccacattctgatctgtttcattaaatttgtggtgatgttactctaaacattttgactatttgaatgtactgagatgtcagaaaacaaaacaaggaaggaaaatattgttaattaaaatgtgctgctgccaaggaaactgcaacttgaagcaaggattttgtaaaatgcaaaatccagctactgtttccatttcacagtagttaactatattaaagagagaatgctttaaaattgatcttgttttgaaacccacttttatgtagctcatcatggtttatcttactaaggaatatgtttgttcattcagttctcaacttttgtatgtgctaaccttaaagtgaagttctgagcccatgtgccattacagtgcttttaataaaatttatttgggattattgtttccttaacattaaaataatagcgacatttagactattcaattttagcatagaaaggagtctttgagtatgtacagttttgaaaattctctttgagataattgatttcatattctgtggctttcaacctccatttacctcttgtcattccaacatctttatagagaaataaaaacccaatttctctttcaccatttagtttgattatcatctggattttcactcaagatgcagctcctaagattattgttatgttaaattcataaactccttcacctttaataattaaggaaacaataccagtgttgataaagatattacaaggggtaatttcatgcaataaacatgtaccgtaagttttcttccacatattttgggaaaaaactaaaaaaagaaaaaggacttcctttttgtggacatctacagatgttagggttgccagaagcaaatcccaggaatgagatcagtattttcattgcatcttaaatgtataaccttcctgtgggagttcagtttgtctgtggttaagtgggtgtgcttaatcattctcgaaattgtgatcagatgaaataaaaaaaaaatcttgatgcaataacagtggttttgccacttctggttgtttgcgatggatctgtcccatgtcagtctggggttttattcagcttgtgttgctaccagcagttcacaggtaaagcagaaattctctttaaccagcaagtttctgctttttaaggttacttttagaataaatcatcagggaaacagagaggatgctttgctttgggttgtag

SEQ ID NO: 15971 - DNA, 11112 bp, Human
tgtgtccctccttgagagctcatggagagaactctccagttttttcctggaggcgtatcgtttgctgtttagttattgccatgtgccctacaataattttcatgtcctggatttatttctcctaaagaaaaatctgaaagacctgtactaaatccaagaagctcctcgctaaaccaattaagcatttgattctgtcttcagcctgtttatctagcagtatcatctgtaaagtcagttatgtgcatgtagcaaatcaagttcacaaggcttgaagtgagttcatctcagctcagaaattcattgaacagcagtgtgaacatccatgtgtcacttttttcacactaactctcatgaataagacatatactccctcaggaacccgtggttttcctaatgaattggagtcacctatgtgtactgtatttgtgacatgcacatttgcagttgaggtccacaggaaggacaccatttcctggatcaaaccgcagagtgcaaatattgtgccctaaataacacactagttactgtaaatgtcagtagagggagtttttctggctatgatttaatgaaagcctacagcaaagccagctgttagcacttcttaactgcttgtcagagcaaccaggggagatagggaggaccaaaaacactttttctctacacttttgttttaaaattaaagtagttttcaacaggtgttgaatagggacactggggaccctatactacttgacattatttagttggtgaatttagaagttctcctccaggagggttacttggatctagaattacataaggagactgtgtaaaatttgtttggaagtttgtatattgaatcctctcacctgcaaaagaagcatttttgtgttctcagctccccatgaagaataatttaaaaataaaaataaaggagagagaagacacaccaaatgccgatccctctttgtcactttgggtattgccaaactaattgtaagccatgtgtgatttgattgatgtcatctgctttttctgaacaaagaaaccacttgaagcaaacacatagggaggaaagtatgcgatgctcgtttctgtaatttttgtcatttctaggatgcattagtaaatacatgtggttgttaagggccttactgcccttggaaattcctttgacattttgctgtgtgtacacaggggagataatctttcaaccatagggaaagtttacagtcttattatcttgaaaaggagaagaaagtttcttcctcaagtgatttataacttgaaacatgctgtcatgttttggtaagcccactttattaattccatccttctctgtggcaaattgaaaaaaaaaatacatgtaccgttgcaacatagtactttctcaatagcatattgtacttataatagcatgatggaagttaccgggcttgggttagtcatatagaatgcagagccaagttctgagtaaaacctctaattgaattacctgcaaaagcactgacagacaagctttcagtacagacaaagctctgctttccccagcagaaataggtcacgtttaagtctgccttgtaactctctgttattggtttttgccggcactttcaccttgggcctctgttgggccccttttcctgcagcagaggaggagcggctctgtgaaagctggagggctcacacattatcctctcgatttagagaaaattgataacagatcaagttaaatggaagagactttgaaataaaaatccaaagtatttcttcacagattactcacattcttgcatgattcttttattgtattgaaaagagaaactcaggatatgaaagtagcctttctatagcagtgagacctgaaaagtactgtttgttttaatttggaggaggaattagagaaagttcctgttgttcaagtcaggaaagaatttattgttcatcatttgtatgtgaaaatgaagagtaatatgttgttgttctcttctttctttcctgctctctctctgtgttacccacagcctctgcaatcccagataatggaagaaggtcctgtctaaagctcaaagtctttgtgagaccaacaagtaagttcactagaatgagcttcagagggtggcttcaccgcgcatgctttattgtgtggtctggttcacggcggtaaaacttttttttactgttaaatcttgtgtggtatctgttttgtatatcaacattcatattttagttttcatcatattttttctcattcttcatgatgcttttacttaagtacacagcagttgctaacttgttgtttcttagactgttgtacatgcagagcaaatgggaacaatattggcatttggaacatgccattgattgtaagacaatctacataaaaaaagaaaaaaaggagagaaagaaaaaagaaagaaatgggagtttaagggtgtcttcactaacatatttggctgttatctctatttttgttatagatagctgtatgaaaactataggtgttcatgatcgtgttttcgatgttaacgacaaagtagaaaattcattagaaccagcaggttagtatgcttagagaatctcttttaacaaatgcatctatttctctggtgcttccgtatttttttcctttcttcttctctgcatgtttgcatgttatagttgttgttctgcttttgctcattgctagcgatgctaatatgacttatattctacctcattcctccagtatctttgtgcaatgcatgttaggtaaaataaaattttcttttttggaatgggtttgagctaatgcagtatcctaatatagaagccccatcggaatgctaaaatctcactgccttttaccatatcctcagagcatgctggtgaatcactgtgaatattaaaggatctgttttcatgtaagacacaaaacatttctatgtatatgttcataaaattttattttttatgtccaaatctgtagataaaagtaataagactattgcacaaaatagaaactaattcaacatacttagttttctctagaaatttacatgcatcattgaactgacctaaggaactttattttatttaaatatttttgctattgtcaatagtaattggtctggagaagtataatcacattgccaccacaaattcgcacatctcttgtgccacaaatgtaccagtagcctgttgagccaaatgtgatccttgattaccgaggcaaaataagttttaaggataaataaaacttttctacgattgacttccacactcctaatgtttcccataactaaagaaaaataaaacctaccaaagcactcgttgaggcattagtctgtcgcatactatggataataagaacctgtaaatatccattcggttatcaattcagtctggccatttaataaaactagattaactgagaggagtggtcgccctctaccaactgcttatggaggggtgtgcctggaggccctgtgtgtttccttcctctgtggtgtcctcttctccccgacctgctccagatcttcactggtttccttacccatctcccttgatcatctcaaagcttaagggaaataaaattatttcctcttcatggagagatttgagcccccttatgtaaatggagaattttttttttttttttttttttttgtagaatttctcttccttatggtcctagaaactaacggacattaaggtccactttttcctccaatattgtaaccaggactgcatagtcaatgaaccttagggaaacttaccctgagtaaatgctgtgcctcaggacatacaatagctttcctgttaaaactgacagaaagagttagagttttttccctgaagcattcttgttttctaaggcaggcatctcacccagagcgcaaatgagaggtgtgtacaatgagctctccgaggtcttagtggctccccagggatcagttagctgctttagaaagttttaaggaatgaatgctgacatgaaggcattttaattgtgtcctggaaatctggagccatgactttggcttcttaaggtaccagagtcctcacaagctcagggacttgggccaccagaggatctgcaagttactcagtatctcccttaacaaccccagactctacactcttccttctatggctgaggagactcacccatgccacattgctgattaggtagatccaggtttaatactcagatcttctgactcctattccaacattagtatcaaagtagtggtctcttaccattattagaggtatgttcataaagaggacttaagtctcttgtctttgttaagaagccacaagaagaatgaccagcatgttctaaacaaaaattacccaggattatgatctcttgatacacattgtgcagaatgtaggcatatctttcccatggttttttttccagggaatctccactgcctgtctatagcataggaggctgcttagacacctaacagattgcatatttttctctggtaatgaagaggcacatggaggactattctgccattaggaaaattacctttgaattccactaacgatacaatgcaagatattgagatgctttcatacatgaacatataccactgtctttggggaaacaaggttttttttcactaagcatttaaaatgcacaatggcccaaaattgatggacatataactgctggaagtttgcaaaagtttggcagaatgtagttcagtgtgtgcatacgtgtgctggggagtagagcgtaggtgtacatgcaggaaaagctccttgagtcagtcagagctatattttaagggcttgctggtgagtatcttcactaacaaagtgagacaaggttgaaccacaattcctggcaataagaaaacaataagaaatgtgtttcttacaggtgtgaggcactgtgcctcacacctataatcccagcaatttgagaggctgagatgggtggattgcttgaggctaagagtttgagaccaacctggacaacactgtgaaaccttgtctttaccaaaaaaaaaaaaaaaaaaaaaatgtggtgtgtgtgcctttagtctcagttacttgggagactgaagtgggaggattgcttaagcccaggagttcgaggctacagtgagctatgatcacgccactgtgctccatcctgggtgacagagcaagattctgtctctaagaagagagagaaagtctagttggatttgcagttcttcaccactgtgtcgagccactgagtgaaagggtatttacctttccccagctctgggtgtagacccagtctttatgaacccagcaagtctgaaaggattccactgcatgatctcagcgatgtgtactaattcacctgtctttggaatgtatttgtcttttttgtttgcttgcacactctgcctgccagtttcctatcatcagggatgcaggatgatctcagggcagacatatgccacataacatgctccaaaatatcgctagtgttctctccgttaaccattgaaacccccatgttgtggaatcctgtagccaggaggcaaaacttgatttgacttctgaagaggaacgttttctttcttcttccaagcctgtgttacaagcgttagaaattctctcatgtttaggtgtagtttccattgggatagattttacctatgaattcctccttagaattctgaaattgctcagatttacccaaatgacagccagtttctcatttcacatttgggggctgtagaatcttccaacattgagaacctgttttaatcaaaggatgctttgtggaatcctgaatgaggaacagcatgttgcaggaagaagagaaggatcctgatgccctaatgggactgatttccttttggggggcaggaagatatatattcgttgggtgcttataaaaggttaattccaaagattgtgtatggttaaaggactgaaagtcacacttagcctcatacttcacttagatgaaaaacaaaagccttcctctccattaccttgtaagatctattccttgtgtcttgtgctgagtggacctggaataatggatagccctcactgagtacctagaagggactagggtggtgatgaaggggttcacaccgaagatctaagtgctagctgggtacctttaacagtacacttgcaagctatacaaggagaaggattgggtaatatgctagtaaaaataagatggagaggaatccaatagctgatgcaatttcaggtgtttaagtatgtgatattgtgaaatgaactctggaatcctcagggtttgtggttatttcacagttaagcctgaagtgctccattgttttgattgacaacatattggtgctcttaagaaagtgatttggattttaatttcagggctattaagggcctttacttctacttcctattaactacagatttaattaatacacttgcaaggctgaaaaagagcagagaatagaagagggtctgaaggtacttggccacattgtggaggactttatatatattttttctgcatccatttatcttaccatcttgcttcctaaccttttctagtctcctaagctaaaatcactccatgcagattcgctaaggtccaggaaaggggagcacatttgacaaggggatgcagtagcttttattcgaggggaggctaaaatggtaagagcactccaggtcaggagactcaacactgagaagacctttctcattgggaatggatgtgatggacaaaaccatcccaaacgagcatatctgaagcaggggtcagcctgtgaacctgaaaagtggttactttaggacaaatattagcgagtgtgattctacccagtgaaggaaaagcacccttattgtgacacgtgtggtaggaaaatacaaatgagtttaaaataatggttagttaacccattaaggggtttgaggtgggtcatccaggggtatttagggattatcctttgaggtcagtataattgagaacaaccactagagccttgttaccattctgtctggcccttgagcaattcccagatggcaactgctgaacacctgcaggaagttaccctgatgctgagataaaatttgcacaggggctcactattggcccccaaaatgtgttattcagagatccttagtctaaaagcacaagtggccaggtatagtggctcatgtctataatcccaatcctttgggaggccaagggaggaagttggttgaggctgagtttgagactagcctgggaagcaaaggaaaaccctgtctctctaaaaattcttaaaattagccaggcatcgtggttcacacctggagtcccagctactcgggaggttgaggcaggaggattgcttgagcccaggaggtcaagactatagtgagctatgattgggccactgtactccagcctgagcaacagagcaagaccttacctctaaaaaaatattaattaatttaacttaattaaaagtaaataaaagcataagttaggtcaggtggaaagaagaagacaggcagccctggagcagagcttggctcctaggcaagcctccaacctctctttggtactaattgcttcagagttcccatttggaagttaagcctgttaatcatgcagatcaggaaggctatccaaagtcagaggcagcctcatagaacactttatagctaaataaaagaagcttaactcacttaatctattttatttagaggaaaatttgcatccacgctgataatttatgtgccaagcttcagcccgataaaaataaaaatagtcaagttcaagtaatttaatcttagaaatacagggtttgtaatagaaatagcaccataattgacacctaattgcaggcaaactagtgggcatacgtttattgaagtttactaggcatgatgtatagtttatccaaaatgctgctgttttggcatttagtttttcatgtttgaaaattcgtctaggcatccaacaaccaggcattcaacactaatcctatgaaacagctaaaagaagggaaatgggcagcgcattctggttaaccactactgtgccaacataactgccccttcccccacccccaccaacatgtcacttgcttgcctgtgacatcttaggtttcaaaggtacattcagatatctgaaatttgtgcaaggcgtgtctgactgctggctaaccaaagcagctcacaggccaaaggttacggtgtatgcataatttttcccctcaatttttaaggaaagtattaatattgctgagaaagtccaattttctttgcctcttctttgtttgctgtaaataatgagtgattatgcagacatgaaagtcaatggtggcacaaggttcattaccctactttgcagagggtggcgaggtctgttaacagcaggctgctgcaagagagttattaaggatgtgaaatctcattggaatgtgtgctttctatttgaacagatgacaccgtacatgagtcagccgagccatcccgcggcgagaacgcggcacaaacaccaaggatacccagccgccttttggcaatcctactgttcctcctggcgatgcttttgacattatagcacagtctcctcccatcacttgtcacagaaaacatcagggtcttggaacaccagagatccacctaactgctcatcctaagaagggacttgttattgggttttggcagatgtcagatttttgttttctttctttcagcctgaattctaagcaacaacttcaggttgggggcctaaacttgttcctgcctccctcaccccaccccgccccacccccagccctggcccttggcttctctcacccctcccaaattaaatggactccagatgaaaatgccaaattgtcatagtgacaccagtggttcgtcagctcctgtgcattctcctctaagaactcacctccgttagcgcactgtgtcagcgggctatggacaaggaagaatagtggcagatgcagccagcgctggctagggctgggagggttttgctctcctatgcaatatttatgccttctcattcagaactgtaagatgatcgcgcagggcatcatgtcaccatgtcaggtccggaggggaggtattaagaatagatacgatattacaccatttcctataggagtatgtaaatgaacaggcttctaaaaggttgagacactggtttttttttttaatatgactgtcttaaagcattcttgacagcaaaacttgtgctctctaaaagaagcctttttttttttttctaggaggcaggttgggtgtggaatgctaatacagagcaggtgtgaaaacagagaaaactacaggtttgctgggggtgtgtatgtgtgagtgcctctaatttttttggtgactgggcagtgcacaccagatattttttctttgaatacagatcaccatggtgctacaacttttttttttttttttttttttttttttttttagaaactcaaagaggcatttttatgaataaagtgaccttccccaaggctgacaagccagggttgatgagtgcatagtggaatagctttgggtactcctctgggggatgacatgtaccaaggagaggaccgcagtggccagaggagacatgatttggctttgctggagcgccagtgtgctgtggcctttccccgcctcccaccctagtacccacgttttgctccacactccttgaccgcaggggctcggacacaaacccctgtcaccaggagagtcagtcagcactacttgggagggctaaagggaaatttggaaataaaattccaaagtttggagtaaaaaaattcaagtgttgattttatattctttccctttctgacacagcctaaagcgtagggggaacatgtgtttatctgtgggagataaacaagatggagtcccaaagactttaacaaaatatttttttaaaaatccactagaatagaaaatacattatttagatatactttatgctgagagtgagtatatatgcttgtcctatttaaacttgtgagaaaaagtggtatcccttgatacatttagaaatatgggggctatcttgtttcattgtgggggtggggcagaaggagaataaatgcaggatgaccctgttgaaggaatcttagcatggccaacaggggacgtttccagtcgattaccaggaaatgcaagccttggggtttctactggtggtggggctgtcatgaactttaaaatccaaagcctagacaaggaaaagtgttagaccaattgaaaagcaatccagccctttttttttttttttttttttggctttgcacgacatgtcaacagaaaccatgcctttcaatataagaaataaatgtgatgatcatgtaaaatgtgaaaaattgaaagcattccagcaaaataagaattttttatatatttgttttttaagatgtatatgttaaaaaaagagaaggtcgcattatggacagacttcgtgaatgggaatttgcttagaattgtgagtagttctgaattagaaaagtatgtgaaggaaaggcagctgtaaacgtattgtgccctggagagttgtacacatgttgaaatgtaatctgggcttacctgatccatttggagtggatgtcactgccgagtctgttctcacatggaaccatgtgtgtggggttgccagcctcacagatacaatcaatcctattcccctctgacataaggaactcctctggagtggcagagtcttatcacagaaggcagccaccatttcaccaaaacaaaagttcacggcattcaattcctttttcctttagctatttatatatgcagtactctcagtcatatgcagaaatacttttttttttttaattaatagttacaggcttgttggtccagtgggatttgggtagggggagaaagataccttctaaaatggatcaatagaaccaaaataatacagcatgttctataaccacaaggaaatcaaatgatcctgtcatgattccagttagtcataactatgttagcagtgctaaatgcattttagaaatggtgacttctgtggttttcctagcatttgtctctaacaaatggtgaaataattactcatggccctctctgccattgtctttcattttttcacagtgaaattagacccctttacttcaccattctgccactgcaaattaagtataaagaaaa

SEQ ID NO: 15972 - DNA, 16914 bp, Human
catgctaagacagcacttcctgaccctgctgtagtcgaatgggtacatatgattaaccttggtcaatgagctgtgagaaaaactggcaatgagttacttacttttgggctagagcctataattacctacttaagaccatccagagctctcttttcctctatcacaatgataatcaaaattccagagagtgaccactgcatcagcctaggtttatgagtgagcatagcatgagacagaccctcaatacatttgaagtacaagagaaataaatctgtattgtttaaaaccaccaagatatgtcaatcatttgttacagcagcgtaaactatcttaacttgagagatgacttattcttggacaagtcactttccctctctaatttttaacgtcataatctgatttaacaaataaagggaaaaaattaacatttagtgagcatctcttaagtataagttgcttcgttatatataatttaatttagtcttctcaatgaccataaaaggtattatctcctgcaaaaatattcctaaatccaaagaaatctctcaactccactgctcatagaatccaagccactactatgtcttactagcctcttacctaccttctgttaaaatttctccctcgttaattctccagtgcaaaatcttttaaagacttctccctgccatttgaatcagagctaaactctcttccatggcctataagagtttacatgaacctgtacctgccagccacttcaatctaagcattcatactttgctgaccacttattaaattccagttattctggtcttcctgatatttttaaaacctatccagcttgtttctgcctcaggacctttgcacttgctattacttttgctgagtaatacacttcccttagctctttcatgactgacttcatcattcagacctcagctaaagtgacatctcctgagataagttttctttcaccatccttgataaataattatttatcaattactatctgaaattatattattaatttattcatttgcttgtgtgttttcagaattccctactgcaagaaaagctccactagggcagagaccttgtcttgcttgtacactagtgtttctacaaagcttagaacattccctggcaaatagtgaatcctcaagaagttattgtggaacgcaatcgaattaatgatgcagataaggaaataagcctctaagagtttgggtaactgtgccaactttcctaaatttctatgagtgttcctaattctgaagtccatttgccttttgcttacagcaaagctctgctgagactgaagagtcagttagcagtcagggctaggcactgtgcatgcgccctttcaggcttcggattctatcgttgatgcagttaaaaccaaaaagtcacattaatcatgttatcacattaatccccagagaaccctgaatttccagtggaacaagataacttgagaaatctattgatctcctattttcatcatgctgtacggctgacaagggttagtggagattggtattcttttgcccatggccctgcaactttaatttctatgtctacccagattcccacaactttgcaacctgcattgctcaaagtgcccatccatgaagttcgagtggcttcttttgtgtcagctctgccttcccagctccttcccattcagggagaggtctctgcctcctcccctgcttcctgactcgaagccagcacccctctcctccagtgcagcctaacacactctcattggccctcagcctgtcaaggggaggggcttgtgtctccggggctcttcaaaagggatcggcggtccaggcagcctaacctggagggtgaaacactcactctctcccagccttccttacgaagcctgtgactttcgtgactgctttctcttttttgttttccttttttcttttttttttttttttcctggctcagcttgaaacagagcctcgtaccaggggaggctcaggccttggattttaatgtcagggatggaaaaacttcagaatgcttcctggatctaccagcagaaactagaagatccattccagaaacacctgaacagcaccgaggagtatctggccttcctctgcggacctcggcgcagccacttcttcctccccgtgtctgtggtgtatgtgccaatttttgtggtgggggtcattggcaatgtcctggtgtgcctggtgattctgcagcaccaggctatgaagacgcccaccaactactacctcttcagcctggcggtctctgacctcctggtcctgctccttggaatgcccctggaggtctatgagatgtggcgcaactaccctttcttgttcgggcccgtgggctgctacttcaagacggccctctttgagaccgtgtgcttcgcctccatcctcagcatcaccaccgtcagcgtggagcgctacgtggccatcctacacccgttccgcgccaaactgcagagcacccggcgccgggccctcaggatcctcggcatcgtctggggcttctccgtgctcttctccctgcccaacaccagcatccatggcatcaagttccactacttccccaatgggtccctggtcccaggttcggccacctgtacggtcatcaagcccatgtggatctacaatttcatcatccaggtcacctccttcctattctacctcctccccatgactgtcatcagtgtcctctactacctcatggcactcagagtgagtatctaggctggggtggcctgaggcagcatcccttcttttttcacaggctcaaagttcagagaaaaacttagaattggggaaattcagaaatggaagggaacagagggaaaatagaatgagctcagatgggaaattgagacttaaaaggacttgcctcaaatgagatgaatggtaaccacaactatttatcatttcctttagctcgtcttctatttttcttccctctattcttggggttctcgtatctaaatgttcctaagaatcatgcagaaaacttactttgggagcaatatgcatacctcacccccaggaaaatgggattcagaaggtctgaggtggagcctcattttaaataagcacatcaggtgatctggggtgaggtggccacactttgagagacttctccacatcctgttgtcactttccagcccctggccactgcctgcattgagattttcctgtacaccaacttggtctgagtataacacaaactatccctgcctattttgtagtccaagataggtattcagttttaaaatcagacatttactgtggttgctccgaccctttcattaaaatgaggttgaaacaaaacaaaataaaactatatatattatatgtatagttacatatataatatatagtcatatatataatatatagttatatataatatataatcatatatattaatgacatgactgagataacttgagcttcttttgagcaggtgcagattgagagataaggaagtaaacagcacatgagatagagtgaaaaaatgtgaataagagcttatctgaaattaagaaaaagatatcacttattttgcaacatatataattagaggttcttttcctatgtttatggtggtaaactgatttctttttcagaaggggggtgtctaaattagctgagagaaactatttttaataagggtaggaattagtctatataattcctctctggtatattctgcacccaaattcatgaagagaaaagttcttcacaatgacaattttacacccacttaagggaggtattatagcttgtgtagtaaacagttacgagaccatttagactcccagatctacagctgacatataatatgcctttaggcaagccacatcattctcctggaattagttttcccgtgtataaaatgaaaaggtcacatcagatcctatctatgtcccctgtagctctaacagtctattattcctttaaaaaaagaaaaaaaaacacctgtgagctgaagtaatgtgagttttaaatgacaggacaaacagatatcacattcacatcatttgctttgagatggctctgacatcacactttatgtgacaactaatatactcctatttcagtccatctctgagaagccgattgtcagaagcgagtgcccaatggtagtccttttgaatacctattgtccctaaggtgaatagcgaggtctaagtaggaagaacaaattctaagtgtcacggacatctgggcacaagagtaaatctaattaggcagagagctgtgccagtcccctcctggagggctagcacctgtattcccagagacatgtcccaccccgcactagctcacagccatgtcttaagaacgtcctgcacatctcactgcggggaaaagacttctatacaactccaaagaaagtcttatgagaaatacccacccacttaatattacctcatccaatgccaaacagtcacctattttgggtcaatttgggaaaaatatttaactttgagtaggaaatgcacagttcctcttccaatctgttacaatcagtttcattgtgttttattatcaaaagtccatggctaccttgtatcaggaggtaagtgacagctcagacaaaagtttaaaaaccaccctggtttgctttgtgtatgtaatgcaacttttgacagcctgttttcaggaaggatgagctgttatccagggtaccagaggacaccaggaaagaaactaacgcttacaaagtcacttctagaagaatttaaaaatctctatactgaaactcaggaaaagtaggccctattctgtgtcactgatcgcagggcctttatgtacactatacctgtagcctgaaatgttcctactgtctgccaccactcccccttttgcctttctaaccctcatttattctctgtgtcatacttcaacacgcttcctcagggaagctctcccagattccctgagcatccctgtttcctgttgtaggtactcatggctctccgtgattttccttcattacaatttatatttccatacttatggattccttaattaattgttttctccccaactagactgtaagctcagtgaatgaatgaggccaaattacttccttcattgctgggctttagcttctctacctttaaaacaaagacttggaaatatcatctcaaggagacccaagcaatcctaatgattaagtgagtgactctgttggatagtttgaaggtatgattgactctgggacccactgctttcagaaggcagcaagcccaagactgatgaaatcacaggaccagagaagaaggaggaaacccatatctgtgctcacagctcggcattcagtcacgctgcatcattccaggacacagccaccactgagctgttctccaggctttgaacattatagagatagaaaatagacaattctagggcaagtccctccacatgtgggaggaagttctggtgacagtctgatttagttcttacatctcctgcatgctgcattcatgattgaggtgatgaggatggatgtatgaattgcagcagaattcaaccatgccaacacagggttgcactaatttttttaagtaaatagattgtgttaagattatagagatatttacacaaaacctatattataatctggtattctgaaactaagtcccacaaactatataaatgaacatctggtagagtgatttcaggcagtataaacaactgatcagcataatgtatcaacctgaataataacctcgcgaacctccctttcactttgctcttctgtagctaaagaaggtaatcacaatttttagtaatcacactatatagtaatggtaatcacaacttttagtaatcacaatatttagtaatagtaatcacaaatttgcactcctccttttgtaacctgagttgtaaaataaaagttttggggtggggaagaataatgaatggttgaatatctactttactaaacatctgtagggaagtgaaattattcaacgataaagcagcattgaatattggctagactaactgttttgattctattctattctgtcaaccactccaaattctgttggaacaatgtacaccatatgtaagtaatcaatttttcactcttcctctagttagctagttaggtcattataaactaaggaagctgcaaaataagcaacaattcatcagcacatgattttctttttagtgtaaactatgctgctacaggaagcctgttcataaaagaattgcgtgaactatttgtttgatgtttgatttttttaaaaattgttccttggggtggagaaattaccattgagaactgttaaacacaaggcaggaagtgactaatatatctcaatattttttattgttcttaattatgaactgaaataaaataatagaataactgcataatgtaaaaaccacaatctttaagtggcatgaagtaattagaacctttaatagatttaatctaagatgagttagtaaagtttgaagtttgatacattgctctaaccttgaatgtgtttttcttctcagcatatctgcctcctttgtatcagtacaggcactctttgtgagcgagtggtaacatgagaaaagaatttctagaagggactcagtacttcacaaaagtaacctcacatatataaacaaacaactctagtttttaaaaatcattttttctgatgtctctttagtatactctggataataatcagaatcactgtaataacagtaatatacaacttgctgagtatcatgtgccaggcactgagataagcactctacctgcatgattttgttttactattgcattaataatacttttcaccttcagatttttcctttctagtcctaatctcacagagtctttaatcctttactttatgaagacacagatacatgtagaacactccgatatattcaagagacaaatggccaggtttatacattatccaagaggattcttgaggtcctatgtggtcctgagtgctacctaactgcaagcagcatatatgtttgttaggaagactggatatggatttgctgaagtttcgaggcagcttttaaagacccactcttccaagtctatttaattttaaataccttttctggaatattccttcaaaatgctatccagcccaggacgattattgcttcttatagcagtttgtttcattattgcacataatcacaacaatttcttccttatcttgaattagaatctatctacctgtaactaaatagattgattctaatctactgccatgactgtataaaataagttaaattttcgttccacctgatggcttcaatcaattagcctggactttttacactgccaatgagagactccaaccctgggtaaataccaaagggagcatagacatgaaaagttcagaagccgagctagctcttggtgaagattaattaaataaaacacacgatcttattataaacctaactttatttctgtttctttgctctttttttctatggtgttggtttcaacctcaaactgcacacagtcatcctttggtggctccaagcattttttctttgtggtggaaaaaaaataacgtttgtaattccagacctcatatgcagagaaggactctctctggcagtcccaataaaaaataaatgaaaacttgcatcttcagaagcacaagcaaatatctgaaatctcattggtctgcattattcaatcattgtgactggaggataggacaagttgattggctaaattgtttagggactatacctggagctgaagtttagtgacacctctatacaaattaaagactaagaatggggaaggagtacattccctaagggaaaattagggtgctattattaagagaagagagaagtaaatgctagagaactaatgggcaaatatatattcactatgtactatactaatttctggatatttgatggtattttatcatgagtccttaaagcttcctttatttggccaaacatccccacaaattaaaaaatgtgtaaaataaagagaaaaacttccacaactggatgaatgatgtagatcttcagtgctgtgggagttcaaaggaaggagaagacagtgggctaaagtggtcatcaaagtctttcaggaacaggcaggacttaaactgagcaaggaagattgtgcatacaagtagtgttgatagctgaaagtttcaaatgttacatcaaggatctccatatcgtccaacaaggatgaatatactttaaacatcttaactcagaaacacataagacttttcagtaattaatattactgtaatattaaaacaacatttcccaatttgtgtttgtcaagatggtacaaggtaatccactgaaaagggttgggggaaaatattgtttactcaaataaacactatctcccttttggctaagatatgagtaggtgatgtgagtgtggaaggtagaggggagctaagtggaaagttgatacactatcccccttgaaaattcataatgcccatcagcatatttaagtctctgagaagatccacaataaatactgatgaggcaagaagaattcctgttttggttttctactaattatccaccacagagcagaaggatttcactttaacagatttctaataattatgaatgagtgaatgaatgaattgagaagcctttctaacttttcttgaacttcagaattttacatttttcatggaacacctattaacatgctacacagccaagtttccacataactgtatacgaaaagtggttgcactattacttggccacaatcacttatccagttgagtagatgacctgaatccaattccaccttcaacatactgttaaacatttgacgtagtcttacatttctctaggtctcagttcttctgtcttcaaaatgagcgtttgagttatgtttctcagattttaacaggaggaaaaatgtttctctttcttactatctctcccaacttacttccctttcagctaaagaaagacaaatctcttgaggcagatgaagggaatgcaaatattcaaagaccctgcagaaaatcagtcaacaagatgctgtgtaagtgccccattttgttttttgttttgttttgttcataagagcaaaggaggtacatttggtaccaactaaatgctgctggggtaggttccaatttatcctgaaacagagtatttatgagagtagattaagatcaaggagcaaaggggagagatatataatgaagacacctccttaatggtctatgtcaacgctaggtgacctgtcttcctttgcttcttcaagcttctaggacctgtgtgttttgtttcatttttggttttgaaccctcaaaacaacactctcagtttcatccactgacatacactctgtgtggtgcttggtaaattacattcactttctcagcctttgagcttcactttccccctctgtgaaataagcaggtttttaacctatttgtattatggatttcttttaaaatatgatgaaagctgtagactctccattccaaaaaaaaaaaaaaatgaacaaatatgcatacacaaaagattttacaatccatctcaggaggtcacgaaccaacccctgatactcatagactccatgggatcttttagttccaggttaagaacatctggcaagcatctccaagtagccatttcacatatgacattgtataactttgtttcaaacagtatacttttgaataaataagatctttttaaaaattcacttactgagccacagtctcccaaaagaatgttataaaaatatatgatacagcactactatatgagaggagttactgatgagggaaaggagatttataatacattttgcaaatcaaaatctaaagtttagaagaaatgaatcctccaggctaatatgcatatgaaacattcactgtaactatacagcatttctgaacaaaaaataaactgtgaagtccctgaagtgggtcttctcgattctaagagttatcttcttggaaatattttagctcctcttggcacttgactttctctatcaagaaacatagtttcttcattatccctccccttttctccttggtcataatctactctcacaaaaaaaaaaaaaaaaaaacatgaagctcactcatattaaagtcacaatagcagaatacactgtaaagtatttgcgttgggatggggttcaactttaacaggaattaaagttgtttgttgttgctgttgttgttgttgtttttgagatggagtcttgccctgttgccctggctggagtgcagtggcatctcggctcactgtaacctctgcctcccaggttcaagcaattctcctgcctcagcctcctgagtagctgggattacaggcgtgtgcaaccacacctggctgatttttgtatttttagtaaagacgggcttttgtccaggctgttcttgaactcctgacctcaggagatccaccccttggccacccaaagtgctgggattataggcctgagccaccacgcccgtcaggaattaaagttttaattaaagggaattgtaggcagtagtgaacagattagggacttttcttgggttggcaaattcagtagaaacctatagttatctttgaaaccataccacacaggcaaacaacttactctgaatgtgtttaatgccaacaggaaatgcatgtataatactgcttactatgaaaacttcatatctgtacacaagtacagaaaactgtaaaatgaatacccatgtacccatcacccagcttcaaaaagtattacctcatagctaatcttgtttcatgtatacccttatctctcccctagccccaaaagattatctttaggcgaatcccaagagtcatgtcatagcaaagtaaagtatttacaacttcaaaaggaaaaaaaaaaagtgtgtgtgtgtgtgtgtgtgtgtgtgtttaatttgtggagcttaaatgccccaaagaaaaactacagaaataccagtctctgttttgggaggtgaaaataagagatgggaaggaattctgtgctgtagcaatttataatatgacagacacaccccttccaatcaaaagattcttgtaaagtactattaggcttgtggttgtttgatctcttctttctccttgcctacccattgcagaattttaaattattgaattcagagaaacttctaattattcctataacaacaagatgaatttatatacacatttaacagtttattatttatctttcacaataagatgttttcaggactttgaaataaattaaatactattttaaatgttctaaaaagttttacattatataagaaatcttgtataatcttatggaaaactgatcctagatcttatacaattcattcttgtgttttaagtgttttgtactgagactctttgggatctagtttgcctctataactgttatagcttaacaaagttgaagggaaaaactgccagaagaaatgattgactcagagtgagcattgtatacctatccttgcacagactgtcttctggtctcccatttatcatccattttcagttgtcttggtcttagtgtttgctatctgttgggccccgttccacattgaccgactcttcttcagctttgtggaggagtggagtgaatccctggctgctgtgttcaacctcgtccatgtggtgtcaggtaaaaccttagctggatttggtgcatgactagtattcaggtaacagcaccttcttcttcatcttgcttagatgcctaagtactccaatttatcacggggatctgccatgctataatgaagacatttgatttttcttttattcagagattgattatgtttgatactgttccaaatacatatataccagatcactattttcaaggctactttatggaaaacctcaagtctaactgtgatgattacagaaggaaaatggtcaaggagtgattcctttggttatcctccaaatggccatgcaattaaattggttcttatttagtaaacacccatgtccctgaaatctcatattgcctttgggaagtattatatcctcatgaaggaaaactaaatggtattcataggtaatcaagttctccttttaggctactgtaactctgcttgttgaggataccatagtatattgtggaaaccatggtggaaaggtcagtaagtcagatgacctggatttgcaacccaatttcaccattgctattctgagtgatctggagaacgtggctgccttcacaccaaagtttcctcaactgtaaaatggcaaaaaaaaaaaaaaaaaaagcctcctgtacacaaaccatggactgatggtaaggagcaaatgcaataatagacattaaagagctctttaagctgtaattgctgtatatctttctataatcatcacaaggtcattaggtggatattatgattaacattgtatagtcaaaaataaaacccttccacaagaagaaatgatttgccctaaggcacttagctaacaaataacccacccaagtcatctaacttcaagttcagtgttctttctactaaaatggagcaaagaatgaccacctagtttcttctttctcagtcagtgacagctaactcagtgttagccttaggctcagacctcttctgtccccccacctctcctggtcaccggctgattctatgggctcattagattatagaagacatcaccggaaaggaaagataagatcaccttttacaagttaagctccagatgtgtacaaagcagaaacaatgacatctatactgaatattgtgtatactatgtattttctgtcaccctcttttttgtactcagcaggcctaatgtatagcttattcctggacattagcactttcctgttcaaccatttgcaaccaaagctcaaaaatatgtatacctcttagtttatccttttggttaatctgcggaaaacagaaatgtttaaataaatgagaaagcactacaaggtcaaatgagacttgactaattgactacaattctctggatgcgtcaaggcaattatcttaagattttcaagttatagcctcaataatgacatgatcctgttcagataccatctccccccttttatattagccactagattaaatctaaatctcttaaaccctacagaaaatacccccaacttgccttttaatcctccaacttttattatttttattcatagaccatatacttatcaaattggtaattagagagttctgcacattattcctgcacaatatggccattcctgcccctgaatacttatgcgtgctatataccctgtacctgcaacaccctctcctgtcttcctcaactatctcttacccattttgaggcctggctagagttcaatcaccccccactaaatcttttatgattatcacagtccttgtgtttctgttattatgtgaattgctatagcatgatttgttatctcatatttgttcttaacagatactgcttggtattgttgtattgttaattatttaacttagccataaatcttgtctctgcagtaccattccaagatcttggagaacaaagtctaattcactacctcccaatgtgctttgaagttcatggcacataataagagttaaatcaatatttattttttgaatgaactaatagtattaatgcatagaaatattctcctttaacattcttccatgtttattctgtaaacaaggcatatagcattctgaatgttctgaaccacataaataaggacaacaaggaaccttttggcaatattacccatcacttgttttacattcttagccattctcaacctctctgtggatggtatcttaactttaccctcacaataatccagggaggtgggttaggctggaaatcacattcccattttacagagaaagaaactgaagtgccagggtttgtctaaggccacaggatattagagggccaagatcagaaactaggtcctctgattcccaaacttgggctgattttgggctttagagaaataaaatttaaaaaggcaataaaggaagagtgtattccaaacaggaaaatgacaatgtgaaggttaattggtagaggaaataaatggtaaaatacaattcttcaaaaggtggaggaaccatcaagggaaaagggtaggtaggaacagcacgctagggaatatttctttgaagccgtatcttagcattataaggagtctcagcaggaactaagccttggctgatttaccttcttccactacttgcaatcccaaattatagatttaagtaaaattccaatgagatagaaacgtttctcttccctctgatatttaagcatctttcagtcatgttatagaaacatgttctttaattaaacaagtagtgatcaaagaaagttgctgaacatctcagagagatcccatgtcagcctaacttactccaagactctttaatctttgtgtttgatggctaagtgcacaggtggaagatctattcagagcattttgtattctcaattagatgcttgtatgtattatcacttataaaagaggcaatcacagggattctaggcctttgtaaatatttatgcttcttccttcatgccggtcacttaagttcttctcagcacatctttttaaatcccctgcattccaggtgtcttcttctacctgagctcagctgtcaaccccattatctataacctactgtctcgccgcttccaggcagcattccagaatgtgatctcttctttccacaaacagtggcactcccagcatgacccacagttgccacctgcccagcggaacatcttcctgacagaatgccactttgtggagctgaccgaagatataggtccccaattcccatgtcagtcatccatgcacaactctcacctcccaacagccctctctagtgaacagatgtcaagaacaaactatcaaagcttccactttaacaaaacctgaattctttcagagctgactctcctctatgcctcaaaacttcagagaggaacatcccataatgtatgccttctcatatgatattagagaggtagaatggctcttacaactcatgtacccattgctagtttttttttttttaataaacgtgaaaactgagagttagatctggtttcaaaacccaagactgcctgatttttagttatctttccactatcctaactgcctcatgccccttcactagttcatgccaagaacgtgactggaaaggcatggcacctataccttgattaatttccattaatggaaatggttcgtcctgagtcatctacgttccgagtcaggctgtcactcctactaccaatggccactgtgagccacagaaggaagacatgtacgtgctgttctactttatatgatgtgagaagccaacatcagtgtcccttggcagcagtctacaggcataacttgttttattgtgctgaattttattgtgcttctcaaatattgcacttttaaaaaaattgaaagtttgtggcaatgctgttgagcaaatctgctggcatctttcttcccaaaggcatgtgctcacttcatgtctctgtatcaattgtcataattttcgcaataaacttgattattattatatgtgcttatggtgatctgtggtcagtgatctttgatattactattgtaattattttgggaaacctatgaactgcttccatagaagatggagagcttaataaatattgtgttgttctgactgttccacccaccagccattccccatcttggtccctctccatgggcctacctattccctgagacaaaacaatattaaaattaggccaattaagaaccctgcaatggcctctaagtgtaagtgaaaggaagagcggcaagtctctcactttaaatcaaaagctagaaaggattaagcttagtgaggatgtaaaaaaactgagataggcttagagctatctatgcctcttgtagcttttagccaagtttggaatacaaaagaaaagctcttaaagaaagttaaaaatgctactctagtgaacacataaattattgtaagaaaacaaaacaccctcattgctgatacaaagaaagtttgagtggtctggatagaagatcaaaccagccacaacattcccttaagccaaagcctaattcagagaaaggccctaactctcttcaattctatggagacagagagagctgagaaagatgcagaagaaaagttggaagctagcagaggttggttcatgaggtttaaagaaaaaagccattctctataatataaaagtgcaaactgaaacattaagtgctgatgtagaagctgcagcaagttatccagaagttacagctaagataattgatgaagttggctacagaaaaacaaaaaagatttttaatgcagatgaaacagttttatcttggaagaagatgccatctaactaaggcttttatacctaaagaagagaagtcaatgtctgacttcaaagcttcaaagaacaggctgactctcttgtttggggataatgcagctggtgacctgaagttgaagccaatgctcattcaccattctgaaaatcctagggcccttaagaattatgctaaatctactctgtgctttataaatggggaaacaaaacctgggtaacagcacatctgtttacagcatggtttactgaatattttaagcccactgttgagacctactgctcaacaaaaagattcctttctaaatattactgcttatgaataatgcacctattcacccaagagctgtgatagaattgtacaaggatattaatgttttcatgcctgtgaacacaacagtcattctgaagcccatagatcaaggaataatttcaactctgagaaatacatttccatgagatggtagctgccattgatagtgattcctctgatggatctggacaatgtaaaatgcaccttctgaaaggaattccccattctagatgcaattaa

SEQ ID NO: 15973 - DNA, 37254 bp, Human
  misc_feature (1)...(37254): n = A,T,C or G
tttttttgagatggagttacgttctgtcagccaagctggagtgcaatggcacaatctcggctcactgcaacctctgcctcccaggttcaagtgattctcctgcctcagcctcccaagtagctgggactacaggcatgcaccaccacgcctggctaattttgtatttttagtagagacagggtttcaccatattggtcaggctggtctcaaactcctgacttcagatgatccgcctgcctcagcctcccaaagtgctgggattacaggcgtgagccaccgcgcccagctgggaggacttcctagaggaggtgttatttgagctgaggcttgagaaatgagaagagccaggtcagggcaaaggcccgaggtgggaacagatgtggatcactcagagaccagctaaggggccaggctggagcagagtgaaccagggcagcgcaggcagagaggcgtcagaggggctgtgaggagccagaccacgctggtccttgggagccacggggacgggcttgggctttgttctcagtgccggggaggctggggtaagtggcagttcagcagtgggggagagaccccgtctggcttctgtgtaggaagagccctgtcaccctttgtgaggaaggacctggggggtcaagagtgacagcagggggaggggctgttccctcaacacgtcatcacctgcctccctccaatcagttccacaggccacgaagcagacactaggaaaggaaggtgccaccccgcaccacccccagtctcgccttgagagaataaaggcagcgtgtgatgaaatgccaagttctgaggcaggtggttcccaggatggtcagcgccgcaatggccttctcagcatgttgctgagtcctgcagctggctgtcctgcaggccccaagagctgcagctgctccaggcagcatctccaaccgcagccatgcccaggctagcaaaacttccgacctcctttttattctttaatgaggtataatttacattaataacctgcacttatctaaagtgtacaatttgatgagctcagtcatgtgggaagccataaccacacattccatcgcccccgaaagcttcttcacacccctttgctgtctagccccatccctaggcacccaccgatgtgtttttcatcaccattttctaggattttatacacgtgcagtcatgcaggatgagctctcgtttgtctggtttctctcagccagcacagtgattctgatgcgcctgtgtatcgggagtccgatcccttccgttgctgaggcatgcttctcatggtgtgcacggatacagtttgtttctagttcacctgctgaaggacattggcattgtttctagtctgggtctgtttcaattaaagctgctgttaagattctcgtgctagtgtttgtgcagacatgtggtttcatttctcttgggtaaataccagagagaggaatgactggatcgtatggtaactctgggtttcactttttgagaaactgccagactacaccaaagtagttgtcccattttccattcctatcagcagtggacaggggttctggatgctgtatatcctgacccacaggctatgaaagagagagaccaggaagagggcttctcccttcaggccacctgtggacttcagtaaatacgaaccttcagcgggagtgggcgccctgacacaggcgggagagcaaggtgcgttggcccggcaaaggctctgagaaggtctgcattgagagcttgtgaggcattgcttaacctgatgtctctgggtgattcagtcctggacctttgctgcagagttcgcctctaccctcaccctgcgaagaactgcagtggcccctgtgggcattcacactgggagatgctcttctccaggaattccctgggggatggagatcagaacggcctcaagtcctgctcttttgcggatagtggccatgaccggagtccccagagcgaagcagggtggtgcatctcaccccctgccccaagcccccagattgtagaactgaaaatgcaagcatcttttctcttccttccccaccccaggtgctcatctgccggaactaccgtggcgacgtggacatgtcagaggtggagcacttcatgcccatcctgatggagaaggaggaggaggggatgctgtcgcccatcctggcccacgggggggtccgtttcatgtggatcaaacacaacaacctgtatcgtatccctttgctgggggtgctcccaggggactcctgtgtgggtgttggtgtgtgtgcatatccacacgcctgcaagcagggctggtttgtgcacagcgcaagcattggacacagccatgccctcctggagctccctgctgcctgcggagacaggcagacaatgcacgatgacatgtgtgatgggtgtggggagaggagcaggtgtgacttgaacctcttcagcccaggggcccaggaagggaaatgacaccctggaggaagcctgcagggaggcctggcttctgccagctggaggggtgggcaggcactaggcgtgggtgaaggctctgcagggaagagcctcattccagcagctgcactcggggtggctggagagggggcgtgtagggcagcgaggctggagtggtcagcggggtctggggtctcaaagaacatcatctgaaatgtgacaggaagtctctggaggcttttagatgtgtgtcttctggaggtttctggctgctgagtggggcaagactgtggggacaggagaggacatgggtaggtggggagtaggctggggccatcgtgcaggtgggaggggaagtggcctggaccacggaggggtggtggggtacagccccgcccagatctcagagccccccacccttcctgtccttgggcccatggggagacttggccaagccagtttctatccaggaggtctaactggccaccccacagctttgggcagacccgcaagcccatctcagtacccacactactgcggaagggcctgctttgccactcacagcccgtttgagccccagctccagcagccatgggggatccctcaccttcccacagttcagtgggaacaacgacccctcactgcaggaccattcgggtcagttgaactgacttgtgcatattgctcccagcaggcatgggctctgtgccctttcctgtgttcttggagacacttggggccttgccagtacagtgtggccaacgggccagaatatccgctgggagccctttggaaatgcagaatcccaggctccacccagccctgccccgtcagaatctgcattgtaggaagatttgttcctggtggccggtgtgcacattcccatgtgggccgtgctggcccagggctccctgtggtgtgcctctgtgtagatttcacctggctctggaaggccctgagaatagctctgaagatgatcttaggtggcttttttttttttttgagacagagtctcgctctgtcgcccaggctggagtgcagtggcgcgatctgggctcactgcaagctccgcctcccgggttcgcgctattctcctgcctcagcctcccgagtagctgggactacaggcgcccgccaccacgcccagctaatttttttgtatttttttagtagagacagggtttcaccatgttagccaggatggtctcgatctcctgacctcgtgatccgcccgcctcagcctcccaaaatgctgggattacagtcgtgagccaccgtgcccggcctaggtggcttttaacccagggaactgacagtcctctgaagccgcccaggtattgggagagggagaggtggctgtggtctgagctcagcaggagccatcagatcagtttctggttgggcccccacatttcacacctgggcatctagggaagagacagggagggctcacccctctggcttagtggacatcgtttcacccccagccgggacagtgctcagcaaggccgtggctgagaggcacccatgagaaggtgagaggcccccactgcccctgcttataaagcatctggggagggcacattgccaggcagcaggagggaggccagcactcgtttgactgggccagcgtccctttcctgggcccctgtgctgtgctggggtgaggcgggaagggagaggatacagcccccaccctccctcctagagctcactcctgggcagacgagccaggcagcacagatgtgccatgaacagggatgtccagggtgcagtgcatgggcctacagaggaagaaccagccttctctggcggcccggggacccattagggaaaaaggaataggaagcgcccagcacacactgaccctgggaggcaggggctggctcctgtggcagaagggaacatctgtgccagacatctcacctacattgccttggtgagttcattcacaggcctccattacacaggagagaaatatcaaggtttctctagaaaggtttatttcatgggccaaggcttgtgtttccaaagccaggaagggctgaagccagaattggccctggctgcttgccacagagtctggccgggggaccctggacctcagcagggtcatgatgaggtcagctttggaggagcagggccagtgtgtcctgctttctgctcctggaatgagcctcactccctccctgctcaaggcagcccttcacccagccgccgggacaggtgccctgtgccacctgccatccctgtgattctccatctcagtgagtgctccctggggcctgggagcgcatctggctggtgactcctgtgtcccaggtctagcttggaccaggagctttgtagcccaccatgggccaagtaaacggctgggagtggggatagggaaggctctgagggttgtgagggttagggggtccctccatgaaccaggatcttccaggcagcagccccagcctctgaatgctccttaactgtggccgccatgcagtggttgccacatccaagaagaacgcgtgcgtgtcgctggtcttttctttcctctataaggtggtgcaggtgagtctcgctcggaggggccgtgggcttgggtggaggttgtcttggctctgcttgtggacctccccatacctggccaccctacagagagctgtggcatccccagggagcactggggctggaagcccaggaagtgggaaaggggagtcccaactccccacgcctgtggaattctatagctcacgttgctcccctaccgtggggaagaaaggaaagtgaacaggaaaaggtagggctcagagcaggggtgccctgaccctggaagggacaagcaggggtcagcgagctttggaaggatgtggggtgaccagctggatggggctggaataaccagcagagctgcagagctgagcccacctcagaatctcccagggggctctcaaggcacagatgcctgacgcccaccttggagagagctgacacgccaggcccaggctgccagtgagacacagatagcagccagggtgaaggcgccaggacaggtgtatgtgtggtgcagctagggaggccagcgtgcgtgtggcagagtatgaggctgaggtcagctgggaagagggcggattatacaggagtgtggatttcattccacttctgatgaaaggtagtggagggctttaagcaggagactgacaagacgtggtttgatctaaagcagcctctctggctgctgagcagaaggaggacttgaggccagtgaggaggctgctgctggcttcccggagaggatgggcctggccgaggtgggctgtggggctcacgaaagtggggaacaggacccaggaggcctgtgctgggcctgggaaagctttcatccctcactgatgctgcctgtgcagaatgttggggaacaggggcaagcctgggcggtgagggcttggggaaggagccgagggtcacctgggaaggccccacgtgcaggccaagggctgccttcactggaccggtgatgctgtcacaggcagggctgggcctggctgtgctgcctgtggtttccaagcagaggccgggtgatcacagtcctgaagcgcgcaggggtcagcagatcagagaatgggggatgcgggaaggggaaggtcctcacccaagggttgggctgtgcctttctgttttagtaacgctccttccttcagcatttgtgcctgcaaaagtgcttctaacagcccctcttctttggcgtcccttccttaaccttctgagctttccattgaaatggggaagatgcatcaagctttccactgaaatggggaagatggcagctcatcaggtccttgcctgagtcactccagactcagaaagggatgacagttacagtcgctcaggaggggctgcctgtctgcgggtgtctgggcagggaagagaatgggaacgcagagcttctgaaggcctcgggacatctgcagtggctccagcctggccccaccccacagccagccactgctgtcctgccccataacctgggtccagggccctgtagcacgccaccgagcctgggaagtaggctgttggtaggacttagcgggcaaatgaatgtgtgcaagcgttcattcattcctcatccgtccgctcaatgatctgcctcccattcctccctccctccccaaccgccacaggtgttttccgagtacttcaaggagctggaggaggagagcatccgggacaactttgttatcatctacgagctgctggacgagctcatggacttcggctacccccagaccaccgacagcaagatcctgcaggagtgagtgggcaggggtggggcctggggccaggcctgggcggtgtcatgacatcgacgtcatcaggtgtggaaacagaaggggcaaatttgtgttcatgttgtcccccacctgcctcccacctccagcagtattcgggtttttactaagttgctcttagtggttttaattcgtttcctcctctacgcccccacataaccgtgcttttcctgctcctcatctttactctccatccacacagatgccttcagtaccttgctactaaggagtcacctcccttgtttttactgtcataaaatgagactgtgatcgaaatctcccctctttggaatcctgcccttcagataagaagcaatgtgaattaagtgcttcctgggggccgggccccagcacttcacattcactcgattcacagcctccccgtataccgtctccccattttacaggggacaagcaagcagactcccagagaagcctgtgttcctaaccgctgcacctcctgctccttcagcaggatggggtcaccaggttacactccgaggcgtcagttccatccacgtgctcagcagggacgggaagcagctcacacccacttcttgttttccttcccaacatggtcttcttggtcccccaaaatgagcacttcagcctctataacttgagtgtattggcttttggaaattgtgaagatttttctgtatgaagcagccccaggtgaaccagaggctgccttttctggagctgctgaaatccaagggctattttcaagtcggtcagaacctgccctgtaccccccacccaaccctgccgaaatgtcaaggccagaagctgtggcgttggtgcgggtaccacctccttcactctgagcgtgtggccccacaggtacatcactcaggaaggccacaagctggaaacaggggccccgcggccaccagccaccgtcaccaacgcggtgtcctggcggtccgaaggcatcaagtatcggaagaatgaggtgttcttggacgtcatcgagtctgtcaacctcttggtaggcctcttttctttccttcttctgtagggttttatctcttccacgatagaaataaacacagcattttaaaactggcaaagccccgagagccgttctgtgtggtaacagatagcaggattcagtttgggccactcattgaaatgtgagtttgtcttatcttttttttttgagacggaatctcattctgtcgcccaggctagagtgtggtgacacgatctcggctcactgcaacctccgcctcccaggttcaggcgattctcctgcctcagcctcccgtgtagccgggattataggcacccgccaccacgctcggctaaagcttgttttctttattagcatttatgctgactgagaatccatacatgcacattatttttaaaaattagaagcagggtatgaggttagaaagtgaagggctcttatcagtcaccatgcacagaaaaaaaaaaaagaaactaaagggctcctataatcagaaagattaggatttattcaccgtcaccctctcgggcctcattctgtagacagacagaaacaagtatattgatttttctataaacctgagatcataagatgtggttctcctgcagcttgtttttttggtggtggttgttgtttgggttttgattttgcgttcagtgttactgttttgtatatttttttcttttggttttttaattatgaggaaagttgacgttttgaaaatgaattttagcgcttgtacagatttgtgtacccatcaccacacccaggacacagaacctcaaaacctcctcatgttgcccctttgtagctccatgctcccctcttccccatttcctggccaccattgaactgttctccatcactggagtcttcatcgtgttgtgattgtcacacgagtggcatcatatgtcaccgcagctgtctttctgagattgtcgtatgaatggcgtcatacagtcatgagctctcgagtctggctgctttaactcattctaattctttgcgattcatccaaatccaattgttttgcatatcaaaagtctgttcccttttatatttatttatatttattttctgttctgaaccacagaaggacatttgggtggttttccaatctttggcaattgtcaatagagttgctagaaacatgtcgtgtccaggtttatgtgtggacataagttttcatctctctagggtaaatacccaggagtgggatggctgggtcacacggtaagtgtatgtttacctttataagaaactgccaaaccattgctgttttgcattctcgccagcaacagatgagggttgtgatgaccccacatcctttgtcagtagttttatttttgtcatcctaataggtatgtagtagtatgtcagcacagttttgtgttttgtttttgtttttgtttttgagacacagtctcgctcttgtcgcccaggctggagtgcaatggcactatctccattcactgcaacctctgcctcccaggcttaagcgattctcctgcctcagcctcccgagtagctgggattacaggcacccaccaccaggcctggctcatttttgtatttttactagagacggggtttcaccatgttggccaggctggtctcgaactcctgacctcagatgatccacccgcctctgcctcccaaagtgctgggattacaggtgtgagctaccacgcctggcctattccattttcttaatggctaataatgttgagcattgctttacatgtttctttgtcatctgtatatcctctttggagaaatgtctctgtgcatctttttagcatttttaaattgggttattttcatatagttgagccttgatagttctttgtgtgttccagatagaagtcctctgtcagataggtgatttgcaagtattttcccccagtctgtagcttatctttttattctcttagcagtggttttttttttttcgacagagtctcactttgtagcccaggctgtagtacaagtggcatgatcttggctcagtgcaacctccacctccgggcttcaagtgcttctccagcctcagcctcccaagtagctgggattacagacgcatgccaccatgcccggctaatttttgtatttttagtcgagacagggtttcactatgttggtcagggtggtatcgaactcctgacctcaggtgatctgccttcctcggcctccctaagtgttgggattacaggcgtcggccaccatgcccagcccccaatactatattgaataggagtggtgagagagggcatctttgtcttgtgccagttttcagggggaacgctttcagcttttgcccattcagtatgatgttggctatggatttgtcatagatggctcttattattttaggtatgttccttcaaaacctagttagttggctgggcatggtagctcccgctctactaaaaataggaaaattagccgggcgtggtgatgcgcgcctgtaatcccagctactcgggtggctgaggtgggaggatcacttgagccccagaggtagaggttgcagtgagtccagattgtgccaccgcactccagcctgggcgacagagcaagaccctgtttcaaaaaaaaacaaaaaacaaaaccaaaaaactccagtttgttgagagtttttaacatgaagagatgttgaattttatcaaaagccttttctgcacctattgagatgatcatgtagtttctgtctttagttctatttatgtgatgaatcatgtttattgatttgcatgtattgaaccaaccttgcatcccagggataaaagccttcttgattgtggcggattagctttttgatgtactgctggattcagtttactagtattttgttgaggatttttgcatcaatgttcatcaaggatattggcctgaagttttctttttttgttgtatctctgccaggttttggtatcaggatgatgctggcctcatagaatgagtaggggaggagtccctcctcctccgtttttttggaatcatttcagtaggaatggtaccagctcttctttgtacgtctgatagaattcagctgtgagtccgtctggtccaggttttttttggttgttaggctatttattactgatgcaattttggagctcattattggtctgttcagggattcagtttctccctggttccatcttggaagggtatatgtgtccgggagattatccatttcttctagattttctagttagtgtgcatagaagtgttaataatagtctctaagggttatttgtagttctgtggggtcaatggtaatatcccctttgtcatttctaattgtgtttatttgggttttctctcttttcttaatagtctagctagcagcctatctatcttattcattcttttaaaacaccagctcctggcttacttgatgttttgaatggtgtttttgtgtctcagtcttctagagttcagctgtgactttggttatttcttgtcttctgctagctttggagttggaggcttttgcttcgtgagttcttttagttgtgatgttaggttgttaatttgagatctttctaactttttgatgtgggcatgtagtgctgtaaatttctcttaacactgccttagccgtgtcccagagattctggtctgttgtatctttgttcttatttgtttcaaataatttcttgacttctgccttaatttcattatttacccaaaagtaatttgggagcaggttgtttaatttccatgtaattgtatgggtttgagtgattttcttagttttgaattctatttttattgatttgtggtctgagagagtggctggtatgcttttggttcttttgcatctgctgaggattattttatgtccaattgtgtggtggtttttagagtatgtaccatgtacagatgagatatattctctcgtttttgggtggagagttctgtagatatctatcaggtccagttgatccagtgctgagttaaggtcctggatatctttgataattttctgccccagtgatctgtctaatactgtcagtggggtgttgaaatctcccactgttattgtgtgggagtctaagtctctttgtaggtctctaagaacttgctttatgaatctgagtgctgctgttggctgcatatttatttaggttagttagatcttgttgaattgaataccttaccattatgcaatgcacttctttgtctttttttgatctttgttggcttaaagtctgttttgtctgaaattaagactgcaactctgcttttgtctgttttctatttgcttggtagatttttctccatttcttcattttgagtctgtgggtgttattgcatctgagatgggtcttttttttttcttttgagacagagtcttgctgtgttgcccaggctggagtgcagtggcgcaatctcggctcactgcaacctctgtcccccaggttcaagcaattctcctgcctcagcctcccaaatagttgggattacaggcacgcgccaccacgcctggcggttttctatttttagtagagacgaggtttcaccatgttggccaggctggtctcgaactcctgacctcaagtgatccactcgcctcggcctcccaaagtgctgggatattacaggcatgagccactgcacccagccaagaatggtgtcttaaagggagcatatcatttggtcttatttctttatccagctcttgccactctatgccttttaattggggcatttagcccatttacattcaaggttagtattgatatgcatgtatttgatcctgtcattgtgttgttagctgtttattatgctgacttgtttgtgtggttgctttatagtgttacttgtctgtgtacttaaatgtgtttttgtagtggctagtaatggccttttctttcctttttcttttttttttttttgagacaaagtctcactgggtagcccaggctggagtgccatggcgtgatcttggctcactgcaacctctgcctcccaggttcaagtgattctcctgcctcagcctcccgagtagctgggactacaggcgtatgccaccatgcccagctaatttttttttggtatttttagtagagacagagtttcaccatgttagccaggatggtctcgatctcctgacctgacctcgtgatccacctgccttggcctcccaaagtgctgggattacaggcgtgagccactgcacccggcctttttttttttttgagatggagtcttgccctgtcacccaggctggagtgcaatggcatgatctctgctcactgcaacctctgcctccctggctcaagcaattctcctgccttagcctcccgagtagctgggattacaggtacccaccaccatgaccggctaatttttgtatttttagtagatatggagttacaccatgttggccagactggtgtcgaactccacacctcaggtgattcgcctgcctcagcctcccaaagtgctgggattacaggcatgagccaccacacccggccttcttttcatatttagtacttctttcaggagctcttgtacagcaggtctgctggtaaacaaattccctcagcatttgcttgtctgaaaggatcttttttattcttctttttttttgagacagggtctcattctgttgctcaggctggagtgcagtggcatgatcatggctcactgcaacctctacctccctggcacaagctattctctggcctcagcctaccaattggctgggactataggcaggtaccaccacacccggctaatgtatatgtttttggtagagatggggttttgccatgtttcccaggctagtctcagactcctggattcaggcactccacccacctcggcctcctaaagtgctgggattacaggttgagccaccacacccaagttgaaaacgatctcatttctcctttgctgatgaagcttaggttggccagatgtgaaattctggattggaatttctttaaaaatgtttaatatattggccaggagtggtggcttacacctgtaatcccagcactttgggaggctaaggcgggggcgggggggggggagaggggggaggggggacgcaagagacaaacaagcgacaacagcgaagacaagtagagaaaaacaaaaatcgaaaaaacaataccggatagagaacgaggaagcaatcgacgacaatacgcatgagaaacaagaacaacagacaagagcggcacacaatgaacgcaaagcacgagaacagagacgcaacaaaaacagactgcaagagaagaagaacggaacagaaaggagaaagaagaagagaaaagaatgagaaacaagagatgacagacgagaaagagaaagaaaaagagaataagcacaagaaaagagagaacagacgacaaaaaaaaagaataaagagcgaaggaaagaggaaagaagagagagaagaagagaaagaagaagaaagagaaagaaaaagaaagaagaagagaagaagagaacaagaaaagaaaaagagaaaaagagagaaaaaagaaaacaaaaagaggaaagcagcaatagacagaaaaagaaagaaagagaaaagnnnnnnnnnnnnnnnnnnnngacgctggtttggcgtcgctgttggtcggttggtgctcttttgtgtgtcgtgtgatgtaggcgtcgcttgttagtgttcgtcctcggcttgttgtcgcgttctcaggttgcttgcatgtggctagcggagggggtttctctctgtggctcggcggcttggggcacgtgtctgtatgggcatgtggtcggcggtggtggtgcgtctgatgggattggcgttcgggttcgcagtgtgggtcggccctgctctggcgtcccggtgctgtggcgtgagtcttgtcgttgggtcgtaaggagtgtgttgtgggtcggtgtcttggggtgtgtggggtgtggggtggggggtggttggggtgcggtcggtggtggtgctggcgcagggtgtgctgtggggcgtcggtgctcggctgcgggagtcaggcagtgctttgtgggtgagtaggcaggggtgcggtggtggtgtcacctagtgggttggggctgggcgcgggcggtctggatggcggtcgttgctgccgggtgagagtggggaggcaggggtgagggaggaggcggagtgtggtagggtgtggggagtaggagtggagatagtcggagtagggtgagcggttgggaggtggtggggtggggggtggggggctgccgtgttgaaggggggtaggaggtgggggggagggtggggttgggggagtaggggggggagtgagtagtgcttgcgcgtgggagacgaccggttgtgtggtgctgtgggcaatcggcggcatgcgcgctgagatcgccgagcagctgttgggacggccgaggtcgaggggatcacctgaggtcaggaattcaagaccagcctggccaacatggtgaaacctggtctctactgaaaatataaaaattagcagcacgtggtggtgcatgcctgtagtcccagctgcttgggaggctgaggcaggagaattgcttgaacctgggaggcggaggttgcagtgacctgctgagatcccaccactgcactccagcctgggccacagaatgagattccatctcaaaaaaaaaaaaaaaaaaaaaaaaaaaaagaatgtttaatataggcctccaatctcttctggcttgtagggtttctgctgagaggcccactgctagtctgatgggcttccctttgtaggtgacctgctatgtctctctagcttctttcattttgaccctggacaatctgatgattatgtgttttggggatgatcttgtgaagtattttgcaggggttctctgcattccctgattttgaatattggcctctctagctagactggggaagttctcatggatagtatcctgaaatacgttttccaagttgcttccattttccccatctctttcagggacaccaatgagttgtagatttgctctcttttttaatcccatatttcttggaggctttgttcattccttttcgttattttttctctattctcatctgactgtcttatttcagaaagccagtcttcaagctctgagattctttcctcagcttggtctgtactactgttaatacttgtgattacattattaaattcttatactgtgtttttcagctgtatcaggtcagttacatcattttctatcctggctgttttgtctgccagctcatatattgttttattataattcttagcctccttagattgggtttcaatgttcctaatctcaatgatctttgttcctatccatattctgaagtctatttctgtcatttcagccatctcagcctagttaagaactcttgctttgggaggccaaggtgggcggatcacaaggtcaggagattgagaccatcctggtgaacacagtgaaaccccatctctactaaaaatacaaaaaattagccgggtgtggtggcgggcgcctgtagtcccagctacttgggaggctgaggcaggagaatggcgtgaacccaggaggcggagcttgcagtgagccgagattgcaccactgccctccagcctgggcgacagagcgaaactccgtctcaaaaaaaaaaaaaagaactcttgctggagaactactgcagtttggaggaaagaggacactctggttatttgagttgtcaagagtccttgtgctcgttctttctcatttttgtgggctgatattcctttagtctttgaagttgctgtcctttgaatgggtttctttttcctttatcctatttgatgaccctgggggtttgattgtgtataaggtgggttcagttggatggcttcattattggaagattttaggggaccaaggctcagcttaggactcctgaactgcatgctctaactctggaggactggtatccagccctggctttgatctctggctccttcaggttaagaacctgctctgctagaggggccaagctgctcccagacagctggtcacaacactccaatgggtggtgccaggcaaagcacttcatagggtagtggcagcaggatctgttcttgtttgcatgtgccagcggcagcacagcggggtgcacgcttatcggctgtgacagagtgctagtggatgtcagggagccagcctctgggagggcatttgtagcagcagcagtagtggcagtatggctggggtgggggcaggggccacgctggcaactgtgcacctgttcattggtgccgatgatggggttagcatgggggcactggtgggtgcaggactgtgtgtgccctttgtgcatgttcacactggcagcagtggctgctcagggctaggggtaggtcctctgttttctctgcctagtttcctgtgggaggcccagcataggtggggcactgggaggggtggggctggcgggctctatgctgccaacactctgacaacaacggtggtgggagaggagaatgaggggctggggtgcacttatgctggcaacagtggcacagcagggtgcacacacaggcatgctgttggggaagggtgggctaggtccacccacgcacacaccaccagcaaaacaatattgagggtgcctgtgggcaagaacctgcaggcaaaactgcacaggggaggctgcagtgggagcggggctcaggtgggctagtgtgtccatggggccgctgtgcaggagtattccccgttcaggtacagtctgccagtgcaggagctctgatgccgcccccaagaggtacctggggattgcactgcaagcaggcttggccaggctggggccccaggagaggccagcagactgagggttgctcaggtcagaccagccccatctgatgggcaagactaccctggagagttcaggtctgacagttcccctacggctaaagtctcctatgagagcaagtcaagcctaggggatgggtgtcctggctgtgctccaccacatatgcttctgcatcaaaccccctggcctggcttaggctggagttctgccccgcctgaggtaggaggcagaactcgacttaggaggtgaggcttggacaccagaccaaattgaggctagctaaaagaggtcagggcagaagcgcctccccataagacccaccccacagtgtgctatgtcagtttgccattgccgtggcaacacttggaagttactaccctttttcatggcaatgacccaacaacctagaagctaccacccacattctagaaatttctttataaactgccccttaatttgcatataattaaaagtcagtataaatgtgactgcagagctgcctctgagctgccgctctgggcgcactgcccatggggtagccccgctccatagggagcagtgcctctgctgccgtgcacatggctgctttagtaaaagttctgtttatcaccaccagctcgcccttgagttctttcctggctgaaaccaagaaccctcccgggctgtctcagttttggggctcgcctgccctgcatcactaccacttctttaagcagcttcccctgccaacgcagctggccgtggcagtcgaggggtccttcctgccgggattccagaggccatggcaagagtgggttgccccttgctagttcaattcaccccctccacaggagtcactgggagccaggaacgattcctggtgcacagtagccctgtgcagggttcccagcctcctcctctgccttccatccagcctctatatcttccctccgttcactctcagggccttcccactgaagatctaggagtctaggagtgcacctgtctgcacagtgtccctgtctcttagtgggagatgtttctcctggctgcgtctagttggccatcttggagcaggagcaaaatctaggcagtctttaaacagcttcaaattagggttctcacaaacccctctttgggtaagcaaggtatagagggaagggacccagagcttccttgccctctctggacacaccaccctccaggaacctccacgtgttcagctctctggaagcttcttttatctcttttgctttacgtcttccctcactgagacttccagcacagtgttgaatatgagtggtgagagctgacattcttgctttgttcctgatcttagagggagaccattaagtcttttgccaccaactaggatgttagctgtaggtttattataggtgttctttttcaccttgaggaagttcccttttattgctagtttgctaacagtttttttttttttttaatcatgcgtgggtgttgtattttcttcagttctttttctgcatcaattgatgtaatcacatgagttttcttcttttggttgttaatatggtgtattccactgactgctttctgattattgaaccagtgttgcattcctggaataaaatcccattggtcatagtgtattataggttgagtatcccttatacaaatgcttgggagcagaagtgttttggatttcagatttctttggattttggaatatttgcatatgcatcatgagatatcttagggctgggacccaggtccaaacgtgaaattcatttttgtttttttgttttttttttttttttgagatggaatttcgctcttgttgcccaggctggagtgcaatggcacaatctcagctcactgcaacctctccctcctgggttcaagcgattctcctgcctcagtctcccaagtagctgggattacaggcacctgccaccatgcccggctaatttttgtatttttagtagaaacggggtttcaccatgttggccaggctggtctcgaactcctgacctcaggtgatccacctgcctcagccttccaaagtgctgggggaattcaggtgtgagccactgcacctggcttcatttatgttttatatacaccttatgcacgtagtctgaaggtaattttacttttcccttggagatgctgaataaactgcattgtgcacctgcattttgactgcaacctgtcacatgaagttgggtatggaatcttctacttttgacatcatgtcagggctcaaaaagttttggattttggagcattttggatttgggatttttgaattaggaatgcttaacctgtattctttttatgtattgctggatttcctttgctggtattttgttggagatttttggatctacactcataagagatactggtttgtaattttctcttttttgtaatgtttttgtctggttttggtatcaaggtaatggaggaagtgttttttcctcttccgttttctggaagacattttatagaatccatgttaattctttaaacatttgttagaattcaccactgaaactatccgagcctggagatttattttacaaaatgcttttaactattaatttcaaaaaaaagtgttttcttgagtcagggcttcgatctgttgcccaggctggagggcagtagcgtgaacacagctcactacactttgactccagtgatcatcttgctcaagtgatcatcccgcctcagcctcccaagtagctgggactgcagccgtgtgccaccatgcccggcttttggggtttttttgttttttgtgttttttttgagacagagtcttgctctgtcacccaggctggagtgcagtggcgcgattacagctcaccgcaacctctgcctcccaggttcaagcgattctccagcctcagcctcccatgtagttgagattacaggcatgtaccaccacacctgggtaatttttgtatttttggtagagacaggatttcaccttgttggctgggctggtcacaaattcctgacctcaagtgatctgctcaccccggcctcccaaaatgctgggattacaggcatgagccactgcgcccagccctaaaaaggtttttttaaaagccattcttgtagaggaggtctactggctacacattcccttggctttcctttaagaatgtctctatattttacctttatccctaaaggctattttcactggatatggacttctgaattgacggtttttgtttagcactttaatatgttataccacttccttctggcatccatcatttctggtgagaaatccacagtcccccaaatctttattcccctataggtgatgtattattgtcctctggctgctttccagatttttctttgcctttagtttcagcagttagatgaggtgtgcacatctttgtgtttctactgtttgggatttgttcagcttcttggatctgtaagtttatgtctttcatcaaattgggaagttatcaatcattgtttcctaaaatatggttttttgtttttttgttttgttttgttttttgagacagagtttcattcttgttgcccagtctggagtgcaatggcacaatcttggctcactgcaacctctgcctcccaggttcaagctgttataagtaaaatgtttattcagaaacagaatgcttgttcctcggtaccacaaggaaaaatcagcattcaaacaaaaagttttctcagcaaggcaaatttactttctgcagaaagggtgctcctcgcagatggaacaatggcgagagcacacccgaacaaaggaggaaagccgtttttatcccttatgcagcttgtccctgctgctgtgtcctatctccattggctggagccagacctcacaatctaagctaaacctgactggctaataacttaaaactttcctaaatagataaaggcaagggagaacaaaggaaaaagaggaagttgactcattcccttatatctaacatcccttacatctaaaaacaaatatcttggttaaagtacaaggacacagaatgtactcattcccttatatctaacatcctttatgtctaaaacaaatatttcggttaaagtacaaggacatagaatgtacattatttctaacacttatgatttattctttagtgagaagggaaactttgaagaggaacttttttactttctacaaagcaattctcctgtctcagcctcccgagtagctgggattacaggcattcaccaccacacttggctaattttgtatttttagtagagacagggtttctccatgtcgatcaggctggtctcaagctcccaacctcaggtgatccacctgcctcagcctcccaaagtgctgggattacaggcatgagccaccgcacccagccctcagatatgtttttgtcattttactcttccttcaggactccagtgacatgaaagacctttggttattatatcatgtgtccctgaggctgcttattttattctatcttttcttctctctgttagattggataatttacattgaactgcctttaagttcacaggtcctttggccctttcctgtttatctccattctgttattattattatttattattattattttttttttttttttgagataggttcccactctgtcatccaggctggagagccatggagcaagcatggctcactgtagccccaacctcctgggctcaagcgatccttctgcttcagcctcctgagtagctgggactacaggtgtgcaccaccaagcctggctaatttttaaaaaaaaatttttgtagagatgagggtctctctgtgttgccctggctgatctagaactcctggggcaagtgatcttcccacctcagcctcccaaagtgctgggattacaggcatgagccactgtacctggcctccattctgctattaagtccattgagcaagttgtttatttcagttactatatttttaaaaattttccatttgattcttctctttttgtttgtttttgtttttgtttttgttttgagacagggtcttactctgttgcccaggctggagtatagtggtgcagttatagctcactgcagcctcaacctcgtgtgttcaagtgatcttcccatctgagtgtgctgagtagctgagaccacaggcacgcaccaccatgcctggctaatttttttttattttttattttgtagagaccaggacttgctgtgttgcccaggctagtctcgaactcctggttgattcttctttatcatctgtttctttgctgagactttctattttaacatttgttgcaagcatttgcaattttaaaaatagctgtttaaagtcttcatcagataatcccaacatctgtgaagtgttgacagtggttgattgggttttccaggcaagttgacattttcgtggttgtttgtatgctgagtaattttggattgcatcctggactttttgagcattatgtggtgatactctaggtcttatttaagctatatgggaaatattgatatttttgttttagccaacagccaatcttactttcaggccacaagttccaatccccaacctgtaggccatgagcatcacgtcagtttttaaagcccccgtgccatttcctggtcagatctcctgggcgtgcactgcccagtggtcattctgggacccgagtggttagttcagttctcaaactctttcgtaagtcaaagtatggtatatgcacaggattcacagatgctcgattctagagagttctggagacataaaccacttcatggggtgactttcctgagcttctggctctgtgctgtctacctggtacttttctgattccttgcggtttactgttgtacacgtctgccattgggcccacttcccagcccacatggagagaggacagagagagaaaaggacaacggttgccccaccccctcggaacagtagctggcaccacagggcctggggcatgaggaacaggggagatggggggcttctgtgttttccaggagagtcaggagttcctcttctggccccagagccaggcctggaggctctgctgagctctcgtgtgctctgtggtgcacacttctgcttccagattgctgctgcactttctcgtggggggcggtgggaacactctgcattcgtggctcttccctggtccacctgctgctgtcttcagtcttccggcagctgccaagcctcctgcccaggtttcagagctgtagtcagtggcaggggaaggggcgccagccgacctgcctcaccagccgcttgctttcttttgtgttcacgctggcctcatccctgcggtgtgggtggactgtatgggctcagccaatccagtcatgcaggtcactcaggtcccgtttctgacggccactggcagtgcagcattgagcacgcttgctcagccccagacgtgtgcacttgggtgtctccgtgacctgggccaggatttctggaggactgaggctgcagacatggaattgccaaggagagtgctgcccagaaagactgtctcgcgcactccgtgcagacctcttcgctttcttactttccgggacgggacagtggcctcgctaaccacattcccctctcccctggggactcttgtctgattgtttattgagccgaaaacagggtccatctgggtgctgtggggtgcaaaggcaagtcccagggggcagcttagagagagtcgagcaggaaagcgctagggctgcgggggtccccgccacagtgcgctgctgcatgtggctccgcccggaaggatcccactcctccaaacaggtcagcacaagggcagctgtcaggatgccaccttcctaagtggcttgcagagctggtggctgggtcaacatttgcctccagatgcgatcatctgagtgcagcctggtacttacacagccgggccctgagcaagcatcccttcagcacccgccctgggaagggcaccggctctgcgtggctggtcacacctcagctgagaaggttctgattgctgcccgcagggccgagatcagcctcgtgggctgggcagcttttcagctccactccctgggcctgctctcgcggcattcacgacctcatgtgttcagttacagctggctgccagggccagtcccaactccctgagggggaggcagcacccaaggggaattaggggccgtcacagtggagtggagggccctccgagaaagaggcaggcaaaatcccaatgctcgggctcctggagccccggccagtgagggtcccgagctcctgagcctccgcttgcccactgagcacctcctgccacacacgctgtttctggtgctggacatggcagcgcgcagccccacgtggcttcccccagcagggagagagagagagagacaagcaggcagacgcagggaagctgttgtgcaccatgggatcagggagccgcttgcgagatgaggacaggacagcacgaggaggtgaggctggggaaggtgacagatccggagcccttggggccatgtccggttccctgcccctcccagggctgtcatttgcttggcacctcagttttcccaattccctcagaggcggcaagctggtgaggggcttttgtttgtctacccagtgctttttggacatcatgcataagactgcacagactctcctgccactctgcagacaggaaatgcaggccctgcacatgttagcctggctggagccagcatctgggcccaggtatccaagtcggtggcctttggcccacttgctggtgtgagcatggcctcgtgcagcatagcagtgtgcagtggtggccagggctgcagccccagcgattcttctgccagtcactctgtgccctcagcacggggcctctgatctgtgcctgtttcctcacctctaaaatggatgcaagaagagatgctccagcatcttggctcacgcaggacaggctagggggtgcaggaccgtcgccccggtgtggattttcagttgcactttcagatgcatctcggcatgcgcagtgggttacagcccctcaggtcatctccccacagtccctgccccagaggttgtcgaggcgtgtgtggagcaatgcctggcgcagtggaaatgctgtcagtgttagccactgtgactggatttaagttgattattttggatcaagtgttatcacacttcagggtggccctgagaagcaagaaggggtcaggactcaggaagcaccatctctcataagccctggggggtgaggggccagtggcctccctgggaggccaagaggagaaacagctttcaagaaaagcaagtctggcctggttcaagagaccccagcccagcccagcccatcggctgagcagggaccacagggtcctggcccaggtccagccgagctcatggactctcaaagctgactcagcgtggggaccagctgccgggccggcccggagcattcagggggctcctgggagggagggactggtacctgatagagaaccctcagagggggctccaggcacgcatcatcaggtcccagtgtggcctgaggcctgaggcaggacccacagtgtccacctcatgtccacagggcctcggcatgaaggctggaggggtgagcctggggaccctcagccaggcgtgggttggtgtgggttaggggtagaccttagccacagctgggactctcccagctcaggggatgcccaggagagggatgggcttggaggtgagaagggcgttgagagtggggtggccagagggtcacatgatgtggtaggaggcagtggctggtgagttggggacctcccctcacgcccacaccgccacccccaggtcagcgccaacggcaatgtcctgcgcagcgagatcgtgggctccatcaagatgcgagtcttcctctcgggcatgcccgagctgcgcctgggcctcaacgacaaggtcctctttgacaacacgggccgtgagtacccttgccaagggccctgcccatgaggatggcctcaccaggcacacacattacagcccagggcagggttgggccaggcggaggaacgagctggtttcaagcacttggttgagcagcacttcacactgcttgagacagctgtgtagagtattcatccttccctggacatagaaggtgcaggggagtgaagatcctccagtccagctgggaggcccccgtcacctggcctcacacgccaggtcctgcaccctgccctgctctgcctggggcactggggcctaggctaaggccttgttctctccctcccaggccaggtttctcccctcaccttgggccctaggtgtgggccgtgtgaaggccacgcatggtgattctcgctcccgccgcctggcctctaacacttcccacagcagggcgggggcagaggggcccagggcctggttttgtgaactgtgcctcccactcagctgtcacaggccactggaagagggtgcagtggctgggcatgcccccgttcctagcccggtgagggcttctcgggcatcagtctatcagggcagctccccgcctggggctgggcagggccccacccacatagccctcagtgaggtggcaaaccaaggtaggacccaggaccccgtggatgccagggcctgagcccttggggagccccgagccatcccccagccaagtccactgatcaatcattcagtgaacgtgtcctgagcaggtcccctggctgggccctgggatggccgctgggactcagcatgaaccagacccaccagccctgcccctggggaccccaggggtgtgaggagtgatggggcagttgtcttgggacccagcccccttggtgtttgtggcccaggctgctctcagtgcgtggactgggggccctgctctgccggggtgggttgcaggtggtaggagtactgctgagatagtgacccggagggcccagatctgtcctaccctcacccctgaccccaggcggcaaaagcaaatccgtggagctggaggatgtgaagttccaccagtgtgtgcggctatcacgcttcgagaatgaccgcaccatctccttcatcccacccgacggcgagttcgagctcatgtcctaccgtctcaacacccacgtgagtgcgccaccctggggctgggctgtcagcagactcctcctccccttcacctccaggaggtgaagcccaggcaggcgccagggccagccccaccccacgctccatgagctgcctggctctgcagagatggagtctgaggacttgggactccgagctttctgaggggcacagacccctttggccaccaccacccctttcccaggcagcccccagagcaggccctggtcatgttttctgcatttgccccaaggcctccccggtagctcccggctacctcggcctgtctgccctggccctccctgacgctggctgtacgctccctgcagggctctgggcccacacctgggcagatggtcccttgccctgggccttggtttcccctctgaaatgggcctttgtcaaacaaggccaggtgtgagcaccctctttgccctccttggcaggtcaagcctttgatatggatcgagtcggtgatcgagaagcactcccacagccgcatcgagtacatgatcaaggtgcgtgggccgaggccacccactgagggccttctggtgtctctggcccgtcccaggagcctaaccgagggctgggggtgccgtagggctgccatccgtgcaccctcactgtggcctcagatgcaggagtgacctgacactgaggggacaccgcctggggcctgctcctagatggtgccacttgtggggaggggcctgtagccaggcatccaggacactcccagaggtgttgcccccaggtggagcacctctgcccctcagcgaccctgtccagcgcagcctggccctgggacatagacattgtcctaggagggcagggcagagggagggatgaggagccttggaagctgagcagacaggaggatgaagatgaaactcctgaaattaggtcttgggagagtctcgagggcaggagaaggggtgggtagtgcctggagaagtggggccaggggcggggctagggaggatcccccgggccaggctgaggggcatgtgtcctggagaggctggccagctcaccttggcctccataaccccgggccgcattggcctggcctgcaggccaaaagccagttcaagcggcggtcaacagccaacaacgtggagatccacattcccgtgcccaatgatgccgactcacccaagttcaagacgacggtggggagcgttaagtgggtccccgagaacagcgagattgtgtggtccatcaagtccttcccggtgagcactctgtccagacatccacgtgccccctgcgcctgtctctgcaaggcagcctgggtgcctcaggaccccctgcacctcaagatggggtgacagtggccactgtgtcttccacacctggggcttctgaaggggtggacggattgctgaggactggagtgggaggaagcagaggctgactcagcccctgggcccctttctgccttcctcttgtttgtgaaccagcctctgtcttcacctcagggcagtgccctctccctccctctctgtgatgcccctgagtactgatgtgagatggggctcctgtccatgcaggccctgaaggagccccgtccacactggcaggtccaaggccctttctgtgcaggctcagccttgcctgccatcgaggggaacggctgcctgtaggccggagcagcacagcctccagagctccgcaccagccgcccatgtcctgggccagctctgcatcggcgtggcttccctgacaacatgttaaggattctgaggagctgagtctgggcttgccgggtgtacacagtgcacagagaggctaggcccaggcatggctctggagctgagccgggtggcactgacctgctccaccaggggggctcagggcaggcgctgctttccatgttctcccctctctctccatctgcatcccagggggacttggggacagccccagctgagttaagctggaaatgctgcaattcaagtgccttgaatttcatgatggtactttccctcccagcctcagtctaatcacatgacataaaatacagaaagtagaggaaggagagagaaaagccagttaccccaccacctaatactcccgtcagcctttccgcgtgtctcctcacctttctttctgcgtattttgcttttcctcattatgtgcaagtagagccagctcagtgcctgcccttccacgtggcgctgcggcagagcgttttccttctggtattgactgtcttcttggcggtcacctttgggagctgtggatattccatggaggggtggtgaccatcccggatagttggattagctcctcttttcctgcaattccactgttgaaaatagtgtttatcatttaaaacacactgggagaatacttcatcaaataaacagcatggtgagctgtagacgggggaggaagggacagggctaagggccgagacacaggctggcgtggactgtgcttgtgtagattttacttcgaagccatgcacaggcacacctcattttattgtgcttcccagatactgcatttttatttttgttttagtttttaaacaaatggaaggtttgtggcaaccctgcgttgagcaagtctgttgatgtcattattccaacagcatgtggtctctgtgttgtcactttttagcaataaagtatgttttaactaaggtatgtacattctcctagacataatactgttgcacattcagactacagtatacggtaaccttttttttttttttgagacggagtctcgctctgtcgcctaggctggagtgcagtggcacaatctcggctcactgcaacctgtgcctcccaggttcaagtgattctcctgcctcagcgtcctgagcagctgggattacaggcatgtgtcaccacgcctggctaatttttgtatttttaatagagacggggtttcaccatgttggccaagctggtgacgaactcctgaccttgtgatccgcctgactcagcctcccaaagtgctgagattacaggtgtgggccaccgtgcccggctggtaaacgtaacttttacatgcactgggaaaccaaaaaatgtgtgtgacttgcctaactgtgctatgtgctttatggcagtggtctggaaccaaacctgcactgtgtgaaggtacacctgtcagtgctttccatgcatagaaaacaaaattaaatcacaatggaaaaaaggtaattcctaaaaaccaaaagcaaaattaattcatcagcgtatcaagttgatgacaaccacagagacacgtcacttcaaataacacaccctaaggacaaaaggaactgcaaaaaataaattttaagaaatacagagagggccaggcgctgtggctcacgcctgtaatcccagcactttcggaggccgaggcgggcggatcacaaggtcaggagatcaagaccatcctggctaacatggtgaaaccccgtctctactaaaaatacaaaaaattagccgggtgtggtggtgggtgcctgtagtcccagctactcgggaggctgaggtgggagaatggtgtgaactcgggaggcggagcttgcagtgagccaagattgcaccactgcactccagcctgggcaacagagcaagactctgtctcaaaaaaaaaaaaaaaaaaaaaaacagagagagagattagaaatacagattagatagatagatagatatccttccccctttcttagattgctccatactaaaagtttttttttttttaggttagttttttttgtttctgagatgaagtctcactctgttgcccaggctggagtgcagaggcacgatctcggcttactgcagaggcatgatctcggcttgctgcaactccacctcccgggttcaagcgattctcctgcctcagcctcccaagtagctaagattacaggcacatgccaccacacccagctaatttgtgtatttttagtagaaacagggtttcgctatgttgctcaggctggtctcaggtgatctgcctgcttcggcctcccaaagcactgggatgataggcgtgagccaccatgcctggcctattgtgaataatgctgctgtgaacgagtgcacaaatacctcttcaagatccagcttccatttgatttgggtgtatccccagaagtggaattgctggatcatatggtgattctattttcaactttttgtggaagtgccatagtgtaggctatttgcttttaaacctagagtgtttctcagtcctgtccctactgctgtctgttaccaggttagggaatttgatatgtgcccatgggtggccatggcacatgacactgtccacctggatggagatctgggccgggccttgcgtccaggccttctcctggctctctctgcatctcctatagcacctgcttcacagaagttgctgccatgttacttcatgcgtgggtacctgtgactattgtgttgtccctgtggcttatgggacggcagcctctaggattgtggcctgtcctcctgtgcacctttctcccttgtgatgatggcagccctgtcctcttttgtctgcctttggcagcacgcctgtcaatgcctgttcttcctacccggggagcccttctcactgtgcctttgtggcgtcgagtgggttttggtgtgtgagccggcgccagcctacagctctcatcgagagcagaattaaacccactcggctcaacgtgacgacacaggctgggtgtgcaggcctccatcgcccctggcgtctgcttccctgcattttctttgtttgtgttttccatttggtctttgctaaggttcagatttggggtctggctgagtgtttggggcacaggctagtcaccgagcgggtttgttccctcgctgcctgctttaccagttgctgatgtcgcatcttccccccgtcatcctcctggagtctgtactcagcacatgtcaccaagtcaggcagagtcctcactctcacgctgccctggtggcagtaggcagagatgaaccactcggccctgccccaggtgcacggggaccgcccctgctgtgaggcagaaacagccctaggcggcagtagctcccacggaacctcggcctgagccctggggagcagagactgtggggtcccaggcacagccagagctgagatcgtgcccccgactgctcagggcgagaccaggcgctgggggtgaccaggctgcaacctgttgctcctcaaggcagagagagggtgaaggtcacagccaggactcgggttccagtcagagccacagccaccccctgctcaccctcaggagcaggacccagggctgaatcgtcactcagtgcatgctccttggtttcttccttttgtcgcctctccctggtcatggttctcacctggacactctcttttctttcacatgctgttctgagactgggcgtgtggcccctgtccccagcagccctcccctgccacggtcattacacactcttccttcccatggccggtctgtctggttcaccagccttggaggaaagtgcattaggggagctgggcggggggtgctgggccactgcagaccacactggcaggggcttggtgactggggctggcagcttggtgagctcagctctgggcgcctgggtatcctcatggggcagctgggcaccccagagcaggggctgtccttaccagcctggggcagcacagggccgagctttggctccccagcacaggggctcatgctcccctccctggactggggtgagtggtcagtctctgcccatcgccactagggccagagctgttggctaagctggggcagggcctaggcctgagcgcctcccccgtctgctccccagggcggcaaggagtacctgatgcgggcccacttcggcctgcctagtgtggaggccgaagacaaggagggcaagcccccgatcagtgtcaagttcgagatcccttacttcactacctccggcatccaggtacgtaaggcccaggcggccggggcccagaacagggacagaggccgcaggtgacagatatcaatgcagccagcttgggaaagggtgtcagtcagctggaatcaggaccctgctgtgctgtgggcctctgcctccccacagacagggtgaggccaggctgcctctgctcagccctgacccctgagctcaaagctcactcattctgccccaaactagcgtttgaggctctgccgtccactcatgccccatgggacctcttttccctggcaccccctcaaaagcccacagagggaggagaggctcccagagagccaggggccttctggccgggccccccaagcaggctgctgaggccgtgtctgcaagccacatcctggctgctcaccacttccagaggcggctctgccctcccacacatttgcatggtccagacaaatccctttcacccccctgaggcctgtgctcatcctgtcgtcatggcctcccctgccagccccaggctgccccagcaggaaagattaaggggggaccaacagggcgggagcctgcggtgctcagggccctgctacctgtgccccaggtgcgctacctgaagatcattgagaagagtgggtaccaggccctgccctgggtgcgttatatcacgcagaatggaggtgagtgaggccctacccgtggggtggggttgtactgaggggtcctctgtggctgcccccagggtggagccatcgggtcgggtcccgaaagcagggagggtgcagagcccagcatgacgcctccctcctgtctcctagattaccagctccggacccagtgaggggctgtcgcagccaacaccccggcctcggggctcctggtggcagcaccaggggacacacctgccaaacccaccagatggaggggccctccctggtctctggccaccctcccagcctctgcccagggacccctgccttccccaggccatctgctctgccgtcgacactcgtctcagaagcccctttcccagaagaggctggtcttcaagaagtctcgtttctttgcccctgaagtcagtttcaggggaaggatgtgaaatttttccgtgtagaggttacagccttttatgctgttgagctcccaggtaccaaaaagcttggccaacgcttgccagccagccagctgcaggtggcatctgccacgaaggaagcgccagcctcgccaggccagcaggggcgtcgttttgttgccattttgttgaacgttatgggtttatgggtgttcctggaacttgtctttgtgcattcgttgctgtttgtgttaccctcactgtccccatgtcccacccacgtcctacggcactcaggaagcacttggtgaggacgagccctcacccttcttgtcttccttcccagcagcgcccgcagcgggccatttacacgtcgaggctggcacctggcgcgctcgggggccactgtagcgtctgcctgctccctggactcgcaggcctcgcctgtggcgccttcccagggccagcctgggtcacgagatgctgtcactcagccagatcagtattgacccaccaggggaggtggggtttggtgagagacgccagcctcagactttttcccactgagggtccagagagcggggccacgtgtcacccacgtctgcgcttggtcacccgtcctccccaccctgtgtgtgtttatgtcatagttacattaaattccattcattgaatactccacagccttcctctgatgcggcgtggtcccaactcctcctgcgtgaccacagggcttgcctggttttgtcgccgaccttccctgtggccccacgaggtgtcaccagctccctctgcttccccagctgaaacacaggaaaagcagctgcgggaagaggcagctgcagtgctggaccatgggccaccactcctgggccacacagaggaggccacagaggcagagtcttctctcatccaatctgctgcaccctcagatggccaacagcttgtccccacctctccccaaactgatggcccactcagagcatggtccttgtgtccacagcagcatcccctgtgtcctagctagaaatgcaggttcgtgggccagccctgacctgccaaagtggaggctctggggccagggtcccggaaaacattaacaaggcccccagatgcttcttctgtgaactgctacttggtccatgggggaaatagcacatatgcaggaagtgctgcctgctcttggccccctccccgaccagtgctgatggccctgcctggccagcaccctcttgccttcattctccccctccctctcctgtcttgccgagctcgtcctcaggtgtctagtgggcatccgacctaacagcctgagtagaaccttccgcccacgtaggtcttccccatctcagtcaatgacgctgccccagcccaggcctcagaccaaagccctgaaggcatccctggggcccctcccctcactgtccacacccatatcagcagccagccctcatggcccctccagaaaaccctggggctgaccccatttgccatcctcgctgccacccccggggcctagctccagtgtgggctgtcactgtccccaccctgtggagcccccatgctgggacaccgcagggacaggagagggctggtccacaggacagaagagagacttcagtttccagcaacttatcagataagacctgcaaaccctccactacagactgtagaaatgcaggaaatgaagcagacgcacctagccgtgcccataaaaaagcaaggagacccacaggagcccaagacgaaggaagtagacgcggaagacaccatgggggctcacaccggagttgctcttggaaaccaccgggtttaggtttgggggccaggtggcagataggactttgggcatcgggaagatggtgaaatgcagtggagatgactcctgcgtgaagctgggatcctcgagggtcatgatacttaacagtaaaaagatggactagaaaaaacatttgccctccacccctgagaataagcactgtgtcctctctctgcctgagatccacaggagaaaaagtcaccactcatttagaccccacgcttgtaatatcaatctggtttgcagacaaccaggccaagatgtttatgacagaaaacctccctggagggacctaacttcatgccttgttacctaagatcctcgcacacaatagaccctcaacatgagggcacatcctgaaaattacaaaacacgtgcatgaaagcaaacttgaaacagcaggatcagatcctcacgaacttcaaagattatcggcatgtaaacaaatacactatgcagtcaatctgttgcaagtgcctaaaggcacagagactctgaatagaaaagagcaaaatgctgttaagacagagctgttacaacatccaacaaggcaaataatttgcatgcgggttataacgtctacaaatcagaaaaagagaacctaacaaaatgggctgtgtgtgaacagacagtatgaagaagatgaaatacaaatggcgaccgttcggccaggcgtggtggctcacgcccgtgagcccaatactttgggaagccgaggcagaccgatcactggaggtcaggagttcgagaccagcatggccagcatggtgaagccccatctatactaaaaatacaagaattagccgggtgtggtggtgcgtgcctgtaatcccagctactcagtatgctgaggcaggagaatggctt

SEQ ID NO: 15974 - DNA, 294836 bp, Human
  misc_feature (1)...(294836): n = A,T,C or G
tccaaggcctcctgaaacaattttaagatcattccaaccgaaggcacaatgtcttctcatcattttgattcactaagagatgaacttagcttttccccactctgctcctactccaaattgtgccaatatccaagagaagctgcaatgtgtaactacaaaaggactgaatgttggaacctcggtgatagatacagctcatcccatggaagaaccagccacgacaacttgtactgaagtggattaaatcaacttgtacccgtcttcacctgttactaaaattttaaatgtggattttgaacaaacaagtgtataagtcttaagcactagatgaaaataaaatagaatctattgaaagttgaactgaactccccccaccacacacacacacacacacacacacacacacacacacacacaaaataactatgtcaaggaacatttctgctcttttctcccagggatatgcagtcaatttctggagatgaggaagatgtcattttctatctaccagaagtatccatactgcatggaaatctaatgacaattcccaacctcagttaaggacttgtttttccatttttctgaacttcaaatactttctaaattgtgttagccgaagcattgtatgtatataattaactcataggtccctctgggcccatctagctaaacttgtggagcttaactgagcaaaacatttgctgatgtctctccctacagtggtacccattgaaatgaataccttctacaagatgaaacctaggaaatgtcgtttccaattggctttctactgattggggttgatgtcttttccaaattggctttctagtgatttgggttgcttcattaaatgtttttggttgtttcataacaatagtaatctcattttctttcaaaagtagagtttgaaatttgggaaaacatgggtggggagggaattctacattttcttcctagttgaagtaggaagacaggtctcttttctgtattaattggactcctgaaattcccccagggtagcagtggctctctgtgggcacagggctcttatgcttatgtttctgtgcttcaatgtaccttccatgctgacagcaaatagaaggtgttcctgcacaagcaaaacctaacggagaggctgcaataatttgtccaaaacgaagtgcaaactgcaagggagagtggactttttcagactgatcctgtttactagtctggtgctttcctccacctgtgtagacacagatgctttattgaacaccagcctcctacagttagaaggtattttgactcttaggaatgggggaaccagttgcaaagttctggcccctgatccccctcctattcctactagagggcttaagataggctctgagcggcacttcccactttctcctctttttctgaagcttcgagccccaaacctcgccctttaaattcaccaagggaccacatgcatcatataagggtgaggaaaagggacctggatgtagacttcctgactatccaaaggaacctacttctctttgctgttctcaagttcaggcgtccggagaaaggcagggagctaggggctctgggtgctagcgtagacgtggcccttagctgagtggcgcgagaggggaggaggttggaagagcgcgtctatgcgttccacctgaacctgcaagctagtcgcttgctgcccaggtgccgattcgcggctgcatgcgccccactgcagcaaagagcagccgcagcctctgcctcggccaccactgctgctgggaaagagtcgtggggctgctgacgcggttgggaggagcctcgcctttaatgcaccagccgcctccagcctcctgcagcagcagcagcagcagcagcagcagcagctgcgagtgcgcgcgtgtgggtgtgagggtgagtgcgctggcgccggctgcagcgccctgcccagctccccgccagcttccctacccccgcctgccggagccgccctcccgtgggaccagcaccctcattccggccaggcaagcctgaatcctgtccctgccatctcgccactgcagctcgggtccagaaaggcaccattttgtcgcggctgcccgctctcccagggggaggagggatcttttttgcattttggagcggctgccaaggaggggaacctgttgggcatctccccagacccgcttgtgagcgcctccggggcgggcgggcgggaccagacccctcggggcacggcgtatcttggcacccggaggcagcggaggcaggcgcagcatcctcgctgggaactggagctggagtgagcgcaccgcgcgggaggagccgccgcagcctcgcagaacccgagtggaggaggtgacagctccattgccgggtttttattttttttctctccgcctccccgtctcctcctcaggctcggaccatggtgcagtcccactggctcccctgcccccctctcctgtgagactggctgcggggagggatcatggatacttgtctgccggcttctggttcccacgcaagtaagcctgctgtcaatggaggaggacattgatacccgcaaaatcaacaacagtttcctgcgcgaccacagctatgcgaccgaaggtaacgccagccccgccgcattccgccgttggggccgggcgcaagttgcggatcactgtgcttcctgggcagctgggcgcgtagtggcggagactcctccgggccctagggctggggcgggggctcggctggccccggcagccccagtgcacctcgcatccatccgggctccgcgaggcgagctcggcgttcagcagcaggtggacccggcgcccacgggagttaaaatggccctcagggattaggctttttcagggtggggctctcgcccagaaagatgaccccaggaaggcagatgaccccttccccgagatgttcgcaggggtcttggggggagataagaagggaggggcccagtaggaccttggtcccccctccctgagcgaaacgatgttatgtctctcagtggctgcagggagggcaaggtttcatttcctgcccattcatctccccggccggccaggttacctgcttagacaatcaaaaccccaaaaagccctttgcagacgggcgaacctctttccttttggaagtgcattagcaaaaataaaaaggtggctggggaaatagtgctctggcgggcagcgaatgaggctgacacgtggggtgagcaacgcgatcggtggggcctttaaaaatcaccattatgaattctgcagcagtagtttctgctgaatcaacagccagcagaaagcaaaagggttcagcaagctgagctttgccaagaggtgaaattgtcgtctctccctctctcccagcttgttctgacataagcactagtgctgtgcgggcaggaagggaaagtcagcaggtggaatctcattctgccttttgtgtgtgaatagagagtagaggcatttttttcccccagtgccaaaacttttgcatttttgctttcattttctacctgtaggccttttatccttagccactcatacaaagtgttgcattatcacattgtaatatccatgcgagaaaatgtatgtggaaatgctttaggacaatgttgcaaggtgtattaatttaaaattattattcttggatgctaacatttctgtaatatttaatcaaatcaaaagactgctagagaaatgtgatggggggagtaaaagagttcaagctctgaaagaaataaaaagacacacacacatctgggggtaaaggtggcatcttctataaacatccctggaagttctagacagaaagaatgtccagtgctattgaaagtatattctccatttgtcatcatttttggagagcatcaagcccagtatgcccatggtgctagacagataaagcagagttgtaagctctggcttccaggagcttagagatggcttttaagatgtgcagcccatccctcccctatacagagcaccatacttaccgattctttttctgtgcatgatggcaacctgattgtaagatgttctccctcaatcttagtgctttgtcactgactcagtgacctgatagcacatgactaactctgtatctaagcatgtcatccaagagagaagttggccttgggtctgttggcttttgggggaacatttatttctgtttgtaaccacaaagaaagagagctgccttcatgttttcttgtatattacattatgcaggcaagagaaacttagcaagctgagaaaatgcccagagtggagctatgtgtacaggagtgtcaattgtgaagtgaagaaatcagttaaaaatggcattctttattgttttcagggccctggatattaccgttgttcttatttttattccatttttgaaaactctgattctggatagaatatctaggttcacatagtcaaaaatagatatgagtttatagcaatgagatttctggcatgtgagaatcaacctctcagatttctttctctttctcaaacacacacacatactaatcacactcaaaactaacaaacctttatttcacagaagcttctaggttttaaaatctgatcttagagaaggtatgaaaagaaaaggaaaatagaacttaaacgatgtaaataccagaagttggatagaacaagaagttccctacagttttgacctattcgtttcagggaagattcatgcaattttgttgccagagggggaagagtccctgttcttccaatgaattccttaagaagtgttagtataccttgaaaaagcaccagatcaaaagactttttaaaaattctcctcactggggacttgccccacaagttttcttcccccttattaacttataccctcttactgggtggggaattagcttctagtccttccatagatcttgcttttctgtttcctttactatttctacattttcctcctacctgctcagttatgtcagattgttcttttttttcctccaaaatatctccttcacatgtatttctgaatttttcttctgtttgctcagatcattccacattgcagtgttctatttaaagctgaaaggtttttgctgtgtagttagtgtgaaggactctaaactcaatttgcattgtaagtggtgactgcaggcaagttcatccagctaagagcaatgcaaatgctaaaggacactttcacccaagctcccctctctcagtctctttctctctctctgtctttctcaaaagaatgcatggtgtgcatttaataaataaatttcctaggacttttttttaattctgagcatgaaaattaccaccctcccctacctttcctcctcttttaaagttaacatctttgagcatcttctatgttccaagcactgtgctgagctctttatgtatagcatttcaatatatctaaaccctgttaaatggatgttgtcatttccattttcaaagaaggaaactgatgcaactgaggtctgaagatgttactaatttgccaaaagtcacacattcaatggaaaaccttgtcttcaaactcaagccagtgtctgaaggccaggttctcccactaggaaattctgcactacttcattttcctttaaccatcagctcttattctgggaaagattgcaatggttttatctcagtgtataagctatatttccatcaggcataaaatcctttgcagggaaaatttgaagtgtgtgtatggggttatatagaggaagggccttgggtagggttgaaatttcccacaaaaataaagtcaacacaatggtttgattttttttttcagatatggaaccccaggtttcctaaccagggattcatctctcaaatctctctatatgtgggtttcctgctatatttttaggcttctgttacagccaagtaaaaccctatctccattatagcagtctgtgagttttctagattaatcttcctactttcaaatggggccacagatagaccaaatattctacatagatggggtgttttaaaataactgctctgttctcagtttccttagctggaaagtgggaataacaatagaacctatgccaaagaaaaattatttgatgcagagaaagcactcaagcactcgggatatgcctaatacaaagcccacccttaattcattatagctgttattgttacttaatgtacttcctggttatattctggcaacaagtgggttccaccttccctcagaagcctttttaaaaaactgtcttgtttatacatattaaaggaagaacaagtttactattccaagtagctcctttcgattattgattcattctgcctttaattccttcaacaaatactgacgttttgcagaggtgatacgggatgttccaatacagacgtggtctctgtcctcagggatctttcaatctagcaaaggagatagtatgagacaaataattttgcaaataaatatatagttaccaattgtgataagtgatatttaggaaaggcacaagatgccttggggtcataaggtggaaaggtggatctaatttagatcgggagttcaaggacagcctctcagacagctgaaactgagaactaaaggatgaatttgcaattaacaagacctgaaagcattttaggtagaagggacaataggtacaaaagcccagagagataaaatagcctaactgattcaaggaatggaaagatgactatggctaggaacagggagaagagtgataaaaatgagaatggagtctgcagttcattttgaaatgtaccagaagcaagaaagattaatgctaagagagagggatgggtaaatggatagacatatgataaagcaagtataaaatgttagtcactggccagccatggtggtgtatgcctgtaatcccagctactcaggaggctgaggcaggaaatcgcatgaacccaggaggcagaggttgcagtgagccgaggtcgcgacaccgcactccagtctggtgacagagcgagactccatctcaaaaaaaaagttaataactaaattgaggtggtgggtctatggataatcactgtaattttttttccactttgcagtctgtttgaattttcataataaaatgttgggggaaaaaaagactggagaagtattcagggaccagatcatatcaagccttgttgaccacaaggagtttggactctatccaaagatgaatggaaagccattaaggaaaagggaaacatgatcagatttgtttttctagaagtttaatctggctgctgtgtaggatggggttagagagccaggcatgtaatgaaaaagaatgaaagttgggagataattaggaggtcatggtgtgctccaggatggtggcatcagtagagatggagagaattagatggatttaagatacgtaatagagaaagattgcattgcacttacttactatgattgggtgcagatggagaaggtgatgtcaaggacaactcccagaattttgccatgaaaatggatgcataatggggcgcatcactaaaagcggaaacagactgaaaactgattagtttgagaagacagtgagacatctagtttcacagtgagacttgcaagtagacaattggatttctgggtctgaagctcaagagaaagacctggactagataataaatttgagattaaacatcaccagcatattaaaggtacttaaaactgtatgaatagatgagatgcctcagataagaacatttcagggcaaaatttgaaccaatgagtgagaaagtacaaggaagtggatcttggcttggtatgaagaaattgtagcaaaaaagtacctcacaatagaatagggccttggtaagcataaataaccacacactgatattattcaagtaatactataatatatggccatttctcagcaatgtggtaggataagaagagtccagtcttggatgagttgagtttagaacgtctccaggtttgagatctgagtgatttgtgaaatacattagctttttagggccacagagagtaaaagtgaggaagtaaagattcctcctccatcccccattccaaataagctcaagaaaggggaaacttataatgaataaagctgggaaggtacatgaaaatggcttttgatatgaagatgctgggaaggcattgaaaaaataaaagggggtagtgtcatatgatggagagctgcctcatagttccttaagttgctttggtatttgtatgcaaatgccagatcagaatgctgtttccaatgcatatggatgaatgtttgagctctctgctgttctcagagaaacctgaaatgcgaggtgagaagtagctgccttacactattgtaaatgacctttctggggatgggaaatgttctgctactaaacataataaccagaatgcattgaaaatcactagcaagtattcattattagcatccaggtccccaggggcaatcccaagccctttatgagtgctggtcagaaatgtaccaatgatcctggggtgaataatattaggccagtcctgtcaaaatattggtaatgcccaatgaaaagagcacagctgtagactgacattcctagactttggcgtttgcatttaagaagaaataggggtccaatttcgacacttagctgagggaaagaaactaaggtatcgcgagtactgtctattccaggcattttcctaggtatttcttatgtttactcatttaatctccatcaacaacccagagagaatggttgcattaacctcatttttaaaataagaaatttcaaggtacagagaaccaaaggaacttgcataacaaatacacatgtattacaaacatactcacttgtaagtggcataaccagattagagctcatgactgtgtggattcttggcacatgttctttgctcacccatgctgctcaggatcttttggagaaatgcaagttgtgctccaccctccacatatatcccattggcgcctggtcggtgctgctggatttacttgatctatcttctcctagcacagcagtgcacgtctctgggccttttccattatcccacagggaggaagctgaattctacgacccagtaacagaattcttagctgacttactcctgtagatttcttctgttatataataagaacagaaaaaaatgtttatggaattgagcaatcaagatgtgagaactagctggagttttttgaatagctttctccatgtcactcatccccagtgtaggacagtaagcatgcagctcccagactgagctgagctgagatggtcccgctgggccatctaggcacccactcttcccagctcatgacaactcatatagttgcctgggccacagcaagagaaatatgacggaggcagctgtgggatggcagatgttcttttgcacataaatatgtagatgtctgaggcttcactttggccagagtggctctccagctggttcccctcatcttccattaataagaagacgattttgctttcacccaacttgtcatctttaccaccaaatttccttcttttgactccaatagaactctagaatcaggctgaaagtcagccccaacataactatctcgcagaaagcacagattatttttataagtccactaggaactttgtcagaaataacccaggaacctttgagttctcctgctccaagttcactgtggaaagagttaatagtgggaaatattaattgttaatgttcatagctttctttggagaaagggtcatcctgggtaatgagaaagggtgtgtgcttgtatgggggtagtcagactttcacttctgtgctttagaggtaaatgacttgatcgcttacaacaaatgttaaatgaagtggggtgggggtctgtgtgtaaggggaaaaaagatgtatggagtttaggaatctagaggggcccttatgaacaggttttaacctgagaaggatggggtctgttggacggagcgtggcgaagagtaccttacctgtgggaggatgtgtttcaggtgtactggcctttgtgcttggtgtattagtcagctcagactgcatttttaaaaacgccacatactgggttgcctaaataacagaaattttgttttctcacatttctggagtctggaagtccacgatcaaggtgccagcatggttggtttctggtgagttctctcttcccatgtatagccaacttcttgctgggtcctcatatggcctttctcctgtgtgcaagtgtgaaaagagagagcgcaatctctggcatttttttttcttcttgcaagggcaccagccccataagaccttatccttatgacctcatttaatcttaattatctccttaaaggacctatctccaaatacagtcacataggagttagggcttcaacatatagattggggtggaggggggcacaatttggtccataacactggggaactgaaaacctcctccatcaagcattgcttatcacactggtatgaatccttgctaagcaatgaacctgaagtggtcaaagaatggcaggccgcctcctccacttgacgtagaaggatcagcttgatgtccctctacagacacacaagggtgtagagggtggcaaagctgtaaatgtctctaatagggaatattgtagcaagatgctgctgagagttcccaggtggtctgaaagatagaacttgggtccctaagtacaaaataccaccaggaaggaccctaccacagtgggagagccacacaggaaactcagtgaaactaacattgcttatgtagctttgtagaagtcaggttagggctagagacactcaagttgggaggtctgttggttcatgccaactgcattattataattcacatttccctctgcctttatgtttttatttataagtcaaataatactatattctttcttacttaaaaggattcaagcatgataagtaaataaagcatgaatcaccctccatcccatgcccatcccactttcctacccaaaggttaccattatcagtagttggtagacttcctcagagccatctttctattcatacatttaaatatacatgtacagatatatagttggggaggatgtttgcataaatgagtacacactgcccgttttatttgcactttgtttttctactagtgatacgtcttcaagatttttccatatcagaacacctacatctgtctcatgccttttaatggctgcacggtgctccatagtatgacagtaccacagtttatttagtagttccctgtggatagaaaatcgtttccagcttttatattacataagatgctgcagtgattatctgtgtatatgtgtttttgtttaaatgtcctccttcctgattttattatctttaaagctgagatgacagttcccatttcttagcaaaatggcaagaaaaaatcagaaatctgtggtcttctatttgttttctgtgtaaccttggatcagtcatttaaaccaagaacctgaatttcctaatgtagagaatgagaatacctgatctacctattcatatgtgcccagtactgtgtcttccaaaaccattgtggatttgaatgttaataattaataatgattgctggtagttatggagggctttctgtgcaccagtacaggcttagagccttaaagtatttttctcatgtaatccagtttacttgtataggctgatactgttcttatccccctttaaatgaaaagttaaagcagaataatatgattactagtccatagttacacaacagtgagtagaacagaagtcacatccaggtctatctgattccaaaccctgtattcttaaacttggcaaaaattcatcacaatgtagtatatgaacacctgtttaaaagaacagttatgatgttgatagggaaaagatgattcatttttctaaaaaatattcttctgaatcaatcaatacaagggtccaatttctaccaaggatttgaaaatgaactggggggaaatggaaaggcaatgcagtatcgtaagcagttatgtggaatgcacatcagaagacctgggtaggattccagtcctgctaccataatttgtcacttttattctctgggcttcagtttcctaagctactataatgaggttgaagatgggggagggaaggcatgctctctacagacttttctgactctcagtttctatgaggcattatttctgtatttgtgatcatctaggtctctttgatatgttctgatgttcacctcaggggtgagactgggaaaacacggccataggctttaaatgaccccagaaattccaggtctggctgtacttcctgggtcaaatcatccttctggcaagaaggttctggtgcagccaagaggcagagccagaaagggaaacttctctttgccaaaagctgctgcagatggaggagccagtctgtctgggcagccatgactttgagaggagccatttggcaaagttgttggcaggagctgccttgcagcatgaatgctggagacagtcctgggctggagtgaatcagggactcagcaaaggtggctggtggaacaaataaccatctggtgagcagggtgctgctcatcttgccacactgatggggaagagcaagtgccaatcaatgaggttaagctctcaatgacatgatctgacaggcacaatagaatttctctcctgttattttatactccatggtgggggttataaactccaagggagcataattttttcagaaaccaggaaggccccaatttcttccactattataaagtaggaaagaaaatttaacaattcaaacaaaaattatttattgccaagtgctatgtaggaagttctggggcatatggtgaagtataagcctatagtcttgttctcaaatgtctttccatctatttgggcaggtgacactccgtccttctcaaaatataattaaccacagaagccagggtgcgtgaaactgtgtcctgtttatctctctgttatcatgaggtggccgaagtggtggaatcagagcccacctggctctagacacacctctggctatgctagttctgtggccttgggcaggtcacttcatcttgctgagtgttttcttgccaacaaaaatatggcaggggatgaggcaacatgttactatttatatgtgataaataaataaatacaaaagaatccctctctactccatgcatttgggaccaatagttgacagtaaacttgaaaagttaaggcaaggagtcataaaaaataacataccatttaaatttactaatttcaatgaaaggcccgatgaagaatcaagaccttacctttgagtatggatctgctgattaggggttgtaatatttttcttgcatgaactgtcccccaaatgacaaagaccatgcccaattttgatttccttgaggttgaacaagaccatagatatcgcagaagcaatcttactacagaatacttctagatttttgtaattgttccccaatttttatatctcctacttttaatttgacaatgctttgtcaagtcttttgaaattcttcaactgacttttcatatgaaacaatcatcctccttttaacactattcttctcattacctttcatgatatttaattaactaacaagtataacttgcatcaggagatttggaaacaaacacaaatgactctcagtaaacatgcaactcaacctgaaggagcagaagtttgcctatgtaccagagattagtctactcaattagctgtgagtacttataaaggatgttgtaggcctgttttacagaaagaatggaaggcactttttcttcttggagtgtcagctacttggaggtctgttaaaaggacttctgctgtaattatgatcatgaggaagagccactatatactgagtgcttgcaatgtagcaggaatcaggttaagtattctggatgtactctatgtgatatactatgtattatgtatctatggtatactacatatgatgtatatatgatatagatgcctctgtgtgcatatatatgtgtgtgtatatatatgtatgtatctgcgtgtgtgtatatatatataatttaatcttcaccacaaccctcaaaagtatgtataattagagctgaattaggtgagactttagatcttattcaccattgtttatccatctcctagtatagtatctggtgaaaaagcactcattacacacttatggagtgaaagagaaaatagatttctactttgctgatgataaaactgaggcttagagaatttgtgtcatctttcccagtatcaatcagcagacccaggacttgaatgcaggtatgtctgacataaaaatatatgttattaagagcaaactgacgtacaatacaataatttttctgtacaaagttattggacatatactttggatctcatattgcctatgaatattctaatagaatgaaactttggtattatctccattttgtaaaagtatgtcgatgttctagagcagggatcagtaaactcttcctgtagagggtcagatgataagtattttagcctttgctgaccatacagcctttgtcccagctactcaattcttccattgtagtatgtggacatggctgtattctagtgaaactctatttacaaaatcaaggagtagcctgtagaccatcatttgctgacccctgttctagaagagtaccgggaacctaatagaggtccaaacagtattaatcgtctaagtgagtggctgcagtaagtgctagagggaagctcacctcaccagaagtggttaagtggggaggtggggccttggtaggatgctggcaggtagagatgggtggcaatggctttcctcattggaggcagagtcttgtgtgatgttaggaggcaaaagtatgcgaggaaggtggcatgttgttttaacaagtgagctggagattagagatgtaatggaatgaatgtttgacagctcattagagtcctcacacatagccatatcccttctaatcagtgtctgtccaatagttcactcagtagttattttaaaaacatttattatatattaggcactgtgctaaaaaacctaggtataaaatatttaaaaattaaatgtagaccctgctctcacagaacttgccttctattgggaatatatacgttaaaaaacacacgtgaatatgaatatgaaacctgttaaagaaggaagatcctttaagagaataaagtacatgttcattatgaaaattttgactgtacagaaaattctaaaagagaaaatcaaatttacttctagctgtgccagagacagtcattataaacatttttgatgtgctatatttccttccaggctcagtgtgtgtgtgtgtgtgtgtgtgtgtgtgtgtgtgtcagagacaaagagagagatgaatggagaatgctaggattctatgcaaaacaacatcatctatagggtttgtttgtttgcttttgccccagacacaaactgttagcatttttctatgatattctatagttgaaccacaattttgcctgttgcctaataatgaaagtttagattatttccaatatttgctatactaattctgaaatatataaataatgtatttggttatgttatagactctaaatcatgtctttggttatgttttagaacaagtttctaaaagtagcttactgggttaaatggtatgaacaattatgtttctagatgataggactaaattaccttctaaaatggctatcccaaggaatacctttgtaattactgtaggcgttttccacttttgttctatccatattttgcttccacctcacattgtcacaaattttcaaggtgcttaagtttatcctaggaaacttatgtggggtgaagatcagagaaaaaattcttaaagatacagccattgaattttaatttgatcccattgcccttctaccccgcaaagctccaggtacttcgaccctttctgagaggagaggcaggctcaattctcagcctctgccattaagcacatgggtgagtagtttgtaccctgggattcagttgcccacctatattaaataaaattactttcatggttccagggcatcatttgtagatgagtatatggaacctggtgacccagaaatgttaattttcttcaaactggtgagtaggtaacttcaaagaatgattgacccagtatgacaaccagtatggttgtttaatgagctagtctctcatggggtacaaatttgacatttcggaaagctgtgcttttttttttttttttttttttttttggttaatactatgtgtggttgaatgaaatttgaacccaggcaaatctgaaaaaaattagactttaactatcaatgactttagacttccagacatctctagtcttctcccaaaactggcactattgtttaatctaaataaaaagtacaaatcttataaattaccactgtagttaacattctatagttgaaccataattttactagccacctaatgatggaagtttagattctttccaatattgctgtaataattgtgaaatagataaataatggcatgactctaaaccgtgtctttattttttagaacaagtttctaaaggcaagattactggattaaatggtatgaacaattatgtttctagatgataggaataaatttccttctaaaatcgctgttccaaggaatacctttgtaattgctatggcccttttccacttttgttctgtccatattttcagtgagcgatttttagtccactttcaaagtatattggctgtctgcatttcagcagtctttgggggttacagttgggagtcggtgtgaaatctcaattcatttagcctgagtatttatttagaacattcttcctctttgaagtgtcttgggttattgaaataaaaatattaagctctttgaggcatttttttaatttaaaaaagtttatacaatattttaaaaattatacgcaggataagcacataaaatttaaaggatggatggatggatggatggatggatggatggatggatggatagatggatggatgggcagttgaatggataaatatttgtggtggttagtaggtgacccagttgccttctcagaggactaaaagtgttaaagcatcttctagaaactccaagtttcaatggagatttgggggtgcaatattaaaatctacttttcatcctcttcctcttctgtcttggagccaagggtaggtgggattaattagagtagcgcagatctgtagggacatgcaaactggaactcatcaatggtgccagtttaaaaggagaagatatgacaggcagagaagagcttccctagaaccctgaactatcagaagagattaggacagtttagtgtttccagctgacatatcctgcaatgactaatttctaatcccttttcctattctgtaggattagcctgggtgaaactgacatactatgttttagaagtcaagaccttctggtcacttaataggatatagagggaaagttttgggtgcagttccatttgtgaacaagatgtatttttctgtaggttctctgaccccttctggggtcagagatcagaaacttggtaagcacccaccaggacctacaaatctctgtgcactgtggaaaaaaaaaaaagcaaaagcagtctgattatcgtattgtacttcagctggcaacatgcttactcagtcctcaagcttcctcagcacaatttgagatggaaattttctgatcagaatttttcctataagtcttagaaacttggatttgagcccattatgtaagccagggttttttttttttttttttccaattacttgacaagcaggttgcctttgagtcactcatatgaatggccttgatgtagacattggcacatgctgaaaaggcaaaaaaaaaaaaaatttacttttctttgaccctttaagaagattagtctgttcacagttttctcctgtgcttataaaccttcatgtttcctgcctatcctctcatcttttaagtctctcctaattgatcttcaaagcattgaggctggcttgtgctgggtcctcactactccaggccattcctgcttccccttccctggtacctgcaaggcctgcctccagtccacattttcctgtgaagtttttcctgaattcctcaagttctttgatcaccacagcaatcctatgagcttatagatattttccccatttcacgaatgtggcaactgaggtccaagttcagacagctagatctaaagacacagatcctgcacgtcatctccccaacaagacagacactccaagaaggcagtgaccacatctttccctctagtttaccatacaaaggacagtagggttcttggcacacaggtgcttagtaatggtttttgaatttgatttcaatttgagagtagattaacagcatttctgtagttaggagagcagccagttacatattcttttcttgggagtttagacttgcaggtccctctgaatgaggtaaagccaggtcctcctaccccaactaaagtttaaagatgcaggggagatgtcaaaagatgtgatctgagatttctgcaatcacttggaaactgtactggctaattaagatcataatagattatttattctttcattcactcgtgtttatgcgtgtgttctttcactctttaaccattcagcaggtatttactgagcaactgaaacttcattcatattatatgagttattacatgataatatcaataagaaaaattatgtgaaagtttattaatattggctatgagggggatgaaagcagcaagccaaaaaaaaaaaaaaacaatgctgtattttaaagaaagtcaaaggtagcttcatccatgataaaaagggtatgtaaagtatgatttctcttatataaaattttatttgtatagacaaagaattccatggaaaaatggcaacaaaaatatattgataactcaggctgatgaaattttaggtaacttctactgtttttatattgtctataatgtatgacagttttaaataaatatatacattgtttatataataaaaacagtaaggctgccattgtggtgagaaacaattcatggagtgtctgctatgtgactagtctctgggaattaatgtagcgaatattcacctgagttcttccttttactttgaagacacattagtttgacgacgggcgcggtggctcacgcctgtaatcccagaactttgggaggctgagctgggtggatcacgaggtcaggagattgagactatcctggttaacacggtgaaaccccacctctactaaaaatataggaaattaggctgggcgcggtggctcacacctgtaatcccagcactttgggaggccgagctgggcggatcatgaggtcaggagatcgacaccatcctggctaacacggtgaaaccctgtctccacaaaaaatacaaaaaaattagccgggcgtggtggcgggcacctgtagtcccagctactcaggaggctgaggcaggagaatgacatgaacccgggagtcagaggttgcaatgagccgagatcgcgccactgcactccagcccgagcgacagaggagactcagtctcaaaaaaaaaaaaaaaaaaaaaaaaaaattcagtttgaatgctggaagaggagtgataagtgaacactgtgactgtcagcttctatagcaagaatcctttttaaggtctgtcacctgaagatctgggtgaaaaggctttagcaatgagcctggcccttagatttatagcccctttggtccttatgtcttggctgcgacaagaaagctaagactatatctctgatctcagccaatcattttataaggggactgagcaacggtctggatgagtcagtgaaaatcaattgcaatgatggaaaactcatctaagaaaaaatgtcctagagccagtgggtcagagccagcccctctgcacatgaaagatttcagtctgtgtttattgacacagagggtggttttaattaccctgaaggaatttctggcatgttttgccaaagccagttttaaaatgtttagtcagtggattagtgactatcggacctactggagaggtctgcatatggggcagcaggtcaagtgtagtgtatggcaatgaggctgttaaagacagagtatgggtacattttgtcagagaaacataggagaatactaccatccactcataagatgatcttgctttagaaagtgtggtgtgttttctgtgtcaaaggcttgatttcctttcttggtttcatgatctaagcaatctcatgacctctgtttttgatatactgaaaagggaacatgggtaagatggtctagagccagagtttgagtgattaatcaagcaatcagttcaagccacaactagcaacttgaaagagtgaatatgcttttctaaatttgataggcccagggaaaatgtatacttaaaatagcatgatggcttttgttttacctgtttgtgtggacctgtaaaacgttttaagatgagagctataaaaggaaaagcaggatggtggtgccacatcacaaagcaattttaatctgctagataccttgagaggaaaccatagtccaagataaaggtaaaatcactagaaaaattgttttcctgatttttgtgtttttgctcttataccttttggttgaatctctccaataagatggaaaaacacttaatagtgctaaataccatattttcttcatctctccaaggtaaacttcagatagaatttcttttttttccctacacaaaactgtccttcatactacctcctttccctgatgttctaatctatacataggccacgttctactctctgatgtagacaagcaagagacttggcaccttgaaatttgaatagaaacccaaagagcccatgttgttgagctgctatttatgtcctgttcatttacatggtagttttgtgatattccttgttgctttcacagaaaggtttctcaggctatttcataccaacatgaacttatctggggggtttgccacgcttactggctcttgactccctctttttttaaaacttttattttaggtttagaagtacatgtgtaggattgttagatagataagctgcatgtcacaggggtttgcaacatgcacattatttggttacccaggtaataaatatcttactccctcttaaccatcaaaacaactgatcaaacaattcagttgtctttggcactgctgatagttttcaactcttaagaattgccccttcctcttgcttttaaattagttcttcaataaaccaacttctccaaacaggttgatacattagcagctaaatattaggcaaggaaggagttatgtaaaatagtaatgtcatcttatacttgtgggaggggttttgtatttctgcaaagcattttcacagctcttatctactctgctcaacaaatataaagagtaaatttcctttattctcattttttcagtgagaaaactgagatccagtggagttaatcaacttgtctatgatcacatacctagtttatggtggagaaaagactgaggtttagagactgattcataaaaccgagctctttctatgatattggaatatcagataaatcaataaactcccaactagatgaaatcttatagtcttggaaaaaagtgcatctgcttgctgactctctgtaagacactgaccactaacatttttagaacaaggttctttgggtggaacaacttggtgtgctttacacctttgattttggggcttgggcatgggttgtgtctcattcctaaagtcactcattgttactcttgccaagtggaagagtctctggaaccacattcctggacagtggtgcaagccttaaagcactagggtttggtgataataaagacatagagaagccagtggatttacttttatgtcatggctgtatattgcgctcaagtatctaactcacagatatctaccatttggaatgagcaagaaaataggtaagaaaaacaatggattgatcatcaccaacaccattctgatccccagaaactagtcactaatttactagtgactagtaaacaacatttactgagtactgtgtgtattttttttgcctcatttccattttattatgtaagcagtgaaatctttgataagaagatgggctcattacttaaatcctctaactgcagttgcccctatgtaaagttaagacaatagtagtaactactttccatggttgttgtgaggattaagtgagataatacttgtacatggctagttcagtccctgacacagattaaacattcagtgagtagttggttgtttttagtagttttagaagacttaagtggtcataagtattatttgcactggaccacatacatttttaccctcccaaccctagagtttagaattatatgaaaaaagtagtcaagaaaacagactctggagatgactgggtttgtatcctggctccaccacttgctagtccttgggcaagttatttaacctctctaagcccaggtgcctcatctgtaaaataaagataacaatgcttaacctcataaggctattgtaagtattaaaagtgacggtgcctgtaatgtgctcatgacagtcccaggaaaatagtaggtagtaattgctaaatgttaagctgtatttttattaatgttagtacagttggctgggcatggtggcttatgcctgtaatcccagcactttgggaggccaaaggcaggcggatcacctgaggtcgggagttcgagaccagcctgaccaacatggagaaaccctgtctctactaaaaatacaaagttagccaggtgtggtggcacatgcctgtaatcccagctactagggaggctgaggcaggagaattgcttgaacctgggaggcggaggttgcaatgagccgagatcgtgccattgcactccagcctgggcaacaagagcaaaactccatctcaaaaaaaaaaaaaaattagtacagttatgtatatgtcttaagatattaccgttagaagacagttgttttgattacaaaacagaggacaaataagttaatacactaaccttaatctttgatccagtatcagtactggctggtggtgattttatctcttttaaataatctgttaggttggattctttttctgaatatgaaatgaaacattgaggaaactaaaactcattatctactccatgcaccatcagcaggatatttaaggataataaatttaagatactaaaaaattaacaataatggactaattatgaaccttttgttctatattagtggtatgttgaagcttcccattaaggcctaattttttttaatcttacatgtttattttgaatatttcttcttatatcacctttttcatagtttctcgtaggatataacctcatacttctgaacgcttgcagagaaatggggccatttctaacgagtgaggtgacttacttctgctcctgaatagttcctattgcatagaagttgttctgcaccagagcattctctttcacccactgctcctagccctgcaccataaaaccctaccccaaacgctgagtatcctgtccacaggaccctactttggctatatgaagccagctctcctgatcactacagcctcttcaaaactccctagaggtcatacagcagctgttttcaaactttaacgtgcattagaatcacctgaagtatttgttaaatacaaggttccaggctccaccccctcaagcttagaataggtctataggcctgtgagtttgattttttcagtttcccaggtaatcctactgctgctgatgatgatcaggagcaacactttgagaccgtggctctctgtctgtcttctcaagtgagtaggcagtccacttcaggtcgacggggctgaggcaaggaagcttttacagtgttgattgtgttaccttgttagcctggattttgacaggcctggagcaaactctcccaaagagatggtagggggtatgtggaaagtatgtaaatgcacctgtatgttaccaaaagttgaagcatcactacctcctggagtctggatctgaaccccatgtttgtcacaggagccaagggagaacccaagacagagaatagtggcccaataatgaagcatgaattatccagatgaaaacacctatggaaataaaggtattcgtattattatttatacctactcttcttgataaagtagcagtatagaagtgttaaatagttccaattgcttaaaatttgttccgtgggacacaagttaatttacattttttaaatagttccagttgcttaaaatttgttccgtaggacacaagttaatttacattttttaaatagttattgtacataggaagcatagtttgatttactgttttaagaacaagaacatattttgaccaaatgtacatggggatgatataactggttataaaattaccaggagagagagtgttggttaaacaagaatagagcctgctttattgatgttaggtttgtcgaataagctagagaacaaagtagatatattaactgctcaaacaaagaaaaagagcttggggtcaagacacaaagaaaaagagcttggggtcaagaggcaaagaaagacaatatgggcatcttactttgaatataacgaagaataaaaggtatcactgaacaggtaatttccaatgagaaaatagatctagaaatcactgtgtaggaaaaacaacttctcacctgtatcaaatattctaaagccctttcattattaactcctaagtagttacacttgatttggatgaagtagcatgaaggcttctgctaggcttttttattcatttctcgatacagtgtgtggtgaggctttagctttacagcctccacatttggctatattttgggataatggaaaataaaatttaatacaaaagaactgtattttgatttaagaaagagaatcatcagagattctctttagaggtggagtttgtaacagagtttgtatgaaccctgagagagatcaaagagtacaacattcagaagagaagagctccctttaataaaaggaacgaagagggaaaaaggctctagataaatattttatcatagagctaataaaatttaaaaggtggtcacagttcaaaaagggaagaaaacaaaaagcaggtatgtgtgtatgtgtatgtatactgtgtttgtgtctgtatgcatatatgtttgtgaatattctccatcagactatggataaagatgtgtgaggcatttgtgtcctaagggaactatgcaatgttagcattatgcatttatagagactccatgcaggtgatatttttaaatgtgtttttatataaaataataagagcaggttttgcttttaaatagtgttggtgatgtgaggtagagttcagctcttcccttgctattgaaaaattaccttttgctctctggtctatttgaataaaaggcttacatctgttgtaatttcaatgtacgattttttttccttcctaccaactaagtaacactttcagtgcattctaatataatattgattgggggtttgagttttatttggtttgcccttgatgatgttactttaatgagatgaaactgaatagctttgagtggatttccctggagcttccaacttttatgccccctattcctcctccaagatggagggagaaaaaaaatggaagtattttgttatttggtcaaattttacgacttgtgtcatatcagactcaaaatttctaaaaacataaaaactgcgagagacagttcagagtccaaattttaagagcttgtcgtgaagaatagccaggataaatacctgcttttcactgtgcctcatcaagtccaaatgtttctgaaaaatcccttcaaagtacaaagacagtgcccttctccaaatttggagggttggtgactatataagtattgtgcacagcttagcgatcagtgtgaggtacaaggtgagtgtgtgtctatacacacgtgcttgtgttttaatataatgtaagaatcacttcaaggtgtcattttcacaagtttagttactttcttcagaaattgaatctattagaatctggttaagactgccttgatgaaaagaggttggtcaatgggtacaaatatacggttagataaaaggtataaattctaatgtttgatagcagagtacagtgactgtagttagcaacaatgtattgcatatttcaaagaagccagaagagagaatttgaaatgtccccaacacatagaaataataaatactcaaggtgataaataacccgaataccataacttgatcattatacattctatgcatgtaataaaatatcacatgtaccccataaatatgtaacatattatgtattttaaaaattgccttgaatttctgacatgagattatgattatttaagagcagtataagacatgaagccatgtagggctctctctgattttctaaaatccattccagtgtgaaataataatttaatgtgtgtcagcagattgggaatgaagagtctggcatccatccttttacttattaagtatttattgtgcacttactatgtgtctggtgctgtactcggtgctggggatgcaaaggtttagtatatagacctggtctctactgttaaggaacctgtggtttagtaggggacacatacaggacaacaggcaattataatgcagaatgagaggttctctgatggaggaagtacaagagaatgtgaaatgacataagagggctcagagcagggctcatgaggaagcagatggctaaactgagacctgaaggatgaggaggagggaagaagaatgaaaagtattccaagcagggagaatggtagtcaagatgatggttagtcccacctcagttatttagtaattgggtgacttcaggaaaaagtctatcgtagatattttattttccttattctgtggaagatggagatggtggccatagtggatactgctgctggtggaaaaaaaaaatgatagcagttaatatttattgagcactaattatgtgccatgtagtgtactaagccctttacatgcattagttactcaattagggttttgaaatcaccttttgaggtaggcatcattattatctgtttcacagataagcaaaaagaagctcagaaaggttaagaaatttgctcaaagtcaccttattagcagtagaaaagccaggatttgaaaacagacaagtttaacttagaacctgtgttttgcaccattactatactattcataatctaactttcataagctgatatagagatgagcaggataatggattaaaaggactttttaaactacatggaactctatactatcattatgcattttaaactggggcatgaatcacgtggttggtagctagtccagaataaaaagtaaaaatgattgcagcaatatatgggctgccatttcttgatttgttagcaatgcctctaattctatggcctcaacacattagtagtcaaaagtggcatttcctaggggacatttttttgaagcaacagaacattagataagttggaccatgggtttgctcctaaatggcaactgctatgttagaaagttctcaaacattcctgagatctttaatctctgttaatcactccatgcccctctgtgacgactgctcagcacaaaatgaaatggaggcttggcaattatccaattcctttgaagaatcttgcctcttaatgctgataatccaaagctctaattgcacttttaaaaattctagattatcaggttcactcaggtatacatactctctactctgcctccgcttttttgtcaaatagacctttttcctgtcacttctatgtttctgataattcccaatgtgctccctgcatttatctgtactctaatcagccatcgtattgtgaacttaggaccgtctatactattgtcacataagcaggttcatgttgctggccaacacattagcagtcattgggaattgttgagaatgtttggagagaggtggtcacacaatcttttggcacaaagagcatgtctccactacaaaggcaaagactggttctacagtaggcggaaccacaatgaaccaaaataatgaattcttctgcatcatagttcgattctagaggctaattgttaatttaagtcctgctcgtggcctgataacggggctttccttttggaaacttgactgagctagtgtgaaaggcaagactgttattcagatatactagtgaaatgcaaacagtttcacatattaatggtcactaatgacctgtaatcaggctatgatttgttaggttaaaaacaaaggcatgattagtttatttgttcaggagtgtaaacagagggctttgtcaatctgcagattgttcttctccattggagacagtaggctggagcattcctcttgagctgtggcatttagggactgcattttcttttcttgagattctcccagcttcctgtcccctcataagcctgcagccttaatcaaaatggaatgaagaggatgctgttattggtcccctttctctgtggctttggtttttgataagtgagccactttaattttaatttttttctttcagctccactctggtctcatgcttcaaatagctaattttctcaaagcatcaccatttcttcagcaaacatttaacacataattgaggtcaaattatgctccaaatgctatcctagacctcaaggattttaatgattatcaagagaatcctaacccaatctgaaaaatttacaacttctccacagatgtcgtaagattttctgtaccactaacaactgcttgtaaacttatcactaaaaaaaaaatgaagactctcttgaaatgaaacagctgctctgttgagatatgcatcttaaagagcaaggcactttgatcttttggggtgcatcaaagctgacaatagagattttgaggtgttatagtgactccttagaaaaggtataccttgtgttttgcctacacttatttaatttgagaaagtgagtatatttaaattcttataggaaaccatggcattaaaacagaaaattctttactccttcatcaagtaaaaagaaaagactgtgatctacctggtaccacgaagcaataatgatgcaggttatcccagtgaggcatttggatcacttacaatcatgatgaagcaatgggcatgatctcactcacatggaacaggatctctttccttgttagcattaatagcaatcagcaatcattttatttactcatttgtgtgttggttatcctctcttcttgaaggtgagcacctgtctctcttgcctagtgtgtatcccaggctctaacacagtgcctggaatctagtaaatatgctcagtaaatatttgttaaatgttgaatgaaatccaaggccaatgatgagagcttgagcccaatagtagcatttgagatattgtgaaataaagaaaaattacttaataaacagatctctgagggacaggattaggagatgattggcaccattgtgaacctttactgcatgagattgtttcttcatgtcctcttatgtccacttctatgtaatattgaataatattcatttcgatatgataaaaaggacctcatgtttatttggaaactaccaaacctggcagtgatgtttatttactcatccttggggtgaccaatcaaatttattatgtgaagtgacatattcttctgaatccaaagaggactttaatattctagaaagtctttacagcagtatggatagattgcgtggtcatttttcagacatttacttgataggtgtttattgggcacttattgtataccagctatggggttagataccaggaatatggagtgacaagaccctctggggaaatatattaataaagaataataaagataaatgtacaattgcaaccgtgacaagcactctgaaggagttagtagtactctgagagtgtgtaataagaggattattggacctagacagggaaggcttccctggtgaaagaataattgctaaatccgaaagtcataataagagttagctctgttgaagaggagatgggaagatgacccaggcagggagaactgcatgtacaagggctttatggtagtagcagtagagagagtgtgtgttcaaaaagtgaaaggtggccagtgtggcttaagttcccacaggatggacattagacagaagccacatcttgcagagtcttgcaaaaatatatgagccatttttgctttttatcttatgagtaacaggaagccatttaaatgcttaaatgtagggaagattggggaaagtgaccaagtttgcttttcaaaaatactattctggctgcagtgcaaagaatagattggaaagggtctagaatagatctaaagagacacgtgatttactcacatgaaactgacacaaaatgtacataatatatgcccacgtgaagcagtccctgcataaagcatgtaccctggcaaaagattcaagatgagctcccccatggtataatatagacctcttcaaattcctctgtgtcacccacacacgcttacccagacataaattagcatcgttaatgcagagtgtcacattagagcccagttatacttccagctgatgcatcactttagcacctttccctttgtactttaccctccaccttcaaaggctgttctcaggtcttattttccttcctagaagtgtgagattggtttttctgctgtgctattggagtgatcctccacttagactctaatctgccatggctttgtgcctgtttgtcaggaacttcgaggatgtattaagatattatacagggtagaagctctattttgacaatgattatgcctattatctattttaataaatgtaaattgctgtggagaaacaaaccattttatgccacttgaatccttttcaaggaagcctgaatcctttttgcatggcttagatgtattactgtcattttcccttcactgggttgaataaaagcacttaaatcagacctttgttagtgcaccctcttgtactgtttgccctaataaattgttgtgattttagtctttgaaatccgtattttgtaacatttgcaaatttatctgtagtcccttccagaattgagattatggagtaaattcaacagtaagtcaacatgtacattatatgtgccaagcactatacttgggatacagcagtgattaaagcactaattctgcctttaagaagcttacagtcatttctcactagtggagtgagaatttacagataagcaagaggaggatgttagaatgctacatgtggtaatgaattaaagttagagacatcaacaagaacccctgcttaactttatatattcacaagtgactacatatagaaatatttatgtagatatacatagggttatatgcacacatatatttctttctgtgtcagctgagagggcctaaaagaaatggcatcccagtagcaactagcacccagatcttgatttctaaaaccattctttaataaaaggaaccaggaattcttgaagaaatgtctgatgctactagtagcaaaggaagtatatgagtctggagcctcttatagaaccagaaagtaaagaagtactgaaaaaaaaggaaaaaagcctgcactgatggaggtatgtcaaaaggacaccgaaatcaactggaagagctcctaatggccaaagtggaacaatccgagcaataaaatatagcattgaattctatcccaaagtataaaatcaatatgcataaattcatactggtataagtaaataattgaataaataggagaggaggagaaaatctcccatgcagaactccagataaattgtgcagataacataccctcaaggaagacagcaagttggcatagctccctaagccttaagggtgagctgtacatcatgacttctttctaagggtgcagagtacagtttggaggagaggggagtaactttacagtggagaaacctgacaaacatttcttcagccaggtgatcaagtccaacatgaaaataaggcatgttgatataggtacctttgattgatgtgataggatggaaatggcactttatctctgtggtcttcaatcacgagaaaaacatcaaataaattccactggaggagcatcctacagtataccttactgctattcctcaaaactgtcaagatcatcaaaggtaaggtaagtctgagaaactgccacagcctcaaggagcctgaggagccatgacaactaactgtaatgtactatcctgggtaggatcctagagtagaaaaaggacattagaaaattaagcaaatctgaatgaactatggactttggttaatgattacataccaatattgcttcattacttataaaaacgtaccacactaacataagatattcacaataggagaaatcctgcaagaggtatagaagagctctctgtactatctgttccatttttctgtcaatctaaatctatttttaaaaataaaatctgttaataagataaaaaaaactaaagaataagaaacatacagtctagtagggggagccagtaagttggtaggcgactgtaacgcaggtaaaatgacggagtatggacagctattgggaaaaacatgatgtggcatctaacttgtcttttaaatcctgatatggtgactttgggaaaattccctaaacttgctgagcttttgtttcctcatctctaaaatggtgataacacctgcacaagtcaacataggctgccaagccaagccgcaggagctcgtatcccctgctatggggctgggtgatttactaaatccatctgggctttagttccccatcaatgaattggataataagagaataatataataggaaaacagtaaatacctaccttagggagttttcctgaagcctgagaaaatatatttaaagtacttgaaacaagtcttggcacacaggacttaaatgctgctgctgctgtctgctcacaggtttgtggtgaggattcagtggcagaattgtggagagtgcttagtgcacgcctaggtttgggcatgtggcttgtgttctacatccaccaccaacagagcacaagccctgtggtgggttcctggaggccaggagatgctttcccttgcaaggcaggcacctatgtaccagacacacctgctgcttctaaccttaagctgagaatagagtagaagttgaccagataaaaggagagtaatggatgtgggttctgtaaaaggagcaaaatccaaaaaccaaaagaagcatggcacctttacagaacagtggagttcagaatgactggtgtgaggagcctaagaggaggaggaagtaggcaagaggaggaagtaagtctattatgtcaggaattaaaggctgaattgaagatttgaactttatcctggggttagtggacaactacaggcaggtcaagcaagaaggcagcatgtaagacttttacactgtctattgttggaaaacaatgagatagaggtagaagaccagttaggaagttacttcagtcatacagatcagttgagagattacggtggcctagatgatggtagtagctctggaagtagaattaaaggatttgaacagtagtgtaaataatgattctaaaattatatgaagatgttttcccacccatagtctgatgtattatagtttatgatacttgaacaatgttctaagatctgcatgagataagaatactgtagaataacataagaatttaaggcagtggctttgagacttctaaatatttttcactctcaatatataccattataggcaggtttaagaaaaagtcataagcattaaaatcagattaactctgaaatgatgagagaatagaggaatattctagaccagcatcattccaagagatctaacataagccacatatgtaattttaattttttagtagctacttttaaaaaaaataaagaatacagataaaattaatttttttttttgagacagagtctctctctgttgcccaggctcgagtgcagtggcaagatctaggctcactgcaacctccacctcccaggttcaagcgattctcctgcctcagcctcctgagtagctggggttgcaggcacgtgccaccatgcccagctgatttttgtatttttagtagagacggggtttcaccatgttggtcaggctggtctcaaactcctgacctcatgatccacccgtctcggcctcccaaagtgctgggattacaggcgtgagccactgtgcctgacttttactattattattttttgaaatggagtctcactctgtcgcccaggctggagtgtggtggcgcaatcttggctcactgcaacctctgcctcccaggttcaagtgactctcctgcctcagcctcctgagtagctaggattacaggtgcacaccaccatgcccagctaatttttgtatttcttgtagagacgggttttgccttgttgcccaggctggtcacgaactcctgggctcaagcagtccactcacctcagcctcccaaagtgctgggtttacaggcgtgagccactgcacctggccagataaaattaattttaatattttaatccaatgtatcaaaaatattattttaatatgtaatcaaaatgacaattatgagatgttacattctttttctcatgttgtcttcagaactcagtgtatattttactcttacagcacattgaattcagactggtgtcatttcaagtgagcaatagtggcccgtggttagtggctactgtgttgcacagtacaggtctggagctcccaaagttagtcaaaaatagtttagatttacacttgctggaggaattctttttcaaaacaagttaatcaacattcctattctagtacatgcacatgggaaacagaatttagtgtacatactcaaattgcctatttcactccatgtatatttttcacgcactcactgtatggtcatggagcatcaactatgttagcatgagtgatggttcacacactggagctctaatcatgagctgaccacgcacagtgtctgttcttcagcttacacctttatggaggagacatgaataaaacagaaaatgaaatagtcataaattggccaggtgtggtggctcacgcctgtaatcccaacactttaggaggccgaggcgggcggatcacgaggtcaggagatcaagaccatcctggctaacacggtgaaaccccgtctctactaaaagtgcaaaaaaaaatttagccaggcatgaacctgggaggcggagcttgcagtgagccaagagtgtgccactgcactccagcctgggcaacagagtgagactccatctcaaaaaaaacaaaaaaaaaaaaaaagaaaaggaaaagaaaagaaatagtcataaattatgctatgatgaaaacaaaagagaggttgagatactggataatgatgagatggctttagatgatttcagttgagatgacataagctgggagataaagaatgacaatgagccagccatacaagaattggtgggaaagctaatcaagtagaagaaacagcatgtccaagagccctgaggcttgtcgcatatgcaaagaatcaaaaagtgaacatggctgaaagctggtgagggaaggagaaagtggtgtgagatgaagaagtggccaaaagtgggatctcatggactttgtaagccgtggaatggagttggaatgttattctaagggctctgaaatctacagagctttaggggaaggggcttcttgattaggaagactgccttgacctcaggtcactgtgtaggctaaaggtaaaaatgcaataagtgaaagttggaagaaagttctgcaacctcacaggttattgagagaaagatagaataaggtagtgaaagttctggaatgacaacatattgatctatagatgcaaagtgctggaaagaaagaaagaaatggggttgctaaacccagctggctttgttgagctgctctttgtaaaggaagtgcatactttcagtgttcagggtgctttctgcatggaatcttaaatttgttttcaaaaaactaaattgcacagaatggatccgggcatgcaggtcttctgccctatctgtggtttctgattttccagataaatggttggctgttcttgaaatgaatgctcacaggtgcatgatgacatcttgctgagggtcctgccaacagtttgtgtaggtggagaaagagcaagaatccaaggaagctaggagagaagacagccttttatttgtctggcattttggatgtttcagtatatatttttttttaatgtttttttttttttattatactctaagttttagggtacatgtgcacattgtgcaggttagttacatatgtatacatgtgccatgctggtgcgctgcacccactaacgtgtcatctagcattaggtatatctcccaatgctatcccgcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgattttacactgttggtgggactgtaaactagttcaaccattgtggaagtcagtgtggcgattcctcagggatctagaactagaaataccatttgacccagccatcccattactgggtatatacacaaaggactataaatcatgctgctataaagacacatgcacacgtatgtttattgcggcactattcacaataacaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattttcagtatatttttgaaatcattatctcagggtcatgataactctgtaagatagaagaagcaagtagaaccattcccaagttatagaagaataaactgagggtttgagaagtgaagggttagtttgtggccaaaatagacagtgagatgatatcatctaatttgtacttttttctctggtgtgagagaacacctgtgactattctaatcctacattaatctgttacaaatcccctattttagcaatgtataaaataagatctaagctcattgggaataagttccctttggggctatttgaaaccttatctactctatcactgcagggtaaagagagggtggagttgttttatattatacattattggtaaagcaatttgattgtaagcttccaagtctggatttatgtacttcaccttgtatagtgctcagtaggctacaatgatactcacaaagtgtcattagatactgaaaaaaagatgtaatcaagacccaaattgatcattattcactgattctggcatctggataattttaaagtttttttgaggcagagtttcgccctcattgcccaggctggagtgcaatggcacgatctgggctcaccgcaacctccgcctcccaggttcaagagattctcctgcctcggccttccgaggagctgggattacaggcatgcgccatcacgccagctaattttgtatttttagtagagatggggtttctccatgttggtcaggctagtctcaaaatcctgacctgaggtgatccacccgcctcggcctcccaaagttctgggattacaggcgtgagccaccgcgcccagccaattttaaagtattagaacagaaaaaaaactgcatttcaaaattattttaatataatttactaactgagactgtcagagacaaaccttctaacagtatttagttgttattagcagataaggaggccgttatccctagcaaactgatgcaggaacagaaaaccaaatatggcatgttctcacttataagtgggagctaaatgatgagaacacacggatacatagagaggaacaacacacactggggcctaccagaggaggagaggtaaaattagatgaccaggaaaaataatgaatggataccaagcttaatacctgggtgatgaaataatctatgtaacaaacccccacggcacatgtttttctatgtaaaaaacttgcacatcctgcacatgtaaccctgaactttaaaaaaaaaaaaaaaaaagggcatggaggtatttttttgaagtatgtcttttttttttcctttttcttgaattatggttagagtatggttatttggaaatgaaataaatagcaagttgactgtggtagatttagaatataggctcttatacttttggggatgtgtgggggtgggaaggaatttgattaaagctctggctcctctccatagcggggagaatttgaagaaagctgtaaatgtacagcaggccatataattttggactatgaattcccatgaagtcgattcctcagtggctgatcaagcacttcagatggaagaaggtaaaggttggagtgaacaaatgtacacaacttagctgaagataaatgtgcagtactttaaggggaggatgttgtattccatgccaagaatggaatgtggttgttttggcttcacagtgatgtggctagggagtatggatgaatccctgtctcagagtactcacctctgaagtttgcccagtctaagtacaatttaaaattttaaaagatttctgatatcaaatctcttttttctttatattttcattatactttaaattctgggatacatgtgcagaacgtgcaggtttgttacataggtatacatgtgccatggtggtttgctgcacccatcaacccgtcatctatattaggtatttctcctaatgctatccctcccctagctccccaacccccaacaggccctggtgtgtattgttcccctcctgtgttcatgtgttctcattgttcaactcccacttataagtgagaacatgcggtgtttggttttctgttcttgtgttagtttgctgagaatgatggtttccagcttcatctatgtccctgcaaaggacatgaactcatcctttttaatggttgcatagtattccatggtatatatgtgccacattttctttatctcccatttctgggtagtaagaggggaagcatccactgtctgggttgtgattacgtcttgcccatagggaagtttgggaggtaggaatgaggaattttcacaatcagaaaatgcaaatagtgcattttctccctctcttcctttatttctctttgctttcttttgtgtgtatgtgaggcagtggaagctagttggactgaacagcgtctttaaaaactctacaaagatataaaaaccaatgaccttttacccaagagtagttaatgctgccttttggatgagatgggacccaagtaaaatttgtactagtgaataatgaagcagttcatgcagaactacatgcattcagaaagagaaggcattattatagctggcttctgctttgagttttggtgcatttgatctttatgcacaggaataatagaaggcattgaataatcctccataagcttcaagtgtctaggctcaaattccacttttttcccaaaaagtctccttgactttgttacctctcctgaatccctacattagagactctagttcaaaatttaatgcttgtaatacagcatattggccactaatgtttaatacatatttgtcttgtttcatctctttgtttagcctccctaaaggtagatgtatatctcccttcctacagagtaagctctatcagattaaggacatgtttgtttcttttattagtctaataccatcacaatgtctcacacattacagacaatgaatagattgttttagaatgagcagttctgatactgcagcatcatttatatctttgatttctatgctacatatactatacttgctggctggtaattaaaatgaaaagcagtttatttttgttttgtataaaaacaaattggagtcaaaatagaactatttgaatggggcagtatctgagtctgattttttgaagtctgcctgtcacagctgatggacctccaaacccctttgggtattttaggagtgtctagatgtgtggaactgtctgttgattttatttttagtgatgtactagggctgtgcttttaaatcacagtttgactcaaaggagagattaatttggttattctgaagacaaggaaaagaaactaagatttattaagcaactactatatgctaggcactgggctttataactttagatatgtcatttcatttaattataagagccctgcatatagtattatattttcttttcgatgtaaaaaaaaagattccaaggggtaattaacttacttggactttaagctctgtaaggacaacgtgcctggcacagaggagtcactcaattaaatgtttgttatgtatattcaagggaactcaatcaggcagcaattgacaagcctgcatttgaacccaaagctgttggtacttaaagcccatcctgttttcactactgctgctcctttaaatagaaattctcatagaaaaaaacagaatcaacataattaacttttcattttagctctctgctcttttagctcagctacacaagtctcaagttttcaacatttggcctcaaacatcattttcctctgtttgtactatttgcccagaggtgatgctaaagatacacttgacttcctggcaacaactcagaacaattgtgttagaacatgctcttcctcataccctaaggaagtaaaaataaatgtttggaaagaaggatgaataaaattgtagaaatggtgacatttcgcattctattctctgcccctttagaaaggcagggaagttgtggctgtccaaacacagccaagaagtcagcaagttagaacttcatcatggtttttatcattccagttttcagacttgtttgtaatgtaaagctgactctccaagttgctgatgattttttgggatggtcagcagatttagcaagtccatttcttaagtaaaaatgagataatattaaattttatagggccaagccctggttcttatacttacctcccagatgacacaaaaacatgatttttaattttttggaaattgcatatacattttactatatttttgagatgggatttcgctcatcacccaggctggagtacaatggcgcaatctcagctcactgcaacctccatctcccaggctcaagcgattctcctgccccagcctcccgagtagctgggattacaggcacatgccaccatgcccggctaattttgtatttttagtaaagacaaggtttcaccacgttgcccaggctggtctcaaactcctgacctcaggtgatctgcctacttcagcctccgtaagtgctggggttacaggtaggagccactgcacccggccacatatacattttaggactcagtttgaatccatatgtatttgacttgagtattgcataagtaatgtttgccttcctgcctcccccacaagatcgaatagactaggtaggcacatgatatctgaatgaagaagagtatttaggaaggcacaattagaacaagcttctaattggaagttataagaagggaaggttggaaatcagtatgtggacgaattttctagtgttcagcctatcaaagagtggcagggactgtcttgggagatggttttctcacagggaggatggacattcacttttcagaaatgttgaagaggctgtagtgaggaagactgggctaaacctctaacgctgcttcagatttcccaaaataccctttgccttgggaaggcagtcatttgtttttgtttcttatttcaagaaaaccttgtcagaagaaacagaagagaggtccaaggtataatatatgaggaactatttaagatttgatggacaaattcgtacctattaatcattaatgtgttagcatatcactttcttaactcacttgtgtagctcactcttctgtctagtctatcctcattcctctttttgtatgctttccttcccattatgtaactctgtcccattcttctctcccttccttcttttttttcttttttttttttttgagatggaggctcactttgtcctctgggcaggagtgcagtggcacaatcttagctcagtgcaatctccgcctcccaggttcaagtgattctcctgcctcagcctccgaagtaactgggattacaggcacccaccatcatgcccagctaattttgtatttttagtagagacagggatccaccatgttggccaggctggtcttgaactcctgacctcaagagatctacccaccttggcctcccaaagtgctggcattacaggtgtgagcccggcctcccttccttccttctaagtctgtaaccttgggaaatcccctaaccaccctgtatttcacatttctctcttataaaatggtgatgttagtagctccttgaaagtttgtcacaatataagtattagagactatatgcaaataccaacacagggtctaccaagctgtagataactattttttaaattcttctttcatttattcattcaacatataaagatttctttaacgccataggacaggggcatagggggctcactgttaggaatatgaacacagaacctacttaccagggactcttaaaatagtatgagaagagacactgccatgtaggtcatggtgctagggaacaaacatgccccggaactcaactcagattcccaggtccctgcttaatcagtttctctgataccattcttctctaccttcatcaatttgagaagcaattgttcccccttttgaacttcctagaattgtgctattcgacaagatagccatcagaagatatgtgagtcttgtgcatgtgaaatgttgctatttcatttgagatgtgctgcaagtgtaaaatacacaccagatttagaagacttagtacaaaaaaatatataaaatatctcaacaataatgttttgatattgattacatgtggaaatggtattttcgatatcttgagtttgagaaaatgtattattaaaattaattttacctttttttactttttaatgtggctgctagaaaattttaaaccacatatgtgtctcacattttatttctattgaacagtgctgtcccagcacttcactgtgccaccttatagccacatcactttcttctcccacccccatacaactaacatactatacagatgctcttcaacttaccacaggtttgtatcctgataaacccatcattaagttgaaaatatcttaagtcaaaaaatgcatttaatacacgtaatcttctgaaaatcataactaagcctagcctactttaaatgggctcagaacaacttacattaaactacaactcatctactacaaaatcatctcatgcaaagcctatttttaaagttcgaatagctcatgtaacttattgaatactgtactgaaagtgaaaaaacaatgatcgtgtggatactcgaagtacattttctactgaatgtgtatcacttttgcatcatcgtaaagttgaaaaatcctaaatcaaatcaccctaagtcataactgtctgtacttgtggattatttttccttctaaattttaaactcttccaggatactatttatcactattattggtgctgctagttgttggcgtagcacctaaaaccaagtgttcaatacatatttgttgaatgaagaaatgaatggatggacaggagctgttttctgaggtattaggaacttcagaggaacataatcttccaatgattttgatgcagaaggcaagttccatggctgcaaattgtcaaaaagtcaacttctttcaccaagatagtatgcccattacattaaaaaagatctagccagaaagctaatcaatatgtcctaagactacatctgtgtctgtagctatctctctgaactttggcaatgacttgtttctacaaagaacagttctcagagtcccacaaatgtttgcattttgaaaatgacagagaccaggttattcattaggcaaagccacagaacctcaaagtctctgtctctctgaaaggtgagtccagacacagagagcagcagttgctaaagtattcatcccggaaaagcaggcaaacagcactcttttaggagctgagccgggtcagctcaactttacaaaatacaagtggagtccagttcgttgcaatttgggacagtgccatctcttaatctgactcagcaccttaaacaaaagaagtgagaaaataaatgcaattcttgccatccatcccaatactgaagagccttgagaagagtgtggtgagccacagccaaactgtacattgtaagtggtttcccaggagtttatactccaagtaggtgggggatatatgtgtggtaaggatggggagtgaggtagaatttttttcaaacattggaaaacgtaaccagtgacataccaactataataaatttgttggcagctgcatggggagggcatagtaggcagaattactctgaagaccttatagggaattttctgttacaatttagcaaaatgataagataaagtaatatttattgaatatttattatgtgtcagatatatgaattattacatatatatatcaccaacaacccaatgcggttggtggtgttatcatcaccttcttacaaataatggaactcaggctttggaaagtttcataattggtcccatagcttaaatcggtggaactgggatgccaacccacttcattaggctctaattagcataatgtccaagatgtctttgatgcagaattagtagcatctgttttctttacaataaagtagtttctggttaacaacattaggaggagggaacattgccagccttatttacaaatgatgactcctttaccgatatctgtacagtacagtgtaagctggagaggaagcgtgggatagtgggagatggttgggctggctctggaacctgggtctgtctggcccaggcactgtggctacctttcttggcttcagtttcttcatcagtagactgtgagagctggaatacactgagttctaaggttttatgcagtgttctaattctctgagactggcaaacctgaggaaaaggaggggtgtgaagcagtgatctttccgccccaagttcagtatggacaggtgacaaaccaaagatgtacatgtttgctagaactcaacatgcttcatgagggtggggcccaggtcaactgacctgctgaagtgggctctatgcttcctcataaagtggtggattgggaaatcaaaacactccctgaaatttctgatttaacttggccatatttcataatttcagtatgtttcttgatgtatttttgaggaaatattttaatattttccctcaaaatataagtgaaaaaacaatataatacattgtttattattaaattgaattattattaagtcatcaaaatttttctgctacagtataactacaagtgaaaaaatagatcctcataaatcttcgagattatttttcattatgatttctgaaatccacctttaacacacaatccatgcacctgtttgttcatcacaggactattcataatagcaaagacccagaatcaatctaggtgcccatcagtggtggactggactaacaaaatgtggtacatttatactctggaatataatacagccataaaaaaagaatgaaatcatgtcctttgtggcaatgtggatgcagctagaggccattatcctaagccaactaatgcaggaacagaaaaccaaatactgcatgttcttacttataagtggagctaaacattgaatactcatggaaacaaaagaggggaaaaatagacactgaggactgcttgaaggggaaggatggaaagagggcatggattggaaggctacatagtgggtactatcctcactacttgggtgacaagtctcaacacacacaatttactcatgtaacaaacctgcatgtgtactcccagaacctaaacttaaagaaaaaaacaacaaaacacaatccaaggactctgaactttcataaaaataataaagatgtatgacttttcatatgggaaatgtagtcattatcactcagagcaccaatcagagttgtgatccttgataactgaacctgaatgacaaaggtgctagatgagttgagacaagtgaaatatttatagctaaaccaaaacaaaagtcatttgatataattcaacttgccaagaaaggcagtgtaaaggagtgtttaagacttttgattcttggttcagacagaacaattctaaattccagttctgccactaactagttgtaactttagtcaagtcacccattctatcagaatgtcattgttctcctctacataaaacatgagaaataataatggtacttacctccatggacttactatgagaatgaaatggattatgtatataaagcacctaggaccttgtctagtatggtgtatgccctcaatacatgttactatttctattgttaaaagataagtaatttatcataaataacaagaatcctttttagcattcaaggtatcataaaagtatatttttccaaagaatcattagacaatccatagtttaatgtaattggagaagcagtaagaacatttgccaaggacattttagagccacgttaggtaacccctaggatgtgcatggaagtggcagtcacttcttaatcataaagagagaacctgattcacatgatgagttatctttaatttccctgcagtgttatgtgaaaacaaatacagctctgcacattgaatattatttgattttgggggatgccaactattgattgttaggggatgaggggatcagtaattaaatgtttgaagttgtcagctgtgcagctgggggtgggggaggaggatgggatggggaagggcagggggagagagacagaaaaagaagagacacggcccgcctgacactccaatgaccatctcattaatactcattcaccagagcttaatatgaaaatgcctcagagaatggagaaactgtttcaacatgtcattcccacagtaggtgaggtgtcaagatttcataaccacggaatgccctgaagttagacactgccttgtcacattgaaagtaaagtcaaggtgaaaaatgccatgttttcattgccagtgttgaaataggctgggggaatttagtatgatggtacagacaggttttgtttcaaggcagcctaagagctttgtttgcttagatccttgcatgtactcttgctgtgactagtgaaaggcttaaagatgacaatgaaattattagtaaaccttccatgagaaggaaaggagcacagcacaatctctcttctacttggggatgtagataaaaattccctttgtagaaagtgttcacttagagcctcacacactgcacaaatatgtaagatgatctgtttgatgatgggcttgatatattggcattaaaggcattttgaagtgatgagctaatgtggaaatttcagaaatcataatgttagaaactaagtaaaaaatgaaagcagcctgtgaagtttcagctggaagtatgtggaaatattttaagttggtggctctctgatattaactaaagcatgaaaatgagaatgaaataccttccctatctagtttgcaaagggcttgtgatattaatatacacacagtcatgcgtcagttaatgatagggatatgttctgagaagtgtgccattaggcaatttcatccttgtgtgaacaccagagtgtacttacacaaacctggggtggtatagcctactgcacacctaggctatatggtataggctattgctcctggactataaacctgtacagcatgttactcttctgaatagtgtaggcaatcataacacaatggtaagcatttgtgtatctcaacatagaaaaagcatagtaaaaatatgatataaatgattaaaaatggccgggcacagtggctcatgcctgtaatcccagcattttgggaggccgaggcaggtggatctcctaaggtcaggagttcaagaccagcctggccaatatgaaactctgtctctactaaaaatacaaaaaaactagctgggtgtggtggcaggcacctgtaatctcagctacttgggaggctgaggcaggagaatcacttgaacccaggaggcggaggttgcggtgagccaacatcgcttcactgcactccagcccaggcaataagagtgaaactctgtctcaaaaaaaaaaaaaaaaaaaaaaaaaaaaatattaaaaatggcacacttacttgtgtagggcacttaccatgaatggagctttcaggactgaaagttgttctgggtgagtcactgactagtgagtgaatgtgaaggccaaggacattattgtacactgctataaacactgtaaacctaggctatgctaaatttattttttaaaagtctttcttcaataataagttaagcttagctgactataacttttactttataaactttttaatttttttaactttttgactgttttgtaataacatttagcttaaaacacaaacacacaactatgcaaaatttttatctttctgtatatccttgttctataagctctttcccattaatgttttactttttaaacttgtttgttaaaccttaagaaacaaaagaacacatgttaccttaggcctacacagggtcaggattatcaatgtcactgtcttccacctccacatgttgtcccactggaaggccttcaaaggcaataagatgcatggagctgtcatcacctaaaataacaatgccttcctctggaatacctcctgaaggacttgcctgaggcttattcttttgtcaaagacgaagtctcactctgtcacccaagctggagtgtcacccaagctggcacaatctcggctcactgcagcctccgcctcccaggttcaaggattctcctgcctcagcctcctgagtagctgggattacaggcatgtgccaccacgcctggctaacctgatgcttttttaaattttttattttaagttccgaggtacatgtgcaggatgtgcaggtttgttacataggtaaatgtgtgccatagtggtttgctgtacctatcaacccagaggcttttttttttttttttttttttttgagagatggagtctcattctatcccccaggctggagtgcagtgccgcaatctcggctcactgcaacctcagtcttccgggttcaagtgattctcctgcctcagcctcccgagtagctgggcttacaggcacctgccaccacactcggctaatttttgtatttttagtagagatggggtttcgccatgttgcccaggctggtctcaaacttcttaccttaggtaatccacctgtctcagcctcccaaagtgctgagattacaggcatgagccactgtgctcagcaacccagagactttttaataaaggttaactttttttttataagcagaaggagtacactctgaaataatgataaaaagtatagtatacataacgagtaacatagtcatttattatcatgattgagtatcacatactgtacataacggtatgtgctctacttttatacaactgacagcagagtaggtttgtttataccaccatcaccacaaacacctgagtaatgcattgcactctggcattatgatggctgcaacatcactaggcaataggaatatttttagccctgttaaaatctcatgggaccaccatcacacattggttcatcataaactgaaacattgttatgcagtacataattgtaccacaatcgctttgtgaaatgatagtatggtagcaagtcacctaatgaacttggagactggtaaatattaaagctgatatagaggttggatgcaatggctcacacctgcaatcctagcactttgggaggccaaggtgggtggatcacttgaggtcaggagctcaagaccagcctagccaacatggtgaatcccatctgtactaaaaatacaaaaattagccaagaatgtttgaacccgggagtcggggattgcagtgagccaagatcatgccactatactccagcctgggcgacagagtgagactccatctcaaaaaaaaaaaaagccaatatacagaagatactattggttaaaaatactatgtgatacatgcaggtggctaaccaagatgcaggaagagtgaggtaacatttaaggttcgggtactgttggttgggctttatatacattatcacatttaagtgtcacattaaccttattgagtggatatgactacgattgaaatcctaacagctagttttttataggcattagcttgtgtcagatactgtgttaaacgtgtggcttaaattatttagtttacttatcacattcctatggcatatctatgattagccttatttgacagatgagtaaactgaagaagattcatcatggtttctcagccagaagtcaaacccagatgtctctaatattagaagcactttacatatagcagtaatgaagtaaaatgtaaataaataacaaaaataagaataaaaaagaaacatctattgagcattgactgtatactagccattgtactatatgttttgcatagaatatcttacataatcctcacaatcctatgatgtaggtattctcacaatatctattttacctctgagaaaatacaggcttaccaacttcaaaagcttgcccaggtttacacaactagtaagaggcaaacatgaaacacaatgagtgtgactctagaacctaaactactagccaatttgcctgcaatgaaaatagattatcaaaattttaggcctgttttttacttaaaaaaaagtccttcctacaaagtaggggtagttacgtgaaaaaatggaggtctgtagggatagactttagattctttggatagtttgagacatcctggttttcttacccacctgtatgaaaccttaacctgcgcctcttttacataagtcagttttgctttgcaggactctttatatggtgtctctatgaaataggccactgcaggtacttaacatacattctctgtttgccagaaacttccttaaagcatgacagcagagtgttccccatcacagccccaccttatctgtgcctcttgcctttagctgtgcttggcttcagaagaacaatgtgattttactcatgttgcaaatgaaacaaaatatgctgaacacttacccattttttaatatcatttttcattgcacacaagcatgcccattaatatttctatgcttaagcatataacccacatttctttggcaacctacaattgtactcccaccaaaatataatttagccattcaatttaccaatgagtcacagattaaaaaataggtttttttcttatttacttagcaggatattataattttttaaaaaacaagagttggtgttctttggcccataagaatcattcattaatgtaatgacattaaatatggtggtcatgtcacccttgtcttgcagtataattttcttactcttattagaataaagatgaactaaagccataatcactctaaatcacattaagcaggtttttttaaaaaattttttctttccataaaaaggtctgtattattcagctcacttacccgttcttctctatgttaaggaaaatattcctgattcggaaggctgtcctgtatcaaagtttatttttccttgaataatagccaaattgtattattcctgattttctgtgtggttacttggtatcattttactaaataatggttgttaactcatctggatgtttttggttttataacctgtgtaaggagttatttgaacatcagaaacagtgataaatcaaatgtgatttagaaccagacctaagaattccaaagagggggaaaaaaattcttcagagagtttggcttgcaataaaacaggattgtcatgtttttagtgttgtctgttttgtgttggggggaaaaagatcatcctttttgtccatacagtcactctctggtattatctccatctggctgtctctacagccttgggcctcttagctctgagtaagtgtgtaccagcagctattaatagctgaattctacaacattctgctgtcacagatggaatctgagcttctgaacactaagaccataaaaactcattacaaagaaagcagtacattctttggcacttaatgcaattaagctgtctataaataaggaacattctgaaagcaatgcaccagccctgattctagtttgtagatctcacccactgatttggtcattgatacagaagtttctcttttatgatgttaaatggatctgagtattaatctaagaactatatgtgaaacagcaagagaatgtcttttttttttttaaaaaaagtaaaagtaatattttagggtataatagaaaattccattacaacaaagaaaagggaaaataaaaccttcaactagagaatgtgcattatggatggtagaattcatgggataatgcatgatcatgcaggagggggctgctcctaacctccttgagttgcaactattgcagcagccaggacgccaccatgaaagaaagcgtacatgattgtctgtctctgtctctgtctctgtctctctctctctctctctctctcttcaactaggccatggagactcccaattctttttcccctgagcaaggcagagattgctctctttctcaaggaactgtcttaatattactaaagtgtaggaagacgacggaaaaagggcttaatgtctatttctgggccctctttctccatgatcccctttccttcccagtatttaccgacagaattaaaggatttattaaatcagattaactgcttgtgtcatctcttctaccctcagtaatatcagagcagcaaagccaggaaagtgaaacccaatgctgtgcatggagtcgatactttatcaatacttattatataaatgaatgggagaaatttcctttattttctcattttgttagaatgtggattctatgagggcaagactatattggttttgttcacttctctatccctaacatctaccacaataaacattcctgaaaaatacataaataaatggagttaaggcagcttgcaagctcttgaaagggttcatgcaaatttcttctcagctctgtgctgaagcataatgcctcagtctttacataagacattttgaaaataaccgatgtgttctgggtgctctttcccttttattcgtattgtattttaccttactctatgccttgatctatggtctgtgctacattttttgttgtagctgagaacagaatttacaaacacaaatctcccaatggtactttgaaagtgattctcatctgaaataaaataaattcacttaggagcatagcttatctccttgaactagagatttgaaaatttctcctaattccctggcaattcagctaggtcatatttttattactgtagttattccaagcatgcacataagcccctatgatatccttggtcccaaggatacggtattgattatgacagaaaaagtagccatacctttgtggacttaaaatgggggaaaagaatggggaagaagcagaaacttaagcagtttcaataaaatgtaagtgctaactttagttcaaatatttattgagcacctgtgatgagctagtgttccagtaaggttgaaaacataaggtatagattcgaaaagccaattaatataagttagatagcaaggtaaaaaacagatattccagggcaatagatgatttgttgacagatgtatggtgtaggcagaagtgatatgtatgcagagaaagattaaattactgtaagttggagccatctgtgaatgttcttggagggaggggaatatcaactggatctttaagaatggggaggatttaaatggatgagaagtaatggcactaaatgcaatttttaaatggtgtaattattaaagttgctgagttttgaaaacgccaccagaatgcattttaattgaatttctttatgctgcacaaaaagtaagttctagttggttcatggatactgacttggtaaattggtaggtggtaagttagtgttcttgtgattccagcagcttgtgcaacctctggtttgttacatcatggaaactgaagattatcttgggttagattcacaaagcaaattttcccttatccccctcctcctaaaaaagcttattttcagggtggtctctaaaatgctagacttaggctctctaaggttctacttcagaataagggatccaagaagttttggccagctcctaatttaacctatacctagaagactcatttagatttagaaggctgtaggcatgatggttgagaatttgaattcagaataatccgatgtcaagttttgtctctgccaccctttattatgttgggcaggatatttaattattcctagatcatttaaagagaatgtgttcagattaaatcatgactggggcatttttaaaaaagaaatgccaagtaccgaggaagtggcaatgatgatgagcctagagatgactgagactttgggtattaatctttgaattatttaccggatataaattttacagcttctacacttctctactttctttcaagtgaaattcttcttatatctataactcataagattcccctggcatgagatggatccttcattcccataggcctgttctgaattggaggagacaacaaaaacttcaattattaatgctattaatgctctgtcaagaatatcttactacatgtgataccaacaacaaaaaaagtggcatgataaatgcttgctttcatagcatgtcatagcacactgtcatagcatgtcacagtttgcaaaatactttaaaatatagcactgcatactttaaactacagcacttccaaaaagttagtggctttcaatcacctctttttacagttaaagaaactgaggcagaaaaagtaacttgactcaaccaggttatcagctaataggtggaggagcctaaatttgaattcagttatttcaatccatccataagtatttctttaacccttacacttatagtctgtttggaaagaaaaaacacttatgatacaaatagaaatgcaagcaagtgcaatgatagaaatgcaagcaagtgcaaattcatgtacctcaatgtggttgttaatatctgaagggtaaaagagtaaaaagagatactttattgaggtagcctaaacaaatcaaagcttgttaggaaagcagaatactaggagatactatgtgttttctttttccaaataaacatggaagtgtgggccactgcactgtgagataacacatcatttctgaatgtgtgtctcctgctgaaccaaagaggagaaacagctgctttcccagcaccatggacagctcagcaaccctctgaagggttgttccatacacagcatgaacaaagtcgtgtctatgtgataacgtcggctctgtgaaacccaggggaactgacctgaccttgtaatgtgaggaacgtaaatttaaaatatcagcggagttgcattaaatgctttttcaggaggtttcattaatgtcaataagtatgaaacatttaaaattattgatttttggctgggtgcggtggctcacgcctgtaatcccagaactttggggaggctaaggcgggtggatcacttgaggccaggagttcaagacaagcctggccaacatggtgaagccctgtctctactaaaaacacacacaaaaaattagccaggtgtggtggtgggcacctgtaatcccagctactcaggaggctgaggtggaagaatcatttgaacccaggaggcagaggttacagtgagccgagattgcaccactgcacttcagccccatctcaaaaaaaaaaaaaaaagtattgattcttgcatttttctcaatttaggactaagagaggcttaattaattattatgaagagttttcatacagttttctttctatctctgttaaagcccgtttcaaaaattaccactctaccacagtgtgtgtcatgagtctactttttctagtgcatactcccttcctcttacccaatgctttcccccaaaactcaactattctatgtatggccaaccctcttctgtgatgataagaaccaaatgaaaagcaatagatgctaattctatagctattgaaggtaccctagggagccaaagagctaactcacaaattggaaatcatataacatggctgctctaccagcagtatctgcccttattggcctgaaaactagagatggtcatgaggaacacaaattgaggcaaactcactaccaatgtgaacatcttccctgtgattctttccatgtcatgaatctccatctgatttttaaggctgggttgggaggatgagactgactctatgttctaggcttttggaatagaaatagcctcatgttcaataagctttctgctcttcagtaaattatgttgccatcagatttgacataattacatatatacatttcaaatcctactttgtgtagcttcctgtgacatctgatagaggggaatttgtggcttagctgcttataagtgaagaagatgacagtggaaacctgttgggagagcacttggtgtttgtacctgcattcactttgcatgcacatctactaccagggatccaggagggaaatggagtgctacccctaagctttcagatggtacttgctgacttgtaagcaaggaccattacagcataagtttggttgagccaacttttctttttcaaattaacttgaaatgaggcaaacagggacttctgtttggctatgttttgcaaaaatcactgttaacacacaggtgggctactaagggctgttattttttcaagttattaaaaggaaaattcagaaagttagggagaagaattattttatacttctgcttgagaagaacaacatatgtttgtcatggatgattgaatccatttccaagattttaaactttaaagtggacgtggcactatgacattaggaatgaggttaccagataatttttaagttaattctcgaaattaaactacttggaaaatctgttcttcccatctcagtgcacgttctgctcgttatgtggtgtgccgtctaagtaaactctgggccaggtgcagtggctcacgcctgtaatcccagcaatttgagaggccgaggagggcagatcacgaggtcaggagatcaagaccatcctggctaacatggtgaaaccccgtctctatcaaaaataaaaaaaattaggcgggccttgtggtgggcgcctgtagtcccagctactcaggaggctgaggcaggagaatggagtgaacctgggaggtggaggttgcagtgagtcgagatcatgccactgcactccagcctgggcgacagagcaagactccatctcaaaaaaaagaagaagaagaagaagtaaactctggccacagagcaagtccaccataggtagtgatatgcaggctgtcagatgaaatctccagattgaaaccagaacagggggctgagctccaaactggagaagaagcatgtgtaaccttttggttcacatggagggagtgtctccaaacagtcccttttgccaaaagactcagctttccttaaatataaagaaaaacaaaagtctttttttctcaaggatgtaagaatgatgtttgcaatttgctcacttcttcctacaagttctaaatttggggactgcattgcttttagttttaaggaggttatataaatctagatgacaaaggcacggaaagacttatcttggtgctttagtggtgataaaagaagcttatttcttcatttagcaaatgtttactgaatatctactatgtatcaatcactgtttcatgtgttggtcataaagaagtgagcaagatcaagatttctctcttttctaataataatctgtgggaggaagaacccacaaagcaaatgagaattttatatgttgataaatggtatggagagattaggacaagttaaggatatagagagtgggtggtaaacaaatatattagatggagaagtattcttgacaggacaacctaaaaagcaaaaaaaaaaaaaaaaccaaaaatgaagaaaatttagggaatgaggacttcctggagagaaaatagtaaatgcaaaggccctggagcagtaatgaatgtggagagtatgagaaacagaagaccagtgcaacctgagtatgatgactgaaacagacaacagtggtatgagagttaggcaggatccagaccatatggaggcttggaggccatgaaaagatgggtgattttatttggagagcaaggagaagtcactggagggcttagaagcaagaaaatgatgtaatctgagttatgctttccagaagatcgctctttcaaatgttcatcctcatttgcaaggctctgctctaaattgaggagccagtccttcttctggcatcttaccaatttgttattttacgaactttcttttcttgtaaaataagcatatttaggaaaactacacagcatagtacaaaggattggacagctatatcatttttagatggactcatttttgaaatgtgagacaatgttttacacggaaataacactcaaaggctgagttctagtcttacttgggccacggattcactgtgtgttctgaacacagttacttacgttgtcagtgtgtattttgccattggtaaaatgtgaatatgaatattagtagttcctttgcttactttgcataaatgggaatttacaatgtggcatcatacttgaatatgctttttatgacactgaaccagctgaaagttaaatccattcatgtaattaagcttttttttttttggcagagtactaggcacatgaggtctaaatagttttaataatagttgccattttattgagtcttaactgagtgttagttagaattttttcacttatttctaatttcaactctattatctttttttgaagtgagaaaaaagggggcttagggaatttactttcccaagctagtaagagatgactgaggtttcaccccaactctgtttgcccccaaagcctgtgctgttaagttctgctgctttttaggactccagggctaagcctagaggcagggctagcaaaccttagtacattgtgatatacatccacaaagtgctgtgacaaccagagaagggagagccatgcttagctgtttcatgggagggtgggctcatgctttgagcttgatctacaaggataaatcagagcttcaagggggcattaatgggtggtatgacagtgaagaaaggaggtctcagaagataaaaatagccttaagagacatctagaaatgggagagaagagtatggtattaagggatggcaggtgggttgatgtatttgaggatttgtgcaattgtacatgtgtgtaagcacatgcatgtgcacgtgttgtctgtggatatatatataggtgttggagattgtgtattgtgtgtgtttctctgtggatattttttagtatgtgagaaggttgtgttgtgtgcgatgtgtggtgagtgacctggtgagaagccagggtgtggctgaatgtaccactgtcaaggaggcggaatgatggaaggagggaggcctattagaaggcgatgcactaatcttggtgagagatggtatggcccaggactagcgcagtgcagagggcatggcgtggaaaaggagatttatgagagggatattttgagatagaattagtagggcttctatctaggtcaatggtgcagctgagaagtgctcagaatgaatcctgtgtctctaggttggcaatttgacggatggagtcctaggaacttaaatgaagaaagtagcagcagaggaagatttggagaggggaggagacggaggtcaatttaggactcagtgagtttgagcagcctgacgttccacatggagatatcagtgttgcaagtggatttggaaatatggtctagagctcagtagaggtatagcctagaggaatagtaatgggaagaaaatatccccaaacagcatggcgttttttatatataatattgcagtagtgtgcttttgtgatcacattgctcttttatattgcattttaaaattccactgaacacaggaggttttctgaaggagtgttttctgcccctgggaaactattggccaattctcaattatccacaaatgagaatccatgccaattgcttttattctttaactggctgctccattttacctagcatggtttttgttttgttttgtgtgtttaaaattttttaatgtttaattgacacaaaattattgtacctatatgggtacaatgtgatgttttgatacatgtatacaatgtataataatcaaatgagggtaattaacatatcacctcagacatgtatcatttctttgtggtgagaacactcaaaattcctgcttctagatgttttgaaattacaatatcttattgttaactatagtcacccttctgtgcaacagaacaccagaacttattcctcccatctaactggctttgtacccattgaccaacctctcccaatcccctatttctggtaaccacaattctactctctacttctctgagatcaacatttttagattccacatatgagtgagattgtgtgcctatttgtctttctgtacctggctttgacttatcataatgttttctgggctcatccatgttgctgcaaatgacacaatttcattttttatggctgaatagtactccattgtattatacattcaattcttatcttggctattgtgaatggagttgcagtaaacatgggagtgcagatatctctttgacatactgatttcttttccttgggatatataccaagtagtgggattgctggaccatgtggtagttctatttttaatttttgacaaatctgcctagcatgtttttaagggtatctctgtaatttctttaaaaaaagcaaattcattttaatatacattcatacaaaaaaacatagaaagctaaatcttatggaggaaacgataactattccaaagctagatggagctagtttttaaatagtacattttctggaattacctttttcacttccttattcttttgttaggaaggtcaggagttgacactttgccatctccacattcaaagagaggtgccatgttgtattccatttcagctcttctgttctgtggttgtgtctctctctgcatactcccatcccaccccagtgttctatttactccagatgatttcttgagaatgtgctcatccttaggttttgtagtattttgcagagaatcttttcatgacaaaaggagaactctccatgtagcccactgagaaactgttagtgaagaaaaaacatctttatctcacaacacagaagatgcaggagagcagcagcctggtggtgaaagtgatgaatcagctcagatttacagattcttggccccaaaatagttcattttcaaaatatattattcagagcaaggcctgagcaagagaaagaattagagctgattttcagctggagattttgtgcccgagaagaaagcctgcactgatttgtaggcataactgaccttggtaggaatgtttgattttcaaatgcagagaaggccatctgttggttcttgagggtaggggaaagaggcataatgatcatctttacagcatgctgtactttatccttggtcagaaacttttgcaggccttgtgccaattcttcagacactatctttacatcggggagtcaaaacttggaggttaaagtaatggctcaaggttacccaaggaattcatggaagaagatagactaaaactcacatctcctcatgtccaggccagcatcctttctattaacctgttaatgtcaaatccctaccattacttcctctatcatcttagccaagctacttagtctctctgggtctcagatttctcatctgtaaagtagaaaaaatgaaactatatcatgggtcactgagaaaattacataacttaagatgcaaggggatagaacccgcacatggtaaggtgctcaaaatatgtgagttccctcggaacaatggggtgaatgttggtgatgtttcttcaatatgttttcaagaagagctcagtggcttataaatcttggggcagggatggggacatcttatcatatggaataagagtgaggagaaaatgcccatcaaccaccaagttagagggagcagagattgtgttgaagggattataaaaatcctcgtgatttttttttttttgcagtgaattttttttagcatagatgaatgtctttgcaatttatttcattaattattcaacaaatatcgtttggctgtcttatgtgccagacacagtactaagtgctatggccacagcagctatcaagacagctttccatgccctcgtagagtttaaaatttggcgggaaagacgtactttgatcaaatagtcacaaaaggagtatataaactcctagcaggatggctcctctgtaatggagtcatcataggctgtgctgagataacctgacccagtcttacaagatcagggaaggctgccctgaagaagtgatcttaaagttaaggtttgggcatagggcagccctgccaggcagacaaaacagcataggcaaggccatgaggtggaaagggatccatgactttggagaaaaggaattggtgcagagcagtgtgagcaaatgggaggatggtgttttatgggagccagagtcatgaactgatttgataattttaaattggcatcagaataaattgttatgaaatgggtggcagaaatatttgaccgttggtcaaagaaatgaaactgagcctagatgagagatgtaaagtggcgcataccactaagttgtgaatagtgattgccttgggaaaatgagcttggaaatgggggagacttttattttacgagtttccataaatttttgaaaaatattttacaacaagcctatgttactttagtcattaaaaaccctagttagagacttttatgcaacaaattggagccttttcaaatcctgttccaggatctacattaaaagggaaaaggctcacaataaaaaaaaattgtgtgagatgacggaaatatcaatttgcctgatttaccatttcacaatgcacacatatattaaaagatcacactgtacactataaatatatgcaaatttatttgcatataaatacatttatcatcaaagttttaaaaatggtggtggtgggatggaggtagcatctctgtcctaagtggtgagcatctaggccaggtgtccaagtcagtggggaagagaaaaatgtcttaggctttctggttgatgacattgggaatgtttaccttgggaaagaggagatttgcataagtaccttaaatgtcattctgattgagttttaggatgagtcacagctggaaggaggaggcagaaaagaaagatcttgacactctagatgatgggccaaatgtagcaacatgaattgtgtggggatcaatgccagtatctttcctgaggttttacaaagccacctgcctgcatacagggaggggagtagccctcaagagcaacgctcatcacaacaagcctccagggtcttggttaactccaagaggaagtcaaaaagtcatgcagctgccaagaaaaggtatatgttgtttgacagcattgatagaaatctgtctagtttaattcttaaccactggtattcatcaaaatcacctgacagtctttttaaaaatatgctcaggccccacccaaactgactgtattcaaatcttggggagaagggataaggaattagaacatggattttggaatcagctcctccatatgggtctctgattttaaaaactgacaaaagactcttcaatgttaaaggagctacaatcttaaatttttaatttctgaaatcatgtttaataaaaaacctgtgtttttatttgattattgaagtaatttttggacaatgcagtcttcatgctaagttttctacttactcaaatcagttttaaataaaattgaaatcatgttgaatgcatcattttgtaatgtgatttcatttaatattctgatatggatatttttctatgctctttagcataatgtttaataggcgcataaactctattatagaagatgaccaaaatttactaaatttctattgtcatatatttggatcttttccaaaatgtttcagtattgttgtttttggagatagtctcactctgttgttcagagtggagtgcagtagtgcaatcatggctcactgccgcctcagcctcctgggctcaagtcatcctcctagcctccctagtagctaaaattacaggcttgtgctgccatgcccagccaattttttaatttttttgtagagatggagtctcgctttgttgcccaggctggtctcaaactcctgggctcaagcgagcctcctgcctcagcatccaaaagtgctaggattacaggcatgagcccactattattaataatactgtaagtgtgtgccactacactttggaggggaatattgatatagtggagtggtcaagatagtggaggtttcataatcttgatattaggaacggctgaaagaactttaatctggagcagacttaggttggaggagtggtgaatatcttcaaatatttgcagggaaatcaaacagaaaagaagtcaatttgttttgccaccctcaaagggcacgactaggagcaattgggaaaaatttcaacaaagcagctttcagctcaaagtaatagatttttaaataatgaacagttttgatgatcttgctttccctatccttagggatgttctgagcatgagttagcatttgtaaagaatataattgagactattcagattcctaaagtgtgtgtgtgtggaaaagtggggataggttaaaatggagtcacaaaccaggagcccgcaggctgcaacccaacagtaaaagggtctgtccagctaatcaacccttctaaacaatttgaattcaaatgcctttaggcagaacattcactcctcaattagccacaagccacgcccttcctcttaagtatttcacttgcgtgcactcctgaaggcatttagtttaccacccctagtaggtactctaaatcctttgattctgtgaatatcatttattcattcagatgcttagtgagcacctactgtgtgtcaagtattgtgcaacctgctaagataaaaattaacctgacagatggcctctctgctctcaataagcatacaatgaaagtgtgtgcaggagtgttgaatgaatatacattggaagaggaaatccgggttttgtaattaactccagaaggtcttaagaccagtgatgatgttaacagcagagagtgctttggcttgttaagaggaggaactttcataatccagttcacaaggaagagaatggaccttgctggaagcattggatttcccccagcagactagtgtaggcagtgccagcatgcacatccttcagggatgatatgaaggagattccagctctgcagaagtaggatagatggcttccgtgtctccttctactgtaagtgttagcagcggaacgtatctgagtcacgtggcaccaaagtatgttaccagaggcaaatctgtacaggtctacagcaacctcaattcttgcctcctcagaagaaagaattcaactgaggggcataagacagaaggagagaccaaggcaggggtgaaaggaaggaaagtgcacttggaagagggccaagcagacaacttgagagatcaagtgcgcagtttgacttttgacttggggtttttccatgttgtcatacctctggggtcttatgttctttcctgattcttcccttggggtgggctgtctgcatgagcagtggcctgccagcacttgggggggaccacatgtgcaatgtgtttactaaagttgtatacatgctcacttgaggtgcttttccccttaccaatccagtgttccagagggaggtaatctgccattttgccttagtgcgcatgcttgagcccattcacccaactcctgagatcttatcaggaagctgctgatcaccagtttcagatgtttctgtctgttgggagactttcccatctattgggtgcctttccctggcactggccatgaccaattattattttagagagacagttaacactgcctgaccatcacctgatggtctcctgacattcctggtgtgtgttgcaggggaggcctctcctactctgctcatttctgaatagctacctactgtaacataaggacctgtcatctttggatttcatgtagaagagctacaagggaagaaagcagcgtttgaagaagatggcaaattagaaaactaacattgtctccccaaaaaagagaaaaaaaaagaccataggatatggagggtttttttttttttttagctgttttctctaccttcagtatttatttggggagggagtgttttacccccattctgatgctcataatctattataaagcatttactgagtgcatactttgtatgcacagttttcagtccctgttctatgtgtccgaagtcatggctttaactgccacaatccactgccttactgatattcttcaagtgagagggtttagcaattttacttcccttttctcctgccttctcctgagtgtggtgttgtctcttctctgttcttgccacttcctgtcctggtctaaactgttgccatcttgccaggactcctcctgcttgctctctccgtttctgtcccatttattcctggattctcctcctcttgctgcctgtcaaccctttctttctttcaccagttttccttcctgctgcttaagcaagtctcctcatcttttgattattcggctatttgggaggcaaactcgttcagacagcaggtgttctaataactgaaatagcagcggagcagagcagtggaaaatagaaggtttcgactttgaattaagagatggagctcttaaaaaggaggtgttttattgatgctaagaaactttaaaaattatcttgccatgtggcctgcttcagctcactgaggacccggacagctgccagtgcctacttggatttgtctccatggaaccgagcgacacactgattcatacctctaagcgttgcttccacttgacttctacaaagaagggtctgttggttttggaggggcatactatttggtacaaagtttataggtaactgtgcttgaagaagctgctcctgaggttgggcatgaggtaatatttattcttagtgacattttcaaaaatatgcatccaaataatgtaactccaaaattgttggtgtagaagttgaattggtatgtgaggtatgtgtgtttgtgtgtaaagagaggggttttttttaatgattattaaaaggctaagatttattaggtgcttcctatgcactaggcactgcttcatactctacatatagcatatatacatatatatacacacacacactatatatatagcttcattcatagtatatgtatatgtagatatatatatgtcctggctggatgattcaccagatgtgtgactttgggcaaattacttgctctatctgagtttccccatctggtatggtttggctgtgtccccacccaaatctcatcttgaattgtagctcccataattccctcctgttgtgagagggacccagcgggatataactgaatcatgggggtggttttccccatactgttctcatggtagtgagtaagtctcacacaatctgatggttttataatggaaatgtgtgtatatatatatatatatatatatatatatatatatacatacatatacacacacacacacattaagtaactctagtgatagcagtatatatatatatatatataaagtaactctagtgatagcagtgtatatatatatatatatatatatatatatatatatatatactcttctgaggactaagtaactctagtgatagcagtatatatatatatatataaagtaactctagtgatagcagtgtatatatatatatatatatatatatatatatactcttctgaggactaagtaactctagtgatgcagctttacgctcccggaaccgaaacgaacagaccnnnnnnnnnnnnnnnnnnnnagtgtgaggagatctatatggtatacaataggacttaaccttccatttatcaatataatttcactaattcgattcatactctatatgtgtagaatgtgaggtttttttattttataatctgaatctacctatcagtatttggatttccctctacctctctttctttactctatttcttatatcgatttcttattttattttgtagtattttacattaatattctacttatttccattcctatttcatatcctactctcgttcttctttttttttcttcattctttctctctcctttttctctttttcttaatcctcttttcttatcatctattccctacatctcttcattataactgtctctaagtcctcagaagaggcctgggaaagtagtagtgctattatcctcattagttcagttcagagaagacaacttgcccaaacataaacaaacagataagtactacaacgaagcctccttagatctactaggctccagaatcttcatgctgaagagaaactttgttattttgaggcaaatgagataccatccatgtgtatagttcttatacctttgcaagctgtttcacatatatttggattttattctcaccccatgaggtcagagtgccaggtttcactttcctctgttttgagctaagagggaaactaaggttcagagaggtaatggaaacttccacacgtcacagaactagttagtgacaaaagtccaaagttaactcagagctcttgggcccagttccctgtagcatgccaataagaccactaatccaggctcctgatctcttagattaaactgggcaagtctgtatctcaacttccccagtgagtaggagttcatttagcaaatatgcatcgagatgtgatgaatgaacagtgtgtcaggcatagtgccaggctttagtgtgatagtgacagataatacatagttgattctggctgggcacggtggctcacacctgtaatcccagcactttgggtggccgaggcgggcagatcacgaggtcaggagatcgagaccatcctggctaacaaggtgaaaccccgtctctactgaaaaaaaaaaaaaaaaaaaattagccgggcgtggtggtgggcgcctgtagtcacagctacttgagaggctgaggcaggagaactgcttgaacccgggaggtggaggttgcagtgagccgagatcgcgccactgcactccagcctgggcaacagagtgagattccttctcaaaaaaaaaaaaaaaaaaaaatacatagttgatcctatgttcacagagcttacagtctattgggaaaaatcaaatgattaataaagaaattgctataaagtttaatgtgcattaggatagcaaatggcaggagaatagaaaccaaatctaagattctaaggaacaagaaggagtagccagatggagatgtgggacaaggttttccaaaaaagaaacactttcagcggagtgatgagccaaggaaaacacttactatagactaatagagataggagccatatggctggacgccgtggctcacgcctgtaatcccagcactttcagaggccgaggtggacagatcacaaggtcaagagatcaagacaatcctggccaacatggtgaaaccctgtctctgctaaaaatgcaaaaattaggcatggtggcacatgcctgtaatcccagctactcgggaggctgaggcaggagaattacttgaacccgggaggcggaggttgcagtgagctgagatcgcaccattgcactccagcctgggtggcgacagggcaagactccatctaaaaaccatcattctcggcaaactatcacaaggacaaaaaaccaaacaccgcatgttctcactcataggtgggaattgaacaatgagaacacttggacacaggaaggggaacatcacacactggggcctgttgtggggtggggggaggggggacggatagcattaggagatatacctaatgtaaatgactagttaatgggtgcagcacaccaacatggcacatgtatacatatgtaacaaacccacacattgtgcacatgtaccctagaacttaaagtataataaaaaatatatatattaaaaagaaaaaaaaagacaggagccatagagactggaagtcagtgaatgagaaaacacagtcatgaggcagtgaaggtgaaggaaagagcatacatgaactttgctcatagacaagcgttcaaatcctggctggacgattcaccagctgtgtgactttgggcaaattacttgctctatctgagtttccgcatctggtatggtttggctgtgtccctacccaaatctcatcttgaattgtagctcccataattgcctcctgttgtgagatggacccagcggaatataactgaatcatgggggtggttttctccatactgttttcatggtagtgagtaagtctcacgcaatctgatggttttataacgggaaactcctttcactcggctctcattgtcttctcttgcccgccaccatatgagacgtgactttcaccttccaccatgattgtgaggcctccccagccacatggaactgtgagtccattaagcctctttgttttgtaaattgcccagtctcaggtatatctttatcagcagtgtgaaaacgaactaatacacaatctgtaaagggagatgttagtaacaatacctgactttcacaaggctaattgtcaggcttgcaaattatgaatgcaaaaccagttctggcacacagcaccactacccaccagcttctcaagcctgaaacttgagagtcatctttgatttctgattttccttactctacccccacacaacagattggctagcaagtccttttttgtactcccccaagatatctcacagatttcttcacttatctctatccccagtactaccatgtgagtctaagccactgccatttcccacctgcactacagacagagcccctaccgggtctccctgcttccactctctgctccatgtaacctccaatccattcttcacactttagctagagtgatcttctaaaaacatgaagcacttgtcagcctgctgcctcaaaccctccaatcatttcccgttgttcttagtagcaaacgccttaccaagactcacctcgcaagatctggtctctgtgtgcccacagcctcgtggcccactccttgcttactaagctctggctgcaggctagctgcttcgtccttccagttttagctgatacgtcatttcctcagagagggtcttctctgaccactccctctaaataaggcctcctttcttcattgctaccatagtgccttatttttttcattcccagccattattataattagtcaatatacatttatttgggtgcttactagattaaatacctaccttcctcattgggttggctgctctttgagacccagaactattctagtagagacttgatgaatttctaaattagcagagaaattaaagttgggcttcaataaatgataactattatttattaatacctgtcagagagacagttgtgaagtgtctgcttgtgagcatttgccaagaatttctgtctccattatttgccttaatttccaaagcagaaagcctgacggccacatagaaggctttaccctggcggagaaagggaaggtcattctgtctcagcaggtctactagagaaagctgcccccaaagcccctgacattggatccatacaatacataatttctaggcaagtccttggtatgtctttttgttgctgttggaaactccaggacccaaggacattcatcactggagaagtgggtgcgcgcgcacacacacacacacacacacacacacacacacacaccagtgttagcagctggcatttctgcctcgaggattttacatttacaaggtaataataaaaatggtattagaaacctgcagacggtctgtcctatagagataaatgttgattgcaaactccaacatgaaagtagaattgactagaagagttaccaggtaatttaaggcccaacagttgatgtccctgcagataccttggcaagtcaattctgttttatttcagagaggaaataaaacttgcctgattggactttctttcccctgatagaaatgaggagttgtcacagtgaaccatgagagccaaggctggcaaggctggcaacacacgccagagccccggcttctaggatgctgtctttgaacttgaagtcagggtcaagttttaggactcccagtttgttggctattcaggattggtcagttcttcctttccagacagcctcttacctcttagtgaatggggctctgaggtatcttttctaaatgtgtgcatttaacagtagagctttcaatactgagaagcagtgaaacacagaacaaggccagtgatagagtgatgattttcagcaattggattctctaaaacaacactatgcaatagaacttgctctgacgatggaaatattctatatctgtgctattcaacatggtagccgctaggcacatgtgactgttgagcccttgaaatgtcatctagtgcaaataagaaactgagtttttaatttaaatttgaatcactgtatgtggctactgattaacccattggacggcacaaacctaaaatattgtatgactgggtttgaaatagcaagaatgatgtgaggacacaaaggtggagtgagaatatttaagagaagatagctgggtgcggtggctcacgtctgtaatcctagcactttgggaggctgaggcaggcggatcacctgagatcaggagttcaagaacagcctggccaacatggtgaaaccctgtctctactaaaaatacaaaaaattagctgggcgtggtggtaggcacatgtaatctcacctacttgggaggctgaggcaggagaattgcttgaacccaccaggcggaggttgcagtgagctgagatcgtgccattgcactccagcctgggcaacaagagcaaaactgtcttctcaaaaaaaaaaaaaaaaaaaaaaagaaggcaccccaggaggtttaaccaaggagttggagagggcatatccctggtggttaagcacatactctggtgtgagtcagatctgtattcaaatcccagctctgtcacgttctggcttggaatttgggcaagttacatctccaagatccacatttctcatctgtgaaatgaacataacaatagaacctactcccagggctgttttaagtatgaaatgaggtctatatgaaagtacttaatactgtgcctggcataagttattatcttagcaactttgacattatcttttaatatgaaatatgatcatcttgtatatctaaacccacaactggatagcagtgttggtgagctttgtgatcagagagaaaaagatagggaagaaccaagacaaacttttcctctgccagaactgactggtctcatgtgactgtgctgaagtacacctataagcaaaaacatactgccatgcctccttagccatgaatagcaagttatgccactgtctcatgaaatagatgttctgtgacagtgcactacactggaccacttatagtataattatagaatgaaaaatctggaagagatcttgaagaccagtgattcttaagctttcatgtacaaacaaatcatctgaggagcttgttaaaatgcaagttcagattcagttggtctgggtggaggccaagattctgcatttctgccaggcccccaggtctcccaaaggctcctagtctaggatccatacttagggtaacaaggtttcagagcacctaggtcataagaccaataccctctttttcagatagggaaatggagacccacaggggtagacctaaggtcatgggacaatgagaagtagagccaaggctaaaactaaggtcccctattgcctgctcccctgtcgggggcacttttatacttcctcaggtggcggcagtgtcttgcattacatgacactcagcagtttgcaaaacgacattctgtcatgtcctttttccatttgtcagccaaggataaaaaagggcagagattactccactcattcatactatcctggttggtgactgctagttaagctgcagcaaaaattccagtatgctgactcttctcccagagtaccttccattatatcacagcacctctgttgcttcatttttaatgttgggaaagctccaggctggatatgatgatggccaacaacataagactttataaggactttggggtcagtctgcatagcagaccatgcagcaaaagcatgaaggaatggaaagagtcaggtacctcttttttttcttttttttatattacaagcaagattctagaggcattttacaagctgagcaataccttaaaggttatacacaagctatttcctggaggtatgttttagtcctaggcaacctaaaattaatgacagctcttattaggaaaggtggaaatgaagcatcaaactatcagggaaaagaatacatttccttggtaggcctgagatgcacagtttcttaaaacaacttggtgggagagattgaaacttagcacaattcatagccctatcactgactctaggtgaccttgcataaaggcgtgtttctgcttgtgcacatgtgtgtatgtgcgcatcacacacactgtctccctagcttcttcatatgttcagtggcacactcagttcattttgtcatccaccaaattcacaaatgtattttcaggatgagtaaaatgttatctgcaagcctcccagaaaattctgaaagagttggcctttttcttgatgttacttctttattggctttattcgccaaggtagggatttgacacttttctaggtcttttccatcatgtgatttggattctaggaaataaataagaactaggaagtcagactcatcgagctgccgataattaagggaatttggggcctctgcttgtcaggtgtagatcacaggtgaagcaacatatttagagctcccagttggcaaacacagccttccccttaagccacatcccctctgcatagtctcaacttgttgggatgcctggttagccagtaaggtatcatttacgtaaaataccacttttaaaccactccatttttttcctagggtgcaatttgtactacaggctcatctgctttaccatattccattgctatcaatgaatttcttcataagaacagtgcaaacacagactcattgaataaagagggctttggtgagagcaaaaattaaagcatgttagacaatgtcactccatcttctgctcaaatatcttggataaatgaggaatgatctatctgctttccattttcaaaaccattgatttttgttgcaattagacaacaaagagctagaccaggcaggatcctttctctacttttgaaaacaacattcaaggatcccagctgttttattgactttctctaatgccaagagttggggggaggggtgaatgttccttgagtcagcatgccatcattgctgggtaaagagaaggatgcttctgcggtctagggaaaggtttgcagatgacttcatgcacaaatggctcagggtccccaaatggtttctgtgtcctcaactttctatgtaataagagccatggatatttctgagcacagtttgacctgcattctattgatctaagcatttggctaatcactctctgcaattaaatccttctccttgcaataaagttaatctcttcccagcacataaaatctgacctcacagcttgaggaggagaattgccgttgtttatggtgccatcttgggacccaacagcttttttctgaaggctgaagcaactcttggagtttgagaaattatattcccctcaaattaaattattagaatgcttttcttcatttctggatgtgaaccccacataggctgccttgtttctgcccagcctcatttcttctccaggactcatcatggagtgtgaagcattaaacatatgcttctcctcaggcgacctgctcctctttgatttcaaggccattggcacatattttgcaattattctgtttaccagtttttgttccagtttgaagagattcatgtctaatatataataatatcagaaaatccacagtctccatcctcacttcagtttaagctttctaagggactcctcattgcttctaaacagattctgattttgtctttctaaacaacatcagaagagtcagtaatccatccggcaaatatttattgagtgacaagtcacaaccctggctctcaaggtgtttatgttgttattgaaaatatagtcaatttaaaaggcaatggatcagagcagggttagaggggatggaggggagagggcaggcaacagaactacaaactttgtacacagatggccttgggttccagtcccgggtctgccagatgctagtagtgacacctggagcaagtcactggtcttctctaagcatcggattcctctcatctttaaaaacagagatgaaagtacctacttcattgggttattgtgaggattaaataatgtatcttaaaatgcctataacaatgcctagtgcataggaagtagtgctcaataaatgttagcaataattataattatataatataattttttttttttgagacagagtctccctctgtcacccaggctggagtgcagtggcatgatctctgctcgctgcaacctccacctcccgggttcaagcgattcttctccctcagcctcccaagtagctgggactacaggcactggccaccacgcccgtctaattttttttatttctagtagagacggggtttcaccgtattagccaggatggtctttatctcctgaccttgtgatctgcctgcctcggcctcccaaagtgctgggattacaggcatgagccaccgtgcccaaccagcttaactatataattattacctgatttcctcacaacaactacatgaagcaagcactgttatttctccctactttgcagatagaaaaaccaaggtctagagatgcaaaataatttgccaaaaaccacatagtttataaatggcaggctttaacccagggatgcctaacttggtcttgtattccttaccattaccccagggtgactgggctaagctttccttatatttttaggagctgcacatgtcatagggctttgaaaaatttaacttgctaggcctgctaatgatgacttaaataaagctgcatgacttagctagaatataatattttcaaatattcattctattgtgtttttttctcctgatacccagtatttcttttaacataaataaattttattaaatgccgaattaaaactggttagattctcataacagttctcagttctgaatttaaacttaatgttatgttaaaatattaatgacctttatctttaaaagtgtctaaattgtactaaagttaacaaatgtggctgataatccccagcactctcttagaacattccctgacatgaggcatttgctggggcttacatagttctaatgtcgggtttcaggcagcactgagaaatacaaaatgtggggaaattttgcattacaaattgcctggggatttgatctcctaatacttaaaaagtgttctaatttcagctaaataatagtagctgtaaagcatttaggtgtggatggcattaggcatgcgctctatggaataaacatgttttggagagagaagtagcatttggagcatatgaagggaacaattcataagctgaatttcactcctcttgtccctgtgtatcctgctttctctgacatgaacattctttatggctctggttccagctccttgaacattttattaatgttgatagtgaggacaggagtaaaatttatccgaagcttagttctaatagccaggttggactccttccaattccccagaagtcctgtgggttcaaaatacttgcataactaactagtgctggcttctgagccttggggcacaagttaaaggcttgatctccttttttgtaaacatgtcctttatggaaagacctcactatatacttatcccatccccaccatgatatggagtgtccaagctgaggaaaaactgtttaccaacctgctgacaaaaccctacttgtaggaaatcccatgtcttatctggctaaataacttagaccatatgttcaggtcccagagcctgggattcttcagaacaagctgaaatgtgcctatttgcatcacctggggatactgaaattccaagcacaagttcattttcacataactcattatgctcccttggatttggtgcttaatgtgaactttgacaacagatggaatgagatgatgcttcaggagcacttactaattcttttgtgctcacaaatacacacaaatagtgataatatgcactcaaatttccaaagccaggcagtgccctcaggtattcatttgccacccccctgttgagttcttgggtagaatttaattatccaacaaatttggagatagctatgccagatgttaggtactgacctagacatttccaatggaagtatccaatgcattctagagagagcagggaaagcaaatttgggaaataagactctggatgcgagaaaagggggcgtgaaactgggactagagcatgaaatttgtggtgacttcctcagtcagattgttactccttaagctccaagaaccattgggtgtttgtgtgggtcattcaggaaggtctgagaatatcacctctgcctcagttagtcataaagaatctcatcatttggacccagccgaggacacagcttttgtctgttcacaataaaaacagaattaccccattgatttgaatgacagacacatgcagctgctcctccctttcattccagcatggttaagtggggccacttggagcactaactcatcttcgaatttgggcttagctctggagaagttgttattgcaattataatttgttattaataaaatgtattaacgggattatgataatagccagcatttattaagtggggattctgcaccaggcactgtgctaagcatttgtacatccctttcactctcatagcacccttattaagtaggtaattgtaatatttccattttatgggtgagtgaataaagctcagtcttttaacataagtgcctaaggtcctacagccaataagaggcagaggcaggcggcctgaccccacagcctgtatcttcccatcaccctcagcatgaactgtatttactgatggtgatttccccatccaagggcatcttctgtgctccagtctccacttaaaaggttataaaggggccctattctttttctagttttattgtatatttgacagttaaaattgtgtatatttaaggtatacaacttgatttgatgtatgtgtcataaaatattagccacagtcaaattaacatatatatcacctcacatagttgcctctttttctgtgtatatatggcaagaacacttaatatctgcccttttagcaaatttcaagtctacaatacaataatgttaactatagtcacattgctgtacatcagatcttcagaaattattcattttgtataactgaagctttgtaccccttaaccaacatgttctccttccccaccccctcaggccctggtaactgctatcctactctgtttttatgtttagctattttagattccacatataagtgagatcatgcaatatttgtcattctgcatctgacttatttcactttgcataatgtcctccaggttcatccatgttgttgtaaatgccaggatttccttccttttaaaggctgaatgatatcccagtgtatacacacatatatatacatgtgtgtatatgtgtgtgtgtgtgtgtgtgtgtgtgtgtatgtacacataccccacattttcttcatccattcatctgttgacagacatttaggttgcttccatatctggctattgggaatggtgttgcaatgagcatgagaatgtggatctctcttggagatcctgatttcacttccttggagagcccccctattttgaacccctagtcattcctaccccatccaagcacagctgattagaccgaagggcaggagtacagaaaggtaaccaatcgatagatgggcttatgactttttatgtgacctagtccacccccccaccccccaaaaaaaattagctgagtctatcagatttcttctcttgggagttgagaccagaaaaaaataccatcagggtatttagctctgagaacttaaggtgaaatgagactatgagagcaagtctgagctgtgaagtaatgaggcagcagtggctatgaggaagcagagaaaattaatttggtagagacagcattagagagtgccctccaagaagaagggtcttgaggaggaaaagaaatagccagcagcctgggatgcccctaaccttgatgccattctggtaccagtacccggggatccttacaatacacagttgtgaggatgaagtgagataatttatataaattacccaccagaatgcttgatccatagataggtaatcagtacaagtcagtaatattatgtttattattattatcttttatttatatttatcttttatttggaaattacagaaaatcctctcatttccaattatcaagatgcatggacctagagctataaaaatccatattatttctttcatcattgaattgacttccttaattgttataataattcaaatttcagcttatgattatcgtcttaggttttttttcagatcgattccacacccactaatgaactatcgtgttgagcaatgggagagcaattcccataatctgtttccctgcaatccctcttctgatgctaatgagaagtaccatggagacatcagccgttagtatacatgggctggtataaatcatggactatggatcattgtgcatctttgttgtaaaacaaatggcctgtggtcagttaatcatacaaagaaacatctccagggcctcctggctttactcataacccctaaattcgtttgcagttttataaacagaacatctgttaaaatatgcagaaattacaatcatagtcattagcagagagctatatagctttggcagattttttcctaagcttttgatggtgatctcctctatctgtgattcatgcttcattcccagtcttgctgaatctcttttgttcacctctgttcttttgggttgcagcacttttaacccaaaactcatgagtggacatgtgttgtctcaggctagattggcaccatgccattgtgcagcatggcagagtgactgtagcctgtcgatacctccttacaaaaccgtatattttgggtgtgcaatatgcatatcttccagcagccagaagctgagaaaccctaattggtttcacacctcttttactgaccttggactcttacagcactggcatttaaccaaaagtaaatagagctccccactatcaccagcagcagcccaaatctttcatattcattctctttctgtctttctgttaaaatttgtactgtgttaacaatttaaattaggctagtgcaaataacatctaagtcaaagacaaggagaaatatgttcatcgctagaaaacaagatttgctctaagaacctaggttggcctcctcattgtttagtgaagaaatcataactccatctaagaactggggagtaagtaaactttctttggccattgctttgttctggctgccccggaatgggaatcagaggatattttctacagaaattaaaaagtcacctcggagtattcagtgtatctgtcacctatttttatatatatggttttataaattctcaaagtcactctggttgagcctgactagatccctttaaacaggctcacaaggaaaaagaagacagaagtgaagtggctaagatagcaaattctgaggtcagacagacatggacctgattcccagatctactatttgttagctgtataccctggagaaagttaattcctgaagctacaattcccttctataatattagtgcctacctcatcaagttattgataggattcaaagagataatccaagcaaagcatctcgctatgtgcctagagcattcttaagtgctgagtcaatattagttgctactgttgataattttgtttgttctcagtgttaatgcactgttagattatgttaggtgttgattttatcattggtaaaacattctttttgtaaagtacttataatatttaaatgatagcattcatttgtctaagaataatttaagctcctgctctaggctcagtatgctggtgagtgctgtatggtgtgtgaagatttatcttctgcatatgcctatcaatgggtataaatcatcttagaatgtattacagagaaaatccaaaccaagtactgtggaagctgtggattagagaaataaattaccagctggggaagccttcatcaggggaaggttaaggaagtcagggttaaggcaggcttgacagatctccagtgatacgtgagaggagagaagagggtaagtctccttggaagatgaaaaacaaaatgaggcaaccgagtgaaagaaattgggataaagtagacaaggaaagggccaatttgccttctgggtgaatgaaaaagaattagagggtaaaagccaattagaggctcaaaaccagactcaccaagtccccaaagatactagggataaaaatggaaagctcctgaggaggagactaaaaataagacaaatgcctgtctcggatggagtagttatgggaagggagactctgaaaggagattgacggtttgtttgtctatttctcagcctgtacctgagacaagctccagttttctgccgtattcatggcacttactggcacttgtggctgcacagctccctgccaacctctgaactccaggagctaagccagctgtctttaggcagccgctttcttgctttcaaaaggaaaattgcagttgtgcgttggagtcctgagccccaattaacatgtcaggctctgaaacaaacaaatacagataacaaagagggagataatgttttaaaattaggttctcaggagtcccccattaatttggagctcaccagacagttactgcatgttcaataaataccatttgatgacaataatgtgcttagctgctggtagtcggagatgcccagtagataggtctctttaagcacgaggttacaaatataccttgttatatcatattcagcacagatgcagagtctttcagctttacagcttttgtgagtattaatccctccagaggccagaaagatgggtgttatcatcctcctgctaaaaataaaagaaagcaggcaagttggtttgaaaaatccagatggtgagttcaggatacatggactcactgtataatgttcagtacacacaaaaccactgcataatcaaatatgctatgtaaatacccagaggttgtttagcagggtagcttgtggaaatgaaaaaattagcaatagtggcatggattttttaaaaagcaattatttgctttatgtgatgacaagaatccacagatggtgcatccttaagttcttgagtgtcttgaaagctaaagcatgattgtagtcacactacaaataatagctgaaaaggggtatgtaagagccctttattctgttgatttcagtggaacagtgcctgttattgtatggatcatggtggagcactttcatgctgtgagaacacagtgggaacgttgagagctaacaaagggtcaactcccaaaacttttggaagagtttagctgatttactacttccaccttaaaaggtggagaacttatgggatggagttacaggctggtgaaatcaagctgattcttctcattgccaatggtggtatattaagtcactctcactactataaaagttcagagtggaccttaattagtagcaataatcacaaggtgatggtactcactaagaatcaatggcctaactaagaaaaaacatgtgcttcctggccagacttagaagctacaaaacaaataatggtttttggcagtggtaactgggaacagagacttcctaaatttggcttgattagtttccttttctaccctaggtttgtaaataggacttcccaaattgtacatttgttcattcagcaaatccttattaatcatcaattatgagccaggtcctctgctaggtatttgttggagaaatagtatattctgtggcttatctttagctcagagattttgccttatttgccttacctttccccagggcccttggcacagtatatggcacattgtgggcactctgagtgtaaattaaaagaagaagaatgtttgccatttgtagctactagagcagtcagatgccacggaagtggtgttctatctcataataacttaaacttatcacttggtaaaaagtgcattgcacataggccaggtgggtggttttaagttctgctcactctgtcctttgtgatgacttctgtttgtgatgactcgaggaacagatatgtatacacttggacgtatgggagcatacgtggacctatcatgaagattctcattggtttttttcattgcccaattggataagaacaagatgcttctgcattttaaaatcctcctcagatgtcatatcattgcaatgacatttttatatgggtgttttctgttggtgtaccattgtttgagtcagcagcaaaacacactgaatgcctacagtggaagaggtgaaacagagatgcttattaggcagtaactaggcagctgagttcaatagtgacaaaacgtagggatagtctatatgcaggcatgtttatacccagttgagcatagataaaaatgtgcatagataaaaatgatagtcactaatgatgacaaagaatttttatcatgtgccagatactacgctggtcattttatgtgcgttattccatcgaatcttctgttttttagtcatgcaaattgactttttcagctttgagatgtaattgacaaaacagtttgtatttaagttgcacaacctgacgttttgatatactatacctagtgaaatgagtccacaatcaagctaattatctatcacctcacatgcttatgttttgtggttttttctgttttgttttatgcatatgtgatgagaataacatctactcttagcaaatttcaagtatataacacattactaactgtagtcaccatgttgtatattaggtctctggaatttattaggccaacagctccccaatacctcactcctcaacccctggtaatcacccttctactctgtttctatgagttcaacttttttagatttcccatataagtgagatcatgcagtattgtctttctgtgtgtggttcatttcatttggcgtaatgtattaggttcttccatgtggtcacaaatgggagggtttccttttttaaggctgaataatatttgttttgcatgtataccacattttctttattaattaatctgttgatagacacttaagttgtttctatatcttatctattgtgaataatgctgcaattaatatggaagtttacatgtctcttcaagatagtgattttatttcctttggatatatagtcagaagtgggagcctatctaatctccttaacagtccttatgaggtgggtactttcaccagccccattttatagataaagaaactgataacctgcttatgaccattgcaactaagaacccattttcttaatcactacactaaattactatgtaagtatttaatataatgtgattaagaaattatttctcctttgcccccatattttcattttgcacaaaaaaaatagggggcaggaggaagacaccactattcattgtcttgattttcctgttttagaaattagtccagtcccatttgattgcctcccagtggaaccaataaattggatgagtcagtggttctggaaaaattcttaaaataaaactgcaccatattaatatgattagtcatatcactaaaatagagacaattcataagggctgttttcaaaaccctaagtaaaaacataaagcaataggatgtgcaaacagttggtaatggcatttggtattgaaggaaatcatttgtgcagttacctttgattcaagcaaatatcagctcttttttccatgtttttctgggcttactcaactgtagaattattggagttatatgcgcatttctgagaagctctgtacttgtctatttagtcagaactaaaaaggaagtgggcattcatagcaacccattttatttatagctctgctgtggcagtttattgtaagtacagtcacttgttagcataagttaaaagctattacactttgattgcaactatcattaggtaaagttatctgaataagcttgggtctccactgacaaatgaaagatgtaaatttctcacacacttttaatgagtaattagtgcaaacctaccatttgctctgcaaagttcaaggttattttatttactaacatgactaaataaaagatcaatttcagttcaagtaggaaattgattatgattgacaaaagaagactgaagaccttcataaagagtatcaaactattttttcaagctaagctgtagtcattagccatgtacagatatctttcttcagtcacaatcctacttgtgaagttaagataaaggccagttttattggtctttgggaatggagagttattggacagagtcaaactaagtctattttctataatagcatttctcaaaaagtgttcagaatttcctgagatatgtgtcaaaatgaaatttctgagctctactcaatatctactgaatcaatgtctaggcatggtcacctagaaagctgcatctagtgaatttgactaagtgtggggaccactgagcaaactggtctccctgtgtttagatacctcagcccttacctttgtctcagcattgtagttgcagctcagtataaccctagagacagggaactgaattcttttggctctgttgcccacacttaggtcctttatattctcgttatttctaaccctaaacatgtatcagctgatttaaaaattccacttgggaataggcagcaatattgggtgacaggaacacagactctagagtcagactgcctgggtttcagtcccagctcagctatttatgtctttatacacaggtgagcatatatgctcttggccaagctgttgtgtgatcttaatatccatgagcctcgatttccttaattataaaattaggataaaaataactgacttaacaaggttatagggattaaataagtgacttaaatgaattagtacttggatccactgttatgtacaattctccctttattatttcatctactcttgtgacttgaaatagtatctatatgtcagcaactcccaaattcatgtttttagtccagtcctgaattccatattttcttatgcaactgctgcttcaaaatttctatttggatgtctaataaaatatcgcagacttaatatttccgactgaacttctgatcatctcctgaacaaacctttttcacctacaactgtcccttcctcagttgataacaacttcatccttctagttcttcaggccaaaaaccttgcagtcattctttattcacactccacatgcaatgcatcagaaaatcatattggctctatttttaaaatctacccagaatctaatcttttttcatcacttccactgctaccgtgctgatgcaagcaagtatctaacatactttgttgtagcagttccctgcttccacttttaccactgacccccaaatctcttctccacacagtagccatattgattcctataaaaaattaggtcagatcatgtcactcttctgttcaaaatctttcaatgactccccacctcacccagtgtaaaaaagggcccttatgatggcctgcaagaccctacatcatctgtccttcggtttattctctaacctcacttcctactgctttctgcctgtcccgtagccttcttgctgctgcttgaactccccagtctggaaggccttaacattggcagtttcttctacctgggctgctcttcttccagacatctgcatagccaatttccttacttcttcaaggctttaagtgttgccttttcaatgaagcctttcttgagtacctatttgaaattgaagtccccttgcacctttagtctttctgatctgcattaacctattctgctttcccatagtcaccttctaacatactacataccttacttatttattgtttgttacatatctccctccaccagaatctgtgttccaaaaggacacttgtttgttttgttcattgttatacccccaacatcctaggacagtacttggcatatagtaagtggtggtcaactacatgttgaatggatgaatgcatgaacaatgtggcattgactcagaagatagtttataatttcccacaggtttttggctgggctcttgaactatttaacattttgtcactgtattggccagtaattttttggttaaacaggctaaaaaatcctactaaaagtttgcttaatcaaaaattaggcacacacaccttaaaagatctaaagaacactagttttgagtaaggcttgatctagagcctagctatgttacccgggttcaatagtctctgtcctctgctttctatgtagacccagcagctgttccagcctctttgtggtagaaaattgtctgccatagtgcagggttccacatctccttaaatccttaggaaacatctcctaacatctcattagctctgtttggattctgtgcttatccctaaatctattccctatattcagtaagatggaatacctgatgaattaggccaattagggcctcactctcatgtggcgggaggaatcagcacctctcaaattttacttgaggataagaaaagggaaagtcaggggattattggcagaagaagaaaagaatgggttgctgggagacagccagtggtctggtataataaatagtagtgagtgtgtgcttattaaattaaatatggtagcataaggtttggggattcaagccaaaataacatatggaagaactgatggatttcttcattcattcaagaagtggaatagcatctgcaaaagcacagaggtatgaaaatgtttgacatgtttggagagctttgaggagtgagtgtgaagagagtaaaagtaatatgttggaatcttctcaatgtagcagtgaaaatctggacctaactctcattggtccaagttggatttttttttaatgcctgaaccaatcactgttgccaggggcagggaatatgccgattagctcagacctgtaagctgtacagacgcacacgcacacgtgcacacaccacacacacatacacacagcagattgggctgaaaaatgaaaaataatattttcttaatagaaaaaggggggatcgacactgaagagttataagaagcagaaaaagattggcaaaatatctcagaatagaccaatggactaagatatagcagtatgatagttacatgacattgaacgtggtgctaatgtaagatatggtgtgacagttgtaaaattccctgccacttttcaaaaagacccgcaccattctactccttactttttgtgttatatatatgtccttccaaaggacacaagaagagaaacaggtcctaaaagataggtgactgggcatagttgagtccttcctttgcaggtagtctctctttgccttttcttctttttcatcttcctttggggtgttttgaatggagaaaaagaaagcctaaacattgaccgatttgcagcattcgttgtgacttttgtcctttctgctccacttgtgtatctactctagtatagttcagaatcaaaatgtgaaggtctgactgttcctcaagagttcattttattctgtccccaaaacactgtcccactttcttcctcctctcttcaatgctaaatggaatgtggacaatcataatataatgcttcactcttcctgccattgtaggattttcagagaagaaaatctaggtgtctgaggcaagagaaggagagtgtgaggtttatcacaggtggatttatccttgggagggatattaggcaatgctgccttatggctcagtgcaggtgtgctcagaggtgaagacagacattggggtatctttctgtacttgttccaagtccccatcatatgctcatccccctttgtgcactgatctctgttgccttgctggcgtaattaagcgctcccaatgctactgccccagtttctagtctgtgggtagaaagagctgccctcacccgtgccaaccccccagcatgttccctcattaaatcatgcatatgctaatgaagtgtgaaaatcagccaaataacaactctttctaatcacttaaggtcccaagagcaaagggcttttttcctgttctcttaattttggggtggttgttatgattttcaagccaatcggaagcacaattctctggtgtttctcctctcccagttcccttccacagaaatgagggtaattggcattttcacttctatctcaagtgagaagagtcttcaggaaaaccagtgacccactgtgcccttttcatttgcatctggggctggataatccctagttttacattcatacacagagcagtcccgaagggcaattaactagactacattatttcctgccccctggagggctagtgtttgagaacatttcccccagagatggggcatgtcaaggcccttgtgttgtgattacattttacctctgcatttcagtcaacttccctgagactttgcccctctacccattatccttgcagacctagttatgttctctgtctccctgatctggcccctgcctgcctgaccatctgctacatccggccatttgcacatctctcttttttcttcttggaaaggtttatccacagacattcttatgtctggcctctttttatccttcacatttaggctcagttgtcactcctcagagaggtcagccctgaccacctatttaatattaaatccaatccattatcattatcttataccacctcctctttattcccttcagagcccccatcactgatacagtcctatttcttagatgtattgcctctctctccttgagggcagggaccatgcccgtgactgtctcgtttgccataacatcaccaggcccatagtaaatgctcagtaaatgtctttgcgtaaatcaacagtgttttccaagtacctttgagtgattttcatgttgaagtataaggttttatttctttggctgtttcacctgagactgctccagagattttgttgtatttttgtatttatatttgcttctctatgttaagcatgtgtgatagctatattattaatactgaccatgttactcgattctaaaatcattgatgatagtgaacatgttactgaaagttttatggagagactgaaagggttatgtcacatacccaacatcttttttcttttccaagtcttacccatttgccccccaagtttttggctattttctcttgcctttccacccacatattcactcagaaatcctccttcctactcttttgtcaagacacaatcagctgttgccctcggattccaccctacagagcaaaacaaaagcctcacagtgatctcaacagtggccaccttttgttcctggagcacgctccttagggacctgagttcattccaacatatttgaatgaataaatcactgcatagatgttatcttggtcccaactgatctgagcccttttttcattttattcatttattcaacaaatatttaccaatgtttgtgccaggtgctggggtacaacagtgagcaagattgatttgctgatgctaaggtctctggaagaaactgagagggatgaatgaatttagaggtctgtgtgagtcaaaaccccaaggcagagagttttgtttctgttgttgcagagtgtttaagtgtaacccaaaggattatatttaaagagtacccttcaccataatttttgttgttgtgttgttgagatagagcctttctctgtcacccaggctgaaatgcaatgatgcacgatctcggaccactgcaacatctgcctcctgggttcaagggattctcttgcctcagcctcccaagtagctgggattacaggcatgtgccaccacgcctggctaatatttgtattttcagtagcgacggggtttcgtcttgttggctgggctggtcttgaactcctggcctcaggtggtctgcccacctcggcctcccaaacgtgctgggaggcatgagccactgtgcccagccccaccgtagatttttaaagtaattttccaaattacttaatgttaagattgtaggttgctctgtccaacctaaacctccctactttggaggttactgttccctttttttttttctttaaaccagggtgtgctaaagaaaaaaaaaatgtggctggtgagtgtggaatttaccattatccccaaaatttgggcagaggagattgaagccaagctatattttttggagtctaatatggatttatttttcttcctcctccaagacaaaatatagctagactcagtagaagacactatatatccgaaccacatgagaaaactggaggcaacttgcgcaaatgctcacacaacggcatggaggaggcagagggagggattctcatttccagctggaaaatcaggcttccaccaagcctgctcagttttgactttgcctccgaaagcagacatgagaaagacagtttgtcactcaactccttaactatagtagagagacagagaaatttaaaagccaaagatgcagtgtttcattgaagcagcatgttattatcacacctgttaagatttgagcctaaagaaagaaagaataggctggacatggtggctcacgcctgtaatcccagcactttgggagtccgaggtgggtggatcacctgaggtcaggagttcgagactagcctgaccaacatggtgaaaccccatctttactaaaaatacaaaacttagccaggcatagtggtgtgcgcctgtagtcccaggtactcaggaggctgaggcaagataatcacttcaatctgggaggtgaaggttgcagtgagctgagatcaccccattgcactccagcctgggtgacacagtgagactccatctcaagaagaaagagaagacaagagagaagggagaggggagaggcgagaggggaggagaaaagagaggagaggagaaaagagaaaagagaggaaaggaaggaagagctctggtggcccaagatctgaactctccctacagaaggcttttgttcagccagttaaaatattttaaatgagctgccaacatttgaaaaacatacaatttttaaatgttaaaaaaatctatgcgtctatcttcccttgacaaatctgatcctgtggccacagtgtgtacatacaaccttcatgaccacagttagctggagttggccaatagtgatcaccctgtagatcatgtaggagtattccaggttgccatatttcccttccagcctgctcccctcatggagattatctgcctggcatctgagtttgcaaccctcaacaaaggccatggcaaggaaaataatagggcagttgtaagcactatttttgtgtgtgtgtttgatttttgacaaatctaaagttaaaatcccacatctgctactaaagatccacatggccataggaaaatccttaacctctctatgcttcagttttttatctgtaaaatagggatttattatgaaaaatgaacaagataaaccctaaagccttatgcatttgactggaattattataagcatagataacaagagttgttgttagcttcgttataaagaaaagcttcctgagatgattgaattaaagaaaattttacaggcctcacctttttattgctttcaggcaacttcatctttctctaaagattgatctgtaataaaaaggaacttgctagattacatcatacccaaatgtgtcttcatttttttccctaccagtttgggaggtggggagagccagagagaatcaaaccaatatcatctctttccaaatgataccaagaaggattaatatgggcaaaggactaaaagggtttatacacaaacagaaaggagttataaattaagagctcggagaaagcagagggcaatgtaaatatcttaaattgtctggaagtaacctggcccccatgaacagcacttcagtgatagttggtggttgtcaggaggcccaggtgggtacagccaggggtttcaggaagtggcagcatctgtcttccttatcaggatgtgggataatcaggaaggtgccaacttcataattggcacctggctgactgtctccaggagcacttcacttggcaacctgggtgaaccatgataatgcatttaaagtagtgtttcctgatgtgtgtatcacagaaaagtggggtgggggacagtgtctagagttatcctaaagctcagaaatgacctttgaaatgagtccttctcaatagtattctacatatcttgagtgattctttttttccttccgtttattatagttttattgatatatagtaattgttcatatttatggggtacatgtgatattttgatacatgcatacaatgtgtaatcgtcatatcagggtaacttgggatatccatcacctcaaagattttattattccttcatgttgagaagataccaaatcttctctcttagctatttttaaatatataacaaattattgataactgtagtcaccctactgtgctatcgaacactagaacttatttcttctatctgactatatttttgtactcattaatctacttctctttattctcccctcccctatgcccttcccaaccactggcaactgccactctactatctacctccatgagatcaacttttttagctcccatgtatcagtgagaacatgcatatatcactatttcttgatatatacatttaatatatttctattaactcctcaactgtgaaaaataaggatttacttccaaaacttatctgactttttaaaaattactccattctgatttttgctagttattattttagttccgttgcttgcctttgtaagtttaaatgtcaccatgaaacttctatttcttgtttcaccaacttaagctattaagttgtttttgttttttgtttgtttgtttttgagacagggtctcactctgttgcccaggctggagtgcagtggtacaatcaaagctcactgtagcctccacctcctggtctcaagtgatcctcctacctcagcctcccaagtaccagggattacaggtgtgcactaccatgcccagctaatttttgtatttttttgtagagacagcgtttcactatgttgcccaagctggtcttgagctcctgggctcaagcaatctgcctgcctcggcctcctagagtgcttgggttacaggcatgagacacggtgcctggccagctattttatcttgacttcccactgtgtcagatgagaaagttagctcccacttccttcctccttttctatactcttctccttttatatcatcagggttgattgtgtttatattctcttttgtaaccactattaaggttgagggtttattcaatgagttatctcataaagttgaaaagcaataaataatatttaaacaatttactttttatttattgctaagtaaaatggagtgctacgattgtactttattctccatgggtgtgatgcactcttgggtgactcttattttctgtttgcttttttcttcgcaatcatatattccaaaagttgatactccatctattttattcctttgtaaattggtatctaacttatgtatgtctaatcctacaatttcatgattctgacaagtcaagtatgtctgattctgaactcaccaggaaactgatattctgtaaagttaacataatagaaccttcttttctgatgtggaaatatttatttaactagaaaaatggacaatgttttaaaatcaacacggcagtcatccttctgaagagctgagagccacacaaaaagaaattgtattgatatgtttaccaacttgaactagcacttttaatagtatatttaagagcaacctacagactgtatatattatatacattacagattgtatatatttagaattccagttctaattgatattcattctgatttactattacgagaaggtatgatatttactgaaggtgtgaataggataaataagattgtagtggggtaaaaatatctaataatcccaaggaatgttgtgttgaatcaattttcccatcagtgttataagtgccaatatatttcttcatcacatctattttgtaggtaatatggaaacatccttgactttaaaataatggctacatttattttttaaatatgtaagaatccaatccagtcatttagaggactgaggctgtcctcttctcacacttttagttgtgactaaatttttgttttgttttgtttctatagctgtttattgagaaaacttctgcatatcatgcatgctatttacagaaaaaactagaagttggagaccattttggggaaaaataggctgaaacattcaatgttattattcacaattaaagagagaaagggtaaaatgttaaccagctgaggttctttttattgcataagattttggggtactccagtcaatccttcactatttcggtgcttctgcttcctttgtgtgccaagttttgtaggtctgggaattacgtgctaagctcatatagacaggtacacacacaaagatatatacatactctgatcttccttgatattctaatgtgataagttaataacatcattctccgaggcagaagcacagccttcttgctcttcctatcccccgatcagacagtagcaaaatttctgcagtgctctgggatggaattgatatttagtgattcaggtccttgttcctcagaggcttcatttctggttcatgggaaattctcataacatctgccagagacttacaaatgcgttgtctgcaatcttgtatctgttgaccattgcaaagacaagcatccacctccaagaagttccttttgggtgctttgtgttagaggagtgtcttaaaaaaatttacagcctctgacattaattattttttaaaatagcatgatgtttaactgattataaaagttgtatggactttggaaaatggaaaaagcataagtagaaaaattttaaattgcttatgctatttaatcaactaaagagaaaatgacgggtccagacagatgcttaaagcacccaaaggtaggttttatgagcatttttgtggaaattattatctctttattcaatgcatatatcttttaaatgaaatcagggcttatgctataccacactgtaacttatgcagaatttgtaatgttcacagcatctgaaaatcttcattttagtccagctgattatgcagtgtaacctgggccataaattaaacctggggatgagactatgaccatgcatgcttctgtattaggaatagatcacaaatatgtcatcaaatactcttatatcatgtgattttcagtagtttataaagcccatgacattaatcttaatttgtttaacctatcctttattctcagacattttatggtttttagtttttcaatattcttaaaaactcttcctatacctacttactttttcatatttgggggaaattcactaaaagcagaatttgagccagtatatgtgatagcaggttaaaggattttttttccatatcgattctatgacacttttgtatccacatttctagccacattcccctttctttctctctctccttttctgcctcccttccttccccctctgtttctctctgtctctcctctcttctttctttttccttctttcttctcctgtttcctctcccttctctctctcacccttcaattaagttcaagcattttacatattgaaataaccaagaaaagtacagaaaccaaggtggtcaccatacatgaagcatagcttgaaaaactatggatcaactctttaaaaaaaaatgggcaaggaaaaaaacaactattgagtactgaggtattaggtttgaagaatattatatcttttgcaatgtatgatgtgacttgtgcaagaattaaaaatcaagagagagcaaacagaaaaatttgctaataactggaggaatcaggtagtcatcactcaggctgaagtgaattcatgtgggccatctctttgggctttataactttataaatttgtgggtacaccccaggaacagatgctttaggggaaacttagatgctgagtttcctggattaatatagaaactggcatattctaaatgtaaagttggttcagaatggtgtctttatttttatttgaaacaacatgttaagatcctcaatagctataggagagttctggttcaattatgacaatggataatgtaatagatcgttcctgcattgctataaataaatacctgagactgggtaatttataaacaaatgaggtttaactggctcacagttctgcagcctgtacaggaagcgtgatgctagcatctcctcagctcctggggaggcctcaggaaacttgcagtcatggtggagggcaaagggggagccagtattcaaatcgctggagcatgggtgggggaggtgctacacactttcaaacaaccagatctcaaaagagcttattatcgtgacaacagtaccaagggaaatggtgttaaaccattcaacagaaactgcccccatgatcctatcacctctcaccaggccccacctccaactttacggattgcaattcaacatgagatttggtggtgacacagatcccaatcatatcagttggtgatgaatctggattgatccaaaatttatttcattcctagcgtctttcttcctttatttgactttcagttggatttagtctggttgtaatatcctgaaatatactgttttcataaagtatcacattgggacaactatgattctgtgaaatgtggtggtgggctacaggaaaattcatttttttaactggtattgattaagcaatacatactttttgtctaaaattttgtctcttttttttttttcttggctcagatctcttatgttctgttttcatgaaaaatgccttgcctgagtattatatgaagctaggaatttagatgagatttgaaatgcttgcttgagcaccacagtttttcaaatatccagatttttgtgttaacgtaaactaaatatccaggtggtcgagtgactacacaaatttgggtagttggcatcagacaggcagatggaatattcaagttgccttcttcaaggatacagttcaatatacacactttcacatctgtttgtcattagctgagaattatgagagaggcaggataatgtagtggctaagagcaaagatttagacttagacctgggttgatatactcacactactgttatgatgtgatttggggcaggtttacttagtgtgtctgttttagtttcttcacttatatcatgagaataattttatatatatatatatatatatatatatatatatatatatatatatatatatatatcatggtggcattatgtatgtaagtgaaataattatataggaagaagttaacatagtccagagcaaataataaatgctctgtcaatagtgttaactgtattaactaatatcatcatcatcatctgaaatgtggatgagaattggaataaagtggcttgctttggcactgaaaactgtatctttacaaagcatagatattcttctacttctatgcagttctatcatgtgatgccttagccattttagaaagaggtgtgagatatatacaaatgagtgactgagtgatcaaatgacacaaataccaacaatgcacttctatattctagatggtgtttgaagtagatcttgaagaacaggcagagagaattgtcatggactcatggactagcaactgaggaagaatatctaactagaggggtcaccaacagcaaacagcacagggattcctagtgattagttttctttttatgttatatattcaacaggtatttcagactctattctagccaggcactagaacaaaggccatctaatttggatatagcataggctggaaaggggaatatgccaaagataattgtagaaaatgtaatacttagagtttgggcttgactctggcaagttgagggagtcatttttgctatcggacagtcagcctttaaagtctgaatcagtattcactgctgtattctctgtattcctcgtaccgcagggcctggatggaggcattcagcaaacattggttctcaattttaggaagatagcaactatcatttttaatctactttattattacttttctgaccatataaacattgcccattttaaaaaataatttaatgtataaaatatcccacaatcaattcattgactcatgcagtcaacagatatttattaaacatgtactacttctctgattttgaggcactaatcccagagataattgaggctttttgtttgtttgtttctaccacagctctacaaagtgttggccacataataggtccaaaataaattgtagtcacatacaaagagacaagtgttttactgtagtggagaaaaatttaaccccacgttacatcattgttttgcaattttgtgtttctaaaaacacttagtttgagctactctatggaatacagaaaaagctacctaatttagtgtccagaatctccaaatctaacataaaccaaaattcgtcccctatatgtaactcaaaagcagacttcaccttcatccccagcttcatcatatgtgtattattaatccaggaaattatactatgtattacaggcattaaactgaacagaagggagggaggcacaccctaccttatgcagagtctattttaaatgttttcagcatctgaaaaccttcatttcagactagctaattatacagtgcaacctgagccataaattaaacccggggatgagactatgaccaagcatgcatctataatgtttatgagctataaggtcattgcagagaacagcaaggaacatagttgtaatagactgttggcctctaaggaaattattaattaaattttatcttctccccagcatgcttcagtggtaccactatgagtctttagacctggggaaactacacctcggtaataaccggccttatcaccgggccggcagtcatttaatatgcttctttgtctgacaccaatcatgaactgcagtgtgggatgtcaaggcttctgcaaatgccaatcgcacgcctcactgtacatcaggcccagggttcagatcttatgataggaaatccaagaatcaaccgctagcagagtaatccgttttctggaaacaagatgtggacagtctcgtttccagcatccagccccttcagtctcccatgttatctctgaaagagttaaaatcactcttaaaagaccaaagtgaagagactcaagtgtcactgtatttacaccatctagatggagtgctatttttgagtctttggcttaaggtgcagacttgactaggaaaatcagagctgaaatgtcatttccagctactttctttgagagatttcccagatggattggctcagcccacgaatcaaatggcatttttgttgttgttgtttctaactgcttgctgtgtcaaccagctgtgttcgtcctgccccacactggatcccccacattaaatgttttctgatcagctggcagctgttctgaagacacacaaagcagattggagtccggctctgtttttccatagatgggcagccctgccccactaatggggatttaagcatcttcattttaggcaagacagcaggtagagaatataaagcacagatgtgttgattagattctgagttttccaaattgttacttaaatgtgccttctgtggcccagttatgtattctgatgactgtgtcatttacccctgctttataaatttgagtcactgacccatctcctctcttcacaatcccctttgttatcaaaaactcatgataacaaaggaaatctaggaagagtgaaaattcaactcaggagactttgactgaatgcctgaaagatggtactgtggcaccatcagtgagaccaagaatgaataagacacagtccctaggatgaaaaaatcaagaagtgacaacactggcaatagctatgacaatttttacccaaattgcctctgagtaggctgcatatttgaggttgacagcatgtgtggaaattacactcacatctttattatggccttgctacttatgtcatatccctgggtgttctccttggaaacacttttgtgaagacaattagggttaggagaactttattttccatataacaatttcatagaggaatctgttccactctgaatttttaaaagccattttaaggtgatctgctttatgaaacctgataagctctatggaaatttcaggcaagagatttatagcaaagaatattttcagtagagacatcaccagacaaaaacagtaaatttttatcaggaatgccggaacccaaattgccattttccattgcctctggaaaaaggaaaattatttaaccttgggaaagtttctagttgtacacaattctcatagaactttaaactcttaaaaagtggaaggcctttgagaccctcatcttgtctaacatcctgccatgtgtataaattccttctacaatttccctgctgggctaccatacaattttttattagtatcttcagtgctgggaattttactccctcgtaacagtgcattcatctttttaaacatttatagacatggattaatatgtttaggtagaactgatacaaacaatttaaccaattacattttgcctgttccagctatctggccaaaaatatgtttaagttccagtttataagggccacttttccttttctcaattgtgcatagaaaaactgaatggttttgtatatgtcatagtatggtgccattacaaataccaacaatgatgtttataatagacttcttaatttacctttttactgtggtaaaatatatataacataaaatttaccattttaaccacttttaagtgcatatttagtggcgttaattacattcacagtgttgtgcaattatcactattatttccaaaaatactcattaccccaaacagaaactgcacccattaagtgataacttctcatttctccctttccgtagtctctggtaacctctactatatattctatctctatgagtttgcctattctagatatttcattcaagtagaatcatacaataattgtctttttgtgtgtaacttcattcacttagaatgtttttgaggttcatccatgtttaccatgtattagaacttcattcctttttatggctggataatatttcatttacatatgcgccacattttatttattcgttcttctgttgatgagcacttaggtgtttctaccttttggttattgtgaataatgctgcatgaacattggtatataagtatctatttgagtcactgttttcaattatttggggtgcatgcctaggagtggaattgctgggccatatcctaactctgtgtataactttttgaggatggaagctgcattattttacattcctccagcaatgtgtggggattccaatttttccacatccttgacaatacttattttcctttttaaaaattatagccatcttagtagatgtgaagtagtatcttagtgtggtattttttgcattttcctaataattaataatgttgagcatcttttcatgtacatattggccatttgtatatcttttataagaaaacatgtattcaattcctttgcccattttttatttgggttgtttgtctttttgttgctgagttataagagttatttttttactctggatattaaaaccttaccaaatgtatgatttgcaaatttttttcctattctgtgggttgtattttcactctcttgatagtgtcttttgatatacagaaatttttatttcggtgaagtccaattttatatatttttgttattgttacctgtgcttttggtgtcatattaaaactattgccaagtctgacataatacacatttgccattatattttcttgcaacagttttatagtttcagctcttaaattgaagtttgtagtttattttgagttaatttcttgttcatatttgggtagggcccaacttcattcttttgaatgtggatgtctggttttttcctagcaccatttgttgaggagagtattctttcctcaatgaatggtcttgacacccttgtagaaaatcatttgaccatagagatgatggtttatttctgggctctcaattctatattgttatataaaaccgttgttatccctgtaccacatcattttgattaatatagctttgcagtaagtaagttttgaaattaggaaatgtgagttctccaactttattctttttcaagatgaattgactattcttgtattcttggtcctctgaaattccatatgaattttagaatcagttttcacatttcttcaagaaacaccattaggattttgatagggatcgcattgaatctgtgtgtcactttgaacagatataccacattggggcagcattatcatcttaacagtattaagtcttcccatccatgaacactgaatgtgtttccatttatttttgtcttgcatttctttaagcaatgttttgtagttttcagtgtacaagtcttgtacctccttagttaaatttattcctaagcattttattattttttatgctattgtaaacagcgtttttataaacttccttctcagagtgttcattgccagttcataaaaatacaacttcttttgttgttgatttgtattctgcaactttgctgaattcattttattagctatgacagatttgcgtgtgtgtgtttgtgttcttaaggtttttaaatgtaagatcatatcatctgcaggcgaagatagttttacttcttcctttctaatttaggtgccttttatttatttttcctgcctaattgctctggctaggtctttcagtattatgttgaatataagtgataaaagcaggcatctttgttgaatataagtgataaaagcaggcatctttgtcttgttcctaatcttaggggctacatggcttttatcaaattgaggatgttcccttctatttctaatgtattgagggttttatcatgaaaggatatttgttagattttgtcaaatgctttttctttgtcaattgagacaatcacatagttttttcctttattctattaatgtggtatattacactcattgattttcatacattttaccacttttgcaatcctgggataaatttcacttgctcagggtgtataatcctttcaatatgctgttgagcttggtttcctagtattttgttgagaatttttacatcggtattcataaaatgtgttagtttatagttttctttgcttgtgttgtctgtctgactttagtatcaaagtaatgctggtctcataaagtaattaagaaagtgtttttgtttctgtgtttttgttttcgtttttttgaaagagtttgagaaggattggtgttaattcttctttaaatgtttagaattcacctgtgaagacatctagtcttgggcttttctctggaagatttctaattactgatttcatttccttgcttgatacaggtctacttggattttctatttctccttaagtcagttttggtaatgtctgtgtttctaggaatttgtccagttaatctaggttacccaatttgttggcatacagttattcataatattctctctcttttcttttttttttttttttgagacagagtcttgctctatctcccaggctggagtgcagtggcatgatctcagctcactgcagcctctatctcccaggctcaagcgattatcctgcctcagcctcccaagtagctggggctactggcatgcaccaccacgcccagctaatttttgtacttttagtagagacggggttttgccgtgttggccaggctggtctcgaactccagacctcaggtgatccgcccaccttggcctcccaaagtgctgggattataggcatgagtcaccgcacccagccttataatattctcttacatccattttttttttctgtaaactcagtaataatgttagtatacaaccccccactttatttttgtctctctcatcattagagaggttttccttgatttttactaaaatctggatccaagaacctttctgacatttggtcctggttctcagactttattattttttggtcagtttaagacaaaaacacattgctgatagtgatgataataatgacagcaataacagctcccatttactaaatgctttccacatgccaggcattatatgtgaaatagcttcctatatcatctcactcaactcttaaccccatgagttaggtattatcatcttatcctatcaattttcagaaaactaaaacacaaagcagttaagtcattcatcaagttagagtatccaggaaaatcaaagaaagatttaattttgattaggattagtccaaggcttataagtccacagaattcaccaagcctacaaaatatacagttttctctcttgttttgcttatggatactaagatattttatttccttctgtggctgacattacctattacgacgggttgcagtgggaatgtttacaggtaggagaaacaaggatgaggtatttgggagaagagatggtctgtgaaggtaggctgtcaataagtgctaagaaaaacagattaattatataaataattcacattaaacaaaaaactcatggcaattaaaattggcctctatggtaaaaatatttcaggaaaagatggataaattgggagactattttatctgaaatagctgttgagttgtgccttaatttaaacatgcagaaaaaaagagaattctcaaaccctgctgctcaggaaagcaagctgaaagggaaggtggcaaaagaaggaatgaactttgattaccttcaggctctgtatcatccaatccactcaccctataatctgtcagacaatgtttatttttgtagataggccataattcattattttgtgcatgtgctaatacaatggagaatgcattctgtttcaaccagatactaaaagtggagttgtagaattgtgaggccatttccactgctttaattcaaatctagatcataataaaccacagtctgaaagaagagcatgaagcctggctctgctttgtgcaagccttttgaaaagatgaaatgaaaaagtcaaaggagaaaagacaccagctccccagaattatatcagacatattaatcatggaaggtccaaacggaattcctggaatgcaaacggctatgcagtatggccatttcccataatttccaagttgctctccatcagctggataatactgtttaatcccttacgctgatttaaaattccatcagagggaagtaatgtgtttctgttctggaggtttactatggtaaatgcattactggattaactttatcttcactattacaggggtcttttaggtgctaacacaattttaaaataaaacaaaaactcttctatttgagaatgcattttccacatcagaactcatttgtgatgtttattgagtgctatttgacatctgaaaagcttaagtcttgtcctttacaggcagaggagccttagtaacaaaagagctagacaatcaaaacccttaaatgatatgggattagtctagtgttatgcccaagtgagatttctatccatattcctttgtgtattttaattttctgattatgagcaatgttggctgttcttaaacgtttgtggccacagaaacctttgatcaaaagaaacctcacttatgggcataaataaataaagcagatgaagacaccagttgaggaaaatggacacattgttcatccttctatggtggtggcccttgaggagttccatggctaggcccctgaagagcagtttttttggttgcattagtggaatgcattccactaaaaagaattcaaattcacaaatgcattcctataaacatggaaacacagaagaatatagacaaaaaagttgttatcccctctttgaccccactcccctctctagagattaccaccatgaacaatttggtgggtctcattctggatcttctctctgtatttagaaataagtatatatatatatatatatatgcacaagttattaactaatatataattttaggatgttaaaatatacattctacgtgctcataagttttatataggcaaggatttttgtctgtggttcactactttatccccactccctaaacagtacctgacatataaatcatcaataaatgtttgctgttttaggggataaattatcctgcagcttgcttttatgatcagcaataggtcttggagatctttccatgatagcccatatagaacctttttaaaggttgcattatgttttttagtatggatattccagaatttgctttaccattttcctgtagatgtaattcaggttgtttccaattttctgctagtataagcaatgctgcaacgaacacccatgaaaatgattctctgtgtacatgtgcaagtgtttcagtaaggtggcttttttgaaatagaatttgtatctctgaaggtacacacattctgatctcctctaggtttgtggattcctttctcttctcctgcaagtgaaaagagcatggaatactttttatgggccaggatattgggtatctcatccccacccacattgcattggctagaaattagtcacatgccctcttttaactgcagtaggggattgggaaacacagattagctatataccgaagaaaaatagaaaaattgtttggagagtttctcacatgtctgtcatagcaagagaagctagcaaatgttctacctaatcatgtgcccagctaaaactttcttattgttcaagaagggcaggactgatattggtagacagctcatcatctgccactgctctattgacacttgagtttgtaactcttatggaaggcatctctggggcaatcccatctatttaaatcacatgtacccttctcaaaactcatattttactgaattttagcccaatctgagtatacctcaggtcaacaggctcacttgtagttgatctgaaaatgactgacagcacaagatggatctttttaaaaaaaattagtagcacctgttcgcaagggatttattgtgtttagtgatcagaagctgagactttatcatctgtctccagattgtcaagtcacttaacatggcctttgaaatttctgtgctggtgctgagtgatgaacaagcatcaaagaggtatttcactgctcattcagtcttcttggccactgatgagagccagaccatgggattaggcctgcttctagaattctggcactgggagctttgggtctaagatataaagatatatcctcctccttctcccatctgatgttatctcataatcagccaaagtgaaacgttataatttctatttatttgtattattctttatgcagcaggaaagctgtctgtggcttttcaaaatgcgcctggtagagcatggatggcccatcatgcataggtaaattctgatttttattaaaaaagaatgtcactgtccatatgaaactttgttttcttttgagaaagtaaataggttgttctctgtaaactaaatttggtggagagctgcaaatcccctctgcaactgcttgagcctcattgagctatttcttggcccccaaaggcactcagcacttccctgaatcctgctttactgacaactcttcctgataacagctcccatgcattctcaagtcccaactcagacgacacctcctgtgtgatgatacctcccaacccacatagcagatttacttgctccctcaactctgacttgttgcccttaacatttttctcttagtatcatagtgcattgcaaaacatttggaaataaagagaagcataaaagtagaaacgttaaattacctgttatcataacacctagtaatttctgttaacatttttaatacattttcccaatacatttatttttatatagaattaaaaactatattatatagtttcttacttagtagtatattgtgaacaatttcacatcattaaggattctttttaattgcaataattttttagtgttctggcctatgtctaggataatttttgaattcttcattctttttttttttttttttttttttttgagacggaatctcactctgtcacccactctggagtgcagtggtgtgatcttggcttactgcaacctccgcctgcctggttcaaatgattctcctgcctcagcctctcccgagtatctaggattacaggtgtgcactaccaagtctggctaatttttgtatttttagtagagacggggtttcacagtgttggccaggctggtctcgaactgctgacctcaagtgatctgcctgcctcggcctcccaaaatgctaggattacaggcatgagccactacacccagccaaattctccattcttttacatttaggttatttctgattttttttgctagtataaataatgctgacaaacatcgttttgataaatctgtgtatgcatccctgggttttttttagaattaatttttagaactagaataactaggtcaaagacaagtacatgtgtatttttaatgcttttggtaggtttttctaggccttataataacacttatcagaataaaataattgtgtatttacctgtttttatctcacttgtctataagttctttcagaacaaggacttgctcgtgtttgtatttatagcatttgggatagtgcctagcatattacaaatgtcaataaatgttgaataaatgaatggaaagaaatattggtaaggtggttcacggcaattgaagtttagccataagctaatatagatcctatgtaaagcagtattttccaagatatgttccgtgtcattcattcattcagcaaatattaatcagcctcagatattgtcttgtacctcaacaatgattgctgatccttacagtgcttgcaaatctagtgagaaaagctaaatgcattaaataataagaagaaacgattatagtttacgataaacatgtaggaaataaacaggatactgccatagaactgcgcaaactttagcctgtatcagaatcacctgaagggctcgctaatacacatggatttgccacaccccagagtttctgattcagcaggtctagggtggggcctgagaacttgcattcctaacaagttcccagatgttcctgatgctgttggtttcaggaccacattttgaaaactactgtgatagggagtaacatcgagaagggcaagggagaaggctgtgctttaggtggttacaaaagctttgcctggcctgtaatcccagcactttgggaggctgtggcaggcagattgcttgaggccaggagttcaagaccagcctggccaacatggcaaaaccctgcctctactaaaaatacaaaaattagccaggcatggtggcacatacctgctttcccacctacttgggaggctgaggcaggagaatcacttgaacctgagaagcagaggttaaagtgagcaattcagcctcagcctcagtgagaggcagagtgagagactgtctcaaaaaaaaaaaaaagtaacaacaaatctttgcctgacgataagatagttaagctgacacctgaaggattaagagctgtaaaaagtctcagaaacactaggcagatgcgacagcaaatctccaggaacaggaaagagctgggaggaggccagtgagacttgcagttaatgaggaagaaaataatagtcaaagttggagatgtgggcccaatgtcagatggtgtgggcccagcgtcagatggtatgggaccttatagatcatgggaagaagtttggattttaccttaatgcagtggaaagccagtttatattctaaagagatcactctgtgttaagaggaaaaaggatgcaaaataagcaggaggtgaatggagagaccagatttggaggccatgacagtggacagtgagagatgaggttggtctgagctggggagtgacagtggagatagtgagaagaggagggaataaaactgttaaccatttcacccccaggaatttcttgggaagcattggctacaacaaaattacaaccagttcttaggacttgcatggtggctctttgggactttgggagtccagggcagatggattgtttgagttcaggagttcaagaccagcctgggcaacatagcgaaacactgtctctacaaaaaataaaaaaattagctgggtatggtggcatgcacctgtagtcccagctactcgggaggctggggtgggaggattgcttgagcctgggaggtggagactgtagtgagctgtgagtgtgccactgcactccaacctgggtgacggagtaagaccctgtttcaaaaaaaaaaaagaaaaccaattgttaactgctagagttttcagatcctttcaaatgacaatgcttattgtgaatctctaataagatatttttccccagaggacctcaggtaattgttttaaaaaatatatggctctggaaaaagctatagagacagtcaaaagatcagcagttgccagggtttggggagagggaggagtgaataggttaggcacagatcatttttagggtggtggaactactgtatatgattctatagtggtagatacgtgtcatgctacatttgtccaaaccctggaatgtgcaatgcgaagagtgaaccctaatgtaaactatggactttgggtgataatgatgtgtcaacagaggttcatcgattgcaacaaatgaaccactgtggtggaggttgttgataatggggaggctgtgcatgtgtggaagcagggagtgtatgggaaatctctatagcttgtactcaatttttctgtgaacttaaaactgctctaaaaaagtctactaaatatatatatataggtgtgtgtgtgtgtgtgtatgtatgtatgtattggagtcataatttaaacatcagccatttcaaagcttcttgccttgtgttggcttcagcagcatgggaacttgttagaaacacttcctactgaaagattcactctataccacggaagaaccagctgcagagtcagtgacagtcttaggaatatggtaccaggagcatttctgaccatggactgctaaccccaggcaaagtatgaattaaatgaaatttgcttacagactaaatgactgatgtgtctgtgaattctttggactccccaaacaggagacaaggggtgggcctcggggttcaaattttgaaggatatgagccacttttatatattctcaagtattcctgttttgtgattttcttcttggcctaaacatttagtgaagtctggatatatgcaaggagaaactaatgctacctaagatattctgtgctgttactgtctctgctgagccttttttttttttttttttttttttttgagacacttctatgcccaggctggagtgcaatggtgtggtctcggctcactgcaacctctgcctcccaggttcaagtgattctcctgcctcagcctcccaagtagctgggacaacaggcatgcgccacctcacctggctaatttttgtatttttagtagagacggggtttcaccatattggccaggctggtcttgaactcctgacctcaagtgattctcccgccttggcctcccaaagtgctaggattacagacatgagccaccgtgccccaccttctgccaagcttttttatggtgccgtagggcccacggtgttgtggtagcattcactgttccagaagctaagacaagaacttgctgtctgtgagactttgagaacttaacctctctgagcctgttttctcatttgaaagtataaataatagaaatcacctcatgaagtacttacaaggattagtgaaattactcagggaaagtactgagcacaacactagctataataatggctgctatgttatcagaaggaattatgtgttttttacctcagtcttggtcagactttaacttggttcttttcacctgcctggagccttttcccactccccactcactcctggcttaggcatttagccacagttcttcctccggtttatttggggtggaatattgtagggagtgatatctctggaaaatggtaattcatctcaaatgctaatttagagacattttctcttttttttcccagacatcttttttaaacctaaaaatactggaataaatttttgtgggaagaatggaatttgattctttatcatcagcaaaatacatcaaagactactaagtatgtggtacagtaacttttcatgagctgttaaagttagcaaagacatctttctgcatttaagctaggagcacattacagaaagtataatgagggcttttcaagagatgccattggctcctttttcctcaaataattattaatgatttaatgatacttattttcctttaaaagaacatgtttaggtatcaccatcttaattctttaatcaccagatgataataaatggagagtctaaaaagttctgtccaaaacaaccagtctaaacactttcccaaagtgactattttccgggcttgaaagttaccagcatgagaaatcgtgatccagtgaaggcatacgtgtgtcagggtgacttaattaaagtctctctgatggctgtttgagaaaactaatgggtttctttgtctaaatccaaaagctcctatgatattaagtttaccccaatcacttcctgtggtgtgaaatatgcattaactatcttctctacaaatctgatgagaaaaccaagttctaaatgtaatgtgtgtcatgttggaagaatctggataaaagtatttgagccagtgtagtagatgttaagaaacaaagcatggtcttgattatttcacattgcgcacagtttaactatttataatttagagtggcaatttagatgttaccaataataagtcagatgctaacacaaagggttttggccacttctcataatatgtggtttatgttgctccttccatgttctgggcactgttcttcaaatgcaggcttaactttgaggctcagaggaataaggaaaaagagatagattttccttatttctcatatgttgttaaagcccttatgaaactttcttaccagaatggtaatgactctgaaaattaccctagtacaaggtgtgaaaacacacactgcctagacgtggatttcctgtgctcagtctagctaagggatgtgaaagcattcagatatcatatgaaaactacatcttataatgtatgaatgtgaaatatagttattatttacatctgtgtttccaagcaaccttttaaaatttgatatcacattttctatagcatataagaaatcttcactgatttggaacttaaaaaagaagatacatttgtcataaaatagtatgtatgacacacttttaacaaaatctacttattcttctgaaacctctatgtgttttctaccaagagtttaattattggccttattaactctttttatacctgaggataattaaattcttaattgtactgcaatgacatatgattcaagtagcttaatattttggcaataactaggaagatccactaggatggtttagatggggcagagtacgtgtgcgtgtgcgtgtgtgtgtgcgtgtatctctctctctctctctcgggatagagatgttccataaagagacatctcttggctagcaagatcacctcttgagattagaaggacttaaattatcttaactgtagcagccaccaaaaggcctgggacctgtgacattcccactgaggttgcctatgactgaatggagatgtataatggagagtaatgaactcactcttgcaggtgcagcagaagtagacaagtatgtgatcaagggataaggactctggggaaatggagcatgagagctgagagatgcctgcttaaaacattttatccattaggggaatgattctgggtccaaaagttatgtttggttgtataattactgacttgagccatccagaagaggcaatagacttgtgtatttgcttgagttggaaaggaatgaagaaatagcgccctaaatactcctgcgaaataataactttcattccaccctaaagccaaagtgatatatccaaatgtaaatctgttcctacttaaaaatcttcagtggctcctggcttctcagggtaaattccttcaaaagtgggcccacaaggcttttgtcatctggtgcctgcccacccccctccagactcaggtccctacagcccacagctggagtgccccttccactttccgtcatggggctggctccatgaagtccttcagactcaaaccagcttccatcttctctgtgttgagctggttgcccctctctgtgtgttctgccacctgtacgtttctcttttctgtgaaattccttttaataattatattaaaattgttgccaggatcagtggctcacacctgtaatcccagcactttgggaggccaaggcaagaagatagtttgagggcagaagttcaagactagcctgtgcaatatagtgagacccccctctacaaaaaataaaatataaaaattagccaggcatggtagcacatgcctgtagtcccacctacttgggaggctgagacagtaggatcacttgagtccataaagtcaaagttgcagtgagccatgatagcaccagtgcattccagcctgagagacagagcaagacctttggaaagaagggtccttgtcttaactcatttttgggtcccagtccttaacatagcaggtggcacatgacaggtgcttggtaagcattcttttaacagaactgtgggaaacctaaattgctgtagcttttatttctgtggctaataaattattttcactgcatttggtcttgcttacctccttatgagcagcagaaaagcagttgtaataagctaccatttattgagcaccagccaagagtcagttcgtgtgttgggtatgtcacatgcattaatgcttactgaattgccaaaagagtcataccactcttgggtaagattatcatcatcatcatcctttccaaacaagaaaccagaggctcagagaggttgagaaacataccggaagatcctcaaccagcatttgaaccagctgcgttatttctatcctatacgctaggaagctgtcccttggtgggttcccgtttatcaaatagcacatttccctgtctgtgccctggagctatttccatttcctccttcatgtttgcttactagaccctgagcaggtcgtggagcaaaagcactttggatgccagtgacaagggtgtgattccagagttgaaggctgatgttttaactgtgcgttcagttcaggttgttattgatttctctcctctccactttgttatggccaagtgctccaggcagaaatctagcaaaacaggctcacagagctgctcttggagccaggcgggtcacaggtcactccactgatgtgcggggcacattagccaaatgacagaggctcaactagagaactcaaagtgaccgtagtcagatgttggtgatattccacacatgttccttattacctaccagcctgaagcagggcagacctggacttggtctggtttgcttccaggacaatgatgctagtcgcccaggccttctatgaatccacagcctcttgaccacaacaattacactgcattataattacttgtctaggtgcctgtcttcattcctatgagtttcttaagcatgatggttgggtgccgtgcatccctatttatttattcaagtcacaactgttaagcacagactgtacttcaagttctgtgcctgactctggatatatggagatgaatagaatggattagaccagaaatctgttcccaaagagtatgtagatatgtaagaaataactactaaaaactgttgtgagaatgcttagatatttttcatctctattacccaaaatcttagcacagcaccttgaatagaaagagtagtgaacagaactgagtgctgactgtatgcctggaactgtgttatgtgttttatattcactatctcatttaatcctcataactgccttctgtgcagctttcggtactattttcttctccatttaatagatggggaaactgatgccttcagagaatgctgaagtgagtgaattcaagtgtagtcttcccattgagtccacgttgttcataactgcttattgttgcttcctaaaatctatgaaagattattctatattctgcagtaaactgttcttttgttttagccaatatcagtaacttttttctttaacattttgtccattaaaggaattctaccagtcccaagagcatgttgtatgaaatcatatcattccattatgtttgagtggccatttggagtcagagctgtttaagaaatactgtcaggctaagatgctaagatgtcttcaggctggaaggtttaggtcccaagacagattggaaatgtagtgcttgtcagctcctcctacagcccttctctgccatcattcccacatacactctgcagagagctcaatgcggtttgctatctgacaaacatcctagattagtgagtcccatctttttttatccctcatcaagccagggaaacattactaaattatcacacattaaacatgttacacaccaggcaccatgctaggtgttttacaaacatctcctcatactgtaattattattttccatcttattgatcagaaaactgaggttaaaaaagaaatgagacatggccaaaatttcagctcaggcaatctgactacaaaatccagacagttacaaccctcaaatattttcttttttttttttaaattttattattactatactttaagttttagggtacatgtgcacaacgtgcaggtttgttacatatgtatacatgtgccatgttggtgtgctgcaccccccacttcccacaccccacaacagtccccagtgtgtgatgttccccttcctgtgtccatgtgttctcattgttcaattcccacctatgagtgaaaacttgtggtgtttggatttttgtccttgtgatagtttgctgagaatgatggtttccagcttcatccatgtccctacaaaggacatgaactcatcattttttatggctgcatagtattccatggtgtatatgtgccacattttcttaatccagtctatcgttgttggacatttgggttggttccaagtctttgctgttgtgagcagtgccgcaataaacatacatgtgcatgtgtctttatagcagcatgatttataatcctttgggtatatatccagtaatgggatggctgggtcaaatggtatttctagttctagatccctgaggaatcgccacactgacttccacaatggttgacctagtttacagtcccaccaacagtgcaaaagtgttcctatttctccacaacctctccagcacctgttgtttcctgactttttaatgatcgctattctaactggtgtgagatggtatctcattgtggttttgatttgcatttctctgatggccagtgatgatgagcattttttcatgtgttttttggctgcataaatgtcttctttgagaactgtctgttcatatcctttgcccactttttgatgggacaaccctcaaatattttcttcaatacccctggtaaacttcaacagcaatttttcaactatgcgagtcaagggtgggtgagagtgaagtttgaaaaagcacccctcccctcagccaggtatttccaatgcatccctcacccacaaaatcacagcagagcatgcagaccatactaataattccaggtgcaccttaacttctgaggtctcttctgacttgcagctcctcagtctcttcctcctttaaatctagagcatatttgctttaaattgtttagtttgataattcatcacatacagtcttatcacctcacatcttccacttgggtatcttgcctgtcttttccagcaagagtatgagttgctggagagcagagagttcatttcatcccataatagcacatggtggccacaaagacacttaataaatgctgcttgtttgcttaaatagaggcagtatagtttgctgaactctggaggcagacaagcttaattttctacttactagctatgcagtgaaaattataaaaattccatatacttcagttccttcatctgcaaaatagagattaaagcaataccttatagggttgccaggaatattaagagggtacatataaagcacttggcatagttcctaacacataatatgcactcaataaatagtaattattgatgttattacacaacagctgaatttattcgtgtttactgtgtgttacatgctgtgctaaatgctttgtatgcaattatcatttaatttttacataatataggaagcagatttagcttctaaacaaacacacctttcttgttacccaaaagttatttaagattatcagatgctctcactgtcttcagagttgtgtcataggatgggaaggcacaaatatgatattgtaatacactattggcacatcatataactgtaagacatcacaataactactaacaacaactaaagcactggagttgacaaatgttttgctcttttatataaattaatatagattcaaaataattatgataccagcacttcctgttcttataccctccgtcacaaatgaaaaaaaaaaaaagggaagaaatggatttgccagtcagacccacccatatggacacttcattaatatatgttattatgaagaatagggtgtgtatagatgaagatacctgcagaggatgttgagagtgcaacaggaagggatgcacctaattcaacttggaaggtggaggcaaggagagctttctagaggtgatgcctgagcagagtcttggaggataagtaagagtttcttaagcccacaggggaggtgggggtgaaggtggggacagaacaatcagaattctgttgctgattggctgactctaaacatgtcagtaatgtgcctttaaactcagttttagttttctgcgatggataattcctttttccctgagtgttatgaggttggcttaattaatgtttgcaaagctttcagtaatcttcagataaaaggtgaggtagaggggaagtatattacttattatcatagctttaccagcatctgatcacataaggaaaattccctgaaaggtcatttctaagaagcaatattattagtctggtggttcttaagccttatgtaacttcctggaacaatgcaatagcaagggagaaaaatgacatcaacatggagataataatgaatttaaatcataagccttatttccttactgcagctgctgagtatgagacaagcttgaagcttctaaacttaactcagccactgcctggaagcatctaattaaaagttttcaaataaaataagtaagtttttgtagataaaagagcagatggcttaagaagagaactgaaagactgcattaggaaagtattaggttttaattccatttgggaaaaaaaaaattccatgtaagagagggcagggattggaagtaaaaaaacctaggggtctgtagagacaggattagggcctgtgctatcataaatgtagctgtgaaattttagtttgtaggataactaaatttttctgttgctcaggattattcctatgacctacagaagatattctctgtcttctgcaaaccagtgtccttccattccccagagtggtttctgttcattcttcctttctttcatttgacccgtaggtattaagctcctactaggtactggtacttctttagatgctaaggattcaggatggggaaaaatcagacaaagtttgtggcgtctcatggagccaacttaatggggaactcattcattagtgaattggctaatgaaatatagctcgtgaaaatatttaaatatttttaaatgtcatgtaaacatttgctgttatttcatcatgatagtgccgtatttgtattttattaatttaataaaatacttggacagatgtcataatgaatcctcataacaagcctttgaggtaatgttggtaacttttagccaagaggaaagagaaattcaaagaatgagggttcttgccccagatcacaaagctgtttcatggtagagctgagactgaaacctagctcctctggtgctagttcacctgttgcttttgctgctacagattgagcctttggggcaatcattgaaattttggttatctatcatttgtaaatctctaagccaaggagaatgcttgtatgagtaactccagagaaagcagacatcactgatgttaatgttgagaggaaggggtggcctgtcacaaagaatatcacataaacagaaccataatgtgagcaaaatcaactgaggaatagcatcacaatgccaagctccatatctggacaggtctgagtagctgagaggtttcatgtccttccttggttgttttcctttggacatctccttatgtctactcagcttcatttcaggcgaccaagccttcaaggtgcatggaagagttccgcttggcctcaaagctttgtggaaaatggaagtttaaaccctgtaggttttcttggccttcaaaagccaaggtgatgtcagggcaaagggttccacttggatgcagatcaagtcactggttatttctggaactttcttgcagtttggttccacaggatagtctaagtaccagtgtgatttgggatacaagcaatattcttgtattctttccttcccccatatcgcatgtttgtacagatttcagagatccatatattaaatttgggacactccagggaagacccctatgtcctctgtgcaagacacatagcaactagtgaggccatctatgttttccagacacccctgcatgtccaaaacaatgtcctcttcaaagtcacctcaaatggggcttccatctctcgccttccacccattttcctttaaactccaaagcagttgtagttctctgctggtatgtgtctctttcttctatttttgtgttcctactgtggtccctccgttccacaatcctcaccctacatggcagccagtactatctttaaatatgtgtatgcaatagatatttatatgtgataccattatataaagttttcactaaatgtcataaatttatataaaaccatgttcccgctctacttctaaaccttctgtggcttccctttgtacacagcacaaaactgtcacattccaccatggcctgggcaacctgcctacctccctccctctccactcagcccccaattccattgcctgtcagttcctcacacttgccatgctctctcctccttcaagccctcactcctgatcttccctccaccaggactgttcttccccatgtgttttgaaaggctggcctttcacatcctaaaaacaagaaaaccccactctcactcagagcttcattctctagctccactctccattgtctaccctccttaatcttaatttgtctgcctcctccaccagaatgtaagtgttgcaaggagaggaaccacatttgacatatccttggagcttcagcctgcctggcagagagctgtgcagtaattgaatgaatggtggatgtgccttgttacccatccagcctaaaatgcagctcactgcacatacaaacaacagtcactgaatgttgactatgcatcaggcattcttttaagtacacgacatgaattcactcatttaattctcatggaaaccatgtgatgctggtactattattatcagccccatttttcagataagaaaactgataagttaaagggttttaaatatctaacagaaaaataatttgcttaagactttgcagccagaaaatgacagagctaggattcaaacccaggcatcccagaggctaccttttaactttcctgtcttcctgcagaaaagattcacatatacttttcagttaatcgaaagaaacttggaatacacactgcagcatggggaaaatgaagaaacctcacatctgccgtagtgtattctttcccaggctgaggaagctagcatgcagtatcattatttctttagtgtgtccatatgaaaggaaaaccagagtaatctctgcagatgctgggattgaaagaatcattgtcccctcatcagaaaggataattaagagcccctctgcccattaaatgaggcaatgaatggtaacccactttgtagggtataaaatgccctataaatgttagttattcttattcccaagctctatggaacagcggcttatgttacaaaactactgattcagaatctttcagaagtactaaatctactcagtagtcaagagaaggaaatgcctctggtttgttccttcccatcatcctgaaaattaaacagcaatccattcttctcctgcatttccaaaatccagggtcagagatatgcaaatgtaagtatgcaggctgcttttaaatgatacatgaaagggatttttgaaatgaatgtgctgtgattgaatttctggtcagtcacccagaaggcattttgcagctaagctctggacccaattccactgaaaatgcataagctttggtgcctgcagccagtctagccacagacgaggatcagggtccttgccttggaactgctattaaatgatgcagacccccaggctcgaagttgaaaaacaaattagcacaagcctaaaagaaatccaatacaaagtttacttttaaaataccttttccataaccttacctgacaacaaaacctctttgattttaaaccatttgatgaaaccacagtgcattaatatataacttggctttttcagtagagcttatctttgtcattttcaaaataatttggatgctctttgggaatacaaatattgccaattggtgttgtccaaagaaaggtctctttgacctgctttaataatagataagaaacatgagtaaaaatgatcatttattatatatgacttatgctaaggtgatttttaagagtaactgacaggagttggctttcttaagtaggttggagagctccgctgataaccttgtttattattaaatgagtttgctaagcaacccttttacttgaaggtgatcaaaggtaaacctcagctttatctgacttgccatgaaattccaaagtagtagaattttacattgtatttcttcccttttagtgctttctaaaattatgtcagtaatgcatgtatgaatgcatgtataacaaaaatagagacacaacaggtgaagctaatcttatccccaccctccatccctctcctctccacttctcagaggtaaccccttcatcactatggcacatctcctgccaaacctttctctaaacatttgtctccatgtgtgtattgttaagttatttaaaaatttatgtttatataaacggtgtattgttgtcaattgctgccatgaacagtgacttgaaataacaaatatttactatctctcacactttctgagagtgagcaatccaagggcactaagctctggggggttctagttcatgatctctcctgaagttgtagtcagggtctaagccaggactacagtcatttggaagcttgactgggactggaggaagtgcttccatcatggctcaccaacacagctgttgcctggagtcttctgtccatcactggctattgacaggaggctgccacatgggcttctccacagggttcctggagtgtccttaaaacacagtagttggcatcctctagagtgagtgatgggagagtaaaagaatgaaagagagagatcaagaaggaagccacaatacctttttattacctagtcttggaagtggcaccttgtcatttatgccatattctgtccactagaaatgaattactaagtctggcccaaactcaagtggaggcgaattaagctgcatctcataagggaaagagtatcgaagaacttctgtatgtattttaaaaccactacatatggcatagtgcacatatgcttctgcaaatttgcttttttcgcttaacaatcttagttttccatgacaatacatgggggtcaacttcattctctttagttgctgcatgctattccactacctatttaatcattctcctcctgatgagtacacctcgagatcgctcccagactttcacttctgcagatgacacagcaatgggggtacttgcttactcctcagcacatgtgccaggatttctctagtaaaaatgcattgatgcagaattgctgagttgaagggtctgcttattataacagttatggctaaattgccctccagaacggctgttgtaatttccaatcatccttcatctgacacgtggcgggggcttgtggcagaactttggtgggcaaaatatcttggggactttcagattatttttggcccttttcaagcctggatttatgatgagaaattatcctgtctgacacccactttgctcataattgcaacctctttcctacaattctgcttgatttaagcaaaaatccagaagctcatccctcaggagacagggaagcttaactgctgtttacaaaggacttggaggttttcaggtacaagttgcccctggagattcaggttgattagtgttaattcaaaaccacttcctctattatggtagcagctgagaagtcacatgcacaaatcaagcatgtggatttcaatgaaaaggaaaatgccatttcagtagcagctattcccggactctggctgagccttcctatggcaagtattattgatgcataaaatcatcgaatcctctgggtcctcccacttctcacttatctttagtttaaaaccgagcatcagaccgaattccttacattcaagctgccaagtgtccttggctggcaagaatctccctccctgtaatatcaataattaatgtcagctaccagtcctgagacagctgacaaaaggaactggcctagttcatttctacttatttactgtgtccatctttggtgaaaatgtttggtcagattcaaaatggtgtgtcaccaaggcaaccagcacttatttattcaatacaaacttattgaggtcctgctctgtgtaaggttctatactgtctattctctgtgtgtgggagagtattcacattataccctcacaaatttgaagtctgatgataattattaccaagtattttgcacttcttgtgtaccagacactgtgctaagcatttcatggacaataacttttccttctcatagcagccctgttaagtaggtagcattccctttttacccacatgtgtcatgataaatacaaaaccctagttctgtcatggagcagctgctcatcttatccaggttctgaacccagctaagccccagtgcttgagaaggttgtactagttctgcttttgccaaaatgtgtttctttccacaagaagctccatgaaaaatttgaagtcatagccacagcatctatgcttctcagagatccctgaggcccacagtggcttctcctgtggatctcagctcagagaagtttcacctgtgttccccgaagtgatcagatccccagataatacactttcatacctccatgtgtctttccttcagagtttttagcacagtgaaagtctgttggtgagattatttactatggctctgccaggctgctggaagctccatgaggctgcaggcaatgctttttttctgctcatttttgttttcccagagcctggcacagtgcctgccacagataatcaatactatttaatccattaactgattgctctgaaaagaactacacacacacaccccaaaaacctggggacttaacttatctcacacattgcaaacctcattcagcaaacttttactgatcttatttcaagatccaggcactgaattaggtactaaagatattgcaataaactaagcagacatggcacttattctcttaggtcttgcatttcagtggggaatccggatgataaatgagtcaaataaaatgaataagataatttcagatatgtgttaagttctgagaaataaaatgagcagcactgataggatgaggggtggtcagggaagatgtctccaaagagaagacattcgatggagacctgaatcatgataaggagccaacattgtgatgttacaggcactgctttttttcatctcaataaatgtatcactcagaacaaaacccctggagtcatccttgactccttcctctcatactccaaggcaagtgcaaggcaaccctacagtatctctaccttgacagcgtctcaagctgatcagcctctccccaccctcactgctaccacactagtccaagctgccaccatctctcacttggacttttctaataaacttgtaacagatttctatccaccatctgttctctgtaagtcaaatcatgtctctgtggctcctccttacactgagggtaaaagccacagtgctaaccaaggcctgcagtttcacatgatctggcctcctccctacccccatttcctgccactcttctgccctagcacactccccttcttgctacccacaaataggccaaatgtgctcctgcgtcaggctctttgcacttgtagttttctctttctggaaaagcccatgtgcttttgtgttgtgctccatcacttcattcaagttcttctcatatgttcaccagaagacctgcccccaccctctgggggcaatcaccattattccctatgacttaactctgtttaatatttcttcatagaactcatcacacaaggcaggatattatctatgtgtgtcttcctcctccattagaatgtaaactccatgagggtaagaactgagttgactttgttcactgttgtattcccaatacctagaatatttatttctattcaatcaacagttcttgaataaacagaagaataaatgaaagaatgacaaaatgcaaaggccttgagtcatgatatgctgcaaagacagaaagaagacaggaataaggagagaagaggaggctaaagaggcaggcaggggccagaccacataggtccttgtgagtaattagaaggggctctgattttcttccaagagcatcagaaaactgttcacctctggaaagctttagctttgcaattcccaacaggtgacataacacttggagaaacactgaactctatgacctcttccccgctatgttctgtgatgcccggaagtagagctctgcactgttatttaatcctatcaatgtttgctctggaggcaatggattaaatagcacatgttgaatcatcaactgaattaaccttctcaagagtacctcatgccacgatttggattctctggaaagtatcccttactctttcctaatgtgcttacagcttggttccaaatgtctctccttggagttgctgtgtaaatccacttctttggggagccatccctgacctcccagggcagagttcaggatccccctgcatgctcttcagctcctactgttgagagcagaacagtgctgctttgtggtgtctctctgctgctccagctggagtgtatgttccctgagggtggggaccttctttgttgtctctaattctgagaccacagagaggctgctggatccagcgtaccaacgtgtgtatttgaactgttttattttatgttaattcaaagtaggtgccaacattttaggttttttaaaaaatagatttctggcttatgttgaaaatatataagccatagcaatgctgtgcccatgttcttaaccatgagaagacttgggtagcaactgctccattcataggggacatggctttcctccagcaagccacaatccccaccattccttattatgtttctaatgctgagctcaagtgttcctggtcatttaacatctgattgagttattgttttcttacagtacagaaatattctgtatccaatctactatcacaagaagcctgcatgttcttaaacctgatacatgcggcctcttttgagcaactgaatttgttaccctagttcgtcctaaaataaaaaagtgtttataaaggcataggacttgtctacccaacgaggcaaagatgttaattcttcccaaattgatatataggtttaatgtgattgctatcaaaatcccaccaagatttttataaatacagatctgattattctaaaatgtatatggaaaaccaaaggaaccaaaatagctaaaaatcatttttaaaagaataataaactgggaagaatcagtctccttgattttaagatttattatatggctatagtatgaaagactgtgtaacattaacagacagatagaggcatagatcaatgaacagaataaagaatccaaaaacaaacccacacaaatatgttcaactcagtttgtttgtttgttttttacaaaattgcaaaagcaattcaacggaggaaagacagcctttcaataaatggcactggtgcaattgaactcccataggcacaaaattaatctcaacctaatcttaatgaactcaaaatggatcacagacttagatataaaatgtgaagctataaaattcttagaaaaaaaaggaaattggccaggcgcagtggctcacgcctgtaatcccaacactttgggaggccaaggcaggcagatcacgaggtcaggagatcgagaccatcctggctaacacggtgaaaccccgtctctactaaaaatacaaaaaattagccgggcatggtggcaggcgcctgtagtcccagctactcgggaggctgaggcaggacaatggcgtgaacctgggaggcggagcttgcagtaagccactgcactccagcctgggcgacagactgagactccatctcgaaaaaaaaaaaaaaaaaaaagaaaagaaaagaaaaaaaggaaatcttcaggatctaggctaagcaaagagttcttatgctatatgcactgtgatcaaggctaagcaaagagttcttatgctacatgcactgtgatctaggctaagcaaagagttcttatgctacatgcactgtgatctaggctaggcaaagagttcttatgctaaatgcactgtccataaattgaacctcatcacaattaaaacatttgctcagccaaagattctgtttagaggattaaatgacaaactacaggccggaagaaaatatttgaaaaccacatgtcggacaaagactagttaccaaaatatataaagaactctcaaaacagcattaaaaaaatgcaattagaaaatgggcaaaagacctgagatatttcaccaaagacgatagacagatgaccaataagcacagcaaatgatgtttaacactatcagccattaaggaaatgcaaattaaagcacaatgagatacatatctatcacagtggctaaaatgaaatggtagcaatacaagtgctggaatgcagagaaagtccatcattcatatatttttgataggaatgtaaaatgtaccttctgaatattctagggaaaaaattctggaaaacaacttggcaatttcttaaaaacctaaacatgaaactataataccatatgacccaagaattgcacctctgggtatttgtctttgaaaaataaaaaaaatgtatgtgcacacaaaaacctatatacaaacctgtacacaatgtttatagcagcattattcataattaccaaaaaactggaaacaacccagatgttcttagatgtgtgaacagcacatcaaactgtggtacgtccataccatggaatactattcagcaattaaaaaggaatgagctattgatacaatcaacaatctgaatgcatctccagaaaatattgagggaaaaaaaagccaattccaaaagcttatgtactactggatgtacctcttcttaaccccaggtgaccactaatctgttctccatttttatgatttcatcatttcaagaatgttgtagaaatggagaacagattaatggttgccaggggataaggaaaggatggggactggagggaaactggtgtggctatgaaagggcaacaggagagatttttatagtgatggaaattgtctgtatctccactgtatcaatgtcagatcctggctgtgatatagtcctatagttttgcaaaatgttaccattgtgatggggggaactgggtgaatgttccatagtaactctctattatttcttacaattgcatgtgaatctcaaaattaaaagcttaatttttctaaaaaaaaaagtacaagctttggaaatcaaccagccatgggtttaaattcctgctacgccacttactagctaaatgaccatgggcagcctcttggggcctcaggttactcatcggttaaatggggatcataaaagacccatgctcacagtgctctggagattaaatgaggtcatgcagttacaatgcttaagagcttgcctatgtttggccaagagctcagtagatgggagctgcttttgtggctgtcactgtaccacatagagaatccagaggcaggttcagccctggaacatctcgggttaaaccatgctttgtgtagaacagaggttccccaagtacctcagttcatatcacccttcgtatcgtcctaatttttttcatgctgctcttgggccaaaaaaaaattcacaactgttctgtttactaagtagttaggttcaaactacttaataagtatgtttgcactaacaatgtagtaactgtttgaaacatagtaacataaattgaagaaataattttatttcattcttaactacaattgcttacaatggaattatgtgtccctaatagtctgtaccacttcccaaaccttggaatcagattgaatactgtcaccttcattatctgctccacattgattttgatgcagtgcttgtttttaattatattaactaccaaaactccagctttgcaaaaatactttgtaattaaggggaatatactatgtactaatgttgaagtggtaagttccctcatgctattcattctcacattatctgacagaggtttaatatcactattattcactcaaaatttaaaatatcctgcagcatccctgtgagtatgccatgatgccctggagtgctttggtgcataaattgggaattataggttgaacagttcattttggcctcttccagagcaaagcaaagtagactaaggcccaaagctgctctactgggatctttccagttgtcatgatccatctgcttctatctacacccatgtccccaggatggtctcacagctaaactgcctaccattgggagacaagagccattttttctgactcagcgatagcagaggatgattaggaatggggtactggaccttttttttcctggtattctaaagatattaagcaatttgggaagctcctcttaaaatttaattccacattaagcacctagaaggtgacaagcactgttgtaggtactggagccacagaaataaattgagcctagtccttagcccttgaataatgcttcctccacagatgatatgcagcacgatgttatagaaaagccttggagccaagagacccgaatgaaaattcggactcgccatatgaacttgttaggttggccttcctgagcctcagttttggtatctgcataatgggagtttaaatatccctacagcacttttatctcacagcatttaataagataaatgcatgtaaactcagaatgttatgattaatgaatagccaccatttagatgtgctgctttttaaaatcactaattatcagttcaagcagctttgcccaagagtgaaagaaatccaaacaacaaaatatacttctcatgcttcttagaagaaatggggatagcaggggtagcgcaaggaagaaaattccaaaagattttataattgtagtgagaaattgaggagcagacagagtcgtcctggaagccctgttctccttttgcaggctagagaataaatactttgagagctaaattgatctgctcatcctcctgttcctttctcctctggaatatgtcacttgaaagagatcaactttctggcctctgattctggctgtcacccagtggctgctttgtctaatgattgctacatatgactttttttttttaaactcccagtccaaaagctgtttcaaagtcaaagttaatacagatgttgtgtcatcccatgcgccagtgataggtgttgtttagtcaaggtggatctgattgggatctctctccaagaaagtgagataatatgagagaccataaagcagcagttaatttccctttcaaagtgaggaggattatgcacagtggtggaaagccgttctctgggtccccagcctaattgtcttgattaacacgctgcatggccatcacaggtgtagcacataatagcgctataaggttttcatagccaagccaattaaagtctgtcattgagccaagaactaactgtgtgtgcatcataatgccaaaagtcaaaatgagttctctagataacaattgcttgcatttctaggacaatttatcttttttttttttctttgagaccaagtctctctctgtcgcccaggctggagtgcagtggcgcaatcttggctcactgcagcctccgcctcctgggttcaagcaattctcctgcctcagcctcccaagtagctgggactataggcatgcaccaccatgcctggctgatttttgtatttttagtagaaatgggatttcaccatgttgtccaggctgctcttgatctcctgaccttgtgatccacccaccttggcctcccaaagtgctgagattacaggcgtgagccaccaccacacctggccgacaatttatcattttaaagcatactttctttacctcattttctcttcatgccagaaggcaagcagtttatgtggggaaactgaagttcaaagagattcagtgacttaccaatctagaggactctaataattgtgccaggctgctcatagtaagttcttaaagatttttctcttatccctatgacaataactaacattcgtctttcacttaacagctgacaaaatgctgatatatttattttctttctagatcttccataacaaccctgcaaatcagatcttctttagatcccatttttatggccaaaaatctcaaaatcttggaatattgattgaaatcctgccacattttagagttgagagcttgttcaagggcacagggttaccaagtggtagaactagggtaagaactcaggcccactggctgacccagtgttcttcacatcattccatgcttatagtctctttctctctctctctctctctctctctctctctctctctctctctctctgtctttctctgcacgttttagagttgggggaaaatgagtcaagacaactgacactgagctgcaaagacacaggtttcttctattgccacagtgcccagctttgagcaactaaagggttttggtcaattatctattttcccattgaactgggaatggacaatttatattctaaactgaatataaatttgactcttggtctcttaactgcctgatctctatggtgtgtttgataaaagtatttttgttggtttacaggccacccccagaggccctgagcaatgcatttgaaagttctgggtggctgtgaatgaccatgaaagtaggagataaatatcttagctggctaggcagaataagaagtagatagcctgcttaaaggaaaagcaagctctaagctattctcaataagatccacaaacaatttcttgcagtaaaatgtgttgttctttgtttctcagatatgaggaatgaggaggaacccttcttaggctcttctgatgattttttaggttaaggctgagtccctgagtacaaatgattgcctggctcatatcccagtgctgatggagcacacaggatggttccctggtgacacatgtgagggtaggagtggaatttcacatttctcactgctggaagggcagtgttttccacccattgttcattctgaaagctctcttcagtcccagcctgtgtgttgtcactggaggaggaaagagaatgaattctgtgttccccatggtgcactgaagcctaagggccaagttcctttcatctaaaaagccaaaaatgatgatttcctcaagagcaaatagctttcattgcttctttggctgcggagacatatctgtatctgctctgccactccatcctgaaatctggggtgtggctgaagtagccatgttaagagcattcacaaataacctcttttatttaaaagggtgggggcaggggatggtgtgggaggaaatgcaggaacagccttatgttctatattttatttcagatttttaaatattatgaaaaggaggaaggagcaagcatctatgtactttaaagatatatttgtaagttagtatgtatactacgtatagttaaatattttttgccactttataatttccaggcatggtatgaataaatctacacttggcttaacttaatgcagttgaattgatttctgcctgctaacctgtgattctctctcagtgggaaataatcaataaggtcagttgggcccacttttgcacatcattggtcctagttttaatcttggtaaccctggctgtaaaccacccactatggaggcagattgattggcagcaatatttgctcaataattttgtggccatatttgaggcacattttagcttacgacttggtgtaacagtttctcctttagagtttagtgcctgttttctttcttatactgcaaagggcctattccaaaggaagcttggggaaaataaacttgacaggaagggaaatgaaataagttttaaactgaatctgaaagggaaataataataataaaattaaagcatatagagccttagtgctcaaggaatttgaactggattagacgtggggatggagaaggtcataacatttagtccagaagtaaaaattgccatcagagtcactaagctaaatttaatcccaattccttctcattaggtgagtagcagccacctcaccttttccttcttttgtaaagaatatcttttatgtaccacaagtgaagggagtgctgaatatgatgccttcctttagcctcgcatgatagttttataaatttctggtgaagtcacacatgaagggaatatataaatccagcatcactgcccaagtcctttcagtccagcatatgttgaaaaatcctatttgaatggtgaaaagggaagaaaaagaattcttcctccacccacccagccattccacccatcaatcgtttatgacaatcttcagaccaaaaggctgttgttaagagagtaaaatgatataagcaaagtgcttaccataggacctggtttgtgtattactatattagtttgctagggctgccatagcaaagtaccacaaagtgggtggtgtaaataacagaactgtactgtctcacagttctggaggctaaaagtccaagatcaaggtgttggcaaagttacttccttctaaggctatgacagagaaacagttccaggcccctctcctagcctcctgtggtctttaggcaatttttggcagtccttggcttgcagatgcatcaccccatctctgccttcgccttcatcgccttcatgtgctattctccctgtgtgcatacccatctctgtgtttcagtttcccctttttataaggacactagtcatattgaattaggacccaccctaatgacctcattgcaactacttctgcaatgactcttatttccaaataaagtcacattccgagatattgggggttaaaacttcatataaattttgggagggcacaattcaacccataataattattatcatttattattatatcttcattatttcttagcttttcatagtttcctttatactataaatctattctctaccctgcagagaattaaaaattcgcaaaaacagaaaaaagtagggaggtgaagaaatcagaatatcaatgcatagtgtgaatatcttcaagtaataatgaactgttggacatagccaccatattcagacattaatgtttcaggtaaaaggatccagaacaactggccagcccaattcagtgaagcagcatagctagtcattagttaaaccctagccatccagagtgttggcagtctctccaacggtaagattttggtatcctttcatacagtaaggaggcagttggtgtggagtcccctgcatcagaggcttcatgcgcattttagatttattaaaaagcccacaaaaaaagaaataccctttggagcaatatagtctcaaatccaacaatttcctgcagtatcacagcaaagttccccccggcggctgttgagatggttagccagtaattcttcaaaacatttttttctgacacatacataacattttcctttgtaagaacgtgaaggtttgattcctccagagcccattacacagacagattggcccctgagataattacaagaagatagtctaatgggctcgattaagaaaatcccaagacccagacgagtcttcctacacaaacacaaatataatttcttacctaaaggcatagaaacagcattcagttcacctgtttatatttggatactaggctaatatcgatctgtcaaaacagacttgttgaaccagaatatttttactgtactctgcttcaaaaataatttaggatgacattcaaggatgtatcaaatatgacatgatagactacattaaaagttatgtggcctaaaattgtgtactgtcagtatcagaatctggcctcccagcacaggcaggagtggcagctctcacaaacctgacaggtggtgacgcagtccttcttgagatggcatgattctcggagctctgagttctgtccccacgtcccgagaggcggtcgcccttcgtattatacccctagctatggattcccatttgccctgtagaggggtgagagagtagaaaaatccttaggtgtccaagaagcatgccatctacaaggacaccgggagtgtttcaccctccactcctagaaaggcgggatttttatgaatatgcagcactgtcagttcataatttataccttcccctgacaccaacatgtccaacttcagattataagtacatttttaatgtataagaaaatgttttagaaggtgaaaaaaatcagtttcattaggttaagacactgtattaagctcatctctgtcctgtactctcttagtgtccaaggcacatatgtacatggagaaaggggggttgcctgctagacaagaaccttccttactgcatgtgctccatccttatcaactaggttttttcaaaatctctgtgataagcataggaattacctggggaatttttcaaattgcggatgcctagatccccattcctaaagaatctgattcagtagaactggggtgggacccaaaaatctgcattttttttttttttttgagacggagtcttgctctgtcgcttggctagagtgcggtggcacgatctcagctcactgccacctccgcctcccgggttcaagtgattctcctgcctcagtctcctgagtagctgggatggaatctgcatttttaatgtgttcctttggtgattgtgagcttcatggcctatgagacacactttgagcagcactctgccctcctatgatcttctttcttttagaacactaatttttgcattattatcctaccatcattttttcaaaatggaattttttttcatgttcatctgtgaaaaaatatgctcattgtgaaaaaataatcagacagtgtgagtaaaaatcatcaggttttcagcactgagatggaattaccctatatattttaatggcatccatcaagaacttttatctgtgtgtgtgtgtgtgtgtgtgtgtgtgtgtgtgtgtgtgtgtgtgtgtgatctcattttaaaatattaatttggcagatccaaatttgtggaaaagaaagagggaggtagcttccataagacctttttcttccagaggtaacaactttttctttgagttctctgactccaagagcccttcatttacaacagcctcttcccatggtggtttcaaagctccttatttacacctctacctggagcactcttctttaaagactgggttaactatcaggtgctcttagtaacttaggagacataagggaaattgcccatcatctccaagattcttttctcttttcttgcaaacattatcttgtcaccacagagctgttctcttttatcacttgtacacctctttcacttggaaaaagttaggtcacatcaacatttcacctattcatttttctacctttggtgagaaccaccatttagcatttcacctctgagaagtcttttctagctagagagggctcccaaactacatttcccaaggatccccatttattgtgctttgcaatcattgtgaggtcttaggttcctttgagaatctgatgaaaatgataatatctcactcctaaaaccaatgcacatattcgcacccacatttttccaagtattttcaagaggtccaaggaatctaggttaaggatactccctggtagtatgtcctcagcagactgagttccctcaaatctacaaaggattcccacagacattattcattaaaataagtattaagcatcaagtatgtagcagacactgcattggggtactggtgatacaaagagaaacataggagcccttgttttaaggatctcaggatagaaatggaagcagatggataaatagtgatcatggaatgtgagaagtacatgaaacacagcagggctagagtaaaatgtgcttaaattataatcgtagcttctttccttaaaatctttgatgcatcctcttcctatcatgcacaaagaccttcctcatgaacctcaagtttacttctctaatatattctgaacatgtgtccttcctttgcccagccctggcactccatgcttccgtctcattgaaatctctgttggtccccaaatgtaccatgttctatgagtcttcatatgagttgtcccccacccctggcattctttcctccccatcctttgccctttggccaggctgactctcattggtcttttaacactgggtttggaatgctttctccacgatgcttcccctaatttctttaaattccatttagatgcacttcttcccaagtacagtggctcacacttgtaatcccagcactttgggaggccaaggcaagaggattgtttgaaccccggtgttccagaccagcttgggcaacatagttgagaccctgtctttacataaataaaaactatttgggtgcagtggtgtatacctgtagtcctagctactcaagaggttcgggggatgggggatcacttgagctcaggaggtcaaggctgctgtgagccatgatcacaccactacactccagcctgggcaacacagtgagatcctgtctcttaaaaaaaaataggtgcacttcttagatgttatccttatcttaattcctattgcattatattacaatgtatgtgtcttcattagtctgtgtccctcaccagacagtaatatcctcaatggcagggactatcatattcacagttctagtcacaccaactaatgactaatagttaataaatatttgaattaatttatgaattaatctgattaaaaaaccctcagtataattagttttattgttctctagtataagctagaataaagaactctacctatatcctccctgagaagtatggtctataattagaactttaacgacatctgaccaaggtgctctctgcccatgaggaatctgactcttggttccttggtacacacagaaggagacagagagctgagggcagttaactaggagttgttcaaccgtcatttgcttaacactgtgcaaaatactttggggagtaaagatgtatttctccctcctttcaagaacctactgttgggaatacaagagttccccaggtgaaatcttgctagtatgtaatttagtaccaaattatgaataaaataagatgacgtttaaagtcacttccaactagtttttctgtgaagctaagattttttttttttttttttttttgagactgagtctcactttgtcgcccaggctggagtgcagtggcatgatctcggctcactgcaagctccgcctcccaagttcatgccgttctcctgcctcagcctcccgagtagctgggactacaggcacccgccatcacgcccggctaattttttgtatatttagtagagacggggtttcactgtgttagccacgatggtctcgatctcctgacctcgtgatccgcccgcctcagcctcccaaagtgctgggattacagttgtgagccaccgcgcccagcccgaagctaagattttttatatcacctaactgtactaaacactctatggcatatcttccaaaccacactgagagtgacaatcatgtgttgatggtctttgtaccttcaaggtcgaacatagtccccaggtctgagtaggtttctaacaacgttttttttgttttgttttgttttttgagacagggtctcactctgtcacccaggctggagtgcagtggcgtgatctcagctcactgcaatgtccacctcctgggctcaagtgatcctcccacctcagcatcccaagtagctgggactacaggtgtgagccaccacacctggcctccaacaacatttgttaaaccaaatacactcaaagaagaccgtgacacccaccataaatataacacctgactggagtttcccatttataaattttttcactgggatgaaaggcttatatactaaataagcattgtttattcttcactgtatattacttaggggcaaattagtatattactaatgtggcaaaaaaaagcggaatggatcaaaaagtacaagctttaaaatcaggcatacctgattcaaatcccagctcttctgcaggtttgacaagtaaccttccattgattccatagatatttgttgaatcatgctctgtgcaaggcaatgtgctaagtgttaaagaggtaaaagtaaatactctctacagtcttggagcttccagtaactttcttcaggctctttatctgtaatgtggagccaacgatgttttcttggaaagctactggcaagatgaagcataatatgtatcaaaatgcccactctaggtctttgcatgaagtagacacccaaaaaatactactagaaggcacagctcctatatgcctagaaggcacttgtcctaatcaggacaagtcaatgaacattcacagtgcagctaaagctctctgccagtatgaagtccccagtagctactgaacccttgaaatgtggctagtcaaaattgagatgtgctgtaagtatgaaatacacaccaggatttgaagacttagcatgaaaataagacagtaaaataacttagtaatattttgtattcattacatgttaaaaggatatttcaataaattgagttaaataaaatgctatatatgattaattttacctgtttttattttttaaatgttaccattagaaaattaaaaattatatatggctcacattatttctattgaacagtcctgggttagagagtaaatgtatgttataggttctaaaaagaaccaactagagatgccaaaggtgatccagaaatgtataccactaggtaatgactgagcagggatgaaaacacaaagctgcaatcctgcttttgtgccctcatggtggtattaatagtaattaacagattacaccggagtcagaacattctcattcactttagttcaaataccaattgtgggatgtacccatgtacacacctaggaaagggggtggtgctgggggctgggaagaagatggcagagatgtcctcaagacttacgatggctgctatgattcacttcttcatttggaggcatgttaaagcagatgggctttagacatatgaggtttggatgtcagcatcatttcttcctgcacgatctggagcaagttagttatctctccgggcctcagtttactcatttttaaaatgatggtaataataacaactagatcataagatttctgtgatgactgaaggagcaaatgcatgtaaaatatgtggcagggcataacgctcagttgttagttattgtcactgtattagtctgttctcacgctgctaataaagacatacccaagaatgggtaacttataaaggaaagaggtttaattgactcacagttcagtatggctggggaggcctcaggaaacttaaaatcgtgtcaaaaggggaagcaaacacatccttcttcacatggaggcaggaaggagaataatgtgtgcccagtgaagggaaaagctgcttatgaaaccatcagatctcatgagaactaactcactctcataagaacaggatgggggaaactgctcccatgattcaattatctccacctggtccctcccataacacgtggggattatgggaactacaattcaagatgagatttgggtggggacacagccaaactaaatcagtcaccatcacagtctattttatgcaatcataaataataatgcccaccacatatttggtattcaataaatacttgttgaatgaatgaaataggttatcatcatcaaatcaagcaatagatgactctttattcctgaaattccagtgtcatcaggtaggatcctgctgctatatctctgaatgtgggtgtgagtcttgtaagaacagtcacagctactgagaactgctggctaagttgtctcttgttttgacaagtgtccctcagcgttgactctaccctcaggccactccatagccattccagcaacgtccatggttttatatttcccttatcctttccacttttccattatacctgagtgtgagactctttttttcccccatccaatttaatcatataaaacctgctctgatttagaatctcctttgcagctaatcgaaccttgcagcattctattagctcttcctatttgctctcagcccaagctgaggctctgggattattatgtaataacttggactcatatctggtcagtatataccatgccttttcattctgcaaatcccctcagggttctctgtctgtttgcaaggggtgggagaagagagtagaaggattgtggggggggttttggtgggaggggactgtttgctaaaagttattatcccacacttatcagtattaaactggatttgacaactcatagcctgggatttaaatgatctaaatcctgcttcatttggcagcctgattttacctgttatttattgtgctacccaatttattatcatcggcacactcggaggcttggcctgtggtgtcttcacagccaagtgatttatacaaataataaaaaagatcgcggttcctagcaatgaaattcaaagcaattccacctctcctttccctctcatctagctcagttcatctcttacacattaacccttggccttcttacttcttctagagaaattcatcctcagcttccttctgatccctggaaggaaatgctattggcagagaaaggggcgggtaataaaagtgatgatttaggttggtgcaacagtaattgtagcttttgccatcaaaatctgcaattacttttgcaccagtctaatagaattccaaaacataagtatcatcaggtctttatatggaaggtaccaggcaaatcctctctatacgttataggatttggttgtcacaccagcactttgaggtagacattgattttatccaatttgacagcagagggtctcagtttgaaagatgctgcatctcagtctcacgaggacagacagagtgggagagagaagcatggccagggggtggggtgtctggaatatggccaggatgaggggtaatactggtaccaaaactgtaatgtagcagttcagaacatgagctttgaaatcaaacaatcctggaagtgaattctagttcttgaacctattgagttgtaggaccataagtaaccagtctgtgcctcagtttcctcacctgcaaagtgggaataataaagtagataggtagttatgagaactgaatgagatattgtatacagggcatttaacacagtttctccatctgttaaaaatggctaatggccaggctcatacctgtaatcccagcagattgggaggccaaggcaggaggaattcttgagcccgggagttcaagaccagcctgggcaatgtagggaggccccatctctacaaaaaaataaaaacattagccaggtatggtggtgtgcatctgtagtcccagctacttgggaggcgaaggtgggaggatctgcttgagccagggaagttaaggctgcagtgagctgtgatcatgccactgccctccagcctcagcaacagagtaaaaccctgtctcaaaaaaaaaaaaaaaacctaactcattttatcttcacaacaaccctatgaggtaatatatgtaaagcacttaaaacaattcctggaaatgctcaataaatgttagctgttattactaccactactattactaccaccaccactgctactactgccgttattattgtctactattactaccaccaccactactactgctgctgctgctattgtcatgactcaaattcaatacaaaatcagtactttccagcacatatattgcaaagaccttgagtagggtcctggtaagctgaattcacccatgatagtaattatagcctatgctaccatataaatgacgtgtgtgtgtttgtgtgtgtgtgtgtctgtgtgtggttttgttttccttgccccagatctacttatgaccttctcaaactggttgccaattctagacttggagggaggttagtctaaagctctagcccaagcttagaacaactttaatatgggaattcagtatcctgtcatcttctctctctagtctcaagctttagcaagtctacttgtattagttcacatacttcttactgaaagccaaatgttaatgggtagtcttctatttactcatttagaatatttataattagagagcttattcatttatttaaaatatgggccaagggtagttctgttggggtatctgctgtgttgaaactggaagaagcccctcacccccaattaattttatatcttgcaaaactatttatgttggcattgcaccaaataacatttagcagtcccatactgccactgttttttgaccacccagccctgtactttggaaatactggaagttttatcccatgttcccacataacttgcactgagtgggttacttgcatatttagggaagaatatgagtaaccagattgcgggaacagcacctcccactgatttacatttgtaaaggaagtgatgctgagagttcatggtgacctagaagtccaaattcggcccatattctcccctatatcctgtatctagagccaagaataatgttaaatatgtaaaaataatttttgccgtgagtgtgtatcagtaatttatggccaatagatagcattgttttcaacacaactttgctgaagcagcaatagcagaagatgggctttagaatcagcctccttcattaactgtgtggtcttgaacaagttgtataacatctataagcctggagtgccccagctacagtctatatggaggtggagtcaatctcatagtgctatttgaggagtaaatgaaaaaatcatttagagtttgtagctgagcacttgacacaaagtactcaaatacttgttacttagtagtattcctcttctattgatttgcatattcctaagctttttacatacaataaattttattgatgttgtatttgttgcctattatagtctgatggtgacagtgctattaatgctgttattgtttgtggtaaaaatatgttttaccatgagcatggtttcaactggaattcacttccaggtttgttctacaaaaccttttatatttcctcttatacctctgcaagattgccctttgttcctgatttcaaggccatagtcactgtggaaattccaaatcatgcctcctttctatttttgtccatcctcccattggttttcacttgctctgtggaaaaaccgtagtttctgtgtattggtagctggaagcctgaggcttcagactaaatattatcatttatcagtgctatagcacttgtattaaagaggtccttgcaaaaatttttatcaatgtatgtgcattagaaatgctgttttctcttgtggtcaaaagaagttattgaaattcttattctcatactcagccctatgtggagtgacttacctttgacctttcaccgtaagttagaagcagaataaatgagtggtgatttcagctgcctcctcctttcttgtgataatgaatgagtcagcatcaaggacttttccaggaggcctgagtcataaatatccctacattccatcaaaaatctccacagaaggttgtttttaaaccgtaaacgggaaaaagttcctggaccttatcttaatcatcaagttagtgggagatatttacgctctaactttggggtcaaaaagaaaggctatagctaacaatatagttagagaaattaatatgaccccatgatgagatggcaaacttctcatagaggaaagacaaaaaaaaagttcaatggacatacccactctgtccaaattcttgtcagttgtgttacattgttgttttcctaaaacttattgaggatttatcagatgtcaggcagtgtgctagctcctttatttgcattatgtcatttcatctgcacacctccttcatgaaaagtggaaagattttcttcactgttttacagagaaggaaattgagaatgagggtgactgactctcccaaggttttgcagctaatagatggcagaaatgtgctttgaccctcagatccatctgacttcaaagcccaagctcttaattagtcagttaaactctacgggaagccacggaaaatgaagagggaaaggagaagaatatacagaaatgcaagttggccttctctctgccacataaagtactcatagtacagtatagttaaggtctcttgcaaaataattttaattttccattagcactataaacagaaagccaatggatactataagaccctgaaaaagtccaggcatcagagtcctgaggctgcagcaaacatcaggtacccagcagtaccacagattttgcagccattttaagtgccagtaactggcaattattctgtatacctgaaaacatcccatttttgtcaccattcattctaacttacttggagtgcagtctcctgtcagggatgtctttgtcacacatacaacattttatttatgagaagaataacaaaatatgattgttggattagctgatagagcatggattggaaaaggagccagctggtgtgttgtgtatggcttcagcaggaagatacatctaatctgtgtttttctctccaaactcacacctcgtacatggctgaatcttcctctctaaccctttccactgtgagcctcgaaggcctcatcggtttcttcttggaatgcagagaatatcttttggctacatttcctggtcagactcctcatgccaattcaggcttccctgatcacctctctttttaatgatataagtttaatttccctgtattagtccatttttatgctgatgatgaagacatacccaagactaggaataaaaagaggtttaattggacttacagttccacatgtctggggaggcctcagaagcatgtcaggaggtgaaaggcacttcttacatggtggcggcaagagaaaatgaggaagaagcaaaagtgaaaacccctgataaacccattagctctcatgagacttattcactattatgagactagcacgggaaagactggccctcatgatgcaattacctctgcctgggtccctcccacaacatgtgggaattctgggagatacaattcaggttgagatttggtggggacacagccaaaccatatcattctgcccttggcccctccaaatttcacgtctccacatttcaaaactaatcatgcctccccagtagtcccccaaagtcttaactcatttcagcattaacccaaaagtccacagtccaaagtctcatctgagacaaggtaagtcccttctacctatgagcctttaaaatcaaaagcaagctagttacttcctagatacaatgggggtacaggtattggataaatccagctattcaaaatgtgagatactggccaaaacaaaggggttactgagcctatgcaagtgtctgaaatccagagaggcagtcaaattttaaagctccaaaatgatctcctttgactccaggtctcatatccaggtcacactgatgtaagagtcttaggcagctctgcccctgtggctttgcagggtatagcctccctcctggctgctttcatgggttggcattgagtgtctgcagcttttccaggcacatagtgcaaactgtcagtggatctaccattatggggtctagaggatggtggccctcttttcacagcttcactaggcagtaccccagtagggactctgtgtgggggctccaaccccacatttcccttccacactgccctagcagaggttctccatgagggccctgcccctgcagcaaacttttgcctgggcatccaggtgtttccatacatcttctgaaatctaggtggaggttcccaaacctcagttcttcacttctgtgcacccacaggctcaataccacatggaagctgccaaggcttgaggcttccaccttctgaaaccgcaggcccaagctgtatgttggcccttttcagccacagctggagcagctgggatacagggcaccaagtccctaaactgcacatagcatgaggacctgggcccagtcctggaaaccactttttccccctgggcctctgggcctgtgatgggaggggctgtcatgaaggtctctcacatggcctggagacattttccccatggtcttggggattaacattaggctcctgctacttatgcaaattactgcagccagcttgaatttctccccagaaaatgggtttttgcatattcaggctgcaaattttctgaacttttatgctctgtttcccttttaaaactaaatgcctttaacagtactgacatcacctcttgaatgctttgctgcttagaaatttcttctgccagataccctaaatcatctctctcaagttcaaagtttcacaaatctctagggcaggggcaaaatgccaccagtctctttgctaaaacataacaagagtcacctttgctccagttcccaacaagttcctcatttccatctgagaccacctcaacttggattttattgtccatatcgctatcagcattttggacacagccattcaacaagtctctaggaagttccaaactttcccacattttcctttcttcttctgagcccttcaaacttttccaatctctgcctgttacccagttccaaagttgcttccacattttggggtatctcttcagcaacaccccactcctggtaccaatttgctgtattagtctgttttcatgctgctgataaagacatacctgagactggaaataaaaagaggtttaattggacttatatggttccacatggctggggaggcctcagaatcatggcaataggcaaaaagcacttcttacttggtagcggcaagagaaaatgacgaagaagcaaaagtggaaacccctgataaacccatcagatctcatgagacttattcactatcatgagaatagcacgggaaagaccagtccccgtgattcaattaactccccctgggtccctcccacaacacatgggaattctaggacatacaattcaagttgagatttcagtggggacacagccaaaccatatcacttcccaactgttggaggattattttgctccacacgaagacaggagagcaaagtattaaccaacaggatgtggagtgcagcagtcccacggagatctgttaactctgtgactctgagcatgtacagaacataatctctgagcccattctctcttctgagagaaaaaataaacacacctattcaatgtttttgctgcttaataagtgataatctctcttattactaaacatggggaaaaggtcttatttaaaaatattctgtttataggagtcacacagtggaatggataatactgagaagaaaacatttttccccttcctgattctgagatctcataggtaacatttgctacattggtatctctccattccctgtccttgctttccttttgctgggaaatcattgcatctgaaaaaaaaaaaaaaaaaaaaaaaagtaagtgtttccctagccatcatattcagagaaactaaaagttttttaaagtgagtgagttactttgtggtatttaaaattatacatgcttattacagaaaactgagaaatagaattatctcaaaagagcaaaagtaaaattttaaactccatccaagcacacaaatactgcatgatctcacttatatgtggaatctaaaaaaagtcaaactcatagaagtataaagtaaaatggtggttacccggggctggttttcggagttgggggttgagataggggaagggggagcaattgggtatgggaagatgtcattcaaagcatataacatttcaattacacaagaagaagaagttttagagatctgcacaacttggtgattatagttaataatgtattatatatctcaacattgctaaaagaatagattttgggtattttgtttattttttataatttttttaaaatttctttttgacttacgggtacaagtgcagttgtgttccatggatctattgcatagtggtgaagtccgggctgttactgcacctatctaaatagagtacattctacctgataggtaatagttcatccctcacccccattctaccttcccaccttctagaagtctccaatgtttattatttcacttaaaagagtagatttgaaaatattctcaccacaaaaagtgataaatatgaggtgatagttatgttaattagctttatttaatccatccacaatgtaaatgtatattgaaatatcacattgtaccccataaatatgtacaattattcatcaattaaaaataaaatttttaaataagtaaaaaaaaaacacctctcataatcctaccctttaagacttcatccacatccttcctgtccttttttttttttaaataaatgtttaacatagctgtaggaatccacactctgaaatgaagggaaatatctgtgagctaatacaatgagaccttgttcttgtcactgttttttgtggaatcaaattcagcatacagctgagcaattttgaattccctgaagggtagtttagaaaatgaagttccaaaagaacccctttgtagagtgtgtcaaaacactagagtgtctctcttctataggatgaaacctagcattcagtaatcctccagttgtcccttcttatggaaacgcctccttgagccaggagaaatcttaccataatgtgtatcctagttacaaagccatgcaaatctaacatttacatagccacagaactgggtttcctcttgaaatccagaactgtatatggccctctatgcatcctgatgattccccaggagcatttatgaacataagcgactttggataatttatacagcaaaagagactgtgggaaatcctttgtaaagtagatttctcagatcagatcccatgagcctgagattcagaatggttttgttgttaagatattgactcaaggactagactgtgtgggtttgaatcttagctccactactaactggttttaggatgttaggcaagttacctagcctttcaaagtctcaatttctttatatgtcaaatgaaaataataggaataaacagatttgctatgaggatcaagtgagttcatgcatatgtggtgcttagaagtgtgcctaatgggttgttcaataaatatggtcactattgttaataatcagggtatgtgtgtgtgtttatacttggccatactccccttctgcacaatcccaaaagaatccctttgagactataaactcgctagagccaaaaagtcctgtgttccactctttgtcctcagcagcacctaggacagtcatatctagtttggcatagatgctgaatactccctagttggcttaaattggccaaaatcctagttttcttcctgcttgtttgacgcccagtaagtgcttggctccaggctctgagaggtggggatgcagtggtggagaaggaggctttagaggatggtgcctgctttttgttcctcctcctctggcatgatggattcttccctttaactccttagtgcctcaaagacaagtaatgatcaaggctccaggtaggactgactatcaaaaccaatagctgctgctaagatttgagtatttataatgtacatgagattccatctctatccagcacaccagcccactgatgctttacaagaaaatcctcagtgcctcagagttagctttcatagttttcttgttataattttcagcttcccatgtgccatgctaggcacaaggtacaacagtgaacaggacagacatgggccctgcccttttagagtctagtgaggaagatggacatagtggatagtaagtacatgtgataaattctatgtcaggaaatgcagggtgctatgggaatcttaggaaggtcacataactattttaacaagtgaaagaaggccagttatttagctttagtaggaaacaaagctctccttaataaaatataaagtaagtgccatattgtgggtttgaagatttctttgttctatatgatatatattttctgtgctgagaagaggatagtacactaaaaatcgatatgtcttgtaactcagtgttttatggtcaacttataacaccttcaacttatagaagaattaagattatcttctaaggcaggctttccaacatttagatgcatgcatgcatatcctagcttccagatacctgcatccatttccctatggctggttatttttttctgaaacggattttttttccagccttctgacagtgtagtggcagaaatacataggttcttcatgctgtgtttttactttccattttcgcaataaaactatatcactgcaaaggaaatcaaatctaatctgcaatatatttagcatgaaagcaataagaagcattaattcactccagaaagagcaaaatacagtcgggtactcaaaagaagaatcaccatggaaactgttttcttgaaattgtgtgctctccaggctccaggcatgactaagtgaggaaaggaaggcaaagggaagagaagaaatattttaccctttctgttgtcactaaaaatgctgctgaggaatttctatgaattattgatcgcattaatagaagtatatatgaattagaattattaaactgttgccttttaaatgagtgtgtaaaaacacactgagaacttgttcctcagtgttctcccttcctaactgtcaaaaccctattgagcggtgttctccctttcctaactgtcaatcatcctcttaaggtcaaaagttttaagagaagcactaggaattatgatgattaaagaattatgtaagctagaactaaggtaaaatgtgtttgcatgtaactcccagatagacttgcttttgtataccattttgagatgattatggtttcagaattttttcaaagatattaaatatgtcaagatcagcccagctcctgcctttgggaccgtgttaatgggatgtgatggaatttccctaaggaatttgttacagattagattcactctgtgtttgtgtgcacatgtatatatctcacaacgagtccactctccttgctttctacatttttacctcctaatttatagatttttctcactgcaactatatatttggattataatagctctgataagaatagctaccatgtgttcagtgttccctgtgagtcgatcactatgctgaattctttgcattataacatcaagggcataagcttttatttgggtggaattgtgtattatttagcaaaacaacaaattcaataaaagctcactaataaaataaatgtttatattctcatgtaaccctcaaaaaaaaaaacctatgacagtccccattttacagctgaggaaactgagtttttgggatggccatcgaatacactggatcacagagccagtgagttgcaaaacctggatttgaaatcatgtgggaatcctaagtccatgggcttaacaccactatgttttcattctaaaggacatagacaacctgcctttttaatctctgtatagactcatagctgcccagggtctggacatgtaagtaggactttggtatattcacaacaaatatatattgagaatctaccattgtaccaggcactgtcctaaatataaaaattgaaaataagataacatccctgccttcaaggaacttacagtcctcaggaaatgttggcacgaatgaatgaaacagacaaaatagtcaaaggttcagagaaaaaagggattaatgagatttgtggatttgttgagtttgtatggatgaatttgtcctggccctccaagagggggaggagcttttgtaaggtgggaggaagagaaataaacatttagggtaagaaaacatgattttaagcacagagatgggaatgagtgagaagggtttcaggacctgttagaagatcagggcgtgtgttttagaaaagtgagtttgaacaagtacatcgaccattgggccaatcagtaaagaacaatgaaaactggggcaaggaggtctggattttatcctatcaacacaagtgatctttcaaaggattcatgtgtttattctgaggtgttaattactcacaataacgagcattattcttttgtattcagcttaatgacttttatacatgtatacaaccatgtcaccattacccacataaaggtacaggacagttttaggactccgtaagattttctcttgcccactcttacttaattctccctcgcccagagattatcagtattccgacttttatgtgagtgttcaaagggaagtgatttcttaaaatgacactatgaaagtttaaaggaaagctgaatgactgacgggatgtagcacaaagtgtggaggtgagaggtttcaaacagggagaccaacaaagaggatgttatgaggttcactccaattcatccaatcaattaaatatttattggacacttattatgtaccatacccatacactgggaatatagtggtaaccaacatatgctctctcaatgaggaggccaacaaataaacagttaccttacggtgtaataaatgctataataggaggaaatatacattgtgcttaaaatgggcatctaacccagaataggaaagtcaaggaagacttcctggaggaagagacgacaatctgaggatcgaggatgaatagagattagccaggttccaggcagagaaaggcacatacaaaggcccaaagaggagcaaggacctgttcatgtttaggtagtggcagtagacaagagagaagtcaaagaaagtaagttttttaatcaaaagaaatggccagacttagtaattatattctatcacaagaaccatgtcaaactgggtttcttcaacactggtactgtatataattgtgttttatactatgtattaggcactaacctgattgtgcaacattgcaaaaaatttcagatgttcagcattgcaggctttttcattattgtttatactgtgggcaacccacttgcttgtcagtcatttctctgaatttgagccagaaaaaccagtcaggcaataagatttcacctacttctgttagatgaagctgtttttcttattctttgtagcatattttgtagcttccccttttctggactgggctgggctgtgcaaagcagccaggctatgccttctgacttttagtttgtttcctggggcagctttgagaaagctattgagttctcaacactcattttttctctgattcatcagcagataactcagtaagcagaaagtggcctttgtagctccgcagacctgagttaagccatagcctaagtcttactaactctctttgtgacttcaacaagttacttaatgtttctaggcttttgttttcttgtctgggaataatagcatccactgcatatggcgtaaatgtcattaaaatctaatgttgtaaaagctgtaagatagtacctaacatatagcaggtcttcagtaaatagtatctggaggtagtaaagttgagtggtttatagcaaaaagctctcaagttagactgcctatgttagaaggctggttctgccaaaggctagctgggttaacataagcttacagtgactcagtttcctcatctgtaaaatgggggtagtaataatgacatctaccttatggttttattgtgagggttaaatgagttaatgcatgtaaagttcttcacacagagcctgctgtgtgggtatgcatatctctacatctatattagtagtgttcctgttaaccttaatgattattgttatttttacttattacttggtcccatctatgagaatgggagagcagtacctacctatcctgcaaggttgttgcaagagctacttaagaggtatgcgtggctcagtgccaggcacacagtgggctcctgataaatgtttgttgagtgaatgagagcaaagtgcttctctctgaatgttttctgtaaatgtttcgccttaatgatcactgggagcttccacatagaaggaagtgccaaagaagcgcacagggcggcagcctggcttgggcctggtggaatccaatgatgttgaacaaaatagattcagatcagtctatttggtgccattgaaactgtgccaacgagcagcaaaatgtgatttcatgttgggagagtgccaggatcctggtttgcaaatcaaagagaatcctacctatttctagcaccttctctctttctcccctcaagattcttctgtgtgggttttcttacctttgaaagagcctctggatgtttcacaaaatcaggccccagatgtttgaaagacttttgcagacaaggtaatcaatccatttggtggccagatgctgtctgaaaattttcctgctatagcactgcaagtttctaaattcattagaaacataaattaattaaatctaatcaacagtgggtgatgcagaagattaaatagtgaaaaacaaatacatttccaacagggtcatattagaggcagagaaaaacagctccagtttggaggtaaatgtcaagttaacccttcatgtgatattctcagaaaacttagccaggcctgagtccccaggtgaggctgtggttctttccaaattaaggctgctctggtgggttaattgacttttcaagaaataaaaaataaattatctgtttctctaaaacattttggagtggtctgattctcttatgtattcacagaagtgaaaatctccatcattcctttatcatgaaaagtctcaagagataggatttgcaagtggctatgcactatgtataaagcagtatttttcagtagcattctatagtcagataaatttggaaagagagtgaagtcttctttactccacactagaataagttacctgagttcaggattgtctgaactgaatctgtcaatattcagatttaatattgactgtcaatactgaatctccaacaccaaaaagaacagtgcctggcaagtccttaataaaaccttaataaatatctgtaagtccttagtaaatatctgttaatgtatgaactgtgggtgaacttctttctgatgggacaactcaatatttacccagataaatccccaagatgagggacagtgtatgagctatttcccaacagtgttcgacatcttccccccaagaaacagcatcttaaggaactaatggtccatatgatatattttagattaaccaagttttgaagtattgttgtatagcacccctatcctttgtcccatatcctctaccctcagtctaaatgaaactggagaagattcagggtgagtgaatagtgaattcatgcagtcaacttctgggtaagaggctgtcctccaaggatgtgctcagcttactggttaggccagcccttagttgtgatttgactgttttttcattccacacttgcatttgcagttttgactgttttttcattccatacttgcacttgcagtgctgacaaatgacctaacgttgtgtggataaaggtgttgctaccttgcatgcagccctgtagagaggtaccagtttgcagaggataccactcaacagtaaagaccagcagctgctaactcagatgcctacagaggcaaagtagcgtaaaagatgaaagcagagaggtagaggaaaacctcaggagggtaaatgggagctggcacttgacactaaggctgggggtacactaggaaatgttaggaggtgcagtaaattcaagacctatgcccttctaaagggagcagctgcttccccactcaagtcaggaatggccatatgggaatgccagcttgatgttgccaatcttcatttttctaaagaaactgaaaaatctcaattgtttaaaatgaaactttatactttttagatgatagaaactcattcaaaatgttggaaacctttgtgtgggctaatactgcaatgttaataaactagtccaaataaaataaatctgcttgtcagatatgacctatccactccaactggtatcctctgggctatttggtcccatgatgtggagctgtggagccttgctctgccttatctgggatccagatgagtgatccactgggaacaacaacaacaaattatatatattgaggagctacaatgtgcaaggcatcatgctaagctcctccccatccttatctcatttaatcctcataattcccctccaaaatggtaccaatattattcttattttacagataaagaaactgagattcagagaactcaagtaacttgcccaaaggcacatcacttgtaaatgacagagatgaatggtatctttctgacacctaaagtcattctgttaaccattcattatgttacttctaggtaaaatactatactaacatttagtgcttatgtgtgtcaggtaccattctaagtgctttgcataaatttatgtacataattctcaacataatatcatcatctccattttgcagattaaataagtagggggcagagagagaggttaaataataaacccaagatttgccagctagtaaatgtggaagctataatttaacctgggattacaagactgctattgatcaactcttagaattatttctcaagacaaagtcctaggtcaggcacatagaaggtgctcagtaaatagttttcaatggacagcaaatctcattttcgtcttgggattctgtgctgcaggtgtggttgttgcctctaagtagctgctatttcagccattatttcatgtgactcactggcagctgtcactcaggcagccttcactgcatcactttgctaattccaggcatgcagagcaaagactgacaagccctagaagctggctcagcctctaatgaactgtctaatccagaaatcccttctcagggatcgggcaatccaattcaaactgcgtatgtgactgaaatagttcactgggtcagacttcttggcatataaagatcttcccacccagtctctggtgttcgattgcctttcttcctgcaaattgaaagggtggagactggtttagacaagggctggaatttaagtagcagaagggtgtgtgtgcattttataatgcatgtgttttcgtgtatatgattagctcagcatagaccttattaactagaatgaagcaaatgtggattttattggttttcaaattttcatgatcccatagttctgctacactcaattcaactgaaaaccaaatgtacgtgtgtgtgtaagaacaacattagaggatataatccaaatgatcaggctacaaatattaataaatattctaggaaaccgtacttttttttttttaagatggggtctcactctgtcacccaggctgtagtacagtggtgcgatcacagctcactgcagcctcaacctcctgggctcaatctgtcttcccacctcagcctcctgagtagctgagactataggcgtgtgccaccatgccaggctaatctttgtattttttgtagagataggattagaaaaccatactttccttgaacaatgcttgcatgtctactatgtgtcaaacattgggctaggggccaggaataccgttggttaaaaaaaaaatcagctgtgcttcctgtgaattatgaattcttgtgaattatgtagtcttacaagggagacagacattaacaataaacactcaaaaacatacataatatacataatgatgaattatggtagatgcattaaagaaaaaggatagagtactataaagaacaatgtgaagactttaaaataggttgtcagaaaagtccactctcaggaagtgctgttgttcaagctgaaattttttaaaatgaagagatgttggctaaggaaaagggaggacgggggactagtttaggcaaagcatgtttccccaaattaagggggaaagcaggaaatttatgagatcctgaaagcaaaagtagggctagaaaatggtaaggagggaggtcaggggatagtttgcgagggaggaaagggcccgttcacaaagtgttcttaatgatgacctaccaaaaggttgtattaccccaaagcttccccaaaatggtgtctagtacattttactgttgatacaagttcaggtgaagaagcaggaggtatatttgagattgtggccagtgttgagtctatatcttcagtgcttaatggtttggttccttctgttacctgataaaatactgacatatcattttttattccccaagaactttgcagaaagcaatgcatcacagtcagtgctagaaacctgctatggtgtgtgttggaaagaaaggaattttgccaacgcatttaatagttatggactttttcaagtttgaagctttttcatatcctccagaggcaataacttaggttgttggaatcagtatttgaaatgttccccaaaaatagagtccttggaggtatggaaatgtgatctgattttcactcctctcctatctgctattcctggagaaagcatttctgaaaatggccttggtactagatttctcaaatactagttttatttcagaggtgtcccaggctataagcctatagcaatgaacaattaaaaataacaataagttgtaggtaaaaatggaacatgtgtgactttaagctaagcagagagctgtcatgtgcattacataaacccaaagtcagttgtccccatgagaatcctaaatctccagttgtgaaccatttatgtcatgtttgctatgcacagaataagatcctaggtactgaaaaagatgctttctactaaagaaataaatattattctgttttcagggaacttataatctagttaaacagataacacatacacaaagtatatttgagccatctatcaacattcagaccataatccaatagaaatgagtcatgcctgataagaagatgccagctaagttagtgaagttttaaatgtaaactgtccttacttggtttctagaagagaataattttcaactgggtgttagaagggaagggaaacaggataagttctaagaggataatttccagattgaagaattgtttaagcaaaggtctgaatgcagggtagtattgagtgatggtctcagatcccactagggatccagagattcagaagtaccatgaaaataagatgcagaatttcacaaatataagtacatgcatatttatggggaaaggatttatagcttttattggatcctcaaagatgtccgagatctcctaataaaggttaagagctaaattgtattattagagaaaggttcagattttacattcttttattcatcaaacattaattgtgcttagtagagtcaaaattgagtaaaataggaattctgcctttaatgaaatacatttcagttaggaaaatagaacaagtacacatgtaagtgacaatgtcatggatctcatgtaaaagtacaaagagttacagtttttgtgaggaagaaggaattttttccaatcaatgaagcttagaaaagcttcatggaataggtgacatttgagctggccttgaaggatttgtgtatttacttttttatttagtcagtaaacaagtgttttttgcaaacctactagatgccagtccctatgctaggtcctcagattataataatgcagaagatcctgcccacaagggacatgctgtctcaaagaatgagatgtcaacaggcacaattaatgacaagaatatattagataaatgaaatggcatgaacagttggtcagcaaagattgtatttgctttgagagtctgaggagttaaactttgatggagtgtgtgacaatgatggaaaagtgaagactgagcccagaagatacactctgctgtgttaagaagtaaaacctacaactgtgagtgaaagatgaaaaaagaatttatatagaaaaaagaagagatagtatacagaagagaataggaacaagaaataatagaaggtggagggaaaagaagcagcccacaaaaaggcaggttctgaacacaagctttggaactacaattgggtttaaatcccagctccacgactagtcttacaaacatgagcaagttatttatcctgtctgagccaccattttcccaactgaaaaatggagaaagatactaaaactcatggagtttgagtgacaattaagtgatataacataaaacacaaagcacagatcatgaccaaagtcagtatccaatatatgacgatggatctatagatttaggaagagagtgtatgtatatagagggtcgaacgccgtgcctggcttgcagtaggccaactcaataaatggtagtttcaaagaaaaactatgcttttctaaactgtgcagtgctggtgtttctcttagactgtaatgtcttgagaccaagtcaatagctagttaatttcagtgagtcttctttatgacagttgcaattctctacctgtagtcatactgcaggaaaggaatgtgcagctaaaagagttttccattaaagactgatgtcctggaagggagatctacaaatcacttggaaagttcctggcaccatcacctgggtctggccatttacaatgtgtctgtaaatcttgcacagggaaaggatgagagtgtagggtttttttccccactctgacagacttgtttctataagatattaaggatactggtgaaagttaaggaaggccaaaaggaggtcagcctacccatgtggaagtgatcttgtagtagatttctcatcactttaaagtgtatatgagttagcagccttctgcctggtaggcagatagtaggtagctaaaagaacagagtcctttctgctctcagcttcaaaaggagaagggaagggaggaagagatgagtggaaagcagaaaagaaagaagaggtgtgaggtcaggggagagggagagaataaggaggaagaaacaaaaaaaaaatcaagaggtcttttattcatagcaatcacatggatctctgaaatgctgatatatgagagaaattcttgtaatactaaatgttttaagaatcctgttaaaccttatatgaagagaagatttcaatagcatttttcttactatccagattttggctgtgggtagggtttgaacctgtacagattttatttcaaatgttagtggcgaccagtcctcattcctggcctgttcatctatacatttatttttttattcattcagcaattccaccttctttcttcttcatcgttatttttttcctggcagttggaactttcccaccagcatataaacatgctgttatttctatgacactgtgaaagtactctcttgatcccactttccttaccatctttcacctcatttctttgctactcttcaaggagttgtacatagtcaccatctccaattcctctcctcccattctctctgaaacctactccgatcaagttttatggccaccatcccatagaaactatacattactcaaagttaaaaatgagctccacagtactaagcttaaagttttactctaaacttttagcttgcctatgagcagtatttgacatggttggtcacttgtctgaacttcacttggtttccaggacattacgtttctttgattttcttattatctcactggtcattctctttgtttttttccctggattttcttcttctgtccccaactttttcaatgttggagtgccctactgttcagctcttggtcctcttcatttattttaatgcactcactccccaagacctcatctggtcttgttgctttaaacactatctgaatgctaataactcccaaatttatatcaccagctcaatcccctctcctgaactccaaattcttatttccagttatctcctcaacatctgtacttataaacctctcacatttcacatgcataaaactgaacatctggtcctcaaaaagcctgctttactcacaatattctcagtgatggcaactctaacatgccagttgctgagaccaaaaactttgggatcatccttgattcttgtattttttcaaaccctataatcaatccatcagcaaatcctcacaggtcaactttcaatatcatccagaaaatagccagttctcttcacctccacagcctacaccatggtttatctccccttgattatctcaatacacttcccaattctacctcagccctctacagtctgttatcaacactgtagccaaattgagtcttgtaaaagcagtcacttgtctacttagtatccttccaacagctatccctttcacttttttgttgtaaaatgtacgtaacataagctttaccattttaactatttttcagtatacagtttggtggcatcaaatacattcacattgttgtgcccatttcacttttagtaagagagtccttgctgtgttatacaagactctatatcatgtgaacctcccatttctcctacctatttaccccttgtttgttctgctctaggcacactgatcccttaacacatgttcatttccctcttagggtctttccattgtcagtttcatctctttggaacactcttcctacagatacctgcatcgtgaacgcctccactccttcaagtctcccccatgaagtctgtcacaaccaccctattgaaattgcagcctccctgaaaatgccagtcctgttcatcttactcagctctatttgttttccttagtacataacatacaatgtaatttaatatgttcattgatgattttcttttctccacaactagaatgtaagatgcatgaggacagatatcttatctatttttaattgatctttctttaatatctggaatagtactttacacgtagttggtgtgttcaatgtacatttgttgagtgaataaatgggtcaatgaatgaattaattaaccctaaatcttgagacgttgtttggagattctagcaggggaacacagctactcatatacccttgaccgaagaccagtcctcctctattggggatgatcatgctcttcaacccattgtgcagctctgggagggatgcacagagtggtgagggaggaaggagacacctgcctagccatccggatcagccaaatcaaccctggtgatcagtggggtgacagatgttgcaaccagatcacccttatgtcctattaacattaaatctttcctgacttttctagttttaatattattcattgttatctaaactgctacatgaccatgaagtcaaatataatagattttctaaatatccgattttcagtggatagataaaagcagtaagtatttactatactgcctttatcctgatgaatatttattaaagattgggtcctgctgctgatgaaaatcaacactagtttattcattctgtattttactcttacctactgtgtgtacagtattgcattcagtgctttaaaatatgcatattatccaaaagagagcatactttataatattcttcaaaataccacaactcctagccagaaactagaaggagggagggagaaagagaaaaaatactaagtgattcatggtattataactggcacgcttgtttctaatactttccattttatttgctaagacccttgaaaaaccatcgtaacataataataccttgtgaactattagcaacatatttattttgtttgacatcgggacctcatgttttaggaggaaaaaatcaaatccttgcctatcatattcttcattcatttctttaggcccacctacagtttaacaaaaatatgcattgtatttagtgttcaatttgtcctttagagaaataaaagagatttattgcatgcaaggatatggctgagatgtgtttccttgagttctgataaggacttctgcttccctctaggaaaaaaaaaattctttgacttaaaaatctctatgatcagaatctttgaacaacctttccccaacattgtacttgtatcccaacctcccattacctcccagtcctctaactgagagtttcacaagggcaagtaccagtagtgtttgtttattactatatctctggtacccagcccagtgacatgcacataataggcattcattaaatcgagtcctttcatctcagatgtatttgctcatccactttggctttcttattaccacctccatgccctctcccaagtaggaccctacctggacatcctctctcccccaacccatctgctttctcttcctgttattcataggaccctgaatccctgacagtgctgcaaaggctttttaggacaagatctattatttattgagcaatgtatctcattctaaaatcatcaaacactcactattccaaatgagaactttttcttgcttcacatcttaagtaaatgtttacatctacccagcatacatattttgattattgatactttgtttagggttatccattctctatatgttggtccactttggtattggctctcttcagtgcccattcagtgatccattaaagaaaaaagattgattgcttgatgacttgtgagcatagaaaaaaaaagattgagaagcatctgttatatactaagagactcagctaggcactgagggtttagtggtgaacaagttccttgtgaagtttacaatgaagagactgaaacaggcatataaatgattctaatatcattgtgataaatgctaatgattagtggtgataacttataaaggcaaagtatggggagcaatgaggctgcataataaagggagctgtgttgggcttaaaagaagtcacacagggcttcttaaggaagtgatacctgagccagtcccaaaatatggggaattttagcttccacaaagtggataccatgtcttactgacttcagaacatctggcaaagcaaaatttctgaccaaacatgtgccagatgccataatatgtgtgtttgggtagcaggtagcacagggcctgcccaagaactcccattcccccacagatgtgagaactttctcattttggacctggagtcctgctgactttggggtcagccatagatgtcccatgttgtgcggataatagatctgaatgattgacagagtttgtattgcctgagcagttaattactcctctgctttttgaaaaattgggtgacagatggtaaacaccttgacagcagattccactgtaaaccacacaggcatgtaggcaagtctggactgctatcaatttcccactggatttttctgtactcagagacttataatttttaagactcctttgccctttaggcaagttttgttccaactatgggaaaattttatcttctaggcttctatgttgcaggaacttgttttgaataaaaggcaatctttatcaacccacatgtccttgggttgattcaaacctgtttagtgttggagatttggtcagcctggggaagctgtgtgcattttaaggggaacagcatggcattcattactcacctgcttcccaccatctggattttcacagctcagcaagcatggtgggcttcctgcatattagcagggaaagcttggctcctaaagagggtgtggctaggtccctctgaagtcataattttacaatgaacaccatgaataaattggggttggcattctatcccagtaagctgctttcatatctgaatggttgaaaaataatacaccatctccacagcaggggaaggaggaaaaacacaaatcatcttaatactaggaatcaagcaagtgggaaggaaaattggttgtgtggtagagtaaagtggaaatgtgcatgtgagagtttgtgcaaatatgttgtaaggcaagggagtttccaactcaacatgcattaataacctggccctgtgcaaagtgctataaggaaaacaaagatggaaagacatgtatagtagcatgaatttagatgaatataacagaaaacttactaacagtagcttaaaccacagggtttaacaatttcagacataggctgtcttaaggtaggttttagttgttcaacagtgtcatcaaagatattgtcccattctcccatctgtcatactcagcttcttagccttttaaagtccataggcttattacctcatggtcacatgatggctgccacagccccacgtattatgaacacatttaattacaaacaaaggcaggaagcaatgaagagtccggtcagaaggccttccctcacttacttccttttattcagggaagaaaactctttcccagaatctctgtcccgctcctgcttccccagtagactttcctgtatgcctcattggccagatctgggtcacacaattacccctagccacaagggaggctaaaaagcaagtatgtgggttttccagcctctacagtgggacagtaggaggcaggcaaggaagaaagattctgagtaggagtagccaaccaagagtatctgccatgacataacacatgccattaatgggcttgatctacagggtcagactgacatttaagcagtgcccattttttaatactgcacttatggttaagtaggaaacagccattgtgataagagcttgggacttggagctattggacccttctatctgtattctttcatctaagaggtaaaccagcaccaggttgaagataaaaccagtatgcacagaattaattaaatgaaaggaagaatattcagtatccaaatactagacactgattggatgacagaggaaacaattctggatcaaacagaacgtattacacacagtaggtcaaggatagcaagcatgtggcatgtgtaatcagaactgtgtatttactacttctgtctttagtaccaaactaaatgagtgtgagaagcagtgtcaagttaagaaggtaacgctactgaatcaggaactcaaacatagttccatttagacaagggcataggtgaaaaggtagaatacttcatggataacgtagcttggatgcaggttggcaaaagtgtattgatgaattttttttagctccataccatccaaacagaatcccaaatagtaataacatctagacagaaagattaaaaaaaatctttgactctgtgtactaagaaaataattattggtgccaaatcaagttgagtcatatcaatagagacactgtatctacacagcatttttaactcttacaagctcttatatctatcagttcattttattcccataattttacttcttttggaagaattgtccactaaaaagagcagtatgaaggaactttctggggtcaatggaattgttctatatcatgatagtggttatggatacatatctctatgcatttgtcaaaacctttagaactggatgccacaaaaagtgaattttacacacacacacacacacacacacacacacacatacacacacacatacatagatatacagatatacagtgttttttttttttttgagaccaagtctggctctgtcgcccaggtgtgagtgcagtggcatgatctcggctcactgcaacctctgcctcccaggctcaagtgatcctcccacctcagcctcccaagtagctgggaccacagacatacaccaccatgccgagctaattttttttatttttggtagaaatggtgtttcaccatgctgcccagcctggtctcgaactcctgagctcaagggatccacctgcctcagcctcccaaagtgctgagattataggcgtgagccaccgtgcccagcctatatataaattttaaatttttaaaaagttttaaagctgctgagatgagtgctaaaatctttcattcagtttgaaaacaaattaaaattgtttacaagttaaaaattgttcaagtatttatggttatggcaaaatatagaaaataccgaagatttagaaaaagaccataagaaaataaattatgtacgttctacaccaaaaagtacaattttggattctctctgataaacttttgtctatagagagagagtgtgtgggtatgtgtagtcattaacaattacttgtaggagagtcagattgtaaaggaaacttagttttatattttaagtgccaccttgtcattaacagaagtttctgtaagtgtacatattgctttacctgttagaaaagatatattctaccaagaagcagcttctccactccttctggaatctccgcctggttcagcccgcctgcctccactcctgcctccaccatgtccatcagggtgcagaagtcctacaaggtgtccacctctggcacccgggccttctgcagctgctcctacacgagtgggcctggtgtctgcatcagctccttgagcttctcctgagtgggcagcagcagcttccggggtggcctatggtggggccagtggcatgggaggcatcactgccgtcccagtcaaccagagcctgctgaacccccttaacctgaaggtgaaccccaacatccatgctgtgtgcacccaggagaaggagcagatcaagaccttcaacaacaagtttgcctccttcgtcgacaaggtacggttcctggagcagcagaacaagatgctggagaccaagtggagcctcctgcagcagcagaagacggctgggagcaacatggacaacatattcgagagctacatcaacagccttaggcggcagctggagactctgggccaggagaagctgaagctggaggcggagcttggcaacacgcaggggctggtggaggacttcaagaacaactatgaggatgagatcaataagagtacagagacggagaatgaatttgtcctcatcaagaaggatgtggatgaagcttacattaacgaggtagagctggagtcttgcctggaagggctgacgatatcaacttcctcaggcagctgtatgaagaggagatccgggagctgcagtcccagatctcggacacgtctgtggtgctgtccattgacaacagccgctccctggacacggacagcatcatcgctgaggtcaaggtacagtacgaggagatcgccaaccgcagtcgggctgaggccgagagcatgtatcagatcaagtatgaggagctgcagacgctggctgggaagacctgcgtcttacaaagactgagatctctgagatgaaccggaacatcagctggctccaggctgagactgagggcctcaaaggcgggaggatttccctggaggccggcatcgcagatgcggagcagcgcagggagctggtcattaaggatgccaacgctaagctgtccgagctggaggccgcccttcagcagaccaagtaggacatggcgcggcagctgcgtgcctaccagaagctgatgaacatcaagctgaccctggacatcgagatcgccacctacaggaagctgctggaagatggagaacatgagtatccatacgaagaccaccagcggctatgcaggtggtgtgagcttggcctatgggggcctcacaggctctggcctcagctacggcctgagctccagctctcgctctggcgcaggttccagctccttcagccgcaccagctccaccagggccatggttgtgaagaagatcaagacccgagatgggaagctggtgtcctctgatttcctgctcaagtgaacagctgcggcagcccctcccagcctgcccctcctacggctgccccaaagcctaggagggaggctgctgtgcaaggaagcacagggaacaggagacttacctgaggctcagccctagccctcagcccacccgcgggggagttcactgcctggggacccccgccccttgcccatgcctccagccacaaaacaattcaattgttttttgttttgttttgttttgtttttctgtccaaaataaaacctcagctagctctgccaaaaaaaaaaaaaagagaaaagatatattctgaaatgaaaacactttgacaaaattgcaatcatttgacataaactgttttattgactgattattttctaaattttatgacatattaacatctttcaacaaggtcatcttggcataatcccagtaggagtatttgggtttggccataaccagacttttttcctatcccctccccaaccccctatttgtggaaaatatgctcaaatgcactatttcagttaccaaaacttggtaagttactttggtaaagtaaaccttatcagagaaaatggatgctgactttggaccgtgatccaggacccaagaaggagaccacagttttatatggatgggaggaacaactgtaattcccatcaggacacctaagaatcccgtttgtttaatgatccacaaagtagtcattgccagtctagctagaagcctctgtgctgggatgacaaatgatacacatcctacctcccccaccacccacccagattcattacccattaatcatggcaccccagcctagaagtgaccccgcaaaaccttctcaacacaaacctggtaactatgatcatttcaccattatcattcactatgaaatatattttctgttcttatcttagctgaaggcgaaaactaccaaaacccaatccagtcatcagaaataaagccaggtattgagtaggcagaactagtcagctgatgcaagtagggtaaatgactttatgatattatctaccaaatgtttcttagatgaaagataaaacatttaatgggctctgaaaactaaattgcattacccttgcatttccatctctatgattgatgttgagaggtcagtgctagtgacctggtcagtaagatattccatctgtagactttgagtttagatcctaagtctaaactgagtctccattttatcaaaacagtcaccctcctatgtgagttgtatatcacctaataatccaggtgcctgcctcaactcaattctctggcattgcatagactccagcctagcatgatactgcaagagactagggatgaactaggagattcctctgtttccgtaagcctcacaatcattagcctcacatgcgtatcattgttaagtcaatatctattattcaggtaaataatactttatgtatgaaattaccagtctagaacttttgtaggatgctgagattgatttaaaaaaaaaataataaactcagccttaatagtgcctattgagctagaaatggggttaccaggccaccatcttgtggaaattaaatcagcacaaatagatttggagcaaggcaaacttcacactacccagggtttcctttaaaaatcactttaactacatctgacctttctagctgtttctggcttttgtttttagtcattgtgtactttatccacatctatatacaacagaggaaaaatgctcaagtttgtagtttcttgatcaacagcatgattaggctgagcagttaatgaaatgtggaattgtcatataaacttacaatttaaaggtgaaagccatgttgaacttgatgaattgatttctgtggatcatgatttcaaatgacgttattatctctaaacttgctaccttattactacatcctcttaccatatcacaaaattattttgtcttgagcagtatattttccagtttaaactgccttaccaaagagcatgctgcaaacacaagagtatttgtatcagaagtttcagtatcttgaaattggaatgtataatgattcatgagttttgcatcaattattaaacagtcatagatgaagatatgcagagatggatggggcagtaaagtattccagttacacctactggcttagcaatgataaatgagtcaggaaacatgaaagttcaaaacaagtattaacttgagctgccacggcttattctctgaagggaagtagacaatagcatgatataaacaggttcatgtacagagcagctggctagtagaattaaaataaaggtaaggactctgcaagagggctaaggaatttcagaatcctgccatgcaaatcaccctttctcttacaaggttcttgagggagacatagcattgcaaaataataacacttggaaaacaaaggaaatatttgtattacctgggaccatgcctaatactccataatgcagaattctaataatactggcttaaatcatgtgactttgacttccacttgaatcctgccttgttttgacttgcatgggtcttaaagtgagagtaaagacattttcagagtctaggaagaaggaaaatgtatgtgtcatcccctgggaaagcaagtgttgcccttggagtaatatcttcttggcaactgagccaagagctcacactgggaaaagctacttaactctcttctgatacccaacttcaccaaaaggaaaggcccatctttagttctcattgtaaggcccttgcagcccacccagaactctagtgttctgcattaatcactgtccagtgaaagggcatagactgcatgtaagcagaactttagaacgtagctctgagacaagagccaggcattgtaaacctcaggcctggctcccaccaccctctcattatttcctgctactctttctttctgagaaatgtttgtatttgagcagttcaagagccttgaactggaccagcctttgtacctgaccaaagacaaaaagtgaaaagcaatagacatgcccgctttaggctgtacccaaatttggaagccccatgaataaccctttgctaaccattcattgaaaagccagaagcagtggttaatgttagaagtgtaacttagcactggtactttcaagcagggcaatctgaagcaactgcaaatgttaagtagatgccttctctcgtctaaacatgggagtagtttgctaagatgggcaaactgtaacaaaggaaagtggtcaaataactcacttgaggtgtctggctttctcactggctggactttcttctcaattcatgggcattggttacataaatggaccttctaaacttacatctggaacttagtaaccatattgcttattttgtgtttccttaaggtagtattcactggagtcttctcgagaaaatgaactagatttctagttaagagcatcagtattggaatgagatagcctattccaaatgaagactctgtacattagaagtcataaactgataacccacaaaccacattcagcccacagatatgattaactttttcattctcatggcattggaaaaaatacttgccaatgtataaactttaagagatttttgcataaaagtcctgatttccagcttcctatatatatttaaacaatgagaacatcaggcaatacatggcaatacaggcaatcatggccccaatcagcttaagctgaatagcctcttgcccctttaaaggagacatacatagtccttctagttcacctatgttactttgtggccctgcaggcctttgtatttgctatctaggaggtcaattatctaagaagtcaaaacaagaaatcaagaattgttcttttaaatgtgtctagcttgaaagtgaccaaggtttatgccttatttttgttaacttctgcacaatgaatgaccataaggagccttttcatacatggaaaagaacagttatatgtgaagtggagaattttacactacttacctgaataaatcaggcatacaaagaaaatcctgaaataatgatataaaagtaagatttgagatcagaattactcaggggtaattgccttagttttccacctcactgtttcccctttgctttccttacctagacattatcttcagaatgttcctgtcaaaggccatagtcataattcccctgcctctttttttttttttttttttaactcatttgcactcttggtagcaattgttggagccctgcaggggaataattgtgggggaattaacctctgacatttttctaaaaatagccctaataaatccaatcataggtaatttacctgtccatgttcctccaggggtaaccagcatagaagaaagacttggcaggctggcattccttcagcaattatctgtgatctgagttcctggtgcctgtgcattttctctgattagaaatacagagtacaaattgccctcacttctctgcccttatgaccttgttttctcagcacccttctcctggggttgaaataagtcatgctcttccagaaggatgtgttgggctcacaaaaaaagaaggggcacgggccaagctggagcattcgtcagttccttccttgaattatcgactggcagagttttcccaatgatttctttgtgctctgttcctccattttccatgtctaagcttcaagcatcctaaccctgcttcatcacagcccccagccctgatttgaatagccagaactgaagcctgtgtggggaagattcttggtgtaaaggccgtggatgcacgaagggtctgtggttggtagaaatcatcaaagaaaatagccatttccttcagccatcatgaagttaattttctcttccttaaaagggtataaatgtgtttttcccttttattctctccagatgttccaggagaccactgtgcagtgtgggcatctaggaaatttacttcccaagtgccacttctggtggcatttaaaacccagaacataacatccttgtaaattccactgcagagacaaagccctaagcccttaaatgcacagaaaagtatatctattatctatcctttcaaagtaagtgtgcagttacttaaattgcctttgtcttcttctttgcagctgacattatctctacggtagaattcaaccacacgggagaattactagcgacaggggacaaggggggtcgggttgtaatatttcaacgagagcaggaggtaagtggtggtgaatgcaaaatgcccattttcttcactttttaaaggaggcctcctactgttccttaatccttatgtgtcgcccttaaccttgctgctttgctcgaaaactaaaaactgccaaaaaagtcattaacatcaactgttatacattcagactcataaaagccctgtaaaagagagccttttctgggcatggccttatctttctacgcctggatgttacacctgcaaaacaacttcacttctcgcctgacctgcaaaattccatgggtgcttgttgagcgtaactcctcctttttcaatgggatctgtcatagagccattgaaattcagtctcccttgatttcaggtgtgccagaatatgcaggaggaaaaaaacatagtttatttgccaacagatgtgaagaggacaacttgggacagcagagaagaaaatgatagcttacctcacctaagggggtaaaaggccacaaactagcgtctgagtaaagcttatgacacacatcacagtatcactgtaggtgacacagagggccctggagctgagtgctacatataggaccatttctgagcaggagttctaacttccagtaactctcataaacccatttcttcctgagacatgggtttcactaggaattgtttctctttttcatataaattgaggtttttggtgtctgcttctgtttgtcaaaatggaattatggcccaatttgatttccttggcctcccctggcatggtcttcgagcttccagcaggccagtctgtgttctagtagctctcccatctgccactgcctgcctctgagattcaccgggcactcgggaagcatgagagaggcccagtgtgagaggaaggtttcacaagagacttccctagcaatttaaagcctgctttgtgcctcaaagccacttgcagtacacctcccctcaaaaaaggaaagcctcatttagaggtgatatatttagtaattgcacattatttgcaattaatttctataagggcatcgtaatccctcggggttccatataaattcaagtgttcagcattaaatcaggcatccagcctattccattggccctggaaacacgaaaatgtggttggcaagtagaaactaatagctcttcatgacctggaatttttcctgcttttccagagctgcctagtgctaattggtctggcacatactacacacacttgacagtctgatttggatggtagcaaatcaacactcttataaatgtattgttaaggtggactggctctctctgcaaatgagcaggatagtaccaagtatgtcagcatttaaagtcttttgaacactcattttcaaacctccttttccagctttttcttaaaaaaaaaaaaaaaaaaaaaaaaccaattaagttcgcagtgatgataaagaggaaccggaggagctatttagcataaattacccaaggcagcatgttgccagtaatattctgctctacattttccattagctatttataggtttcacctattttaatttagtgaaatatttgggaagcctgattcattcgtagaatgatgggggacacattttctaaagcagggtagttttgttcaataaaaaataaatgtcagtgaggataaagaacctgcagttaagcgttaagctttgtggccagtcttgggattaaaatgagcactaaatccgagaaacaaacccatgtgacatcatctagggcagacctgcttttgacttcagtgagtgagctccaggagtgaattctcaggaggcacacacccagagagtctgcacaaatacattacacacccagggttcagcactctcactggtcagtaagttgagatttgggtttggatattttatatccacctagaaatatacatttggaaattaacccttttattaagagtcaagcttttataacaaatgtttaataagactcatatttgaatttttgagtttttcaaagcctgcttcttgaagctcttggtaataaggacctaaaatatctgaaataaaacttccctttccactttcctcctcttcttcttctttctttcacatcctgttttttttctcctctcttcctttcttctttttcttcctgtttctgcagacccttgcccttgtgtttaattctctcatcatgtatgtagtccctgctgtttgctcattgcataatcagcgctagaggaaagccaagaggtaaagtctcatcattccttaatgatgcaggtagcatccctgagctcctgtctgctttgtcactcatgttggaaagaaaaaaaaaaaaaaggagcaggggcatatctgatgcccaaatctgctccttatgagctgtgagacctagggaaagtcatttaatatctgagcctcttttgtccatttccttgccccaccctacctcagagatttcatgagaatcaggtgagatcttaaaaggccaatgaaagtcatagatgctacaattttgtactctctttaaggggtcgatgtaagtatttacgaatgccactgtgggatgactcactccaaagggtgactgcagcatctgttaggatgcaaaaagaaaatattagaacttctatttatattgattttaaaaatttgttctattttaaaatttctatgtatgtattatgtatactatatgatagtacagaagttcatgtgtataattatatgtgtgtgtatatatatatatatatatatatatatataaatattttttttttttttttttttcagaggtgctagtgactatcatggccctgccctcatcctcatggccctgccctcatcccacccccaatgactgctggaaaaaaaagggagttggcgagttttacagttggctactgtgatttaatctgttgtgtatttttttcctttcctacagagtaaaaatcaggttcatcgtaggggtgaatacaatgtttacagcacattccagagccatgaacccgagttcgattacctgaagagtttagaaatagaagaaaaaatcaataaaataagatggctcccccagcagaatgcagcttactttcttctgtctactaatggtaggtggaattcctgtttggtattttcagagatacagtcggccaaactatatacttcaatctctcttaacctcaatttcctttgaactgtgtgggctgttgaaaaacttagaaataacatttgcaagatgcttagcagagtgcctggcacacacagattcggccctcaataaatagtaactactgttttttaaaatattaaatttatgacccaattatgtgagacccattatctgcagttttcaactattgcagattatttgcaggtgtttttggaatgtgacttcctgtcttaagattcactgaatgttattctgggaatacatttcaggaaactcaacatgctgtctctgtgaggttggcatattgaatagaagttattaatccctgaatatattttagggtctgtaaagcagatggctgtgtgtctctctgacaaaaattaacttctatgataggagcacaaggcaagaagagatagggactttatcaaaaaactgatcaagaaagggtttcttttcctatctccctccatacttaacaccatttgttggatgaggaggagttgacataaataggtcagagagagaggatgttgggtactgaatagagagacaaattacataatgactgggtaagtctttatacagtggaattacctaacctccaggttcttaaatccttgctaaaagaagccatctaagctcaaaacaacttggcataaagtcacatgttaaagggtgctaattgaatagcataacaattaagaggattcgtatttaaaaattaaacactctctcccaagaaaatgagttggagaatgattcattttatctcatatgtgagtctatgaggaatatacattttaatttaaatcgagaagcaagaagcaagggatttaaaaagaaagggaaatgttcatatttcaagtgaaaaaatacagtgtcaataatgtgatcaaacatacatgaatatttttaaagactggaaggaaatacaacataaggttcatcatgattaatttttgtgcagtatgggcaacttgtcaatttgttccttttgtcattttaatttgtaaagttttacaatgagtctcatattaatcttatggaaaaaagcggaaagttatttaatgcatttgaaccccaaatctctcaaatataaagccagcatagaagtctaaaaaaatgacaattcggacgcagctggtttaggattatccaagcatatctcatctcctcatgaccagatctctactcatctgtttttccagactccaagtagtttgattctttctcataactatatttattgttctgtttatgttttgcaatcctgatttcttggaagccaaaccacataaatttgtttcaatttctttccttttaattttgctatttaagtttcactaacgggctttgcagattcaacactacttggaataaaagagacttctgatgattttgacttaattactttaggcagaggaaaaatgtctgattgtcttctatagctaactcactttatattctcaaatttagcctattgattattgcatttaaaactcgaagacttggccaggcgcggtggctcacgcctgtaatcccagcactttgggaggccgaggcgggcagatcatgaggtcaggagatcgagaccatcctggctaacacggtgaaaccccgtccctactaaaaatacaaaaaaattagccgggtgtggtggccggcacctgtagtcctggctactcgggaggctgaggccggataatggcgtgaatccaggaggcggggcttggagtaagccgagatcactccaccgcactctaccctgggcgacagagcaagactccatctcaaaaaaaaaaaaaactcaaggatttattaactactttgttggcggggggatgggaaaaaatcagtgaaatgcaatgaagattaattatatagcataatattctgttaattgagtttttaaatagttttttgattaacaaggatattatcttcccatttgggatactgtttcatatgccaacagcatctcaaaatgattcttctaagaaaaattcccatgttcttatgtaattttcttttttatactaatattgaggttgagaatcccccttaggccaaataggttaacatgcaaaagttaatggaagacaattggaattactgtacaaaagagaaaatgaagatagatgataagattgtgtttaaaagctgccacaagcgatgataaactactcagagaaccagcaagaagaaagaaaaagtcattactcattaacagccacatgttccttagacttttttattcacaaagcttcaagatactgagtcaagaaaaaaagtgtgataataaagtcaagaatgactccaggcaacccaaccatggggaattggattgaattcactatcaattatctttaagaaaatatactgcttatcttattatagttaggaacaatttttactttctgctagaatatattttcaaacttacaatttcaataaaaaataaaaccaacattcaattgtgaatctagactctcaaattatttatgacataaaaacacattgttttacctcattttctgcttccacttcaatacctataatgagaagtggggtatactgaatttgtttttctcactatgaaattagtacatgttcatggaaaaaaaaatatagaaaaacaaaaataataaaagtgttcccatccagagagaaccactgttaagtcttttaaagtaaaaagcaaaaagatacaaataaatttgtttgtttcttaatggaaatatgatatattctgcaaactcttttgtaactaggtttttattaatataacacttaataataggaatatcttcccaattgttaaatattctaaaatatcataatgaccacatagtatttccttgtatgattcttctttagtttactagtaagcctcctacgattagtcctttagctgttaacaaattctcactattataaatcatatatgcaatacgttatagtatacaaatatattctatccctataaatatatttgcagggatagacgttggtatagataaatatgattaggcaaatgcatactgtaaactaagtatgccatattatgtttactaaaaacagttacataattgtatacataaatataaaagaaatcacaaaatttgtataataggtatctctatctagtggaattaagggagtttttttacctttatgattattttaataaacattccatgtatcgcttgtataataaaaagaaggaaataaaatgagaaaatacaaaatctatatatgcaatattacagatttgtattctccccccaaagtacatagaaaaagtactataaggatttatgcaaaatgttgacgatgatcgttcctgactggagaggttgtaggtgatttttattcttcatgttatacccatgatttctctgtttctctgtatagcaatttatcattcatgataagaaaaatatacgatgttaactttgcaaatgggatgggatacattccaaagccacgcaacaaaaaaaatttggtattaaaattttggggatgttctaagccacagctgatcaagagctaatcacgtgactatataaatatggcccatgttcattttctcaccctaaaaagcagttcggtatgcagcaggatctcctttcgctccagcgcaagccagggtgacggcacaattcagagcgcacaaatcatacacttagcagccttgccagtgtgtcagacacgagcagcccaagtgatgcccagatacaagaaaatggggcacttatttgctgctgaaagcccacttcacaatgtggttcattaagacctccaagaacaaggcatttgtttctggcagcttcaaggcgaatggtactgtgatccacatctcctgcttagaagatctgtccgcccaaaggcatgagaagtgggaggtggtggcaaaaagtcaggtgaggagaagtggaggaatggagcaaggggcaaaagaggaaggaattcccagagggacggcttttctcccctgacagtgttacagataagaaataggatgtgctgacatcattgagggttgaagctaaagctgtcagagcaacatgttattatggcagaatagttgcccaatttgctaattctaataaaagctgtcatttgcggaccattattagaagcctaatactgtgttaaacattctccatgctgtgacttatttaatcctcatcagagccccatgaggaagatactgtttccccagtttacaaataaagaaactgaggcaccatctttctttgtaagattgaactatatgggatatactcatactaaattattttttgcttatctgaaattcaaacttaactgggtgttctatatttttttacttgctaaatctggcaatcctatttgttgcttaagaaatactagttgtggtcgggtgtggtggctcatgcctgtaatcccagcactttgggaggcaaaggtgggcagactgcttgagcctgggagtttgagatcagcctgggcaacatgaaaaaatcatgtctctataaaaaatagaaaaattctctgggcgtggtggcatgtgactatggtcctagctactctggaggctgagatgagagaatcacctgagcccaggaagacaaggctgcagtgaaccatgatctcgccaatgcactccagcctaggtgacagagtgagactctatctcaatttaaaaaaagaagaagagaggaagggaagaaaggagagaggaagggaaggaagaagggaaggaaggaaagaaagaaggaaggaaaaaagggagggagggaaggaaggagagagggaagggaggaagggttatgtacctactgagtgggaatccccgtccttggacatgtgactggcgtcagagtggggattgggcccaaggttgtctgattccaaaccctaccttgtgcaagacagaggaagatacaaagaaggcaaccaagttctgccttcaaaaagatatgttaaaacaagtataaaaaatgtacactggatctgataaggcaagcccaccaaagcatgtggccagcagacatgatttgtttgcctgatcttgtctccttaaataattgaattaggccgggtgtggtggctcccgcctgtaatcccagcactttgggagaccgaggcaggcggatcaagaggtcaggagatcgagaccatcctggctaacacggtgaaaccccgtctctactagaaatacaaaaaaattagccgggcgtggtggtgggtgcctgtagtcccacctactcaggaggctgaggtaggagaatgtcatgaacccaggaggcagagcttgcagtgagctgagattgtgccactgcgctccagcctgggtgaaaatgcgagactctgtctcaaaaaaaaaaaaaaaaaaaaaaaattgaattaaaagcctgcatgtagggcacgccattccagctccacagatcctttagccctttttactcatttccttggcctgcatgacaggtgtagggatgggagttctcatgggagttctgtagggataggagttctctgttttaatgctatagagaatgccaggtgtcatcaagttgtaaaaagtgctggggcagtacaaaggtgagaaaggtagtttccagctggagactccatagaggcagcaaaaggaaaggaacatttcagtgtatctccttaccattttatttccctgaatattgctagaaatatgtactatgcaggtagatgagatttgttcatttgccctactaatgtttattgagcagctattgtgtgccaggcactgttctgggtgctggtggtacagtgataaacaagatagatagaatccctgccttcaacaattttacactctagtgaaagagacagatagttatttgataaataatcaaccaattgtcaggtagtaaaaggtatcatgaagaaaaataaagcaggagagaggagatagagaatggttctgaggacagcatttttaggtaggtattacataagcttctctaaggttgggatgcaagcgcaagaggaaagtaaaggagcaaattatacgaaaaagagggtaaaggactttccagacagaagacacagcaagtgcaaaggccccgaggcttagtgagcttaatgtgtacctggagcagtagggaagccatgtgtctggagcacagtgagtgagcagggagaggatggacaggggggtcagaaaggtggagaaagtggagagggcaggtcatgaagggccttttaggacatggtaaggacaatgtgttagtgaggtgagatgctaaaatagagataatagcacctacttccagagttatgactgttaaaccaatttttcatgtaaaattcttagttacattgtaagctctgtgtatgttgcactcttattattcaatgctcaataaatgcttttattgaatgagctgaattaaggtataagctatagatttaagagcccattatcagggaaatccatttgtcccagcataatgtatgtttttgttttgaaatatgagctctgccttcaaatgacatgggatttatgcacgccaaacgtttatgtgagccagcttctgtagcaattctatccatccttacctcttcctctccccattgcccccaggaaaactcccttatgagcttgcttttcactataattctgacttaatctggttgcccactacagataaaactgtgaagctgtggaaagtcagcgagcgtgataagaggccagaaggctacaatctgaaagatgaggagggccggctccgggatcctgccaccatcacaaccctgcgggtgagtgcaaacagctgccctggccaccacagtcaggggcaggtctcctaaggttggccatgtgctggttgttactgtaggttgcaactataatgggccagtgagggaacgtaggcagagactcagcctaccccagtctctctctggtggcagatggagaagcaggaaaggtgccaagccttctaatgactacaaatccatgcttttccttttgtcccagaagacttgcccacatggccactgccagacgttactataatcttagcctctgttgttcacgttatctaaaatgtcttgagcaccttctgtactgaaggtacagggatgagaatccagatggcgagttgcagtcttgtgattcagaacacaaacttaataatctaacagacctggcttcaaattctgccacttacccaaatttcccaatagtcatttaaccttttcgagctttcaacatgcaagttaattttaatttctccatctgcaaaacagtgaacacagtacgtactgctcgtggacttatgaggaagaagtgcaaggatggaaaacccttcctctatggctggtcctcaatatatgatctctactcagtctgagtggcttccttcctgttcctcagaaatacatagcctgataaagaggatttgtaagactaatatacaaatgattatggcactaaatatagtaagataaatgcattgagaaagtgttggagagttgcaatttgataaaaggaggaaaaaattagctgtggtttttggagaccagaaaagttctcataggaaagtggcattaaaaacggatttctcaaagcgatcttttaagggaagggtctctagatgtaaggtaaagtggtttaggactggatgatgagctcagttatgaacatgttcaatgtgagcagtaaagcaggcacatgttgggatagccctagccccaacagccttgtaaaactgtgtaaaatatgtgatttcagacaccagcagctctgctaaagaccaaaagtaagaagggagacagtgaagtagatgtgaggaaaataggttcttgccctatgtttgaaagccaaaatgggatggtcattgtatgcttaattagctcacttgtttatttgtttaataattcatttattgatacatctgcttattcagcagttactttttgaatatagactctgtgctgaccaccatgctagactattaggtgtttaccctgtcctaatgggcacatggtcttcagttgagctgcttctgagctcacaagcattggcgactctgtttcctctgatcagcctatgctttcagctctggagaacctccatgtaagtccaccttatcattctgggtggacttggcataaatccaggcttgatgctctgaatgtgcaggggttttggaggctggaaagtagcgtagtgaagagtattattgttgagtcagtccagcctgggttagaattctggctccgttactttccgctagtgaccttgggcatatgacagtcatatatcacttaatgatgggaatatattctgagaaatgcatcattgggtgacttcattgttgtgaaaacatcatagagtatacttatgcaaacctagatggtatagcctactatatacctagactacattgcctgttggtcctcggctacaaacctgtacgcctgttcctgtgttgaatagtaagcaattataacacaatggtatttgtgtatataaacatatctaagcatagaaaagacacagtacaaatacagtattataatcttatggaaccagtgttattgaccaaaacatcatgtggcatgtggctatatttgaataccttgtgcctccaatgtctcatctatataacggggatgatgatagtcactgcttcctggaattgttgtgaggattcaataagttattttgtgtaagaaacagcttagcctgtgtagtgctggctcacaaaaagcactcaatgatgttagttcccttctgttgttttagtattaataacatcatcgtcatcatggctattattaccccctactgatagtgggcctatatatatgagacaattcagttatttttctttttatactttttatactgttgtatttattctacaaactactcactgagatttactaagtggcaaacaccgtactggcaatatattgggaataagactgtcttttgcccctcgagacatggcaatcttatggagaaaacaactggattaagtgccacgtagagtttataccgtgaacttctgcccagactttaccttgcccttgtttgctatgtggatggaatttctcagatgacatctgtagaccccaccgtggaatcctactgtccatggcatcctatgggatttcatatatctgtgcttaacccctgggagaattccatccctatgataaagagcaaagaaggtctattcagtttccacgagagcagagatcctccccatgccaagccagtgatgccaatgaagtggacttcagatgaaacagagaaggaggccctgaggtgtggctgggagttggaaaattccaactctggttcttgctttcttactaaccagctgtgtaacctaacaacctaactgatgaattatacttcttccctccaagcttagtttctaagctgccaagcagaggactgggaaatgtaaattcctgagacccactccagagaggaggcccagaggaatctgcattttcaacacttgaccctggtggctgagacaagggggtctgcggtcactggactctatcatccctaaggcccattcgagctatcattttttttttcaagctatcatttttatgaacctgttattttttggagagacatgttatatttgctatataacctctgttatattttggagggacatgttatatttgctatataattataaataccagtatctgtatttacctcctctcctttcctaggctctcaaatatcctgcatttcagtgtaaacatccacaccacagcactctttaaacactgaaaagtccagcttccttttctttttgatcccagtggtagaagaaaaaaaaagcaggcaaccctgaagactagattcagaacaatgactccaaacagagaatgagctgacgtgatattaatcagactataatttactaacacgctctcctcttgaaatgtgcattgccagcaattgtgtctttttttcccttccctgtactatgattacttcttgctcactttcatagtttccagttctatgtgggtattgagagtgagaacatttaataatacccgacagctaattaatccttactgtgtaatgaacctgttctgtttcagcgctgagagactcagcttttcaaagcaagaatgtgactatatctttcatagaagatagcctttcaaaatcaatctcattaccaaaagagcccatgagaagcatgtctatgaaaactatatcccctgctcaatatcataacttaacataaagcaataatcatggtaataatttaataataatgccttacagttgtaccatttctattacaagcgttttctcacctagtcccttgattcatcttcagaatagccaatgaggagggcaggacaggtatttagcaggtgaaaatgcgggtatctagcacttattgatcatttgccatataccatgcaccacgctgcactctctatctgcactagctacctcaaagggtgttaaaatgcccatttaacaaatgaggctccaagcagttaagtagaatacccaagatcatgcagggctgagaaccaagctttgatctactttgctctgggacctgagcccttcgatccgatgcagcctcagagagggaaaatgacttacccagtatccctcaactggttattccaggactgggactaaaaatcaagagttaggctcttaaacttagacatatacatctgggcatttgaaatgtttgtcttaataattagtgccattattattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccctccccccaccactccccgctaccactgtccctgccacacacacacacacatatacacacacttacacattgactttccagatctctgacctcagcaatggagaaacaaaggccttgaggtccctatgcagttttacttcagaagaccctccatgcccttcttccccaacctcccgctgcccaggagtaacagacccttagagctctttctaggtaatgggaactcatcgttaaagtgacttaatcagcctgaaatggaagttgggtggtgagaaatcacacttagcatacttctccctgcagggtaagcctggaggtattctttttctcattattatcagctgccagtgccctgggaacctaggccaggttgaaatcggcatttttacctgttacaaatatgagctcccaagctgtgactggtcataaccttcccaaaatgaaggtgatgtgatgaatacaatttttcgaatggattttattcaaacatgccttacaacaaataaaaataattatagcaaccatctattgagtgcttactatgtgccaggtactagattttatatccttaatatcacatagtcctcataatatctctctcggttaggttctatttttctctccagatcatctgaagccatagcctcctcttcatttcagtctctgctcaagtgctacctatcaggccctcctagggtatcctatggaaaagagcacacccacatttcccattcattctctctgcccttttttgcttagctcttgtcactgtctagcattttcttcgctgtctgcctcctcttcacccccagtaaactgtaagctccatgaaagcagggactctgttttgttctctcctgcaactccggcacctggaacaatccatggcacatggtagactttcagtaaatatctgtcaagtgaacagattacacagaaatggaaaccgtgttttagagtagccaagaagtttgcccaaaatctcatggctagaaaacggaagagctggaattcaaacctagtccgcatgactccaaatctgatgtttttcatcttattctctacagctctgctttttaagaaaatattcctgaccatggggcaggaatgttttattattgattgatgtctctcagaacgttttatcaaagctctcttaacatacaagctagattttggtggggtggaaggcggggggtgagggctgcagagccttttctgccacagggtgggtacacaagggatgcactgatttttaaaggaaagatcaaatgacatcatattttacacaatggctgtttctgtcctcctgtcagcacaggacactcacagtctcatgaatctccagaactaaactttttccacttaaaatgaccctgatgttagcaaatcccattggtggcaatttggacacaaccataggtaccgtctaagacactggccaactggcattcagttttaccagctctgactcctgaatgaggacttcctgaggaccattgctaaaaggtcatgagattaggcaagttgactgaaaagactagctagttttcccaaaagagagatcctctgagtgaaacagtttacttgatttgtctcctagagaactgattaaacagactattggtttaggcttactaatagtagcaactgtgcatattcagcctttcttagtgacaggcttggggcgcagttgtttgatgtcctttctttatcatcattctgtgacttaggcatcctgcccattttagagatgtataaacagaggctcagaaaggtaagtactggcttaaggccttgcaaatagtaaacagcaaagccaagaatggagtccagagctccagagtctgtctgactccagagctcctgttcctcactattattaggactatttatggcatggcacttgatttaaacaacagtgaggatgacaacatctgatgtacaggacttttccatgtattttgtatctcagtgtctactatgctacacactgtactaagcatgcactacaaagtgtggctcttacaaagatgaatgaaacacactctctgtccttagggggcatggaggagacaagttacaagtggctgaaacataaaatgaattcaatcattggttcttaaatgactgtgtgcctcatggtcaccggggactctgcctagaacataatttctggcctcgtcactagggatgctggtttagaaggtttgagttggactctaagaaatgacatctttgacaaggcccctcccagaaaatgcccaggtgattctggtgcaggtggtccctggaccacactttgagaaatcatggagaaggataactgtcctgagaaaagcacagaagataaccatggcagttcagaagaagcacaaagggaggagacgggattaggaaggagtttccacgatgcatctggagggtagatgggctttcatgttgggcatctcatttgatgctcccaaggatcctttgaggcatacaggatgtgcattgccatttctttctttctagtggtgtggatgtgattatcccatttataaaagagggtaactggctctgaggggccaggtatctaatcaggatcacacagctagaaagaggcagaactgggaatgaagcacgttctgtctgtctatagcctttaggctttcttgctccctctgaggtacctatgtcgtaatactcattctgggaggagggggaaccccaggccagatttagtgcaaattattggttgagtcaggatcagcctttactgccccaggttttaattttcggtatatgctttgataactgaggcctcttaggacatagatacagccttcctctaccatttttaatttttttagacttcattttgtgatttattgctgctctgggggcttcacatccaatccttttatggtttcatctttcctttccttacatttgttgcatataacaatggcgtgtttagctactgcagtgaaaaatcaatcaagcctattccatattcacaggcttgcaatggcaccaacggctcctggattagattaactttgtgaatgtgtcattctagtatgggtaatttctcaaccttcgctctatcctccccatcctgcctcggcgggtggatattgagatctctcattgattgactgccctgaaagtgaatgctggcatgtgatgtgtgtaactcagtgggatgcacatactctgtgtttatgaaaataaataataatttctgttatcattattgattgccatcattatctgattgtatctgtcagtgtcatggggtttcagttatgggatcagaaagccctccacgagaatttaaccactaccctcactgacaagcctttgtgttttgacatgtttcgcctttgggggatgagagtttgggatgtttctgttctgctcattggctaatatttttggctaatgttcagagacatgatgataattgagttccatgtcagccaaaggaactacttcagttggaattaaaagagaagctaacatttatgctaatgttccaagaacattttgcatgcattggctaatttaatcttcaagataaacctataacataggcactgatattatccttattgtagagatgtgatagctgaagccagggaagttaaggaacttgccttaggttagacggctagtaagtggtaatgcttggacttgagtgcacgtctttatgactctaaaacccaagctgctgtcctgcctcttgtactaaaatagaatgcctaatatatgcatctgaatattcagtgtaagccaaaacacatatgagtaagcaggggctggaaaacaacttttcaaggagattgtaaaagttactggtgccttgggcacaggtgggctttctgtttaattttgggaaaaggcggggtaggaagggtacatgaaactaggtcatggcttaccaaagctggatgatcatcagactctgggaacatctaagtcatctccaaccaagtgactcagaatctccaggagtgtggccaagacacccacccgtatttctcggccatattcttggccatcctgaagatcagatgggtttgagaccctttggcataatgatctctctactcaaaagtagagattctcagatttgatttttaaaatcccttcctttttcctcttgtctcctcctgcctcaaggttctgtatagatcagtctgaggacaacattattatcaaaatgtggttgcctttacactaagagagtgatttgatttagaatgagcatccatgatgattctgtgattgtgagctgttagtgccttttataactcaacttctttccccttcttactcctggtcaagtcatgggggacagcctacttagttgccagtgtgctataatagtaacactattgcagacatttattaagtatgtattatgtgccaggccttctgctaggcaggtaccatctcactatgcccagacggcagcctgtggagtgggtactactgttattcccattttgcagatgaggacatttgatctagagagctatagtgacatgctcatgtctatagctactaagtggcacagccatatttttaaaccaggttcaagctgactccagaataataactatactttcttacagaggttgggctgataaagtcacttgttgaagtgtttagcataatatcttgccatcaatagacgcttagtttatgttaatccctttctcctcttttttcccatcttgtcttttacctagagactaggagtttcaggaaagcatgatgaatatattgaaaagttcgaagtagtattacatctagagactagcaattcattatgctttgaatctgcctttgtactgactctcctacgctgccttgcattcagagtgtattcactgacaataaaatattttctttcatcccaaaggtacctttgttatgctgcacttaccatgtagtaattagatccaacatagacgtaaatataagcagaaccctatacctggtttaggatcgagttctctttgtcttttgctcccaaaccctttggaaggtgtccatggcttcttgaatgtgataggaactaataaaggacacctcccatatgtacactcaatggcagtggcaagctgagacgtccactagtgtcagaaaaagaaaagaatcacattacagaagaaaatctggatgtttccatggcctctggtgccatttatcttgagattccctggccataaagcctgatagtgttacaggctctgacacattgtctttccctaaccttggttgttaaatggtctgaatttcagagatgtgggaaggttgacagggcagagttctggcctttttagggctttgcaagtaaggatcttgtcaccattccaaacctgattcacactgacccagataggattttctcaaatgagaagttattagagtgattctcccatcttttcatttaaagggctctctgtatacttttcaaaggaagtgaaaaatcaaggataattggatgattgaaggagagaatacttttattttctgaatttttcagatgaaattatctgaattataagcgtaatgggaaagacattcagcccacaccaggtcccatttctgaagtgtgagctcactgttgctagagcaatgggtgtgtctccggtccccgaaactacacgtgcatgtgtgggtgcgtgcaggcatgtacatggcatacaacacccaagcagggcattgctcaagaatcctaaaaatgttaacaaagtaaagagctgacttttatttatttttcaactagactttactaatagaagatcaaaaatacatgcctagatccctttttgctactaggttatgcaaagaactaatttgaaatcagtagaggacttctagggcctctgctcattatgcattaggatttttgtagaaaataattagtgcaaatggatttggaatccaactcaatagaggacatgatcactttgatcctagtacgttgcaagccgggcttcgactgatgcattgatgtaagcattttaaataccagtccttaccagagaaaaatattttaaatatttccctaggggtagtgtgcatagcaagatactatcttgtctttgacgcataaaaacaagatcttggttggagaaaactacttacaagggtggtttcatgttaaaggagactgttttcaacagaaaaatatattttattctctggtttccttagaatggtttagcaacaaggaaaggaattttctacctgaaaggtgttaggtttgtgtttgtttgggtggaagaaggtgggtcatgctcttgtaatttgttgttgtgatcagatgagtttattttctttttaccagaaaactgttaaaagcagtggtacacacatgcatacacacactgtctcacacaaatgtctctggctcaagtaatataggaaaccctagcttaaacacagttaagcaaatttatttacttcaggatttctgggaactttttttttttaagtgtgtgcaacgctgtggttttttttattattattattatactttaagttttagggtacatgtgcacattgtgcaggttagtcacatatgtatacatgtgccatgctggtgcgctgcacccactaactcgtcatctagcattaggtatatctcccaatgctatccctccctccccaccccaccccacaacagtccccagagtgtgatattccccttcctgtgtccacgtgatctcattgtccaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctatcgtgaataatgccacaataaacataagtgtgcatgtgtctttatagcagcatgatttatagtcctttgggtatatacccagtaatgggatggctgggtcaaatgggatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgacggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctgcatatggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagcgtgatgcctccagctttgttcttttggcttaggattgacttggcaatgcgggctcttttttggttccatatgaactttaaagtagttttttccaattctgtgaagaaaggcattggtagcttgatggggatggcattgaatctgtaaattcccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtgtcctgaaactttgctgaagttgcttatcagcttaaggagattttgggctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagtttccaaagggaatgcttccagtttttgcccattcagtatgatattggctgtgggtttgtcatagatagctcttattattttgaaatacgtcccatcaatacctaatttattgagagtttttagcatgaagtgttgttgaattttgtcaaaggctttttctgcatctattgagataagcatgtggtttttgtctttggctctgtttatatgctggattacatttattgatttgcgtatattgagccagccttgcatcccagggatgaagcccacttgatcatggtggataagctttttgaggtgctgctggattcgttttgccagtattttattgaggatttttgcatcaatgttctcttaaccaccatgttacctggcctcccaacagcaatggcttttaaccctctgagccatgggggctttatcctactttagagacttcttgaagcagaaaagaaccattagccaatccaaaacaaatcactgttcacaaatgtttccttctgtctaacctaacattaatcttacctgccacttatttaaaaaggattccatacatatagtcatgatggacatgtatggtctctgctctcatggggcttgtaatccagtgactaggaatctttggtttgaaaatagtcacaacgggccaggagtggtggtacacgcctgtaatcccagcactttgggaggctggggtgggtggatcgcttgagctcaggagttcaagactagcctgggcaacatggtgaaaccctagctctacaaaaaatacaatagttagccaggcatggtggtgcacacttgcagtcccaactacttgagaggctacagtgggagaactacttgagcctggtgcagtgagccgagatcaggccactgcactccagcctgagtgacagagtgagaccttgtctcagacagagggagggagggagggagggagggatgagttttttaaaaagtataagatcatagcatgataccattaatgtgaaaaataaagcaatcctgaaccgcaaacaaacaaacaaaaaaaaatggtgacggcatgtacttcatttgcccctgcctaacattacagtcaatcccattgtgtatttagaaactgcctgagttctttctcaacattttcttctctactctgtgatctcacttcctctcattattttcagggagtgagagttctgcaacattcaattaaataaggacactgactatttaatgcgaaaacatccagatacaaagcgaaaactctgtccaattatcttgccagttcaaaaccaaatatacagatgtttagaaacttctgaaagcttgaatttttaaatcataggctctccaaattcaaagagcatctaagaaaagcatcctatgagggaaacataagatcgtcaaagcagacaaagcagacaacaaagataggagttcaggagttataaggttagagattaagatagaagtgacaaaacaaagccacacttggttatcattattccttcccatactaaaatcctttacgcagatggactcagaggtgaccgccacaccagtcccaattagatatgccgttgcactacttgacggtcaaaccaattaagaacataagcaccacctcggtttcttgctatgcattttaaaaactaattccacaagcacttattaagtccctactgtaagccaggtactatgattagtcctggagttatagaagtgaacatgaaagatatggttcctgccttcatggagctagccatctctttgggttggaaaaagcatgcataaaatgctcctaatgtaaagccgacagtgtaatggggcctctagaggaaaggtgaatggtgtacaggagagcagatgatggggagaatttgatcttttcagggagagcagaggataatttcctgagcaattaatatttaaaccacagcaggaggaaagtaagaagaggagcagaaagaatgttctaggcagaggcggtgacatgcacaaagcccatcaggtaggaggtagcacagaaaaacacagtgtggaaggagggcccaggtggctgaagctgagtgcaggggatgtgtggtaccagtaagatgcaggtggtgaggcagcttatggccagatcatgctgggcaccataggtcttgttaaggaactcgcttttttccccatgagcaatgcaagccctcgcttctctgtacaggtcattttttggaacagccctactttgcccagatagctaaatgttctgcactgaagacaggatgttcaccaacatggaaaagccgcctagatagttcctggcagaagagtttaaatttaggaagtaaatgacattttgtcagtttggccatgttgccctctagcccccagctgccattgtttcaatacatgtcagggcatggcctccaccgggtttctccaatatcaaggcgtcctccctccaaggtgaatccgcccatgagtgattgaattgtttggagggtcatagaacctgacagctccctattacacaaaggaaaagataagcttccgattagtcctggggcaggaggaagccaagatagagtgcacctgtcagaactgcttacgacatataaatcattacctcaattttctgtgcaagcagtggaccagagagagagagagagaagtgactgaggttggttaacagtgcagaaccataaaaaagagctgctgctttcctccaaagcaggatttcctctgctgtccatgcaaagaaaactgagccccatgcccagaggaacgacaaagacaaatgcccactggctccagaaaggggcaatttgtttctatggcatttgctaacagcatttactgctaatctaacaatagcagccaccaaggctttcccagactttaacagggagcatgcttaatattgcacttgctatatgtttcatcctagatttctctaccttgtaattgccataacaatcatggttgttattgttgccattttcctttcattcactgggcaaaaatctctgagacagaccaattgcaactaacctgctatcccacagtccaggataccagggtatttatagcggggtgagggggaacataaaaacaaagattgaatgaaagatagcaagtcagaagatgctcaataaagattcaaaagcttaagttgtttgggcaatactcagattttcatcacaatttatgttgtataaaataccaagtatcggcggggtgcagtggctcacacctgtaatcacagcactttaggaggctgaggcgggtggatcatgaggtcaggagattgaaaccatcctggccaacatggtgaaatcccgtctctactaaaaatacaaaaattagctgggtgtggtggcgcatgcctgtaatcccagctacttggaggctgaggtgcgagaatcacttgaacccaggaggtggaggttgcagtgagctgagatcgtgccactgaactccagcctggcaacagagcgagactccatctctaataataataacaataataataatataataccaccaagtatctagctgaatgtgaaagcctgaaagatcctagttggagaagtgccaacactgagtaactactaacttgtacagcaaagctcaagaaatactaagtcttgtgcttcttctgggctactctaaacagagtggataacactttgggggagactggttcattcttcagaatagatgtaaactaagttcccagaacttttgagagggagtttggcacctacattgaaagggagccacatgtttgtccagcccagatattcctgctgccaatgatggaggagacattttattccaccttggtgtattttaaagggaagcatattctcaaaattacaacacaacccaagatgtatgagctgtcaattacattccttaggaccagaagggaaatatatgaacagacccaaaaagtgcatcaagacagtacacaaagggatgtaggagctgagggaatgagtcacatggatactttaaaacagaataattgttcgttcaaaattgtgagcaaaatgttcttactgccaggagaaatgttgggcagacttatttctacttattgtgtaataggggcagaaatcccatagttgaaatcgtcatgggagagagtctagggctttagagtgacaactccaggttcatatcctagctctgtctttgtatgactctgagccttttacttaagctctcaccatatcagttttatcatcaaccaagtagggataatattatttaaagtatctcataggacttgttatcagaaaaaaatattagcacagtatctgacttttagtactaaccattcaataatatgtagctagctccaagatggaaatcaggaatgctcagaacagagagataactgggagactccagttgctacttttggatggaagaatacatttataaaaggacagataagagggaagagacttctaacttggtcgtatggtcagagtttatttgcctaagacatactgacctcaacatgtaagacttcttagtgaatatttctatcccttgctggaagaaaattcccctgagaatgggaaactgcaagtgcagataagatgatgatgaaaaaaatcgtcagtttgagattctgtggataaagggaggtaagtgagttcaccctctaatgcctgtttttgaaagctcagtaaactttcaagttctcactgagctaagaaaggttacatgctcaggagtcactcctttctagggaagaagctacagttaagtctcatgtgaggggcctctgggctgatggcaggtacagttgtctggaaagctgttaaagtcaagggtctagttttgaatcttcctttagattctctgcttcaatcattagtcaccaaaaatgcagaattctcagcctgggccatgcatttcccctcaggttaaaggatccactattgaatattagactttatgtctattttctagtagcaataaaaaaaaatcttctaaataggttacttttccttagataaaaacaaacccaaaaaaagttctgttgatattttctcctttgtcttgaccactaagggaaaaaaataatcttttcttccagcacaagttcattattaacccagttaacgtttgcaaattaagatacaatattagacatttgtactttacagaaattttcctcttaattggactgctttcctataaaaatcatcccgccagcatctgtggtaagatagattctggaaaaacaatgtgccatgccaaattatcaggtagaattagattgctctatatttctgtttgataacaacactgtgcctttgcataattcttgctgattatcagaaggaaaaaaccataactcagacagatgagctttattggcattggtcccttctaggaaagaaagaaaaatgtatgaacagaagcatttgcaagtgccatatatgttgagagaataaaattccaaacagtctgtaaacttagcttccctgcaaccttaaaaaataaaaatgcctccctatatttggtgtcacatctcaggatctgggtttatcccattttctatatttcaagacaaaaaaatgtacatgcctataaatatatctagaatagaatgtcattttaaactagagagttctcgtgaaggaaaaaataaatcgtcggagagagttgtgagtcagagtctttatagaacttggaaattaacaagaaagtgttaaatgaatactcaaatagaacagctgcatatactacttatagagggagggaggttggtctgccatctttatttgtttgcatgctgaaccaaactatggtgtccattttctctagctgtctttatccatctcagtttctgcaagcagttttctgtgatgggatagataatgtaactttaatctggtacatgcgaacaaagtctgcttaccctttatgtgtctttcaagcattccccccacccccatgtctccagcagtatccttgagagctatttttttgcctctaattccagactctacccctttctctaggaaaatccacagaaaccctttgagccccttccctgagcaaattcaggacttctctgactctactcaagactcaggaatatttagtctctgtttcctgtaccccaaacagcttcagatgtctgtcagtacccaggggcaattgtgtggtttgatccttgttcaacatcaaaaaccaatgctttgccttttgaggactcgaaaacaagaatgttgcttcataatcttcttcccctgggaaatttacatctcctcttgcctccttggatgtctcccattgtgaaagcagcagcaaataattttgcttccctatgtctttctttttggcacattcttacttgtcgatcaataaattaccccctgccaagctccagcagcctggcttccgtcttcaccacttatattctccttttgtgtttaaaaaagagctcattatttttctcttaacctctagtgaaatattccctttattctctccgttttgcttatcgtttaacttaattcttagtccaaccatccccatctgtacctgtccccgagtcctccacattttcctctttaataaccagaagttaatgagaccacccttggagtcacatgctccttttctgatcacaccaggataagcaaatgggatttaaatagcaatagcaggtaatacaatagaagaaaagccataggcagggattcagccagtcaggtaaaacagaggatgtagttttgtgctctctgggatgtataatgtctccttttacagctgtgcctcagttttctcatctgagaagtgaagtcagccgtcacttatagtatctgcttcatgcagtacttgtgaggattagatgggataaattacacaatgtgtttgatggagtggcacacagaaagcccacagtaagtattaggcactactgtgtcatgattataggaagcaaatgtaaaagacaatcctaccctttaccaggtttgaaagctgcagttacatatggttgagagacagaggccttcagtgtccagccaggaatcccagctctatttgtttatgcaaataactcatcaaacccaccatttagcggttcttaatggggagaaggtatgtgaaataacactggacaacctaaggacagagacgtgtttttctattctcaagacccaatattttgcctgacacagtacattttctataaatacttaaaatcaacatacatgaatcacctaacatactacctttgtgtatatcattgtgtttcccaaagtctaggatatgtgtttctgttgatgtaagacacaactgtaagtaatattgaatcacataattgaggaagttattccctcctttcttgctttataaattattctgatgacatcaagcccaaagtctcagtttgatgttaatattttttaacctctctcataacacttacaaatcttgatttttttaaactgagaactgaccttacactctgtcttttcagatgactctatctggctagaatttaaaaacaatttttattgtatttatttttataattttcttcttttttgacaattcatagaaaactggttttccatgtgttacagtgtaaagttccctatcaaaataaagttagttaactaaaagcaaatcagtttaaagaaaatactaagtgggccgggtgcagtggctcatgcctataatcccagtactttaggaggccaggcatgcggatcgcttgaagtcaggagttcgagaccagcctggctgacatgatgaaaccccgtctccactaaaaatataaaaattagccaggcctggtggcacatgcatgtagtcccagctactcagaaggctaaaacaagagaattgtttgaacccgggaggcggaggttgcagtgagccgacattgcgccactgcactgcaacctgggtcacagagcaagattctgtctcaataaataaataaataaataaataaataaataaataaataatagtacacataaaacagataagaaaatctgaaggggtactaaaaggactgagttttagaaaacactattctaattttccctcaattatttggagagctttaaaaaaaaatcaggatacctaagcctcacctcagaccaactgagttcatctcgaagtctgtattttctattgctctttaagaactctcaggtgattctgatttttttaaaagccagtttaggaatctctgaatgagaaaaatctgattttgtttttaaattcttttaaattcattcaacaaacatttgttgaatatctgttctgtgtaatgtcctgtgtcctggatgccaaggatatgatggaaaataatacagatactgtgttcactgagtttttgcctgcttatgagctttactcctatgctaatcacaacctgaaagatataaaagtgtcataattttgtgaacattttttggttatgattctgacattgagtttactgcagagagaaacctgaagctagccttattttccctctaatacaagaggaattcatgtttaaagatctagataatccataaatcttctttatactggaaatatagtaacgtcaccagaaaaaaatgccatggtattgaccattctctgtaaggttcagatggtatttgaatcctagttctgctgatcccgaggacctcatgacttattatgtcatttaacctcactgagcctcagctctttaaagtctgtaaaatatgtatggtatcaactatgcaggatttttgtgaagcttaaaggaggtaacgtatgtaaagcatacaggggacagtaagcactttttaaagggtcattaaagtggcagttttacagaggttaggttccaaagtcgccccataaagcaagcaccaggtttggtaaaaatactcttgaaaaatcccataaatcacccataagatttgtttgtttttattaactctatatagaataatatatacatataaatatataggatataaagaataatgtagaatataaactatgcaaacaatatgaggggccatttgtgaaaaatatacttccttaaaccttagtaacttattcaacatcccacgatgctcagagatgagatccacccagaccattggtctaaagaaagagcaaattaactcccctcccccatctcatactccctgggacctctgacccattatttaaatttgcttctttccttttttcatattattctaagcatatatagttgaattcacatattaaatgcatatgtgatacaattcagtacataattgtattcctagattagaggcaaaataaatactaaatagaatgtaaaataggtggaagtcaggtaccataatttgatgttcaactacagtgattttaaatgaactgcacatttgttctcttttccctctctatgattagttttcccttctttttaggttttcctttcctttctgttagcctcagagcttgatggttttttaaaaaggtcctctgctttggctattggagaaaataatttatattccttccttcaggaagaaaatgaattaatggagtctacagtcctcaaaggcaataacctccgtccatgccacccgtgccctgcttccttccattctatggcaatgcagttcacaacatttgggggcaaagaggtcagaaagcagtacagaaatggatgacaaccttgaaaacttgaagggaatagataggattcagagttctaaaaggacagagcatagtgctgggacatgtggggagaaaactcaacagttcatgtgtagaaagtggaaacacagccaaagtaaagttgcagaaaaaagatctcagggttttagtgaataacatgaaagtgttacttaaaagtagaccaggcataagtcaccccaaatagtgtgttgttccagaagaagtaattacgtaattttcttcagttcaggataaattcttactctaatatggtttgaggatctagtttttaaaaagaatgtgattgccatgaaaagggctcatagcacttctaagattggcagggaagtggggggaaattatgagggagaattacataaatgggttcattgcctaaagaagattgaaaggcaattataacattccaaacaaaataaaatttctagctagggaatagtgaccacttgtgctttgccctccttatacaagacactgttagaaatctagattaaaacactaggagctcaagttacaaaatgattccaggagggttgtcaaaatagtgacaggttgaagaaggaagctagagaatcgttttctttaggactcttaaatgtatccaattattcttcatcacagtgggtacatataagaaaggaggaatgagatgagctctgttaactgcagcagtcaggttctgggatgatttagggatatggatgggtggatagaagtgaggtgaacaaaggaatatcctaggaaaaggtgtggatgtgattacgaatatgggatgtccaagggacaaggatgagacccaattacagggctctgatgcttccttcttcccactttgtttctctgcctgcttgtttccttctctcctttctgatagcactgagcaattgggctgaaagtgttataaaatctgggctggagtgactcattggaggccatattcagactggtaaacagatgaagtcattggtaaaaagaggagaaagggccagacatgcagagagaaggcgtttaagagaccaggtggcccctaagcaagacagacaaagagagaaacagaaaaacaaagcacatttttcgaggttcctaacagcttgccaagtccctgttctatttcatatgctccatttcagtcttgatgatctgtaatatttttctgtacttcagtaatccttttgggttttttttttaagtaagtttaggaaggtttctgttcttaaaatctaaagagcccagactagaatattacttcacctccctgctttcttctttttctccattcttatttctgaaagcttggcatctttttattctatagagtcttatttctgcttcttttctcagatactctcttctcttgctcatcccatcctgtttactttttatctcctttgtgtgtgtgtgtgtgtgtgtgtgtgtgtgtgtgtgcacacgcctattcctgctgtctctccttggaaccagcaaaccttcttctctggagttatttcatcttcatccacttcatataacaatttattttctagaatcactacattcaaattcagctcagccattgaggaagagaagatttacggtctctcccaccctcatgcctgaattcagaacattgccattgtcttctccacctccctaactcatttgttcatcttctgaccaatagcctttattagacagaaaaatccaattatccagaatctactgttcagtagattcctaccaccatctcccacattcacacacataccatttcctacctctgcattttaagagaaagcaacagatctaggaggagaggttaggaaatcacattcaagttcaaaacagtcaaatagtatagaatagattcaacttggtatattacttcatttgaaaaaagacctgggaattttacttgatgatatgatatggacgattacaaagggaagtctgttttaacatacagaaacagaaagcacatgtcttctttggaataataaatgcctgtgctggtagattgtgttcagtgaagcaaagcatttgtggaggccaagtggcctgagctcaccattattgaggtgtgaagattggaggctgagtcttggtataatctatgaaagtggagaggagatgggttgagagctgtcctcaagtatctgaagtgctgttgtgcaaagaaagggaatgggctgactccctgtccactctgggaacaggtggacagttcagtaaagcagatattaagctcacaggaatgagaaagttgtgctcattaaagatgcttaagttttcccaagaagagtccagtgcagactgaagaatcttaagaatcctgccctgacaaaacattaaacatgatgtcttcccttccttttcttacaaaagaaatgcttgtttatagcatccagtcaaataatactatatttacggttccatatctcagggtaactaaggttgctagtttggtgtatgtctttccatacctttctctgtatctatgaatacgtatattaacattaatgaatgaacagatatgactttgttttgtttacaaaactgagatcacactagacatattactcagtaatatacacatccctccaggccaatttaccttccttgaaagagctgcagatattctaaagcataggtaagctatgacattaaatcatttctccattgatagatattcacattgtttctaaattttgctataactaacaatgctacaatacgtgttctcagacatacagccataccttgttttattacatttcgctttattgtgcttcacagatagtatgttttttacaagttaaaggtttgtagcaacactgcaacaagcaaatctattagcaccatttttcgagcagcatgtgctcatttcatgtctctgtgccacattttggtaattcttgtaatatttcaaatgttttcattattatccttgttatagagatctgtgatcattaatctctgatgttaatgttggaattcttatggggtgttttgggtttctcattttaaatcaaaagctagaaatgattaagcttagtgaggaagacatgtcgaaagccaacacaggcccaacactgggcctcttgtgccaaagagttagccaagttgtgaatgcaaaggaaaagttcttggaggaaattaaaaatgctacttcagagagcacacaaatgataagaatgcaaaataaccttcttgctgacatagagaaggtttgagtggtatggatagaagatcaaaccagccacaacatttccttaagccgaagtctaacctagagcaaggctctctcttttgttctatgaaggctgacagaggggaggaagctgcagaataaaaaatttggaagctagcagaggttggttcatgaggtgtaagaagccatctccataaaataaaagtacaacatgaagcagcaagtgctgatgtagaagctgcagaaagctatccagaagatctagctaagatcatgggtggcggtggctacactaaacaacagagcttcagtgtagacaagagagccttatgttggaagaagatccaatctaggactttcatagctggagagaagtcaatagctgtcttcaaagcttcaaaggataacctgaccctttcagtaggggctaatgcagctggtgactttaagttgaagctaatgttcacttaccattctgaaagtcgtggggcccttaagaattacactaaatctattctgcctgtgctctaaatggaacagcaaagcctgaatgagagcacatctgtttacagcatggtttactgtatattttaaacccactgttgagacctactgcctagaaaaccagatttatttcaaaatattactgctcattgacaatgcacctagtcacccaagagctctgatggagaagtacaaggagattaatgttttccggcctgctaacaacatccattctgcagcccacagattaaggagtcatttttgagaaatattatttgagaaatacgttttgaaaggctatcgctaccaaaaaatagttcctctgatggatctgaacaaagtaaattgaacatcttctgggacgcactcaccattcattctaggtgccattaagaacattcatgatttaaggaaggaggtcaaaatatcaacattaataggagtttggaaacacttgattccaaccctcgtagatgactttgaggggctcaagacttcagtggaggaagtcactgcagttgtggtggaaatagaaaaaaaaaaaaactagaactaaaaatggagcctgaagatgggtcttaattgctgcagcctcatggtaaaattttaacagatgaggaattgcttcttatggataagcaaagagtggtttattgaggtgggatctactctgatgaagatgctgtgaatcttgttgaaatgacaacaaaggatttagaatatcacgtcaatattaataaagctgtgttaataaagttaataaagcagcaacagtgcttgagcggattgtctctaattttgaaagaagttctgtggataaagtgctgtcaaacaccataatatgctacagagaaatctttcatgaaaggaagagtcgatcgatatggcaaacttcattgttgtcttttaaaaattgcaacagccagccaggcgtggtggctcatgcctgtaatcccagcactttgggagtccaaggtgggtggatcacaagttcaggagttcaagaccagcctggccaagatggtgaaaccccatctctactaaaaatacaaaaattacccaggcgtggtggcacgtgactgtaatcccagctgctcgggaggctgaggcagaaaattgcttaaacccgggaggcagaggttgcagtgagtcaagatcatgccactatactccatcctggatgacagagcaagattccatctcaaaaaataataataaataaataaataataaaataaaataaattgcaacagccacctcaaccttcagcaactaccaccctgatcaatcagcatccatcaacattgagtcaagaccatctacccgcaaaaagattatgattcacagaaggctcagatgatcattagtattatttagcaaaaagtattttttacttcaggtatgtaccttgttgttttaaacataatgctattgtacacttaatagactacagtatagtataagcataactttatatacactgggaaaccaaaaaaatttgtccaactttattgcaatattcactttattgtggtgttctggaactgaacttgcagtatctctgggacatgcctggtatattgttatttacggatgtttttataggatggatttcattaaagtaaggtttactaagttaaaagatgtatatgttattttaacagctacttccagattaccttctgaaaatcttgtggtagtttatgcttccatgagtaaatgcttgttgtttattccatctccaggatagaatgttatatttttctttttatacttccaactgagaggcagcatagtatagtggtttagagttaggactcccttggctagaaatactgagtacctgtctcagctccagcaagtactagttgtgtacttttagctaggacacattactgctttgtgtctcagatatgctgatctgtaaaaagaggatgatatgaatacctacctcataaaattgttatgagtgtaaatgaattaatagttttaagacttataacagtgactggcatagagtaaattctttatgcataaaggttaaaaattaaaagattcatcagattaatcttttataagattaaagatttaaaaaatcttaatttacatctctttactaatgagttgggcatatttctatctatgtcttggtcattttcttttccctttttctgaatttttcattcctatttttgcccatatttttactgagctgtttgtctttttactaattttcatgaactctttgtatatcataaatagtaacccttttcctgtcatttttatcttccataagtgattttctttttattattataaaaataatcagaatttttaaaattaacataaaccttcaatcagtatagaactataaaaatcattttaaacccatagtcttagtctattttgtgtttgtataatagaataccacagactgggtaatttataaagaaaagaaatttatttctcacagtattagaggctggaaagttcaatatcaaggtgccagcatcttgtgagagtcttcatgcaacatcaccccatggcagaagcagaagggcaaaagagcaccccggggaggcaggcatcagtttttaacaagaggtcttatttgattctgatgtgcagccaaggttgggaatcagacaatgtaaccctgaaatgtcaatcttaagtcaatttgtttctaaatcaaagtgttgctagtaattactactgccatctgttggtgggaggtagaactgacattctatggatatctatgaaaggccatgttttttaaattcttagaaatgcatctttgtgtttatccagacctttttaatgtaaatgacttctcaggtaacttccagctgcaagattcttgaagttaatatcaaatttgtatttatcttcttggttctgtatattccacggtaataaatgacagaatgcagtgtgatacttcggaggcttggtcaatcctcggtgatcaaagattcagtgatatttatcctaatagtaggaaaaagtaatacttcatcaataacagttaaaaaacagcaaaaacaatttttgtgcttaatcctaaccaaactaaccaaaaattaaaccaccgcctctcccaatcccactctccccagctataaatgttaattgaaattttcctctactggggtattttaagatgtctctttttttcttgtggcattacacaatgtaaaacatcaaaggaaataacaggaaaggcagtgaacagggaaacacactttgagaaatagtgatattggcataaaaagtaagtgtctggggaaaaaataagataaaactggcagaattacaggtttctgcatgagttggtaattagcgagtttatcttctgagaaaaaggtatctttcctctcctttttatagtcaggccaaaagaagtcaatgacacaaagagcatgaaattttttgccatgcaaaccatttttgacgcactgaatttaaaatatatacattaattccccaggcagcttttatgcatttattattcttacagctggccataggggataagtctttcaaatatatattttatatgtctttgaaatatagatattaaacatagatattttatatatttatgtatatatgtatatatctttgtatatgaagtaccttttaatccaaaacgtcttcatgaactgaaacttattgctggtctattgtagaagttagtacttggtttcttctatgcaccctagatttggactgtgttccaggagagtgtccttaagacttgggtttttcagccttggaactgttgacattttaagctagataattttttgtttcaggaggagctaccttgttcatcaaaatgagtttagctacctccctagctcctgcacacggatgccagtaacatcccctctattgtggcaaccaaaaatacctccagacactgcccagtggcaaaatcgctcctaattgagaaacactgatttagaggattgaatgcttatggccctgctttcgtgggatgaattgtcatttctttaaaaacaacttatctgattcctcagtctaagttagagcccctatttctttctctcatgaaacaatatacatctctttgtagcatcagtgacagtttataacaatgtatttacttagagacattaatgtctttcttccctgttagactttaaattctaccccttaatctcttttgttcactgtgtacacatactacctaatacagtgattggcacttaataaatgtttgtcaaatgaaagaatataattctaagatatttaatgacctgaaacacaaagcctgacttggttcaaagaggtttttcttctcaggcttatttcaatctgtatgacaaagccagtaaaagaagaaattagggacatattgaggctgttgaagggtgtgagcagggaaatctcaaaattatattatttggataggattcccagggggttttggcggggtgctggtgagtggcagtttcattctggaaacaacagctctgatatgtcgctgtaagccagagccagcctatcactcctgctttctgaacaccatccaccattgatccatggaagaaacaggttttttgaccaaagcgaggtttaacgctccactaattctttgagggaaaatgccccaggaccaggagaaatatatctatagaaaataaacatcagtatagatagcacaagaggcctttaaatgcttcttttcacgtttttaaaaaatggaattaagatgcatattttttaaaatgaaaaatgactggcattcttcctactgaaaatgaaaagtaatttaatttgttagtggtttattttatttgacagtcattgtacatactctatttggtttgttacactgaattatccttcaataatgggtacacacaatgccagactctgccccccaggttgctttgataattggatgagcgtccatattgttcaagattttcatgacaatgaggacggagctatttgcaaaactcctaaccaggagagctttcagctttttaaattctcaataaagttaatctctatccaatgaccaatcattcccctggctacttttcctaagcaaccttaacattatataatcatgactgaattcccttggtggatggaagagatgctaaaacctcatagtcaatatagaaaagtcagaaaatcttccccaagcaatctttcagaatggaccatttttctacaattggaagttaatggtaagaatgctaataatagctaccataggggctggagccagacagctgacatccagggacaattctaccccttggcaacaatatgaccttgggcaaacttcatgacctgtgttgcttcaggagttacatccataaaatgacaatgatcttagtacctacttcataaggccattgtgaagattcaataacatgatgtgcataaatgattagcacaatcctggcacaaatcatgtctccataaatgtttcttcgttagatggtatgtgtcaatcgtcgtgctaagttctcttaacagtgctactgaaaatgttacatatccccaacattaaggaggggaatactgataccaagaaagactaagcagcaaacccaaggccacatggttggtaattagcacagccaggatccaagcccaagtccacataactctaaaaaccctcttataccattcaaattgtgtgcttgtgtacctccagaagaattttgaatagctatgtactttcctgagctttttaaagtaggcaactaagcatttccattgtaatgttaaataattgcagaaaatgtgatttcaaagtattttaaacattggcagtttaaaataaagcttttatatcatcttttggttgcatccagtgggatttaaatacctcattactggatactcaccaatacccactaaaagaatatgtgaacaaattttttttaagtcaaaagcttcatattattattttttcttcttcaaacatctatttttattgcatttcccctaaatcatgttaaaaggttttttgatcatttctatgacaaatatagatgtaaatagactttttcttttatgaatatatgactgtaagactttaaaattatcttctgggtttagttgttgctttgactattaatagaacacaatacatcaaaacaacataaacatataattctgacaaatgatgaataaatataaaaagtaacattttattagaaatgcatctcataatgatctggggatgggggcgtctatgcggccttgattaaaagtatcatgcaaatgtccctctcaggaatgtttatgaattgcatagtacaccttggtaagattcaggataagttaaagtacatcttctatatctttcttttgaaaaaggaagaaggagaacctaggctgtgggtactcctgagaagatctgattttaggaaggagaacatggaagttaggaatgaagaaatgaatttccttaaaactttttcacatagttcttaggaagtcatccaccactgctgttcctaggggaatggtattctcattgaagacggctgctctgtaccactgagctgtattctttggaattaggatatttataggaggacccaatgctctcccatttttatgacaacttactccctcttccttgaaaatgaagtctgggtcccagttgttactaaaaagtcatgaaggctgtttcttgaaggaagcccagtgaaaaggcaaggtgataaatttgaagcgaggccggaatctggaatttccaagcccctctgagagatttaccgtctagtgcctcaagatgggataacatattcaccctcagattctccactgggcctcaaacctgtggtcccagagcaccagggtcagggtttccgtatacctaggatgaggtggacacccaggacttccgctctcatctttgtcttttctaggtcaaacagccttcccaaaaggggtggtttgagtaagaagaaggagggggttacatattgcctacctcctctaagcttctcaaggatactctgtgtggcaacttctcagcatgtagtagatgctcaataaatgtttgttgaaggccttatctggggccagtgtgtggttataaccttcctatgtgcacttcctaattgatgatacagaacccaccaaaccccatgaccttgatatatactgtcagtctaaatgtaatctcaattatttggagaggggaatggggagcatctgttgaacactaacaaggagatatggagcaagtgtggatttaaattgacagcaattttttcaaaagaccccataatgttgattatgttgtacgtatcataatgagctggggatggggtcgtctatggggccttgattaaaagtatcatgcaaatgtcccctctcagaagtgtttatgaattgcatagtacaccttagtaagattcaggataagttaaggtacattttctatatctttcttttgcaaaagtaaggagaacctaccctgtgggtactcctgagatctgattttaggaaggagaatgtggatgctccttccataacataattgattatgcttgtacgtaacaagcaatggtattcaaaggtttatctgttcacctcaatgagatttgacctagagttactaaacagctaaaatccatccacatcctacagacagacatctctcttttcttccttctccatgacttcatcttttctgttctttatctcctatctggccatctcttctctcttctccgagtcttgccttgaatctgtcaatttactgagctgctggaggttgccatggtaaacacagctgttgttttttctctgtgaaaaactcctctcatgaaggcgcattgaggggagtcctccccatggcctccccttgctgtgccttttcacatatgttttttaaagtggaggcttcaggggcttcctgttttctagggctctactctgctttaattgcatgtctctgaagcaaggcactgtgacccgccaacccccacttaggtgtcatggaagattgtgaagaatcgctggtgtggtcaccaaataagccaaatgacagcaacattcattttgttagtaaatgcgttctgggaagtgaaagatgatctggtatttcccaagaggagaggcgggaaagataataagaacctgagggaggaagactcaaagcgggtgagcagagacagaaggaatggtgagggaggatagagtcccatatcaggcagctactcacaggtagccacacctccctgagctttcctcacccgcacagtgaaggtggtgatccggccctgactactgatccaacatcttctccaactgccatgcttccttactcactcctctccagccataaaagctctttgctgacaggtacatggcacgtgcctgtagtcagctactcaggaggctgaggcaggaagatcactggagcctaggagtcctgggctgtagtgccctatgctgttaggatgtccacactaagttcacattaatatggtggcctcccgggagtgagggaccaccaggctgcctaaggaggggttaacctacccaggtcagaaacagaacaagtgaaaactcccgtattgatcagtagtgggatcgtgcctgtgaatcaccagtgcactccagcctgggcaacatagcaagaccccatttcttacttaaaaaaaaaaaaagctctttgctattgttcctcctgtactctgagcacactccaacctcagtgcctttgcatttcctgttccccctggctggaatgctcctccccacattgctgcatggctccccctctcacttcattcaggtctctgttcataccccactccctcagagaggccttctatgaccaccccacctcaaagagcatacctctcgcttgctagccccttacccaactcaggttttcctcatgtacacatacacacaagaacttctgtaccacagagagttcactgttgtggcaccggtccctagaatatgtctgctattgaggagggatttaataagtatttgttgaatgaataactaaatcactgacctcaccccagaagcacagttacccatctttatgtgtatactttgctgtctctcctctgagtttgcacactgctggtccctctgactgaagcccagttccctcccctccctaccccccacctctctttggggacctcccacccacccttcaagccctgcctagcttggtagtcttctcctttctgaggtctgccttgggatccccaggcaggacccgtttggttcatacggcctgggcagtgcctgatgacctccatggcagcgtgatcgccctcgctgaaagatctatttacttgtctgcctcccaagcatctgagtgtgccttaagcgactaagggtatagactcctgagtcaaggagtggcaggagtgccaggcctgagtactcgccctgcctcagactcactgtgagccttcagacaacttcacctttctgcctcagctttctcatctgtgcaatagggattgtaacatctaccaagttaatcataggatagcgatgaaaattcactgaggaactgctgaagtgtttaaaaaactctgagcagtcagttggggaagaggatagactgaaggctgtgcgatttgaggtgggatggtcacggaaggcctccctgagggggtgacatttgagcagggactgattgaagtgagcggggaagccgtgccactctctgggggggaagagcttcccaggaatattacaactgaaatatatctctgtaagctttattgcagattagattcaggctgctcttttggggcttgggacattattcggttgatattctaatataatactgggtgtccaggcaagacacagggctgggatgtgcatcctttgaaagcagcctaggagaatgagctgaaactcaaccagggtcagagaggagggtgaagcacctgaatcgggggacatcactgaattccagctgctcaacacagaaccacctgcagacaggccaaggactgaccgctcagagggccaaggactgaccactgttcactcagcacatcccttgtctccgccttgatcctagccccatcaatgactctgccaacatggctcagacaaggtttgaactgagttaagatgtcctggcctgatctgaattttgtctggctctgcttttgtcatttggcaaaagggcattctggtcctgtggaggatggctcaggcagatggtgtgtgggagcagaagtctgggacaggaagcagagacctaggctgtgcaagcaaccccggaagggtgaccatggacaaggtgcttaacctctcagacctcaatgacctcatctgtagatttcaagaactaccctggctactcactttcatactttgcttatccacagaaatagttctttcagcatgatattattgaggatgcaagcatataataccaagaataatgaaggaggagaggcctagacactatggcctcccactgtaagactcccaccacacacacagatgatgtcctaggaagaggctctaaggcaaaatgttccctgatttgatgtcacatccatacaccacagagcctttccaaagtgttaggttaaaccgcatgagattgctgatatttcacaatttttgacttgcaaacatggcagttttgtatttcaacctaatagtttcattcacagtagtggctaggtgtgctcattcaggaaccaaattaactggcttcagatcctagcccccagcttattctttgtgtgacattggactggatactccacctccccccacctcccctgtaaaatggggcaaacagaggaatcttccttggaaggttggttactgagggcgctggaggagataacaccttggagttgggtggggcagggagtcaggggttctaaactcagtgactggcacaagaagctctccatgtatgtttccagagacaaccttaacaattgactgtggacctgactcagggaatagtgtccggatctccttcctgcctggccttaaagggagaatgtggccagagcagatgaaaaacacagtcgcaatgtggtttcctaatcggtccatcgtgtcctgcttgaaccaccaaacttccctctttctccttgtgaggggagtcactgggcagcagacaagccttgacgtaggcctgggactgatgttggaataccacgagcggcattcagctctccatcccccccgtcttatctgagcaaagcattagaggctccatccccagatacctacacggagcccttccccattaagtagtacatcatggaatatgtcagcctaaattagcaggcaggcccatcacattaagctgaagctgtgggctggcagctcccactctgtaatgcctcttgttcctggctgcatgctccctcccatgtcgccacagccacaagaaatctctgcagacaatgtacggtaactgaggaggcccggggaagagtttaggaggagccacaggaagtcctgcagattccatttcttttgtgactcttggggtcctgctttgagctctggtacctcttgacggcagaggaaccaggtagcaaccaaaagcttcaggtggggagctcctttgtgacaaactataaaagcatggcacacatttctgaaaaaatagatgccctgttcaaataccatgaacacctccaacacctaattgaggtttcttaactaccacactactatgaataccactaccattataactaccagtaacactagttattccataaattctcctggcaatttatgtcactttcagagcatttatcatacctaccctgtgtgatatttcaatgtgatgtggtgcagtggaaagaacattcactttccagtccccgaattaaacctagctatgcttcctgtagctgggcaaccctgggccagtgacttagcctctctctgcctgagttttctgtttgtatgagtacctatttcacagagcttttgaaagaattacctgagattatgtatgaagaatacttgacacagagaaaatgcccaataaatattttggtgtagtgtttctcagggcaaagtcacttttttatccatcgcaatgccttaactcaggcatgcccttagttgatgtccaaaagtgtatgatcttcactttaaaaattctacctcattcttcctctaacttgttttccattgtacatctggactgatctagtcaaaacctggatttgattatatcacaatcattgcaaatcctttcatttttttccctattcacttggaataatggcaaaactttttggcgggggtgttgcctcctacctagcctgtcacctcatctcccacaatagctcccttcactacttctgtctcaactacagtgacctatcagtttttcactcttgccttgttcacctctatcacgggacctttgcacatccctcagacacattctccctttcactcccctcctggcctggttaaatccctacccatctttcacattccaatacatacattctcagggaagcctcttcagttctccctgagcaggttaaatccctcttggcaggatatcctctcttttgcgcacctagcccttttaattatgtctatctcccctgacaagaacaggtatatgatgccaggacctgtgtctggttctgcttaccagttgaacactccaggactttgtgtggcactcagtaaatattgttgaaagagtgggtaggaggatgcattggaggtcagatcatctcaacaaaaccccaaaccaccctttgcgatagtgagagcacagggagcatggtcactgttttgcagacagtgcaattgagctcaagcttaggaggagcaggttagttgcccagacctcatagcctattggttagtggtgaatctgatcagaaccctggtctcccattcgctgccacacacacttaatctataggcccttatccgtaattgggatgggggaccacaaagactttccttccctttcctttcctagtattcagaggacccctgacccttctacagccacacctcaagtcacctgtggtttctgggttatcaagtaccacatctgtctagaattctgtgtttcctctgaatcattgatttgatttaaaaactcccgcataggtgagttaaagtccctcaagtctgaactgggagaattcttttttctaaaaggttatgttggtgaggtgactgcacttcagaaaatttaacttttgtttttcttctcctcgccacctgggttgaagccaatccagaagttgaagtcttaatctaccacctggtatcaaatcagtcggggctcagttgcaagaaatgatttgcttgaaaagaaaatagctttggttattttattatcttgtttctattaagtgaccacacctgtgttgtggggttttgtctgtcttgggtgtttttttagtttgttccctctcgggcattagtgttcttattctctttctttgtagccagttcacccagaactcaaaggaggaagagtgataggtctttgttcacatttgccagaaagacggtcatgtgtgggaaactatttagttgccgattctctgatccaccagaaagaaatcatttaatcatgtattcttactcattcaacaaatacttactgagaagtatttatgtatcagtaaggtgaccatatcattaatgttcaaactgggacagttttgcatgtaaaagtggacactacctggttcgcactctaagacaaatataaaccaagattttctcagtcagatgtcattgggttccctatatattagtggctgaatttggacgattagagtcttgggtgatgctaaagtttcccaaaatgcccttaaggattaaggacaaagccaggaaggggtatagcttccaaagccatgagatgaaaagacataaaagataaatttagattaaagttgaactagacatttctaaaattttcccacaactcccttttttaaatagatttcatgtttaaaaaaaaaatagaacaatgtctctggaaggtaatgactccacaatggaagccaagttcccctgagatgaggctacctggaggggcttagaaaaatgtttagaatttataaagaatgaaatttcccaccagggctaagtgatggtgatatcttttgaaagaggaggaacagaatggaacaagaacagtgtgtgattcgttattagcctcttctttctctaacttggagtttcttcaatgtggctattattttgtgtgtgataataaatgatattagcatgcacactcttttcctatggaagatctttggttctgaagtgatttgtttctcttgcatcccaggtgcctgtcctgagacccatggacctgatggtggaggccaccccacgaagagtatttgccaacgcacacacatatcacatcaactccatatctgtcaacagcgactatgaaacctacatgtccgctgatgacctgaggattaacctatggaactttgaaataaccaatcaaagttttagtatcctttctttgtgatcaagaatcaactggcctgaattaagagtattcaggtacgagtgggctgggagaaaatatggaatagaaatgcaacacctagcatttgcggagaacttgccccttttaaaatacactggcacctatgagactctttaatcataacaataaagttagggaaatattgttattacaagtgggaggccagggctagctctggattgggactctgaatcaattccttcatacagaggcatttatatgtcatgaattaaaattagaggtgattttatcaacaataggataagaccctagagttcaggttctttctctgttaaaggattcataaatctgtatggacagcatggaccacagacatactggtttccattgtctcataatagtgaaaataatagtgactgacatttattgagttccaagcacttgcaatgggaactttatagtattacattttttacctcattgaagtatattatgcatatagaaaagtacatattataattgtacagtttgatgaaatgtatagtatacatattataattgtacagtttgataaaatgtacagtatacatattataattatacagtttgatgaaatttcagaggttgaactcacctataaccagcattaacatccagaaacagaactttgctaacaattctcaagcccccatcatgcctctttatattaataatttctacccccaaggacgtatttgataaaacaaccccataatgtaagtatcattatctcctgtttaattaaaatatagaaaagtcggctggccgcagtggcttatgcttataatcccagcactttgggaggcctaggtaggtggattgcttcaggtcagaggtttaagaccagcttagccaacgtggcaaggccccaactttactaaaaatacaaaaaagaaattagccaggcatggtggcgggcgcctgtagtcccagttacttgggaggctgaggcaggagaatcgcttgaactgaggaggcagaggttgcagtaagccgagatcgtaccactgcactccagtctgggtgacagagccagactccatctcaaaaaaataataaaaataaaaaatatatagaaaggtaaaaaaaaaaaatgctgaatagctgggccagtattttcacccccactatgttgaccctctatttcatagtaaaaattggtcatttattgaatacctatcatgtgctccatttctcacaaacctaaggcatgagatttatgaggaatggcactgaacaactcaggtaactgaacaattgacctaggtatcaatatggagttttctcttccacttaccagcctcccctactctaactccatctatccatgagccctgcctctaaaatatatgtcaaatcaacgcatatatccctatctacctacctacactagcataagccactgttgtctctcaccactgtgactgcaataatctcatctggtctccattcattcttgctcttttatacagtacgaacccttcaacatgtaattcaaatatcattccttccctgataaaaaacattccaggagcttcccactaaactcagaataaaatccaagttatttaacttggcctataagattctgcgtgatctggaacctgtctccatctttgttatccagtcttgtcacgcttccctaattcacttcatttcagccaactaatcacttttctgttcctaagtaaaccttattcttccattctttgcatttgctgttccctctttctagaatattttgcccacagcattcacatggctagttacatgtcacttcaggccccagaggtactctttcccattaactcttaagtagctaccaataacactatccctgttattgtcatggtacttaccatgatttgaaatttttttacttatgtatttttggtttcctcatgttaggatgtaaattctacaagagcaagggccttgtatgaactattgctgtattccagtacgtggaacactctgacatacagaaaattattgaacctgtcaagttcgaaataatagtaggtcatcaaagtagcgctatccagtagacagttcataaaatctaacctggaaatttaattttaagagttatagtaaagctctgaaggttcgtttatagaatagaccccataatggctcaaacaaataaaagattattttcgtatgaagtctaatattgatgatccccatcagcaggcagcctcctccaatcagtaattcagaaactcgggcctctttcatttgcagctccccaatgttaccatgtttatagcaggactgtaaaaggggaaggtcatggaagatcacaagtgggagattcctctgagccatgccctaaaaaagtatgcattccattggctagaattcagccacatggctaactcttaactgcaaggcagcctaggaaatgtagtctggctgtgtgcccaggataaaaagacccggttttggtacacagctagctagtctccaccatggagagcactcaaccgtctccaagggctttcagggaaggcagctttaatcagatagtggcaattatgagatatatttggagacaatgagaactgaccatcaggaccatgcctggcatattttgttgatcacggaacagactccacatgctgtctgggcctgcctacagattttgcctggcagtgcagctgctaatagaatgagtgtgggtggtggttccctttttctctctccatctattccaagagccagaaatctgctcaggctcagctggctgtcactctgagcttctgcttccccagtctaggtgacatgttttctgaattttgcctctaggccttcaagggggaggggagtttctttaggcattttgggagacagatgccttggggagaatgcaaaggggaaatattaacagcgcagtttaggttatattctgcagatgtgtgacagactgccagatgctggcatacaaatgagaccgtgccattcacccttaaagcagccatatgtaaaataatcattgtcatcatgagaacgatgataagtgatatctatatagttcttttcaaccagaccgccctaagcactgagcctctcatcactgaagtatagccacctctggggtaggaagcggccatctttcaaaacagtctcagaaaaataccagccaccaggcaggtctcatttccacaatgccccttattcacaaaggagacagaagaaacatggttcaggatagaataatttgggattcccaaagcatagtgtggctactactggggatggtaagcaatgtgcttctaagcaatacatagacttttttttggtttttatatttatgtatttatttagtgaatgtcaaaaaacataaccatcatatcctacaatttcatagatattcaaaatctatttagattacaaagtaagtgtatgtaaagtattaagtaaatagtgagacaagggatctggagatatggttagaaaacagtcatgacttcctgtgactggcatttggtgtgactttggcattacggttgagaactcaggcttcagagtccaacaagtgatagaggtctcacccagccctaccacttttctggctgtataagctttaacatgttcttaatctatccaagcctccatttctcattttgttcatctgtagaaagcagctctatcacgagaggattatgaaaattaaacacacacacacacacatacgcacgcacacatttagggtagtgccttgctaagcaaatgctcagtaaacaggactagcacaatcatgataattattgagagtacaaggaaactagaaaagttgaacattagaatggtagcttttattctgctaattttattatctggattgtcttttcaattctagactcttcctttggttctgcagttgggtgtcctttgcaagatgctgccccctagttactaaatgttttcaggaactctgaggtctagggccttgtgtttagcaccagatcagagcaaggcatttctaaacctcatgataactggtcatgaattctctcccttccatccatagccagtctgtccttgtcttgtgtaacagtttcccacataagcagtcaaactttcgtcttaataggctaactacatcaggactataacaagtcattaatagattagtagttttctagggcaagagacaatagcaataaatgaaaatttatattaaaagatgttgcttctttatgaaaactatggtatacctagaatcctttgaactctttttgcaggactaagaatgaactgacctgagttcttaccttgtccaacatgggatctattaaataggcccatatcgagtaaaaataaagactagccctcaacgatgataaattgagcacctagtttgtgccaggcatgaaaatgggaaaaaacaaatttgccgctttcagagtaatgttcatcaaatacactgagtatataattacaaactgagataatttctgtgaagacagggaatatggttctatgaatgcatttttaaaaatcctgctatagaccagggaaggctttgctgaagaattagttaagatctgaaagaggaagactatgaactaacttggcaaagaggtgtggagacatgtgttcagtgtgtacagaggtcctgtggcaggagagagtatgacatgttggaggaattctaagaaggccactatttttgaagcccagagagtgaagtggagcatggagtaagcaaggctgggaagggtagcagaagcctcacctttcagaagtccagtctctgaatatgagatagaggacttatctgggagaagccagctggactctagggatacttcaactttgaccttggtcctaacaaccctgtacagtggcttcattttatttgtcaaccaagctgaagccctgttagagtcgattccctaattaagggaccaggtagcctcaactcttggcttccaggttctagcactcattactaccatggacagcagcttccttttaattcagtgggattctgccaggcaggcttccaggggagctgtggggtctagtacaagtttctcccctgttgctgcttcagtggctttcaccctgcccaatacatatttaatatgacaccatgtgtctctttgtcagtctcctcatattgagcctaggaattggcaaacactccatgaatatttacacattgacttttttttaagctcttaagagaggaatatcccttggagtcctctttggagatttccagtgtctcatcatcaagcaatatgtcctttcagctaataagatctttatgtttcataatcattgcttaatatccaaagattaaatttagaccatggaaaggaaaaaagatctcaaagcaactcatgtccctaaaaggaaatcacactcatcaaacaaatacgctgtgttcacacaaagatattactattttctaccttcagtactggcagactttaagtgggatatgaaaagcctcagctgcttttgaatgtgggtactttaccctggtaaacatagattccactcttcagcttggccaatgtttataatactcagccctgcagaaaagcgtcctacttggctctcttatcctccattggcttagacaggaattggggaaatacgcatgtcagtattagcaaaatcagcagcaaagggacagaggcatatgaaagtcacctcacaaaggcaatgcatataaaccctatccttggagaaatatgtgcttccttcagaagaaggaatattcactccagtgtaaaaccacttaaattatcttttccattatcttgtttaataatcaaaattcttagaggctgatagggttacacccatttataggcaaagaaatggaaacccagagagataaaatgactttcccaaattctcttagcaaaatggagatagaatcaaaactgaatcccaatctctggtccccattttgttacaatcacagtatttttcacaatattatctcaaactttacccatcgcgatgaggttcctggtctcgcagctctctcacagatgattttaagccagggaaactgctattttttaatgcttattgttttctttgtttaatatgtattcattgtagagatttggggaaaataaaatgaccaaaaatcttactaccaattttgctgtctatacattggattcgcatcacagttttaacttaatgctagctaattcaacaatgtgggttcagggggaaataaaagaaattttaaaagccaaagccaaaaacaatttaaaactcctgatttacccaagaatctttcttcttcttctttttttttttttttttttttttttgaaactttcctaagggaagaagttcaggttcctaatccacttttttttgcattacgatattcttttattgatattatttttaatacaaataatacatgaatacaagttattttttggtaaattactttagcaataaacaattcacctcttactctgctaaaaggttagaacaggttggcaaactgcccacagaccagatctatcccaaagtgtttttgtaagtaaagttttgttggaacacagccacaccctttcagttacatattatctatggctgctttcctgctgcaactgcaaagttgaatagtggtggcaaaggcccaaaaggctgaaaatacttgctgcatggtccttatggaagctcgcctagtttaggatatggactcacacttttttctatccatttatatatcaggcatattcacagactattttattttgtatatagttgggattataccatatgcctttttctttttaaaacaattttttatttccacaggttttaaggaacaggtggtatttggttacatgagtaagttctttagtggtgatttgtgagaatttggtgcacccatctcctaagcagtatacactgaacccaatttgtagtcttttatccctcacctccttcccaccctttccccctgagtccccaaagtccattgtgtcattcttatgcctttgcatcctcttagcttccacttatgagtgggaacatacaatgccaagaaccttccttctattcaatctaggacatatagagacataatttctctctccctttcctgcttttactgcttagtagttatcactgcctaatatactgtgtataatactcatttaccttgtttattgactgttccctactagaatataggctccatggatcaggggggcttggggcctgctttggtcactactgtatctcctgcacccagaagagtactggcagggtatagattctttggaaacacttatagaatacacaaagaaagaaatgagtgaatgggcccttgtctgtctccctctctctctctctctctctctcgtgtgtgtgtgtaatatcttttacgtggtcttggtcagactgtatatactttgtacctaactttccttacccaaaatagtacacatcataagtatggaaagtatcctaagtttttgttttgtttttcaatacagggtctggctgtgttacccaggctggagtgcagtggcacaattaccactcactgcagcctcaacctcccaggctcaatcaatcctcctgcctcagcctccccagtagctggaactacaggtgcatgccaccacacctggctaatttttgtatgtttggtagagatagggtttcaccacgttgcccaggctggtctcaaattcccaggctcaaatgatccacgcatcttggactcccaacttgttgggattgcaggtgcgagccaccatgcgtggccctaagattttttccagcctgaaatacaactttattaaaagaaaatgtggaaattgtgctgatcattgaaatcaaaagaaaaaccattcgtaaacccaccctgatagaactatcactaatgttttagtgtcttcccatttagctcatcattttcagagtataagttttaaatgacatcatcaaactgttgttagaattttgtgcactatggtttttacagacttggaaatttcactgcaaaaacaatttaatgagatatataaaaattcatctaatcacttccttgttctgtatatttatttaagttgtcaatctttttctaatatcatgctggacttttgttttcataaaaagctttttctaaacttgggattaggaaatgatgtttgaatggcccccatgctacctcttaccatcctgccatgaccctctccattccctcatcccacactgatgaaccatttgtggctctggcttcccatttgtttgaagtggatcccttaaggagtgacctcctggtgtcttcaattattattttaaatgatgccttaggccactgcctggcacagcggtgccctcaccttcccctcttctgccttccaagcatggagctcagctgccaagctggctatgccccctcctgtcctcagagctgcctccagagtcccagcagagagccagattaaccccttttgttagcagatgtaatttgcctgggctcagcattaataagaaatgccgtaagcagtcaggtcaagaagaacagatctgtcaagccccagggttaatttaatggcaatctgttggctgtcggggttgtatattagccatgaattcaatgctctgttttgcttttgccatctagttatttgggacaacagggaaataatttggatagagagctctaaaggattaaaaaaaataaaagtgactgtcaaaatgcatcattccattttcaagattatacgtggagccacgaattgctcatcttctttctccttccctcccaacatgaagggcaaaattacatatgctgaaaacatggatcgccctttagagttgtgcaggggaaaatgcctgggtttctagaggatacagatgttgaatatcctctcccatcatccccataagtcacttaatttttagcaactagacttctctcaaatgtttctagaactcaccaaatcctccagcaggtaaaaatccaaataatcccttatcaggcttgtgtcccaaattctgcttcaaaaaaaaaaaaaaaaatcttagagcacataaaaattctggttctggaaaatgcagtcaccaaagtggtaggtaaattaagagagcacaagcctaaagccagaagagatggggctgccctctcagattagctgggggtcttttcaaaggaaccaaaattgtcacattttggccagctttgtgaggccattcctcaagggaggcagagtggcatggtgagaaagaacccgggctctggagtcagacaagcttgggttcaaatcccagctctgcccactgtgtcacataaccttgagtaatttatctgagttccctcggctgtaaaatggacctgttaataatcctgccctcataaggctgagatgaggggcaagggggacaacacatggaaagtgttagcacagggcaggcctggcccctgatcagcattagcaactggccatatcttcctcttaacttcatcatcccagtgattaaaaagagggataatcatggtttatccctggaacccctttgagtcaaactaaacaagccctctactcaaaaaggaagactgagacctgctggggataggaagccaatggcttggggatgagggctgggtggtgggtaggcttggaaggtccagtgaaggaaggaaagatccagagatggcagctctgggcagatctcgtgggcacagccccactggcatccttgatggtggaggatgtgcctggtttcatagacatgtttaggcactttgtttttgcacattcttactttggggctttatttttaggtgggaaaaaataactgtagctgtagcacctccccctcccacacagcgaagatcccttccagttcagcttgttttcagagctatactggtagaggttgagaaagctgacaccagattttctttccctatttggagaaaagagaaacatgttcacaggcacagtgggatatcaaggcttgctctggaggatgaggaaatctaacagcagctgaaaactaacctccgtttacccaacgccacgtcatggccataaagcccagggcatgggtcagtggctgagagagcaccggagctgcagcctagagcctcctcctgaggggcacaggctcttgctccacagcatgtgatgctaactgcaatcatatttataactctggcagaagttgagttgaagggtagtattttgtgaatccaggagactcacatgccccggagacccaagtaatatttgcatctgggtttggtaggagaaattgtagtaacatgtactgttagctcagtctcatgccaattttagaaagaacccaatagggtttataagagataatgaaggggaaagaggcacaaccaaatacaaagccattgttgcaacaaattgcatgttggaatgttgtagcaggagcatagtgatgtttgatcatagatgattactttgttagtgctagcgggactaaaaatatcagtgcatttgcttgtaccgcatctaaactctaaggaggggactatgctactagcttaatgaaaagcatacaagactttcatccatctcagtctaatggggcagttatatcaagttattgcttgttgattcaatacattgttgtccaaaatgtggtgcataaactcctggcacacgcatttgcagttatcacatgtcaatttttatgcatattacttaaaatgtagctaccttattaaacccatgattttatgaacattgggttactgtttagataaagctaagtaaagaaaaaagtgaatcaatttaaagttgatctgaaagaaaaatgttaagtaaaaagtactatctgatgatgcacagatagggcaaaaatcacaaaggtggctcacgagtaggaaaatctaggaaaagtgggagtcctgttggtcagctttactgtgtaacagcatccacatcacaaggcttgttctttgcaggatgttgctgggtcctcagacagtacctcggcccctctgtgtcctgatcccccaagctctgggtggaggtgtgaagagatctgtacaaacccactccttcactcatgccagacatcccagtgaaggggtttattttcattgagtcaccttcataaataaaagactaaatgtttcattccaatatacaaggatatggtctttaaaaaatagaggtataattcttgatcagaaagggaaatactgagaaaaaaaaacccagatgataaaactaaggatattttccacgggaccctaaaactttccaactggatggcttgtttctgatacttaaaaactccctcacaagctgaaaagcagatcacaacttacagagactagaagtcttatatatcatacatgagagaaattttgcataattatgaaagagcacagactttgcacctgggatgaaatcctagtgttgtcacttagccatgtgacttgaagcaagtttctttatgcacatggagcatccgtttccacccctgaaaaaatgaggataaggaaaacgctaattatatagagttcttgtaaggattaaatgagataaagtacatgatatgctttgtacagtgaatggcctatagctagtgctccattattggtggcagctattattattatcatcaacatattataaagaagggcttagggatttcatgaaagaagatatgcactctattattatagatatcacttatcagcccaataatccattaaggaatcagataaaatgaattatttggttataataggaccagtaccttaatcattattataaaatgagaagcaaaatctttgcaacttggtacattttagcctgattgcacaagcagttaactttggtcatgagtggatgtcttttacatgtttatagaggataaaacacaaatgaggagtcaagagacctgagttctaatgctgcctctgactactgggtaaccctgggctattttcttaaagttcctgagcctcatctgcctgggacaagtttatgatgaggatctaccatgtgcatagcaaatgttgacatattttactaatataagatggtgccattgctaattctccccttccccaagttcctgcctccttctcctggttccttccttgactcgtctgtgccagatattgtggacattaagccagccaacatggaggagctcacggaggtgatcacagcagccgagttccacccccatcattgcaacaccttcgtgtacagcagcagcaaagggacaatccggctgtgtgacatgcgggcatctgccctgtgtgacaggcacaccaaatgtgagtagcaactgaagggaggtggggggcatggccactggccccaatgtgctgggggagagcctggaagcttatgatctccctttctacaccagacacactaggagtaaagaaactacaagtgggagtcagctccgtattttatatttcagtaaagatgaacatttgtgttcgattccaaaacatccagagatgaaaataaataagacatgaccctcatcagaaaagggtttaaataacagtgtgatgtgatccaaattatgtgttaaggaaatcatgcttgctgccatggggagaatgactttgaggaatagcagggggaccagttaggagaccgttgaagggtggcctggacaaagaggtgagtggaaattgagagggcagatgggttctggacacatctttttttttaatccatgtaacctgcacagtactgcacagatcttggcaataaaattaacaggacttgctgaactgcatgggaggctgagaacataaaagccatctagaacagcagctgggggaaggagctggtggcttcttggagagattgtgactataggatgccagagccatgtcataatgaccatgatttttaaaacccaaatttttttcatcaaagtgagtgaacagccacaaaagtaaccagaggagtagtatgatcagaattagttgttagggaaattgttcagatggaaggcagaaggataaaggttaaattctggctgagagaacaaagaaacaaggagacaggttaggaagccactataatatagataagcatttcttaacagtacaccattgaatcttgcgctacatagatttttgtttcggggaaggggctgtcctatacattgtaggatgtttagcagcatctgtggccttacccactagatgccaataacccaagcccagttgtataaccaaaaatgtctccagacactgtgaaataccctcttggtgaaaacattgctcccagttgagaaccactgatctagactacaattcattcagtcacagatactgcatgatattcttgtatctacaatgtatttgttacaataaagaactctgaggggtacaatggaaaggtaagacttatctcctatactcaaggaatttaaaatttggctaatgaggcaagatgcacccaggaagcatttcaggaacaatgtataaggcagtttagttttaatactcaagtgaatgatggagataattatgggttaggccattcagagacggttgagacatttgaaacagacctcacagggaaggcagaggctgagcagttgagtgttgaagtacaagtaggatttggttaggtgggaaacagaaagaagagtattgttggcagcaaccacagaatgggcaaaattctgaagttactaaagtaatggaacatttgaagggtgttaaataaaaagtgtcaggcttgggggaaaggggaatcttgggttaatgaggttaaatagcaatgatggttcatatcaggttgatccttgaagatcagattccaaagtttatgctgtcatgtattcatgcattcagtgagtacttatattatacccagagtctggttcccatagtatccagtccttcttaagctgttccaccaaatacagttctggtggggccaagccatgaaccctgctgccatggaaggagggcacagagaggaatccagttcctcccatgtgctctgggttggcccaacctaccagcaaaggcaaaacagcccatgcctggcagagaccagcgaccctgggggaggtgctgaccacaacagattttctttgaagccttatttttctttctaaaaattcatgtgaattttacattttaacccatataaaatctattttcactttaatttaataattatgtttctacccccactcccaaattttaaacaaaactggtgtttccaaaagatgtaacatttatcctatggcttcctgtactttttagtatacccccatatcctcccctcttcctaacgcccaaggatatatacaggtaccccggttggagaagcacagtttctagtatgtgggaggtaatttgagagcatttcgctggacagcagagttaataaaaattgtgttttatggaagattaacacagtggtcatgtgaataaaggtaggaaagttagaaggttttgctttagtctcaatgcaaggataatttggaacctagatcaagaatggtggctatagaaatccaaagaaagagaagggggaaaatgaacattttcttttaaaataactatgggtgttataagtgacattagtgatattaaaggttggcattcgtcatacatggacgtgatatgaattgttcaatgtcattcccctgtagatagtaaatgccttgaggataagaactgaatctgacttggtcacattatatgaacccctgacacataagcagaggtcaggaaatatttaataaatgtgtgcctaagggttgacataaataacaagtgggaatggggatggatggaaagtctctaactctctcccagagagtgaagggttgggactcagtaccggacatgctgtgggtgaggtgacatgagctgtctaaggaggcagggcctctctagtgagtgaaggcagaaccgggctttctgggccaccaacccagggtggaggccagggatggcacgggaagccctggcatccccatagcccagtgtggctgacactagcctcagctttggagtcagacagatccacatgcattctggatattggggaatcaactgactgggaagcttgatgaactgaacacaagatagaaaaagggcaaggccttagaagctttcaaaactagaatggtaaataactaattggtactaggcttaatacctggatgatgaaataaacacacaaaaaaaaacccatgacacatgtttagctatgtaataaacctgcacatgtaccactgaacttaaaagttaaaaaaaaaaaaaactagagtgatttagagcagatgctttggaatcagaactcagctctgatactcagtacctgcatgacctcaagcaagttatttaatcattttgagccccagattcctcatttgaaagtagaaatattaaggacagcatcatagggcaggttgttcacaagaactaaatttcatgtgtgtgagatcctagccctctgccaggcacaaaggagtcaataaatgacggcagcagttatcacaattattcaccctggattcctccggttctaggcctgcagacataagatgttcgaaaccccaaccctcttgccagatataggaggcctcattattcatttatttaatcaatatttgttaatcacatactttatgtcaggtactgtatcagactctggagacagaagggtaagcaaaaacagacctggtttcctccctcttagagcttactctctgtattagggttctccagacaaacagaaccagtagggggtgtgtgtgtgtgtgtgtgtaagttaagagatttatcataaggaatgagatcacatggttatgaaggctgacaagtcccaagctctgcagccagcaagctgaagacccaggagagccgatggtggtgttctaatctaaaagccatcagagaccggcctcagtggctcacacaggtaatcccagcactttaggaggctgaggcgggcagatcacccaaggctgggagtctgagaacagcctgggcaacatggtgaaaccccgtctctactaaaaatacaaaaattagccaggtgtggtgacacacacctgtagtcccagttactcaggaggctgaggcaggagcatcgcttgaacctgggatacagaggttgcagtgagctgagattgccccactgcaccccagccttggcgacagagcaagactctatctcaaaaaaataaataaacaaaaccctcaggctgaagacccaggaaaaaccagtgtttccattcaattccagaagcaaggggggaaaaatacaatgttccagctcgaaggcagtctggcagaggagttctctttcccttgcaggagggtcagcgtttttattctcttcaggccttcaactgatgagatgaggcccattgacaataggcagtacaatctcttttactcagtctattaatgtaaatgttaaactattccaaaaacacctttacagaaacacccagaatttctagccaaatatctgggcagcccatggctcagtcaagctaatacataacattaaccacactgtctaaggagagaagatgcattagttagagaacagaaacaaatatagcatcgcaactgcaatacatgtataaaagagaggcatgtgctggtacaagtagaggtgttgaggactctacaagacagtgactgctgagctgagacctaaggatggagaagcagacggggagagcccagggaagaatcatgcagtcatacagaagcaggaagccggtcaagccacacacccagggagccccagaagctgcttctccctccagcctcagccccacacagccccagagaagcaaagccctggtgactgtcctgaaggaggcggaggagccagctactggccttcaggcctctgcccagccctgtcctcccactccctattccaacaccaacagagttctgaattgcaagctgccagcctgctaatctaattaagaagcaaatgaaattcattttcctgactccttcaaagaaccaaccttcttcagtgcacatctccctttgttcagctgctgcggctacgagccccagctcctgccagctgggaaaacaagttcaatctgacccctcgcctgacatttcatattgattttctccatcctcctcaaacggcagcctgcagtcaaccgcagttcagccgaggtgtgtgatcggaattgagacagttcatcagagttcaaaatgaaaagcaacattggcttttggagatgagctctgagaaggagagtatttaataaccaacagcatttaatcaaaatgccgaggagaaccgtgttatcagagctgcatttattaatttccatatgtccctcactctgcatactcagcaggggttggaaaggatgattccttttctccctcgcctatttttttctaccacttctggcggtagtgacagggctttgtttgcagtttagatgtctgaaacaatagggtgctgatggcagcagtacttagctagagtggattattctttcccctttccacgcatgagtatcggtggctgggtgaagaaactggccaggtgtaatggacaccaacctggggaatgaaaggaattaagcctgaactcctttccaacgtgccccgtaaatctggtctctgccaacatttccaggctcagctccctgtagcctggccacactggcttgcttcctacacctccaatacatccagccctttcccacctcagggcctttgcacatgcttttctgcctggaattctccctgccccccacacactctacctgtctggcctgtactgactttttaagtttctgagaaaatgtcacttcctaagagttaacttctctgtccaccccatctgcacctaccatctctcaatctcatcactctatttctttatttctttcatagcctccattatagttgtttgctttacttagcctctgtcttgctgactggaatacaatctttatgaagacagggactttatctcactaattactgaatttgtacaatacttacatagcacctggtggggcttcatagaacatctgtggtggaaaggcaggcagataggaaaagacaggtgaaaaaagacatattggtttaccagggctgctgcaacaaagtaccatggactacactgcttaaacaattcaactattttttcaaagttctggaggctggaagcccaagatgaagtgttggcagggttggtttcttctggaggctacgaaagaaggatcagttccacactgctctccttggcttgtagatggctgtcttctccctgtgtctttacactgccttccatcagtgtctgtgtccaaaattcctcttcttatgaggacaccagtcctattagatcaagacccaccctgattaccttattttaattacctgttgaaaggctctatctccaaatacagttatattttgcagtactgggagttaggacttcaatatatgaatgggcgggggggggggcacaactcagcccatagtaggaggaaagacataaaagtcatcaagaacacaagccctggagccagcagttccagacattgtttccaggcctcattgccgccagaagcctgggcaggtgctgatgttgacaccttcctccaggaggtaagagtggaaagaggtcatggacacagggctcttgcacagcccctgacacattggaagcacacaatgagcataacttttattaaaggcaggagagaaactagacaaaggaccaaaggaccaggatgatagaaacctgtgcattgggtctcgacagtttcaccaggcaggttgtccgtgtgtgttaggacagtgatgcctggaggctttcctgtggagctagaacactttctttctgaacaaagcagactttaattgattttagaggcattgaggtacctgattcctattcaaaagccagtcttgaagggagaggttccccaataagtagggtgtggtttagcagcataaaagcagcaggtgaaatcctcaagtgggactgggaatagtaaaagtgataccttgaaaggccacagagacttgacttgccaaagacctggggacacagagatggagcaagtggagagatgtttatgaatgttaaagcagcatgcgaaatgataatctcaccatgaatgcagcaaggtcaggataagtatatgtggacaaagactagcagaggctatatgaaagggatgaggtcaggggccatgaaatgtgggcagttctcttattttctagattctctccaaggttgttgttttacttctataacttgaagaaagttgatgaatgactgaagagccccaccgggtgccttacctccagggtggagacagcaggaaagatcaaaactccctgcccaccccagcagcccctgtcataggtactgggatgaggcaaggcggtgaggagcccagcatgatgttccctgtaagcacagcccaggacaattttgttttgtttcttcccctctgtcaaaccaaactgacagtagtgagtgaattcagggactgggtcaaaacaggggaggcaaatcaacatagttgagcagccactatcagcttgtatccatggcctaattggtgatcttgagcaggttacctaacctctgtgcttcaacttactcacctataaaatatgggtcatgaaagtatttaccttatagggtgcttgtgaggattaaataacacccgtggagccttagaatgatgcctggcacatagtataagcatcgtgttatggttggagtgaagatggtgtcttgcttccctaccacatgtgtcttttaagtgtgggagcaggaagagcagaagcaatcataaaagtagtaatgtcaacagccgtattcacagctaacttccatgacattttactgtgtccaggaagtaagccaagtatacatgcatgagctcatttaatcctgataacaaccctatgaggtacatactgccattattcacatcttagagatgaggcaactagctaaaagggggaaagatacacttatggccaccaaagagcaagtgatgaagttgaggtttgagccagaccacctgtagctcttcaagagaacaccaaaaactacttattcaactaagattgattaaacacctgctggtttctgcctttaaggaccatactttcttgtggggagggatgagagaaaacacaaatgtacaaataaccgaggtcatttcagacatgataaaaaagctgtaagaaaattagcagggtcaggaagtagtggtatgtggcaaagcctttgaattaagacctgttatcagacggatccaaagagaaagccaacatctaagtgtgaaggccctaacagaggaggaaacttgtgtgttcaaagaatagagaaaaaagatcagtggatggatacaagtaggctagggacagtatagaaagtgaggccacagccaggcatggtggcttatgcctgtgatcccagcactttgggaggctgaggcaggtgggttgcttgaggccaggaggttcgagaccagcctggccaacatggcaaaaccccatctctactacaaatacaaaaattatctgggtgtggttgcacacacctataatcccagctactcaggaggctgaggtaggagaatcgcttgaacctgggaggcagaggttgcagtgagccaagattgtgccactgcactctagcctaggcaacagagcaagacgagagggcaagggagagggagagggagaggggaaggaaagaaaggagaaaggggaaaggggaaaggaaagaaaaggaagaaaaggggagggagggaggaagggaggaagagagggagggagaaagagagggaggggaaaaggaaagtgaagccagagaggtaggctgggtctagatcattgagagctttatgggccagagcagagcacttgcatttcactctaagtgagatgggaaaccatgagatggtgctaagaaggaagtgaatactgtttatgatcttaaaagagttctcagacaaggggtgccaggcctggaaagcagagagaccatttagaggttgttgccactgtctggaggagacatgataatggctttgaccagggtgggcacagtgaagtagtggtaagtgggcagattcaggatcaccttaggaggtgaggctaagaggacttgctgagagattggcagtgaagaggtgatggaaaagggagaatctaagataactcgtaggtttggtgcttgagttactgtacggtaccatacactgaaacgaggagactggggaaggaacagttttggcatggaaagaccaagcattctcttttggatgtgtccagattgagatgtctgtgattcatccaattagagaagtctggcagacaattagataacatgagtctggaagtctggggagaggtctgagctgtaggtataaatttaggaatcacgagcatgtcatagctattttaagccatgggatgggataatgtcaattagggcagaaggtatggatagagaataactgagggcccaggaatgaggtgaaggccacaccgacatttaccaatggggtaggggaaaggaggaggtggctttttacagatgatcaagtatgagctaccagggaagtgagcagaaaaccaacacatgtaagctgagagaagacagtgatttagaaatacattaggatcaattatgtcaaatgcttctgagagggcaagaaagatgagaggggtgaagtgatcatgggatgtgggcttatggaagtctttgtccattaattagttactttaagtaaaagcagttagcacactgcctgacacatagtaggttcccagtacacatttgctgaatgcaatcaatcttgtgtgtggtggcacagggtaggttctgcagtagcatcttaattccattgtggtttgggcagaccttccttcttcctcacctgcccctcgagcttccatcttattgagaggtaatgtctagtgctggggaattgcagaagctgaatctggccagagaaggtcttgagggccagggtgaggagccagggttcacctcagcagtagcgatggggctgccctgcagcaccaatccttgcactggctctaccagcaagtccactgcctgtagacactctcttctagcagcaaggcccttctgcattggcaagtctgcagcccaaggattggccacagaaatcccctccttcggatgacaccaaagcagccttcctgtccaggggcagtctgactttttcatgctgagggggaaatggcataagcactttagaccttaaaatctgagatgttaggccaggtgcggtggcttacacctataatcccagaactttaggaggctgaggcgggcagatcactttaagtcaggagttcgagaccagcctggccaacaaggtgaaaccctgtctctactaaaaatataaaaattagctgggcatggtagcgcacacctgtaatccccactactcaggaggctgaggcaggagaatcacttgagcccaggaggtggaggttgcggtgagctgagattgtgccactgcactccagcctgggcaatagagcgagactccatctcaaaaaaaaaaaaatctgagatgtttctgtgaacagtgtagtcattggagaaacagcccgagttccaatgagaagaaggcaaagtttgatgcccagtccaacaatgcaaatcagaaatttcattgtcctccaaaggtgggtgtagtagagggggagggtactatttttgaacatttctgtatctcatttaattctcacaacaacccatgaagattggtattagtacctctaatttatagatgaggcacagagaggtgaggaaacttgccccagatcacagtggaggacctaagatttgaacccatgtaggtctgcttccagaagatttattcctctgctgggcatctgacaggataaagagcatgatgtttttctaaaatccagaaggataatttcacaagagtccattttatacaatccccatctggctggattccccagcctgaccattttcaaccatagaattaattctgccattacacagaacataaaatccactctcattcttcaccctcatctacaaacttaattgccaacccctggtaagtaagccactagagctccctaataaacctgtggctcattccccaggtccctgatggaatgtgtccaaagacatcagctgagacagcaactgcaatgaatcttaaagcccctgagatttggcatatcttccaaaaggggttcagtattgatctgaggtataattaacagtatttatttcaggggagcttggttaggttaaaaagacaaggtcctttattaaaatgcttttgcctgatggcaggattgcaaacacacacacagacacacacttcccactctggagaaaagccaaaagccttgctgcaaggagcagaattcactgataccaccaccacccccacctcacccccatgtctgaagctgctctatcccattcaagcttagcagcaattaacagagcaggcagtgcccaagccatcgaataaaaatagaatcccttcccccttcttccatcctcatttccatttttgattaatttaaccagttctgtcaattagtcatcctggagaatccagttgagtggattttgctaagaaccagaaggcttattaattttggaagtgagtgttattcattagtagttaacaccttcccaggtcttgccctctccctcacttggggtcttgaatgagacagcagtgaaggtcaaaattggctcccacacatggctgcagcccccaagacatgcagaatgggaaagattggccatagggttatagatggctctggccttgggacattttaggccaacttacctgtcgtcatgccctgtaacaagctatcactagcaaagcagccacaagcacctgggggcatcctgaattctaggttcaggagaacccagtcaaggaaatgcccagaaatattttccccagaaagaggcattggcctgttagagcctagggagggcactggcctcctattccctgtattttgcctgcaaaaaccaaaaattatcttccattttttcaatttataaatatgttgcaacttttaaaatctaagtctgtgttttatgaccatttttccatttgtggtgccaaggaattaatcttttaacattcatataagtatcataacaaggtgggaattttatcatacaatctttatatataatagatcttccaacagcccgtttttcccctccacagtgaaatcaaagttcacctctttctctctgtattagctgcccgtttttcccctccacagtgaaatcaaagttcacctctttctctctgtattagcttcctatggctgctgtaacaaattctcacaaatgtagtggcttaaaacaacactaacttaccatcctgcagttctgcaggtcagaagtctgacattggtctcactgtctaaaatcaaggtgttgatcaagttgtgttccctgctagaggctctaggggggaatgtttcctcaatttcttcagctttcagaggctgcccacattccatggctaatggccccttcttccattgtcaaagctagcagcaggaagatgagtccttctcatatcacatctctctgtctctctcctgcctctctcttccacttttaaggacctttgtgattacgctgggcccacctgggtaatccaagatactctccccaccttaaggtcagctgattagcatcataattctatccacaatctttattccattttgccatgtaaggtaagatattcccaggttccgggcattaggattttgacatccttggggagccatcattctgcctacacattcttcaggtttcagttaaggcacattcctccaggaagacttcctggacccccaaataggattaaatgccctgtctcagagcacttaataccatacatttaattacctctttctattttggtctctctcactagatgggaccattattatggctagactcttttctcaaaccccctcagcatttaggacagtgaaagtgctaaagaaatgcttttagaggtaaacaactatagtcattcaatctgataaatttgcatctgatacttctctttacacatatgtaaaagccaacagtaaagagtagttgacccactgtttgctcatttctagcattaagaatacattacacacacacacagtataataaaatacctaccttgttatatttaacttacatgaacattaaaattaaatcgcattcctaggcaccacaagtgggaaaatggcaataaaaaagcacaaaataagattttaaaagttgcaatatttttacaaattggaaaactagaacataagttttggtgtttgcaggcaaagtaaaagaaagagaagtccatgaagtaaaggtaatcaactgctacttatttattcaacgaatgtttattgttgcttcacatgtcccaggcactgttccaggcactaggaaaatcatgccccctgcccttgcagcactttattgaaggagaaggaatctaacaacacacacataaataagattgagatttagtgaaaatgtttcaggggaagaagcaacagcaaatggagtggctctgaatctggacagtgcttggcaggtcacagggcagaaagatgaccagctgggctgtgtacagtaccataaggaggaatagcatgagaggaggcaggaagagctacatacagggcagtccccttgcaccacacagcccccattcacattgtcttctgtgcaaaggacttgaagggctgggccacacggtagacctgtaggcaatggtaaggagtttggatattgctgtattaagagaaaatccaggagggcttggtgtaaagaggatgattgattatacttttaatatgtcactctgtggctatttaagaatgaagcctcaggaggaagagtagatgctgggagaagagtcagaaagctatcaaagtgctccaggtaagagatgagcatggcttagactaagatggtgacagtggaaatggtgagattgaattgatttgggccgtactttgagtgtaaagttaatagaactgtttttttaaaaaaaagatgtagagggtgaagtaaaggaaagcaccaaggacagctcccagctttttggcctgagcacacacctagatgaaggtgccatagagcgagttcacaacaacagtttgcaggggaaatttacaaattctgtggactctcagatttatgtttttaaaaaggcataaaatgataaaagttgataccttttgctgtttagccctttgctatttatagagccccttctcattgatttatcttcattgatcctcctgaaaacccagtaagtttgcagtatctcttcctttttgcagctgaggaaatcagggtttagaaaacattaagtctgaaacactgacaatgattggttttttttcttacatcatataatgaatacaaccatcctcacgacttgcatggccctgtaagatggagaaggggggatctctcgtgtgtgtaattgactcatgtttaagtatatcggttaattcaagccccccatgcagttctcataattctattttgacagctcagtaggtagcatcagtaactgaattgtgagatctgctgtccactcaagcagcttccagccccatcagtgcaagtctctttatctgctgaattactcaaagcacctgctggccttccatcattatcaagcacagactggagacagcagaggtcaggggaatgctatccccacgaagctcataatgatacttgcctttatcttctctttttaacctgagcataaggatttaaataggattgatctcatgtatgggcatccttaatcccagggtcaaatagcatattctgacattttttgtgccatttgaaaatgtctgtaatgcagtgaaattgtcattgaagagttacatatgagaaaaatagaatcatcaagcttaggaaaaagactgaaatcaaacaaagcaatgaattggtcaataagtgttaacaaagtattgtgctaagcacaatggatagacagacttatgcaattactgcctttgtacacttatcgtggtgggacaagagaatataaaattatgaaatgtttctaatataaagttcattttcaattgaatatgaaatttagattcccataatcagaaagagaaaatgctgactaaaaagtgtttatgctgaatattgttttagacagttgaaatagtgatttcaaatgttcttatcctcagcatatcctatgtgtacccaaaagttctgacgcgtagcatttttcagtttctgtttattgagaatcttttgtgttcgtgtcactgtggggccacaaaaccacaaatttgtgttaatccaacgtactgttgcttgcccctagggaggttattaagtaccggaagattccaagggccatccctgacatttcatggatactaaattgtagttattgaatgtatgagtgaatgagatgagatctaacatcagataaaaggtgatatgtatctcagaatacactaaggctatgaattataagctaaaactcagaattgtctcaatgttaaacttttctcctggaagtattcctgaaatttgtatgatctatataatagaccccagtacaaaatggtatactgagttatatataagctactttaaagataatgtcacaatattttatggtgctctgccccatgacttttgtgtcttgatcacaacttgggaaccttgctctatagaagttcagagaagaaagtgattgtttccaactcaacttttcagaaagaatatcaaggggtggtggaagggggagagggagcagagcctggaatatgggaacaattttgccttttagagaatttcaaatcctactgagcaacttccagccactaggtggctttcagatactctgttgaggttcataaattataaaggccggttataggtatttgtgagattcctgtggcttggaaacttggctttaatgaagatagaaagaggctgtatatcatagtggtcaatagtgctggttctggggtcagacaagcccaggtgtgggtaacttggacttaactccttggatttaccctctgtacagctaagtatccacctctataaaatggggacaataatggcacatgcattactggattgttgtgcagattcaatgaaatgtctggtccacagcaaacactcaatattttttagtattttattatcaaaacaattcataaacttggagttacagatgagaaaattgggcccagaaaaagcatgttgtttacacaaagtcaaagatctaggcaaaggtagagggggcttgaaccgaggtctaaagttgaatgttgtcagtagataatacctacaaacacttcccatctttgcctccccaggcctgtaggagaggtagccagggaagccatgtactaggcagagcacagaggaacacaagtatttttctggtagagtctgcccaggccttggggtctgtgtttctacagaacctgctgggggagtgctagagtacactgggaggaagtacctgagcagcagtggagatggaaaggcctcttactctctaaccaagtgcaaaatgaggaccaagtacaacctgtctctccttccccatgaccaagtcattaagcaaaagtgcttgctaacagataaagcctttattgtctacagtgattataaaatgtttcttctctctgcatcagaggacagtggcctcaagttctagagtgactgtggaagggaaggatagcccacgtgttaatggcatgtctggagcaggtagtaggtgctcaataaattcagtgactgttctccacattgcctcggtacattgtgttaagtctgtaaagagatggctccactctggttaattctctgtggttggtgagatcacatagctaatgaagcccaaaccagcggtttaatccttgccagtccaatttctatttgctggaaccatgccttcagaggtgtggggccgccagtgtctgttctcagcaccaggttgaaggggccaccctttctagtcagaggactggaggaaaaatgatgctatatgagatgccatagagccagagttgggtttacgtcctagctctgcctcttcttagcctgtgaccaagggcaaatgactctctgagcatcatttctttgtctccataaagagtttagcgcagtgcctggcagatggaagactatcactactcgatgtttgcaaactccaggaacctttaagaaatggatcagtggattaggagcagtgttttcctgtagaaaaccagtactgggaacacagaggcagactgcctgatccatgagaagacagtgaagcagtgaccagctcacaccagggtccctccaggcagtgcttggcccatgccaagatgggctgtcgtactcagctgtgaactgctcaccttgctctgcagggagatcactgtcagtggggagctgctcctctctccctttctgtgcctgtgcctctcattgcagtgattatgtagacagccttggaaacggggcagcttgggagttcagcactggcctctgcggtgccatggcaaccagcttcccagcaatcacccctaataatagccactcgagagctcttccacctgggcagaggctccccagggagttcgggcttctcttggagtaactgcacaaagctacctgttgggaacaaattatgagagggaaggagggaggggagagcatgctatctcagggggagagacgtgagaaaggaggcagacaagaagtctctagcctgtgatgtgtggagtgggcccaggggcctggggatgctgccattgggttcccggagcccactggctgtaggaatgtgtaattccacagtgggaggtagaggcccatggacacttttgccactcaccaaccttgcagagagtgaaagaccaaatatgagcgctcataaagccagccctcgctgttaccagatttcttcattaggctcctgtcgagatgctcactgccaactcatcatcttgtctggactgcagccgcctcccttacggctgcctgctggagagaatgtgctcagaggcctccttcaatcaatatctttccagaatgacagttctcaaaaaggcaccagtcccgcttggctaataaatgattattcctcacaaaagaaagacaaacagacccacaattaatgaacttgtctgtacatattagcccaaattcagtctttagattgacaggcgaaccctaagccaaacacaggttttcgcttcccctttctttagatcagattccagctgagtctccttcgtaagaaagttctaaccccacagataatgagccttccaatgctgggctcactcagagaccatatggtcctttgggtccctatctctccaagcctctgtttcctcagccataatatagagataattcttaccctagatggtgcccggcaggtaacaggtgctcttgttgtcactggtgttgcctttctgtggggccaattccctaactaaaattttttaactcattgtgaatcctgaacagataatatttaaaaataataggaggaagattagaaggtggccaaattaaccagtaaggaagaaaggatgcagtgggccaagattgtccaggaagtttttctagaaaaagacagtgagccctgaaggttgaataggagccagagaaacaggggagcagggagaggttagggaaggagcatggatccagccccagcacatgccagtgcaccacagacatcaccatcatcactgcagggagttaatcaggtcacaggtgtggcctgcatagcttacagaggacgtatgtttgatcacacgctcaagtttctttagttagttgctaacatgaaaaaattagagttcctcaaaaaatttaggccttacaaattagtctggctgtgctggagccccatttctgcatggctgcattcagccggagcagagtggaaattgcccctttatggttttgttttgtttgtttgtattttgggtttgtttttgagagagtcttgctttgtcacccaggctggagtgcaatctccgcctaccaggttcaagcaattctcctgcctcagcctctggaggagctgggattacaggcacacaccactgcacccagctaatgtttgtattttttttttttttttttttagtagagacggggttttgccttgttggccaggctggcttcgaactgctgacctcaggtggaaactgccccttttatagggtgtggacactctagtttgccacagtccctactgttccctattgctacccatgaatgtgtcatctatttcactacctgcctggaccctggaggtaggagttattcaactctggtgcaaatgagtagtagatgggtcagacctcaatggagcatttcagcagaatgaagtagagagtaatattggaatgctgacctagggcttgatatggagcccctgaaccaggacaagggggtaggactgttggctatcagccacacagagtcactgtagatgtctgagcacaaagtggcattgctttgggaagattcaaatatttagcacatggtaggattgccggtcgtttcatgttctgctgctaagccctgatgtctctgaggagtttggcttgctctgcctttgcagccgctgggttctggtttctctgaactgtgtcggcttatgggtgtacagcaccagcatcaggaatgctgggaggaaagagtggctgagctggggttcaccagctcccttggacagtgagcctctcatggcctctgcccagaagcagcccgctctggcctgccttccctgtccagctgtataggggcagctgctgaaagggaactggccctggggtgcagggaaataataacagcggctttgcagagttgaagggggaattcatgaactttgagccctccctttgttgacaaacggaggaggatagttttctatcactgctgtaacaaattatcacatacttaatgaacttagtggcttaaaataacacaaattgattaacgtccttacagttctggaagtcaaaagtcagaagtgggtctcactgggctaaagtcaaggtgtcagcagggctgtgctcctttctggaggctctaggggagaatggctacctgcctttttgagcttcgagaggctgcctgcctcccttggctcatggcacctttccatcttcaaagacagcggtgaccagtcttgtctttctcatatacggttattcagactttgaccctcttgccttcctatttcacttataaggaccatggtcattacactgagcccactcagataatctaacgtaatctgtcttaaggttagctgattagcaaccttaattcccccttgtcatgtaacataacgtggtcacaggttctagggattagggtgtagacatatttggggatgggggcaatggcattattctgcctactacaggggaattgagcaagagatggctggcatggtggttcactcctgtaatcccagcactttgggaggccaaggcaggtggatcacctgaggtcgggagttggagacagcctggccaacatggtgaaaccccatctctactaaaactacaaaaattagctgggcgtggtggcacacgtctgtaatcccagctactggggaggctgaggcacaagaatcgcttgaacccaggaggcagaggttgcagtgagctgagatcgcgccactgcactccagcctcggtgacagagcgagactctgcttcaaaaaaaaaaaaaagagagagagagagagagatgagaggaagccccagccatggtagataagaagccccactctttgttgaaggagcgtaggcatggtatatctcttgctcactcttgtaactctagcacctatcatagtgctttacacacactgggtactcaatacctgttgtttaaatggtgtgtgacactagaacttgttgacgtctttttatgggtacagaggtgtatatatttatgaggtacatgagatattttgattcacacatgcaatgagtaataatcacattggggtaaacggtatattcatcacctcaagcatgtactctttatgttacaaacgatctggttatactcctttatttttaaatgtgcaattaaattaatattgactataatcaccctgttgtgctatcacatactagttcttattcatcctttctatttttttgtacccattaaccattaacccacttccccctgccccccaacctctggtaaccatccttctactctctatctccatgaactcaattgttttgatttttagcttccataaataagtgagaacatgcaaggtttgtctttctgtccctggctcatttcacttaacataaagacctgcagttccatccatgttgttgcaagtgacaggatctcattctttttcatggctgaatagtacttcattgtatataagtaccacattttctttatccattcatcagttggtgaacacttaggttgcttccaaatcttggctattgtgaacagtgctgcaacaaacacgggagcgcaaatacttcttcagtatactgattttctttgtttggggtatatacataaggagtgggattgctggatcatatagtagctcaatttttagttttttgaggaatctcgaaactgttattcatagtggtttttcgaattttcattcccaccaacaatgtacaagtgttcccttttctccacatcctcatcagcattattgccttttagatgaaagccattttaactagggtcagatgatatctaattgtagttttgatttgcagttctctaatgatcagtgatgttgagctcttttttgtatgcctatctgccatgtgtatgtcttcttttgataaatatctattcatatcacttgctcatttttttaaatggattagatatttttttcctatagaattgtttgagctccttctatattctggtaattaatcccttgtcagatgggtagtttgcaaatattttccctcatcctatgggttttcattttgttgactgtttcctttgctgtgcagaaatgttttaacttgatcccatttgttcatttttgctttggttgcttgtgcttgcggggtatccctcaagaaatatttgcccagtccaatgtcctggagactttccccagtgttttcttgtagtagtttcatgctctaaggtcttagatttaagtcttcaatccattttgatttgacttttgtatatgttgagtgattgggatctagtttcattcttttgcatatggatatccagtttttctagcacaaatagttgaagagactgtcttttcccccagtgtatgttcttggcacctttgttgaaaatgagttcactgtagatatacagatttgtttctgggttcttgtgttccattgatctatatgtctgtttttatgccagtaccatgctgttttggttactgtaactctgtagtataatttgaagtcaggtaatgtgattcctccagttttgttttttgcttaagatagccttggctattctgggtcttttgtggtttcatataaattttaggattgttttttctatttctgtaaagtcattggtattttgatagggattccattaaatctgtagactgctttgggtggcatggacattttagcagtattgattcttccaattcatgaatgtggaatatctttccattttttgtgtccccttccttttctttcatcagtgttttttaattttcattgtagagaccttttacttctctgggtaagtaagttaaatccttggtttttaatttgtagctgttgtaaatgggtttaatttcttgagattatttgctgttgagatcatttttgtatcttgattttgtatcctgcagttttactgaatttgttttcagttctaatagttttttttttctttttttttttttttaatttttttttttattatactctaagttttagggtacatgtgaacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcatttgggtatatacccagtaatgggatggctgggtcaaatgggatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcgacattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaaggcattggtagcttgatggggatggcattgaatctgtaaattaccttgggcagtatggccattttcacgatatcgattcttcctacccatgagcatggaatgttcttccatttgtttgtgtcctcttttatttccttgagcagtggtttgtagttctccttgaagaggtccttcctatcccttgtaagttggattcctaggtattttattctctttgaagcaattgtgaatgggagttcactcatgatttggctctctgtttgtctgttgttggtgtataagaatgcttgtgatttttgcacattgattttgtatcctgagactttgctgaagttgcttatcagcttaaggagattttgggctgagacgatggggttttctagataaacagtcatgtcgtctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttatggaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtcgtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgtgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccaagagatccgctgttagtctgatgggctttcctttgagggtaacccgacctttctctctggctgcccttaacgttttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttgtttttattcttttttctctaaacttcccttctcgcttcatttcattcatttcatcttccattgctgataccctttcttccagttgattgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcccacagaggcaggcaggcctccttgagctgtggtgggctccacccagttcgagcttcccggctgctttgtttacctaagcaagcctgggcaatcaatggcgggcgcccctcccccagcctcgttgccgccttgcagtttgatctcagactgctgtgctagcaatcagcgagattccgtgggcgtaggaccctctgagccaggtgtgggatatagtctcgtggtgcgccgtttcttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgcacacacactggcctgcgcccactgtctggcactccctagtgagatgaacccggtacctcagatggaaatgcagaaatcacccgtcttctgcgtcgctcacgctgggagctgtagaccggagctgttcctattcggccatcttggctccacatccagttctaatagttttttggtggcatatttaagttttttcaaatacaagatcatatcattggcaaacaaggataattttactttttcttttccaatttggatgccttttcttcctttgtctgattgctctatctaggactttcagtactatgttgagcaacagtggtgacagtgggcatctttgtcgtgttccaaatcttaaaggaaaggctttcagttttttccccattcagcgtgatactagcggtggctctgtcatatatgacttttattattttaaggtacgtttcttctatatccagttttttgagggtttttctccttcattctgttgatatgacatatcacattgattttcgtatggtgaactgtcttgcatccctgggataaattccacttggtcatgatgaatgatctttttaatgtattgttgaattcggtttgctagtatttttttgaggatttttgtatatattcatcagggatattggcttatagttctcttgatatatctttgtccggttttggtatcagggtaatactggcctcatagaaggagtttggaagtattccctcctctatttttttgtaacagttggagtagaattgacattagttcttctttaaatgttcgatatgggcttggtgacttctgacagtgtaccaggcactgtgctacatgtcttgtttgtttttgagacagagtcttactctgtggcccaggctggagtgcagtggcatgatcttggctcactgcaacctccgcctcctgggttcaagcgattcttctcccaggtagctgggactataggcatgcgccactatgcccagctaatttttgtatttttagtagagatggggtttcaccatattggccaggttggtctcgagctcctgacttcgtgatctacctgcctcggcctcccaaagtgctgggattacaggtgtgagccaccatgcctgtcctgtgctacatgtcttatttgcttttatctcttttcatttttataaccaggcaaataagatattgatgtctacattttaaagataagttgcgtcttaacaagataaggaaaactgacaaagacaatccaacctggagatgatgaagcccaggttctagccccaatatgtctgactcctaagttcattccatgtaccatcctgagagatgtagtttaggaaagaaatttgcagtttaagcagaaatctcatcttccagcccttctacatgatctcatggtgctaccagtcctaggggcccactgtcccacaaaaatgcattgatcaccccaggcatttattcatgctgattcccctgtctagataggatgccccctcctacccctcaaacaccattatcagggctcagcaaactatggcatacagccaagtctgactcacaacttttcttttttacaactctagcaaagaacagtatttttacattttcaaatagttgaagaaatcaaaaaagaatagtgttttatgacacataaaaattatacaaaattgaaatttcaatgtccatatgcaaagccttcatgtgggatacatgctcatctgtttacatattgtctatgctgctttcacactacaaaggcagagttaaacagttgtaatggagaccagatggccctcaaagtctaaaatatgtactaacctcttatctatccagtgcttcttgatcatttaaggctcagcttcttattaagtctttcttggtcataccagcccatttgctcctcacttctccccactatgaatttttggtctgtttttcctgtctgggaaaagaaaaggttttgattcattatttcttaactttgaatgaatgattagttgttaaaagacatgttgtaaaagaagtatagtagatgcagaattattttgaaaagttatgtaaaacttagggaccaatataatttcttctagattaacttttcattcttcatcacgctatgcattgtatgccttgtcttgttaaagtgtcactgtcaaacaactgtttgttgaattaatggagggctatatgaaaagcaaactgcaagggttaagcaacttggtttcattatttcccaattcagaatccttcatctgagtcttaatacgatctaaatttgcagtctccaatctgtgtctggagactatgtcattaggcccctggtagcacagtagccactaattaaatcttaaacctcttctctcactgtcctcagctggataaaggccagtattgtcagtccgagggagttcttaccctctgtgggaaaattgttggccgtttctctcactgggcaaaattattggatgtgtcttctgtatagtaaaaattactggctgcatctcaatcggcgaggcttttctctccaggggcaaaactgttgcctgcatgtctctgaaggaaaattgccatctgcctcactctgtaggaaaattgccagttgtgtccccattatggagaaattgtcaaccatgtctccaaacggaagaacgtgccagccgtgcttccctgtagaagaaatgtcagcaaaagtgagcaatttaaagccctgcgcatgattccgagcccgttcctttttcatcgtgagcggaccctcatgtcccactggcttgtttcctgtacactcactctcatctgcccgcgtcatcacagccagggtgggggtgacattgaaatgagagacacttggaccaaggaggtgtatttcaagggatagttcagaaacaagctagtatgtgtctgtgtcgcagcccagacagaaaacccagaaatcagtaccacaactggttcttaagatctgcctcaaacggaaaaacactaggcttttggactcattgcacaccaagcttgccttaagcaatgcctacttctgcattactgctgccttccctattgttttgggtacagacgctttgctaagtgattcacaagcaagatctcgtctattctcacaaccgccctagaacataggtactactattatctccattaaatgaagcttggaaggagtcaagctgcttgttcaaagctccatcatttataagcagcaaagctggagtttcaacccaggccactgtgtttggaaccacctatactgttagtcaccacaccatctaagacagagtgaacaggccttcaggatcagctgttagtggtcttgggcccctcctaacccctctacatgggcatgagttcctgtgaaattaatgaaggtccagtgtaaggtcaagagaaaggagccacacccagcaacagcctgcacctgtggttacctaatctctctcttctcctatccccagagtccacaaccagctcactgcatgcctcctttctgcccttgctccagttgtaatgaatgctgtttcactttaggtttctctaaagttggcagtcttcttcttaattctttctcttatttttgaattcttgaataactgaattcaagattttccccagattctggaaccttatttatttacccagtcatctgagccctttcagggggctcccacaagatacttacagctccatggagatctattcatatctgtacatgttataacagaaaacacgtctacacaaggcacataagatagcctatggaattttaaaggcagtattcagttgttttgactatagcaatataacccaaagtgtattctgaggaagcctgtactagaaaaacactgagctgcaaatgatttgccaaataaaaataaaatggagtggggagaaaggtatgatcaaataatactctgaagtaggattaaagcagtgattctcaaccaggggcagtcatgccccctggggaacatttggcaatatctagagacattttggttgccacatgtgggcagatggagtcagcagggcagatctagtgagtagaggccagatatgttgctgaacattctataatgccccaacaatagggtaattgcgttgtcaactcccaaaattgtcgaggtttcccaagcttatttgactttggaatctggaatgcctgacatatcacaggttgaacattttgctgaagtcactttggaaaggctacctagagtagtggggattaggaaagggaaatggaaaagccagtggaatttcatagattttagaatccaacagctgggagggacctggtaggcaacacttactccttcatattacagagaaggaaacagggtcagagagttgacagttgctgaaagccacacagatgagagagagtaggacagaggttaagaacataagctggaagtatactgagttcaaattctgcctctgttcctactagctgtgagttgtacctgagttgactgattagactaatttgtggaaaagtactaaaacctatgaatagtgagtgagttaatacatgtagagcacacagcacaaaagctcagtagatgataggtattatcaaaagccagcctggacttgtgcccagcctggattccagcccagcatccctgagtctgatgttctttccagtgtacctggatgggcacaggaagaggtgaggagcaacagaggcaccaaagtgggactatacaaggtatatctagaatgtgaggaatcctggtttgacttgtttgaacagggaaacaatattgacaaagcaaggcaaggccctgttgtggaggtggtgtgacagatgggcagagtcaagagcccatctctaccactgcctagctgcatgatcctggtgacttactgaacctttcctcctggtctgtctccttatctacaaatgagaagagtgatagtaccttccttagaagtttgagcattaaaatgcaataatgtatttaaagcttgaggaccaagaagtggtagcaaatgtcattattgttgttactgttactattggggtctccaagacatacgctcctgttggtgaacctgacatacccccagtggctaggactgggctatcaggtttctcaccaagactgcttccttacaaagggagcaaagctcttcttgtctctcccttagttctcttcctctctcctctcaatgtctctattttctggtagctaattggaaaccttgcaggtcagcagattctctactgtcatgccaagccaagggtctccaggagaaaggctagtgttgatttgtcctaagttctatcactcaggcaccagatactgttgttcaacaaattttgcacatctctgatattgcagggggcatgagaagtaaattttatggaacacacactggtgttccatttaccttccactagccagttccatagcaccatgatttccgtctgataacacagtaaaatcacacttattcacaactgtaaccacatttgtgtgattgctaaacatttgtcccctcctctatcctgtgagctcactaggagtagtgctggatctgtcttgttcattattgtgtctttagcatttggtacagggcctggcacgtatcgaaatactttttacttgtggactctagctaatatactatattgtgcatgtgtgtgtgcctgtgcatacaagacacttaacttataaatgaatgctcagcaaggtcttctacatggcatcatgattaagaacaaagattttgaagtcagatagatgtgagttcaaaatgcagctctatctcagtgtgtccctggactggttataaaacctctctgtgccttagttatccacatatataaaatgaagaatcataattcctacttcataggctgttttaacaactaaatgaaataaaacatgtaaagcacagggcctgcagtattataagcttcccatcaaaagtaattattaatactattaaatgctattacccaaggaaggaaaataattcctggagctgctattaaaacttgaatatacatagatatgtcatgaactacaaagtgctgtgctggtatgttatctgtaccttgccctctgtgtgctacctaaagccggcactccacaaataaatggtggtaggttgattgaagaattgtcatctttcatttcacatccatcttgtgaaggtgtcattgtgaggctttacagtgttgctgcactggcttcccaatatgccaagtatttgggaaacagattcctatgtataacattgaaaggcaccataaacatatacaattttgttgtcaatttaaacattataaaatagatttgagtttaaagaagagaaaatgtaaacattctttatgtctttcaaatagtccgcaggttctgtactccttggtcccaaattctcaagagtcttgttgaatgagatatgactggccagcacagaagcagtgcatgctgaaaatgaaaatagtgatggcatatactgaggacctactgcgtaccaagcttatatgccaagcaatgtggctcctctttttgcagctgggaaaactaaagctggagtagtaaataaaatgatcatggctagtaactgacagaggcaggaattgatgactccagagcacaatttactaagcccatccactttactgcctctggatcaggtgttttacttggaatttccaaacctccaatactaatgacatagctgttagttgaaactaatgtgaaaattttcttcctatctagttctcaactatgaagataccaatcagaatccaggggccttcactaatactcagccgaagcccaaaagctgagggcagagactaagacattgggtcagaggctgtaataagccatgtttttctgtttcaatgatttttttaaaatttttgcaatttcaattctgattgatcagggcttttgttgctattctcttcaatggttctgtgaaaattaacgttttggcttagttcacggtttaattcagcaacttaattatatacttgggttctttatatagaattcattactgactatgcgagtgcattgagcaggcaggaaagaagtagtcttggaggataagttaactcagcaacctgcaggccagtgtttggttcagcctaaaattgtgatataaacccttattcggtttagccatacacaattgccatctttgtaggtcaaaaataattgaatgtcagcaaatgcatatgtttcagctgaatactatacatgctaagcacccagaaggcaaagaatctgttaatttatctggctttggctccagtgaagcaacaaatattcattgaacatttgtgagtaagactctgaatacgaaaataagaccaaaatcctgttctcaggaagcttatgtcctagttgaagagataaaacaaactcatcagttgttaaaataataataataatgtgaaaaatgatagttccattgtaagagagtacctgagcaaatactaaataaatgaccagaccaagcatgatagggcttcagagaaaagaaaagatcatttggggtgaaataatatgtagtagatgaggtatatgcatcaaagagtatttggatcagtgaagaaagaatcaggcaatgaatagaagtgggaaatatcgagatatactctatacatccaacttaaaatcaaggtagaaagaattagaggcagtttgtgatgggctccaataacatactgagaagccatgcctttttcctgtaagtggaaatcagctgaagctattgagagagataataagaacctggatatcagtgcaaatagacaatccacacaaaagacattgtgggttcaatgtacactatttggctaatggttacactagaagtccagacctcaccactatgcaatatatctatgtaacaaaaccacacttgtacccattaagtttatacaaatttagaaattttgttaattttaaaaagacatcatagttacagtttacatataaggaaacctaaggcacagagaagtatcttgcctaaggtcacacaacaagtaaatgacaggcttagacccaaggcagtccagtaagaaagcaccactttttttatttcttccttttctgaagacaggatctcgatctgttgcccaggctggggtgcagtggcccaatagtagctcatccacccaagtagctgggaccacaggcatgccccaccatgcctggctaactttttatagcaatagaatcttcctatgttatccaggctggtcttgaaatcttgggtttaagtgatcttcccgcctaggcctcccaaagtgctgaatacaggcatgagccaccacacctggccaaagtttcactattaaacaccgtgagccaacaagagaaatgaaaacatatgaccagacaaaaacttatacatgtataatcatagcagtgttattcctagcagctaaaaagtggaaacaactcaaatgctcataaaatggataaacaaaatgtggtatattcatacaatggaatactattcagccataggaagaatgaagacctgatacatgctacgacatggatgaaccttgaaaattttatgccaagtaaaaggagccagtcccaaatgaccatatattctatgattctatttatgtgaaatttccagaatgagaatcagaaagtagatggtgtttacctagtactataggagcagggaatggaaagtaactgccaatggatatggagtttttggggggaggtaaagaacatattctaaatttagattatagcaatgattttgtgattatactaaaaactactgaactctacattttgtggtatgtgaattgtatctcactaaagctgtaaaacaaatttttttaactatcttaacatgactccagattttgtgcagtgacacccagataccaagggaaacagaaacagagttagatacatagatctgtcagtgccagatctatgatgggacgggtcccatgccagtccttccatgagaattaaaatccagaaactaatgacagctttttccgctaccagagagatgacagttctctattagcaacttacattctgcagacaccagccctacttaagactctcagttacactgtcagcttcctagccagtccaaacatgttagagtcagttgataaggattgctaaatttgtcttgttttgcttttgttctgcagtttttgaagagccggaagatccaagcaacagatcatttttctctgaaattatctcttcgatttcggatgtgaagttcagccacagtgggaggtatatcatgaccagggactacttgaccgtcaaagtctgggatctcaacatggaaaaccgccccatcgagacttaccaggtatagaaccccaggcacccataggtatattgaacattcccttcatgagcttttaagtcagcccctgcttccaaaggtttacagtgcagcaaaatggaaggcaatgcatggtgatacattcagtaaaatggtacaggctataagtgccacaggatttaagataacggtacatgtggagaggctagaattcaatttaattgatatggacagagcacttcatgtggaatggatactatagaggtaaacaaatggtcctgctctcatgcagcttaccatctggtggaaaagtcagatgatgaacaaggaattgagtgtgcatctctgcaagagatggtccagccaggtgagaaaggttttcccaaagaagtgacccttaaactgagtcttaactgccatgaactagtcaggaaatgcatgctcttaaaatagtgtgttcacatggacgcaggaaggggaacatcatacactggggcctgtcagagggtggggggctcagggaggactagcattaggagaaatacctaatgtagatgacaggttgatgggtgcagcaaaccaccatggcacatgtatacatatgtaacaaacctgcatgttctgcacatgtatctcagaacttacagtgtaataattaaaaacacagtgtgttcaaaggcctggtgtcaagagaaatgaggtgtgttcagggtgcttacaccttgaatatgaatcacaaaggcagaaggatgagcctggagatagaggcaaggggctgatcactaggccctggtaatatacagtaggctgttttgcctgtggactgggtacaatggaggaccattaaagttttacaccaggaaataacattgtgagttttactttttactgtgtgtttcactttgcagtttgccaaacagacaatttagataagaggagatgatggcaatttggtctggtgatggtagcgtgcagatggaaggatgggtaggatgaagagtcagtgaggtttgcttactgatcaaatgtgcagggagagggaatcaagaagactgtgtggaagttttggatttaagtgttgggtggatggtgtaaatgcaaggaaacaaaggaaaaggcattgtatagggtggttttgttgaaagaggaagaccagactttgaagtagagaggacttaaagaagcaaaatccaggtccaagcaagagtataatgaaagcaaagatcaagtgctggagataaactaaccctattttaagctatttggggttagataaaaagaagtgggggattctagacagaaggatttgacttacattttttccttgagatataatgtacataataatcagcctttcaaagtgcacaattcaatgatcttagtttactcacaaaccaccattatctaattccagatcattttcatcattgacatttttaaatgaacattctggttgtgctggggaggagaaactgtgggagggacattggaagagacaggagaatagttataacattctggcaagcggcaatagtagcttagatgagtgtattagcaatgaaggtagccagattcttgatatatctccaaggtaaaagcaataaggcttgaggacaaatttgatgcgggatataacaggaaaagaaagaagcaccaaggattactccaaaatttttgtcctgagcaattagaaaagtagagttgccaagttatttagatgagaaaatcgaaagtttggttttggctctgttaagccaattaaacatccaaacagacacagcaggtagacacttcaatgtgagtctggatatatttagcttcaagatataaatctgacactcacaagtatgtagagggtatttaaagccataggactggatgagatcttctagacaattagtataattaaagaagaggtcagaaaatatgacctagttgagaataggaagaggatttggcaagagagatttggggaaactagccagtgagatgagaggagtgactaggaagccaaatagagaaactgtcttaaggaaaaataagtcatcaactgccaaatgctttgctgaatcaagtacagaagactacgaacttggatttagtaagtggagattatcagtaacctgaatgacagaggaacagcagtagagcagtgtgaataaatgtccaattggagtgagttcaagaaactgaagatgggaacattatgaggacagacaactgtttcaacaagtttactctgaaggagaacagagaaatggaagggtagctgaaatgggattctggctgaaggaagttattacagcatgttttctgctgataggaataagccactagagagagagaccattagagagagaccgctgaaggagcaaagcccttgggggaagccagaggggatggagtccattgcagaattggctgtagatggtaagatgcaaagataattcatctatcaaaggaaggagagtagttttcttatatagatgaagtaggtttgtgaattttgtgatgggaacatgtaggtgttttctttagtaaaataagtagtaaggtcattagctgaatgggaaggaagaaaagtggtaaagtactcatctaagagaaatgttgtagggtggtagggttgctcagggatccacttgaaatctatataattgctttaaagggaaattaacctgtatgattttatgtttcttcccagccacattcacctgcttggtacaggtaaacaaagggtagaaagtaagatttaaccagtgatggagttttgccaaatgagtacaatggaaagagagagcaagaaaggcaagcttgttgaatatatatgctaaaggagtgattgattgtaacgatgtactgctgaatcgaaggtagggaaaaggggaaataatgaattttaagaattgatagaatcaacatactagaaggagtgaactaaaaagacaggaggtaacaacagcaacagggatagcaatgacaggtacagggatagcaatgacaaggttcataatatgaccaaggaagcaaaggacaaaacacattgaatagatgagaccatgtaagagagagactagagtgcctgaataactaaaaatagtggcaggaatagtaatggaagagagacagagatacaaacttgcttcaagggatgaggattagggactcagaacttttgatggctgaaagaaggacaggtagcaggaagcttagtttgatggcatgacttcaaaggagttgaagactttaaataggaatagttgtctggagcaacaaggagcccagctacccaacactggcatgtggagtgacagcaaaattctagctaccacttgagtgtcttcagaggagatccaaattccagtcagaggaagaagaaggaaaggttcagagaggaggttgaagactttgatgactctgtgttccagcagggctggagaaaggtttgggagccagaattcacagccatatatgtagtggagatagctttgtttcccctgtggtccatcgtactccctgttatttagtgttcctgtctcctgaatcctacctcgacttcagggcttggctccacatcacttgcccccaagctttcatttgcagcccttcatctttagcccaggactagagtcacctcagtgtcctcttccagctgcataagacaaaccttacaggattcgaatccttaatgcaaaagaaagggcagtgggaactaggacccgtgtgtggctgctggggagccttaactaggaagagtagatttaggacaaagctagttttagaacacagccagctagcttttacgtgaagtaatttaaagatgatggtaaacaaactctgattcagtgagcctccagaacaccatgatagattgtgaggtccagtgggaaagaaattagttaataggttgtgaggtccagtgggaaagaaattagttaatgaaagatcagttaataatgcctgcccctgggcaaggagacaggtaatgctactattatacattttcatacatgcattcacagatctcaatcacatttccgtgaataaaaggctgcagacttaagtatgattagctattttcaagtttttccatagaacaagggttggcagactgcaacgtgtgttccaaaccagccccctatttgtctttgtaggtaaattttattaagacacagccatgtacagtcatttacatatcttctatggctgcttccatgcacaatggcagagttgagtagctgtcacagagaccatatggcccacagagcttaaaatatttactatccggccctttggagaaaaagtttgtcaacacttgaaatataagaacggaccaatagagttggctctttgtttgcctcatagcagtccactaactatatgacactggactcccacaaataaatatgagaaacactgtactgggacactcagtctggcgtccaaaatcccatgcacaaattaataggatcatagaaaagtcatactaggaacatgaagaaagaacatcaaataggatgagttttaagttctctcttgctccaagctctagaggttgctcatgtatacatctcactttattctttcctctagtagaaaaaggtccctctggtttgcctaagaagactttttttctgtgcaacaaaacataaatacagcataccttcatagtagacattctttttctttaaatgctgtcaattggaggcagataggagctacccagaccttaggtatggtggagaaataatggttcagactaggttttcccttgaatctatcccaacttctatctttcaagaattatttacagagttctcagcaatgtcattcctgctaatgggcgtgacttccaaagcacacatgttttgacacttatagaaacactgcaggtgagtaataagacaaaatgccgaaggtgaatggtgacagatgaggaaaggttcatcacaaagcggacatatggaactagaccttaaaaaccttgccactgcccagtttatatacctttactgctgtgccccctagcgaaggtgaatgagttagtttatagcagagatgcctctgtaagggcaggacacagcctcacccttgcagcccccaaatgcacctaacaatgccaagagcactgctgtaggggtattcccttgtcaccaaagcactgaagctgttaccctgacaaggcctggaactgtttggaagtgagagagtaaaggtgggggaaaattaatttgcagagttagaaataacttcctctgtccaaataactcagagcttttcaaatacccagaacatctaatggaacataggatgagcctgacctcgttcctttgcccaagactaagagcctgaagctctgcatccagcagaactgttggagtcgaaggaagagaaagagccgcagttgcaggaaaaaagagatcgaatcatcactcttaacttaaacaccaatgcccttggtagcctccctctgctttcacacagttctatctccttctctctcagcctcacttgagttcattatcacagctcctgtcaaggactgaggacccaccagagcaagctggaggcaggttgctagtgcagctcagagtgtgcactccagagcctgataccggggctcagttccctccccttctgtcactttttctgtgtgatcttggacaaatgatgtcttatctctgtgcttcatgctccattaaagtaaagagaatgaaagtacctacatcataagatggctttagagatgaaatgaggttttgacagataaagcacctggctaataatgacaagccagcatattgggtatgcccgttattattgccactccgtgctagtgggttcaggaaggattaccttcaaaacagagaacccaggctactactctctgaaccttattcatctatttggcatctacagctgagttgctgaatgtagctggagaaaaatattcaactatgcttgatgagccttatttgacatacatgtccaacaacgtcaagtgtcccctggtgccttccagaaatctgacactgtttctcaaccctttctctctcctgctcactcttagttgataaccatgctggctgctttcactggaaaagagaaaccaggaaagaatcgccacatactccaggacagcacctttcacctcagagtctactcgacagctccacatgtagacatctctaaaccattgtacccaaaagtgaacatggtacctactccttccacttgctcaggagaaagatcagggagtcatctttgactcctgtttttctctccacacctcagagttgacccaagtcctatctgctctttccctaaacaaaaggagaatctgaccagtccccatcactgctcatgccctggtccaggccagaatctatcactcaggttataactggtctccctccctttgcctttgcacccttaggatccattgcaacacagcagattcagcaatcctttctgtgaggtctcttcttcctcagaataaagggcctatgtaaactgatcatcctctcccccagctgcttactcactcctctcccaccacactccctccaggattcctgcctctaggcctttatgtttgctgtttcctatgcttggagagccttcccctcaccccaaacccagacatcactgtggctcattcatctcctgcaggcttctgctccagtgctacctcatccagtgaagccctgactacttgccctgtataaaataatacacccccgacaagatctcccaggctctttttccatacacttttgttctatgattttatcaccatctaaacatcttatttatttacttggttatataatctgtcacctgacactgggtcaaaagcactgcaaggatatttggctcactgctgcatctcaagtgcgtagtaggtattcagtaaatatttgttgaataaaagactgcatgaatggtgatctctaatgcctgtgagcaaatcagcttagaaaatgagaatctaccacttatttagtcttactggatgccactgtctatacaagcaagcttgattaatccatatcatctacatgagaagctcatcaacccatcctaatgtcctacagctaaaagggccaagcctaggttcagatccaaggccatctgattcaaagagcatgtacaatgaaagatttaacagctcacatcagaagaggaggtgtttgcagaaataattactgtttaaaataataactgaccttctcgatatgtttcctctccaggttcatgactacctccgcagcaagctgtgttccctctatgaaaatgactgcatttttgataaatttgagtgtgtgtggaatgggtcagacaggtaagaaaggctctgtggctgaagaaccttccaaagattgtcttgaagaggctcagggaatttatcctaagtagagtacagccaaagggaggtcaaaattgggccccaaaacctggctgaaatgcataatgtgggcccctagtgacccttgaagtcaaggctggaaagaagagaaggatgtagtaaggcctttgaatcctgtttctgaactggcacagataacaccttaatgttaataagaaagtcctatctttttcacacaagacacctccagcactaggtcaacatgcctaaatgaagatcacttatccaccagcaaattccagcctgaacagttcagattaatgccaagtaggctttccagatcaaaaattatcccttgaagctgctagtggagacctggccaacggccctggtagttcattaactgaattctagtcaacctcatttatcacattccctcaaagtgatttattactattttaaggcctttgatttgaacagtgcttcataatacctcccaatagttcatttttagtttgacaaatacaaatgattctctgatttccatgagaactaagtgcaagctaccaggggctgatttcgttccttgatgaaggtggcaccaataatagtgtttgaaagcatagaaattctgttatggcaagacattcagagattcaagctttcagtgaatatgaactgtctctctctcacactccacctgtttcttggctttctttgccactgatccaaaatgaatcccctccttagcaggcttggaaggagtctccacgtggcaaaggacccaagtcacactgaccagttggtataggacagagagcaaagcaactgtgacataagaacaaaatccaccatgggaaaaagaagccagccctctcattttattatttatttataggtatttatttattcatatattattatttacatatctgttattattgctcaagtttttcctctatcttagccttgattcaaaaattacacttattaggcacctactatataccaaacacattcgtacacatcattttatttaatcccaaccacagtctaacaagattgcttccatcgttctcattttacagttaaggaaactgaggcttagcaagataaagtaatctgcccaacctcataaagtagtaagtagtagagacaaaagtaacaagtttagagtttgaatcctaagatcaatactctttctataacatcacaactgggaagtttaatttctctttcagataaggttggtagtctttttttttttttttttggaaaataatctcttacttgtttaaaaataagtcgggtcatggtgggcaagcaaacgtcaaagtatgggaagcagtgaggccaaccggctgaatacttatgccccagagtcaaccatatgtgggtttgagggtggactttaccaccaattagcaatgtgacactgagcaaattacttctctgtaaaacccttttaggggataatagaagttgaaacgagatcatggaggcaaagccctcagcgccctgcctgacaaggtgataacagtccactcgagtacacagacacagttcacagtatcagtttgatgagccagagtaacaaaatctaacctttgcttaatttacctggtacaggtgacaacgtgcccaaaaacacatcccccttgctgtggcccaatcttgtcagctttttccttcacctctctacacatcccaaatcatttgagaaatacacgagagttcctgctctcccatcttaaggagccagtcagagctccacccagaaatgagtaggagccccccactccaggggaaccaccgtgtgatggcacttggggtacttgccctggcccaaggaatctctccctccccacctcagcttgtcaccgtgtctgaaatgtcaccattaaacattcagtaccttgcctctggaagacattgggtgtttgccactctcctgatcgattgcagctatgcctaagaggggataacttataaaaatgtggaaaccatctgtccattaagtgtgggaaaaaaaccatataaaatctttttatttctccatcccagattcttttaaaatttgaatttccttacttgtttcctagataagaccatgatgacatccatttcgtagataagttttctaaaaaggccgaattcagagctagttctcggcaggggagaggtcgcgccccgggttcgtgcacgatgccactagcatctctcccctcactgcactgatgccatgaagccttagaggccagacggcccaggaaccctgttgacagtggccaaaccttaaacacgtacaactgcttattgttttcaaaagtgtgtctacttcgacaaacctcattctagtctcacattcctgatgggaggtaggtaggactgggatcattaaaaccagtggacaccttttctgagccaaagaagcaaaaagaatctattgagcaaaagcaaattacaaggagagttctcaccatccctcatttccaaacccagccaaaaatcctattgctttcagtgattcaaaaaaaaaaaaaaaaaacacaaaaaaaaaacaaaaagccaataatcacactgcagagcctgttctcattttttggtttttgtttttaataaaacctatggtgtcataagctggccataacatggtatcatttgctccaaaaagaaaagacagtgaagatatgtcattgcctttgctctctgccttgcagtgtcatcatgacaggctcctacaacaacttcttcaggatgttcgacagaaacaccaagcgtgatgtgacccttgaggcttcgagggaaaacagcaagccccgggctatcctcaaaccccgaaaagtgtgtgtggggggcaagcggagaaaagacgagatcagtgtcgacagtctggactttagcaaaaagatcttgcatacagcttggcatccttcagaaaatattatagcagtggcggctacaaataacctatatatattccaggacaaggttaactaggtggacaagttattacttaataatctcacatactgaatactagtcaaacaagtttttaaatgtttctttgggtcttcatttgatgcattgactttaatttccctatacaggaaatgattggaatagaattaaaaggagtccaacattcccagctccccagttctaagaaacttttgtcaaacccaataggtttgggacacttctgtttagaattgaaagctgccagctaacagtaattcttccatagttgacttgaacttctgatgcttttattgcccagttttctctggtgggtccagtgttttgttcctaggtgtctgctgcgataaaatgaggttgtctgtagtatttaaggagaaaagagataagttttttttaattaagcaattccatttgattgaaaaaaatcaacaaaaaataaacaccgtttactcttagacaaattcttcttgttttgtgaaaaaccagaactagtcagtatctcctgcccctccaccatttttttttccattttccattttcctttgaacaatttcatttaagccagagatttattgcatgaagctgagaagaggatgcagaatgacaaggaaagggcacatcaaccctgctatgctctttttttgtaagctccatagaaacagcctgagaatttggctagggaacttgaatgcttcaggggacagaaagagagcactttcgacacagtgcttcccagagtgagcttggcagggccaggcggggccaaattccatctgctgccttgttactcttgctttttgtgctcttaaatggctccatataatcttctacttacatgttccttggcttttttctcttcaaccttttccagcttatttattccattgacttctaaaggccgagtcctgggtgcttattatctggtgttctaaatgaagcagtaagttggaagcagtgccaccacccctgagtccctgagaaaggctggtctgttctttttgggtgtttctcctaagcagcaccctcccctcctcctggttttggtaaccaaaagtaacaatccatcaacctccattgtacctagaacaaaaatagccaataaaaacgctgagttgtgaagtccaatcaggcacttctaactcaccccaagctcgccatctggaaaaacagaccagaaggctctcttctacagaaatgaactgtggggaaatcaagcagctgtgacatgaagtgaatgaagtccacttgaagctgtggaagatggttcatccttttccccagttgaggatccagatttataacttctagaaagccatttccagaaggttctatgtggcacacccctaggaaaggcactaaatgcatgcaaaggatttataaacttaggaaagtagatgggtggagtccagaaaactggttctgggttaatatctctacatctgtcttgatgactcatttctcctaactcccatttagtgcagggtaaatggtttgagatgagagtttttcaatgaaagggaaattttctttcagtttacagatgtattagaagtcctgactttcaagtgtaatttgctttggaggaggaaaaaatagtgaaagaatcattttatctcaattctaagctactatccatttactaatagctttttggcaaggaaataactgtcaccttaggtaaaaacagtcttgttagatgcagcccaatttcaggaacattaaaatgtaaaaaagtacgtctcagaattgagggagcatgggaacaaagacgagactttctcagtatttctcatttttcctgcaaggaaagcctcgccttaggcatctcaagtaaagtggctaaggtgtaaactctctgggcaagatttctgtcctgactgggacagtgttcttggaggagacatgagagagtcagaaacttctgccagtcatagagagtgatgattttgcagaaggccactgggttattggcctacatttaccaccgacttcctttatggccttttctccacttctccggactcagctcctctgtctgtaccacgtcgggggttgggaccaatcattgtatctcaaacttaagaatcaactcacatttgtactattactcatgtaacatttttttaagtcaccttttcttaaaagcaagacttagcctcctccaaagaaataatatgcatgaaatttcaactctgatatgctaggtttttccctaacattaatcacataattatcaatgtaacaaacatgcacccacataccacctgaaatcattttgtgaaccaccaggagcatgtgtatcaaactttgggaccctgagtaactgatatgacagaagatttatgcccttaggggcatcaaagatggtggttcttcacatattagagtcagcagggctgcccataacacacacaggaataatttttgtcatggtttaaggagttcataggcccctttgcagtttatctgcgaactccaaataaaagcccctacactagtccaacacccttagcatatagatgtacaaactgggatccagagtaggatgagtttgccagagaagaaagagcagagggcagccatcctctcctccatcccctgcaaaggatgcattagagcaaacacccaagactcctggacgggaacaggaggggaaagccctagagattaggcctcagggagcaataaccaccacgatgtttcacaaattaactgttctttaccaggtactgaactaggtattttacatgtgtgatctttcagccccagtactggcaatatttcttagttagtggcacatagaagtcagtctgttttcctgctgacactaaaaactacttgaaggctgatttgctaccttgcaacagttggttcgattctaagggccctatactactttaccccacaaggcctgctgcttggtaagagccatcagattacaactggagggtgtcagttgaatgaaggaaaatggaagccacgccatccctggcttttacaaaaaccatccttgcgcaacattcagttcctgacgttaaaaacaagtaatgcaaaaagctgaactttggtagacattcgtactcttctgtcaggaggaggaagattagttagaaaaaacaaaaaaggaagatactagccagcatcaagaagtgggatatataaaggcagatgggcagtgggaatcaagttgcttcttaactccttcaagtttggctcctgcctttactcttccattgaaaaaaaagcacctttaaacctctcattgatcttgtaattaattcaaccaaatcaacttctattaggcaaccagcatatataagatggaacaattgcaaggtggaataaagatgaagctaaaattctgctagctcagtggcccaatgaaataagtcagctatctccactaaacttcctttgaatattctagggtccattataataaaaggtacacactcaaatgcccaatttctaaggacttgaaaagccataatttccctcccttcaagcctacagagcaactgcctaaagcttccctccccagacaaccccaggcctcatttctttttcagtccctttgctagctgcctgcagggctcaagaaa

SEQ ID NO: 15975 - DNA, 15914 bp, Human; identical to SEQ ID NO: 12001
